(12) United States Patent
Feldstein et al.

(10) Patent No.: US 10,738,302 B2
(45) Date of Patent: Aug. 11, 2020

(54) COMPOSITIONS AND METHODS FOR IDENTIFYING POLYNUCLEOTIDES OF INTEREST

(71) Applicant: The Regents of the University of California, Oakland, CA (US)

(72) Inventors: Paul A. Feldstein, San Francisco, CA (US); James E. Lincoln, Woodland, CA (US)

(73) Assignee: THE REGENTS OF THE UNIVERSITY OF CALIFORNIA, Oakland, CA (US)

( * ) Notice: Subject to any disclaimer, the term of this patent is extended or adjusted under 35 U.S.C. 154(b) by 0 days.

(21) Appl. No.: 15/737,297

(22) PCT Filed: Jun. 24, 2016

(86) PCT No.: PCT/US2016/039348
§ 371 (c)(1),
(2) Date: Dec. 17, 2017

(87) PCT Pub. No.: WO2016/210321
PCT Pub. Date: Dec. 29, 2016

(65) Prior Publication Data
US 2018/0155712 A1 Jun. 7, 2018

Related U.S. Application Data

(60) Provisional application No. 62/184,868, filed on Jun. 26, 2015.

(51) Int. Cl.
| C12N 15/10 | (2006.01) |
| C12Q 1/6869 | (2018.01) |
| C12Q 1/6874 | (2018.01) |
| C12N 5/00 | (2006.01) |

(52) U.S. Cl.
CPC ..... *C12N 15/1093* (2013.01); *C12N 15/1051* (2013.01); *C12N 15/1096* (2013.01); *C12Q 1/6869* (2013.01); *C12Q 1/6874* (2013.01)

(58) Field of Classification Search
None
See application file for complete search history.

(56) References Cited

U.S. PATENT DOCUMENTS

| 8,158,595 B2 | 4/2012 | Galloway |
| 2004/0259079 A1 | 12/2004 | Barber |
| 2006/0029958 A1 | 2/2006 | Sakanyan |
| 2006/0074041 A1 | 4/2006 | Johnston |
| 2008/0207539 A1 | 8/2008 | Arbuthnot |
| 2014/0206546 A1 | 7/2014 | Chenchik |
| 2018/0155713 A1* | 6/2018 | Feldstein .............. C12N 15/111 |

FOREIGN PATENT DOCUMENTS

| WO | 2005021751 A | 3/2005 |
| WO | 2008058291 A2 | 5/2008 |
| WO | 2014022702 A2 | 2/2014 |
| WO | 2016210321 A2 | 12/2016 |

OTHER PUBLICATIONS

ISA/US, United States Patent and Trademark Office (USPTO), International Search Report and Written Opinion dated Jan. 10, 2017, related PCT international application No. PCT/US2016/039348, pp. 1-14, claims searched, pp. 15-29/.
European Patent Office (EPO), extended European search report dated Dec. 12, 2018, related European patent application No. 16815419.3, pp. 1-9, claims searched, pp. 10-12.
Liang, Joe C., "A high-throughput, quantitative cell-based screen for efficient tailoring of RNA device activity", Nucleic Acids Research, 2012, vol. 40, No. 20, published online Jul. 18, 2012, pp. 1-14, supplementary data, 19 pages (33 pages total).
Shen, Shensi et al., "Dynamic signal processing by ribozyme-mediated RNA circuits to control gene expression", Nucleic Acids Research, 2015, vol. 43, No. 10, pubished online Apr. 27, 2015, pp. 5158-5170, Supplementary Information, 61 pages (74 pages total).

* cited by examiner

*Primary Examiner* — Sean McGarry
(74) *Attorney, Agent, or Firm* — O'Banion & Ritchey LLP; John P. O'Banion

(57) ABSTRACT

Provided are constructs and methods useful for the screening and identification of polynucleotide sequences of interest, in particular promoters, RNA stability modifying sequences and transcriptional modifying sequences.

11 Claims, 36 Drawing Sheets

Specification includes a Sequence Listing.

```
    10         20         30         40         50         60         70         80         90        100
     *          *          *          *          *          *          *          *          *          *
1 AGATCTGACCGTCCTGTCCGTATGACAGAGAAGTCAACCAGAGAAACACGTTGTGTATATTACCTGGTGGCGCGCCGAATTCTGGGTG 100
  >>>>>               >>>>>>>>>>>>>>>>>>>>>>>>>>>>>>>>>>>>>>>>>>>>>>>>>>>>>>>>>>>>>>>>>>>>
   P5                  E48                                                Reverse transcriptase primer 1
          >>>>>>>>                                                        >>>>>>>>>>>>>>>>>>>>>>
           D8                                                              Multiple cloning site (MCS)

110        120        130        140        150        160        170        180        190       200
     *          *          *          *          *          *          *          *          *          *
101 CCAAGGGTTCAGAGAGTTCTACAGAGTTCGAGAGTTCCTGCGGGCCGCGTCGACGATCGGGCCGCGTCCTGCAGGTGACCGTCCTGTCTCTAGAGCGCGTTGCTGGCGTT 200
                                                                                                   <<<<<<<<<<<<<<
                                                                                                    rep (pMB1)
                                                           >>>>>>>>
                                                            second D8
                                              >>>>>>>>>>>>>>>>>>>>>>
                                                 >>>>>
                                                  second P5
     >>>>>
      Reverse transcriptase primer 1
                          Multiple cloning site (MCS)

210        220        230        240        250        260        270        280        290       300
     *          *          *          *          *          *          *          *          *          *
201 TTTCCATAGGCTCCGCCCCCCTGACGAGCATCACAAAAATCGACGCTCAAGTCAGAGAGTGGCGAAACCCGACAGGACTATAAAGATACCAGGCGTTTCCC 300
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     rep (pMB1)
                                      <<<<<<<<<<<<<<<<<<<<
                                       seq2
```

*Fig. 2A*

```
       310        320        330        340        350        360        370        380        390        400
301 CCTGGAAGCTCCCTGCGTCGCGCTCTCCGTGTTCCGAACCCTGTCCGCGCTTACCGGATACCTGTCCGCCGCTTTCTCCCTTCGGGAAGCGTGGCGCTTTCTCATAGCT 400
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

410        420        430        440        450        460        470        480        490        500
401 CACGCTGTAGGTATCTCAGTTCGGTGTAGGTCGTTCGCTCCAAGCTGGGCTGTGTGCACGAACCCCCGTTCAGCCCGACCGCTGCGCCTTATCCGGTAA 500
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

510        520        530        540        550        560        570        580        590        600
501 CTATCGTCTTGAGTCCAACCCGGTAAGACACGACTTATCGCCACTGGCAGCAGCCACTGGTAACAGGATTAGCAGAGCGAGGTATGTAGGCGGTGCTACA 600
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

610        620        630        640        650        660        670        680        690        700
601 GAGTTCTTGAAGTGGTGGCCTAACTACGGCTACACTAGAAGAACAGTATTTGGTATCTGCGCTCTGCTGAAGCCAGTTACCTTCGGAAAAAGAGTTGGTA 700
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

710        720        730        740        750        760        770        780        790        800
701 GCTCTTGATCCGGCAAACAAACCACCGCTGGTAGCGGTGGTTTTTTTGTTTGCAAGCAGCAGATTACGCGCAGAAAAAAAGGATCTCAAGAAGATCCTTT 800
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)
```

Fig. 2B

```
            810        820        830        840        850        860        870        880        890        900
             *          *          *          *          *          *          *          *          *          *
801 GATCTTTTCTACGGGGTCTGACGCTCAGTGGAACGAAAACTCACGTTAAGGGATTTTGGTCATGAGATTATCAAAAAGGATCTTCACCTAGATCCTTTTA 900
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<

910        920        930        940        950        960        970        980        990       1000
             *          *          *          *          *          *          *          *          *          *
901 AATTAAAAATGAAGTTTTAAATCAATCTAAAGTATATATGAGTAAACTGGTCTGACAGTTACCAATGCTTAATCAGTGAGGCACCTATCTCAGCGATCT 1000
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
                                                                                           ampR 1010       1020       1030       1040       1050       1060       1070       1080       1090       1100
             *          *          *          *          *          *          *          *          *          *
1001 GTCTATTTCGTTCATCCATAGTTGCCTGACTCCCCGTCGTGTAGATAAACTACGATACGGGAGGGCTTACCATCTGGCCCCAGTGCTGCAATGATACCGCG 1100
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1110       1120       1130       1140       1150       1160       1170       1180       1190       1200
             *          *          *          *          *          *          *          *          *          *
1101 AGACCCACGCTCACCGGCTCCAGATTTATCAGCAATAAACCAGCCAGCCGGAAGGGCCGAGAAGTGGTCCTGCAACTTTATCCGCCTCCATCCAG 1200
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1210       1220       1230       1240       1250       1260       1270       1280       1290       1300
             *          *          *          *          *          *          *          *          *          *
1201 TCTTATTAATTGTTGCCGGGAAGCTAGAGTAAGTAGTTCGCCAGTTAATAGTTTGCGCAACGTTGTTGCCATTGCTACAGGCATCGTGGTGTCACGCTCGT 1300
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR
```

Fig. 2C

```
      1310      1320      1330      1340      1350      1360      1370      1380      1390      1400
        *         *         *         *         *         *         *         *         *         *
1301 CGTTTGGTATGGCTTCTTCAGTCTCCGGTTCCCAACGATCAAGGCGAGTTACATGATCCCCCATGTTGTGCAAAAAAGCGGGTTAGCTCCTTCGGTCCTCC 1400
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1410      1420      1430      1440      1450      1460      1470      1480      1490      1500
        *         *         *         *         *         *         *         *         *         *
1401 GATCGTTGTCAGAAGTAAGTTGGCCGCAGTGTTATCACTCATGGTTATGGCAGCACTGCATAATTCTCTTACTGTCATGCCATCCGTAAGATGCTTTTCT 1500
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1510      1520      1530      1540      1550      1560      1570      1580      1590      1600
        *         *         *         *         *         *         *         *         *         *
1501 GTGACTGGTGAGTACTCAACCAAGTCATTCTGAGAATAGTGTATGCGGCGACCGAGTTGCTCTTGCCCGGCGTCAATACGGGATAATACCGCGCCACATA 1600
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1610      1620      1630      1640      1650      1660      1670      1680      1690      1700
        *         *         *         *         *         *         *         *         *         *
1601 GCAGAACTTTAAAAGTGCTCATCATTGGAAAACGTTCTTCGGGGCGAAAACTCTCAAGGATCTTACCGCTGTTGAGATCCAGTTCGATGTAACCCACTCG 1700
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR
```

*Fig. 2D*

```
         1710      1720      1730      1740      1750      1760      1770      1780      1790      1800
           *         *         *         *         *         *         *         *         *         *
1701 TGCACCCAACTGATCTTTCAGCATCTTTTACTTTTCACCAGCCGTTTCTGGGTGAGCAAATGCCGCAAAAAAGAGGAATAAGGGCGACA 1800
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1810      1820      1830      1840      1850      1860      1870      1880      1890      1900
           *         *         *         *         *         *         *         *         *         *
1801 CGGAAATGTTGAATACTCATACTCTTCCTTTTTCAATATTATTGAAGCATTTATCAGGGTTATTGTCTCATGAGCGGATACATATTTGAATGTATTTAGA 1900
     <<<<<<<<<<<<<<<<<<<<<<<<<<<<<<<<<<<<<<<<<<<<<<<<<<<<<<>>>>>>>>>>>>>>>>>>>>>>>>>>>>>>>>>>>>>>>>>>>>>>>
     ampR                                                    seq1
                                                                                      <<<<<<<<<<<<<<<<
                                                                                      ampr promoter 1910      1920
           *         *
1901 AAAATAAACAAATAGGGGTTCCGCG 1925
     <<<<<<<<<<<<<<<<<<<<<<<<<
1901 AAAATAAACAAATAGGGGTTCCGCG 1925
     <<<<<<<<<<<<<<<<<<<<<<<<<
     ampr promoter
```

*Fig. 2E*

```
         10        20        30        40        50        60        70        80        90       100
          *         *         *         *         *         *         *         *         *         *
  1 AGATCTGACAGTACTGTCCGTATGACAGCGAAGTCAAACGGCGAAACACACCTTGTGTGGTATATTACCCGTTCCTAGGTCTCGTGGGCTCGTCGTCG 100
    >>>>>                            >>>>>>>>>>>>>>>>>>>>>>>>>>>>>>>>>>>>>>>>>>>>>>  >>>>>>>>>>>>>>>>>>
    P5              sArMV E50                                       Reverse transcriptase primer 3
         >>>>>>>>                                                                        >>>>>>
         D8                                                                              Primer 4

110       120       130       140       150       160       170       180       190       200
          *         *         *         *         *         *         *         *         *         *
101 GCAGCGGTCGGTACCACTAGTAGTTGACCGTCCTGTCCGTATGACAGAGAAGTCAACCAGAGAGAAACACGTTGTGTGGTATATTACCTGTGGCGGCCGAATTC 200
    >>>>>>                      >>>>>                                                     >>>>>>>>>>>>>>
         second P5                         sTRSV E48                                      Multiple cloning site (MCS)
                >>>>>>
                second D8
    >>>>>>>    >>>>>>
    Primer 4   Barcode insertion site 210       220       230       240       250       260       270       280       290       300
          *         *         *         *         *         *         *         *         *         *
201 TGGAATTCGGGTGCCAAGGGTTCAGAGTTCTACAGTCCGACGTTCCTGCAGTGACCTTCGACGATCGGCCGCCGGTCGACGTTGAGCTTCCTGTCTCTAGA 300
    >>>>>>>>>>>>>>>>>>>>>>>>>>>>>>>>>>>>>>>>>>>>>>>>>>>>>>>>>>>>>>>>                           >>>>>
                                                                                               third D8
    >>>>>>>>>>>>>>>>>                                                                      >>>>>
    Reverse transcriptase primer 1                                                         third P5
    >>>>>>>>>>>>>>>>>
    Primer 2
    >>>>>>>>>>>>>>>>>>>>>>>>>>>>>>>>>>>>>>>>>>>>>>>>>>>>>>>>>>>>>>>>
    Multiple cloning site (MCS)
```

*Fig. 4A*

```
      310        320        330        340        350        360        370        380        390        400
       *          *          *          *          *          *          *          *          *          *
301 CGCCTTGCTGGCCGTTTTCCATAGGCTCCGCCCCCTGACGAGCATCACAAAAATCGACGCTCAAGTCAGAGAGGTGGCGAAACCCGACAGGACTATAAAGA 400
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)
                                                                   <<<<<<<<<<<<<<<<
                                                                        seq2

410        420        430        440        450        460        470        480        490        500
       *          *          *          *          *          *          *          *          *          *
401 TACCAGGCGTTTCCCCCTGGAAGCTCCCTCGTGCGCTCTCCTGTTCCGACCCTGCCGCTTACCGGATACCTGTCCGCCTTTCTCCCTTCGGGAAGCGTGG 500
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

510        520        530        540        550        560        570        580        590        600
       *          *          *          *          *          *          *          *          *          *
501 CGCTTTCTCATAGCTCACGCTGTAGGTATCTCAGTTCGGTGTAGGTCGTTCGCTCCAAGCTGGGCTGTGTGCACGAACCCCCGTTCAGCCCGACCGCTG 600
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

610        620        630        640        650        660        670        680        690        700
       *          *          *          *          *          *          *          *          *          *
601 CGCCTTATCCGGTAACTATCGTCTTGAGTCCAACCCGGTAAGACACGACTTATCGCCACTGGCAGCAGCCACTGGTAACAGGATTAGCAGAGCGAGGTAT 700
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

710        720        730        740        750        760        770        780        790        800
       *          *          *          *          *          *          *          *          *          *
701 GTAGGCGGTGCTACAGAGTTCTTGAAGTGGTGGCCTAACTACGGCTACACTAGAAGAACAGTATTTGGTATCTGCGCTCTGCTGAAGCCAGTTACCTTCG 800
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)
```

*Fig. 4B*

```
       610        620        630        640        650        660        670        680        690        700
        *          *          *          *          *          *          *          *          *          *
601 CGCCTTATCCGGTAACTATCGTCTTGAGTCCAACCCGGTCAAGACACGACTTATCGCCACTGGCAGCAGCCACTGGTAACAGGATTAGCAGAGCGAGGTAT
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

710        720        730        740        750        760        770        780        790        800
        *          *          *          *          *          *          *          *          *          *
701 GTAGGCGGTGCTACAGAGTTCTTGAAGTGGTGGCCTAACTACGGCTACACTAGAAGAACAGTATTTGGTATCTGCGCTCTGCTGAAGCCAGTTACCTTCG
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

810        820        830        840        850        860        870        880        890        900
        *          *          *          *          *          *          *          *          *          *
801 GAAAAAGAGTTGGTAGCTCTTGATCCGGCAAACAAACCACCGCTGGTAGCGGTGGTTTTTTTGTTTGCAAGCAGCAGATTACGCGCAGAAAAAAAGGATC
    <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
    rep (pMB1)

910        920        930        940        950        960        970        980        990       1000
        *          *          *          *          *          *          *          *          *          *
901 TCAAGAAGATCCTTTGATCTTTTCTACGGGGTCTGACGCTCAGTGGAACGAAAACTCACGTTAAGGGATTTTGGTCATGAGATTATCAAAAAGGATCTTC
    <<<<<<<<<
    rep (pMB1)

1010       1020       1030       1040       1050       1060       1070       1080       1090       1100
        *          *          *          *          *          *          *          *          *          *
1001 ACCTAGATCCTTTTAAATTAAAAATGAAGTTTTAAATCAATCTAAAGTATATATGAGTAAACTTGGTCTGACAGTTACCAATGCTTAATCAGTGAGGCAC
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR
```

*Fig. 4C*

```
1101 CTATCTCAGCGATCTGTCTATTTCGTTCATCCATAGTTGCCTGACTCCCCGTCGTGTAGATAACTACGATACGGGAGGGCTTACCATCTGGCCCCAGTGC
     ampR 1201 TGCAATGATACCGCGAGAGACCCACGCTCACCGGCTCCAGATTTATCAGCAATAAACCAGCCAGCCGGAAGGGCCGAGCGCAGAAGTGGTCCTGCAACTTTA
     ampR 1301 TCCGCCTCCATCCAGTCTATTAATTGTTGCCGGGAAGCTAGAGTAAGTAGTTCGCCAGTTAATAGTTTGCGCAACGTTGTTGCCATTGCTACAGGCATCG
     ampR 1401 TGGTGTCACGCTCGTCGTTTGGTATGGCTTCATTCAGCTCCGGTTCCCAACGATCAAGGCGAGTTACATGATCCCCCATGTTGTGCAAAAAAGCGGTTAG
     ampR 1501 CTCCTTCGGTCCTCCGATCGTTGTCAGAAGTAAGTTGGCCGCAGTGTTATCACTCATGGTTATGGCAGCACTGCATAATTCTCTTACTGTCATGCCATCC
     ampR
```

Fig. 4D

```
        1410      1420      1430      1440      1450      1460      1470      1480      1490      1500
          *         *         *         *         *         *         *         *         *         *
1401 TGGTGTCACGCTCGTCGTTTGGTATGGCTTCATTCAGCTCCGGTTCCCAACGATCAAGGCGAGTTACATGATCCCCATGTTGTGCAAAAAGCGGTTAG
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1510      1520      1530      1540      1550      1560      1570      1580      1590      1600
          *         *         *         *         *         *         *         *         *         *
1501 CTCCTTCGGTCCTCCGATCGTTGTCAGAAGTAAGTTGGCCGCAGTGTTATCACTCATGGTTATGCAGCACTGCATAATTCTCTTACTGTCATGCCATCC
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1610      1620      1630      1640      1650      1660      1670      1680      1690      1700
          *         *         *         *         *         *         *         *         *         *
1601 GTAAGATGCTTTTCTGTGACTGGTGAGTACTCAACCAAGTCATTCTGAGAATAGTGTATGCGGCGACCGAGTTGCTCTTGCCCGGCGTCAATACGGGATA
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1710      1720      1730      1740      1750      1760      1770      1780      1790      1800
          *         *         *         *         *         *         *         *         *         *
1701 ATACCGCGCCACATAGCAGAACTTTAAAAGTGCTCATCATTGGAAAACGTTCTTCGGGGCGAAAACTCTCAAGGATCTTACCGCTGTTGAGATCCAGTTC
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR 1810      1820      1830      1840      1850      1860      1870      1880      1890      1900
          *         *         *         *         *         *         *         *         *         *
1801 GATGTAACCCACTGCACCCAACTGATCTTCAGCATCTTTTACTTTCACCAGCGTTTCTGGGTGAGCAAAAACAGGAAGGCAAAATGCCGCAAAAAAG
     <<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<<
     ampR
```

*Fig. 4E*

```
             1910       1920       1930       1940       1950       1960       1970       1980       1990       2000
               *          *          *          *          *          *          *          *          *          *
1901 GGAATAAGGGCGACACGGAAATGTTGAATACTCATACTCTTCCTTTTTCAATATTATTGAAGCATTTATCAGGGTTATTGTCTCATGAGCGGATACATAT 2000
     <<<<<<<<<<<<<<<<<<<<<<<<<<<<<<<<<<<<<<<<<<<<<<<  >>>>>>>>>>>>>>>>>>>>>>>>>>>>>>>>>>>>>>>>>>>>>>>>>>>
     ampR                                                    seq1
                                                     <<<<<<<<<<<<<<<<<<<<<<<<<<<<<<<<<<<<<<<<<<<<<<<<<<<
                                                     ampr promoter 2010       2020       2030       2040
               *          *          *          *
2001 TTGAAATGTATTTAGAAAAATAAACAAATAGGGGTTCCGCG 2040
     <<<<<<<<<<<<<<<<<<<<<<<<<<<<<<<<<<<<<<<<
     ampr promoter
```

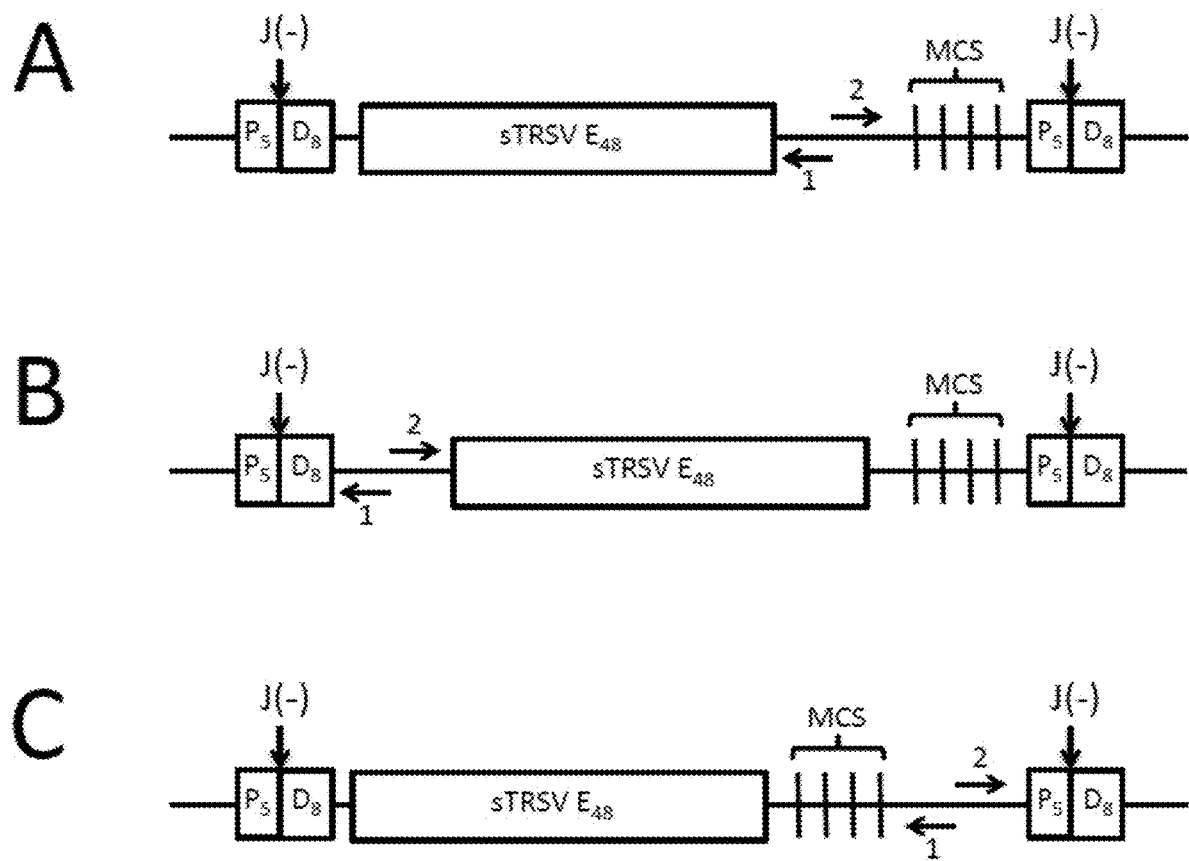
Fig. 16A-C

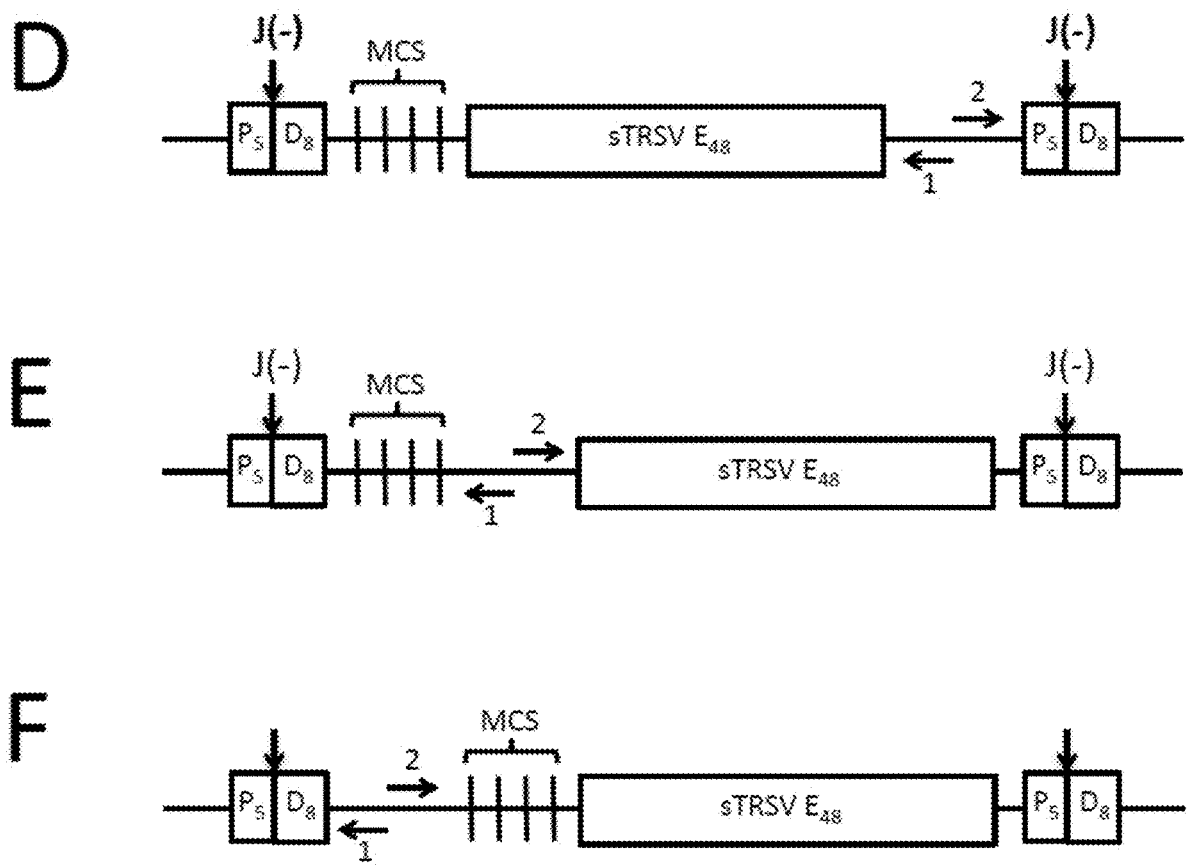
Fig. 16D-F

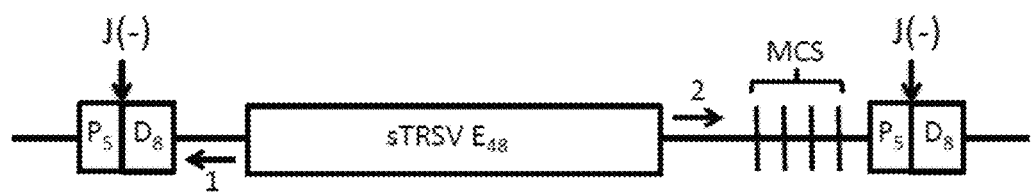
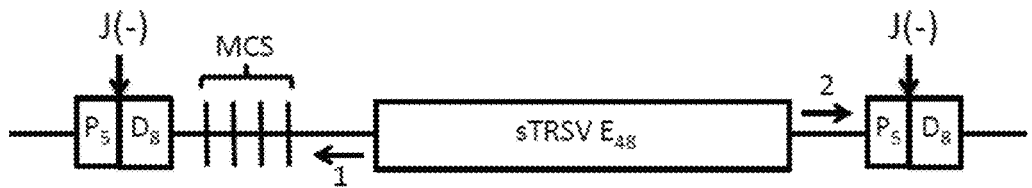
*Fig. 17A-B*

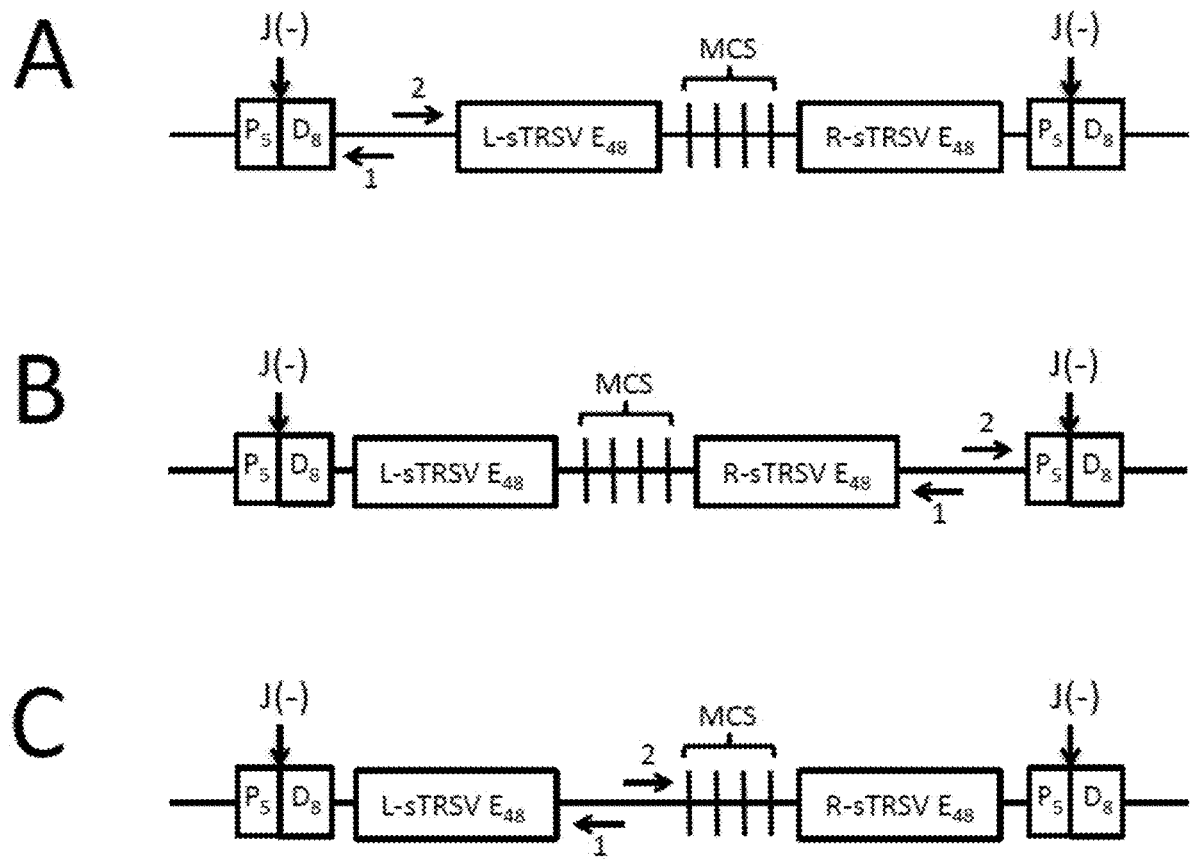
*Fig. 18A-C*

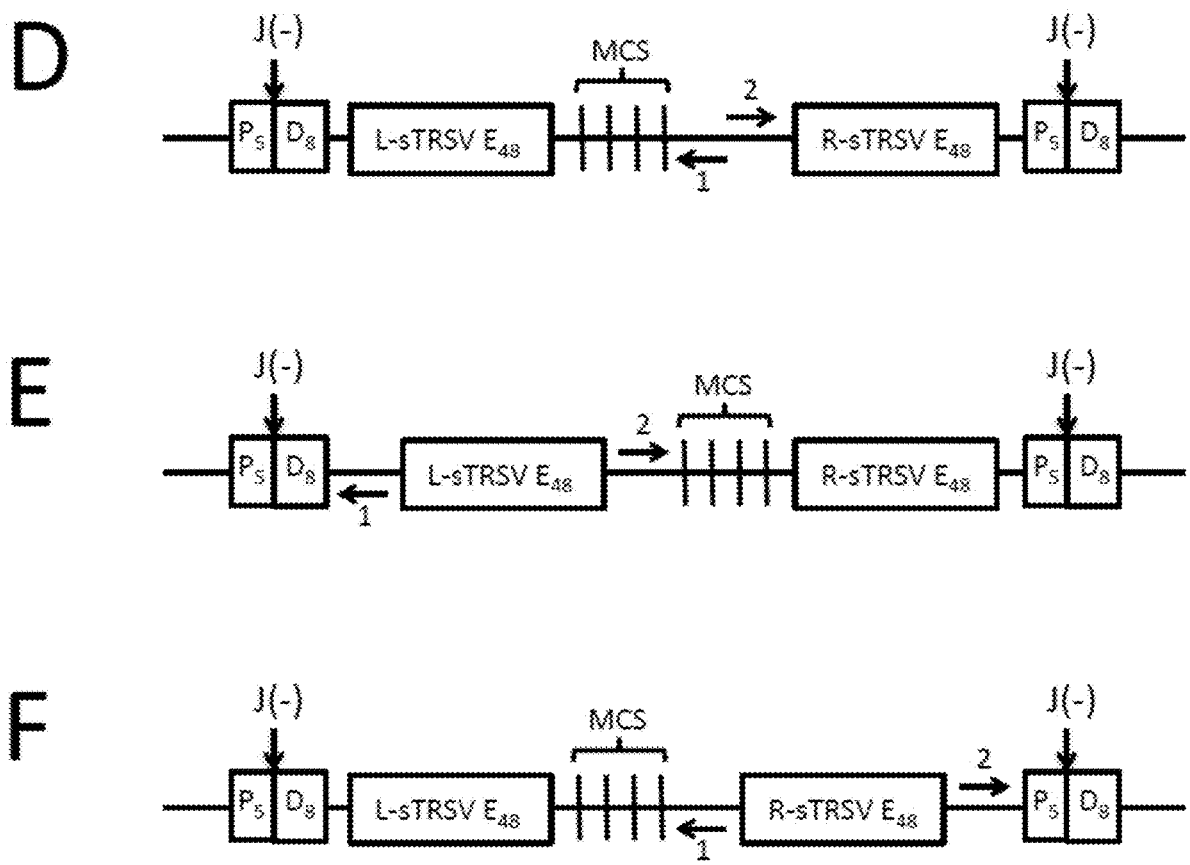
*Fig. 18D-F*

Improved T7 RNA polymerase promoters expressing the green fluorescent protein (GFP)

GFP expressed 2 hours after induction of T7 RNA polymerase

| | | | | | | |
|---|---|---|---|---|---|---|
| Predicted by transcription ratio | 1.00x | 1.51x | 1.68x | 2.40x | 2.69x | 2.81x |
| | Wildtype | Mutants (fold increase over wildtype) | | | | |
| Measured protein | 1.00x | 1.46x | 1.65x | 1.95x | 2.02x | 1.88x |

COMPOSITIONS AND METHODS FOR IDENTIFYING POLYNUCLEOTIDES OF INTEREST

CROSS-REFERENCE TO RELATED APPLICATIONS

This application is the U.S. National Phase of Intl. Appl. No. PCT/US2016/039348, filed on Jun. 24, 2016, which claims the benefit under 35 U.S.C. § 119(e) of U.S. Provisional Application No. 62/184,868, filed on Jun. 26, 2015, which are hereby incorporated herein by reference in their entireties for all purposes.

FIELD

Provided are constructs and methods useful for the screening and identification of polynucleotide sequences of interest, in particular promoters, RNA stability modifying sequences and transcriptional modifying sequences.

SEQUENCE LISTING

The instant application contains a Sequence Listing which has been submitted electronically in ASCII format and is hereby incorporated by reference in its entirety. Said ASCII copy, created on Jun. 23, 2016, is named UCDVP115WO_sequencelisting.txt and is 11,109 kilobytes in size.

BACKGROUND

Currently available technologies for identifying sequences of interest, including promoters, transcriptional modifiers and RNA stability sequences, consist of computer annotation of sequenced genomes to find expressed regions. Generally, the sequence flanking the 5'end of an expressed sequence is "identified" as the promoter. This analysis is often paired with RNA sequencing which identifies the starts of the transcription. These methods do not yield the cloned promoter or allow promoter mutations to be evaluated.

SUMMARY

In one aspect, provided is a DNA plasmid useful for identifying a promoter. In some embodiments, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a multiple cloning site polynucleotide comprising plurality of restriction endonuclease cleavage sites; and (iii) a reverse primer annealing polynucleotide located upstream or 5' to a forward primer annealing polynucleotide; and (b) a plasmid backbone, comprising an origin of replication. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a multiple cloning site polynucleotide comprising plurality of restriction endonuclease cleavage sites, a reverse primer annealing polynucleotide and a forward primer annealing polynucleotide; and (iv) a second ribozyme cleavage site; and (b) a plasmid backbone, comprising an origin of replication.

In a further aspect, provided is a DNA plasmid useful for identifying a promoter. In some embodiments, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a reverse primer annealing polynucleotide; (iii) a forward primer annealing polynucleotide; and (iv) an inserted polynucleotide suspected of comprising a promoter; and (b) a plasmid backbone, comprising an origin of replication. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a reverse primer annealing polynucleotide; (iv) a forward primer annealing polynucleotide; (v) an inserted polynucleotide suspected of comprising a promoter; (vi) a second ribozyme cleavage site; (b) a plasmid backbone, comprising an origin of replication. In varying embodiments of the DNA plasmid, the polynucleotide suspected of comprising a promoter has from about 50 nucleotides or base pairs (bp) to about 2000 bp, e.g., from about 100 bp to about 1000 bp. In varying embodiments, the primer annealing polynucleotides are reverse transcriptase polymerase chain reaction (RT-PCR) primer annealing polynucleotides.

In varying embodiments of the DNA plasmid useful for identifying a promoter, the second ribozyme cleavage site is capable of being transcribed into RNA by a RNA polymerase when the inserted polynucleotide comprises a functional promoter. In varying embodiments, the promoter in the inserted polynucleotide suspected of comprising a promoter is functional in a eukaryotic cell. In varying embodiments, the promoter in the inserted polynucleotide suspected of comprising a promoter is functional in a prokaryotic cell. In varying embodiments, the inserted polynucleotide suspected of comprising a promoter is from a library of randomized chemically synthesized DNA sequences. In varying embodiments, the inserted polynucleotide suspected of comprising a promoter is from a genomic DNA library. In varying embodiments, the inserted polynucleotide suspected of comprising a promoter comprises a mutagenized promoter. In varying embodiments, the plasmid has from about 1800 bp to about 3800 bp, e.g., from about 1900 bp to about 2900 bp. In varying embodiments, the plasmid backbone does not comprise a promoter functional in a eukaryotic cell. In varying embodiments, the ribozyme catalytic core is derived from a hairpin ribozyme. In varying embodiments, the ribozyme catalytic core is derived from the negative strand self-cleavage domain (e.g., a hairpin ribozyme catalytic core) of a satellite RNA of a plant virus selected from the group consisting of the satellite RNA of tobacco ringspot virus (sTRSV), the satellite RNA of arabis mosaic virus (sArMV), and the satellite RNA of chicory yellow mottle virus (sCYMV). In varying embodiments, the ribozyme catalytic core is derived from the negative strand self-cleavage domain of the satellite RNA of tobacco ringspot virus (sTRSV). In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 8. In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 3. In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 4. In varying embodiments, the ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 5. In varying embodiments, the first, second and/or third ribozyme cleavage sites are hairpin ribozyme cleavage sites or sites cleavable by a hairpin ribozyme catalytic core. In varying embodiments, the first, second and/or third ribozyme cleavage sites have a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 7. In varying embodiments, the first, second and/or third ribozyme cleavage sites have a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 6. In varying embodiments, the plasmid does not comprise upstream of or 5' to the mini-monomer cassette, a promoter functional in a prokaryotic cell that promotes the transcription of the mini-monomer cassette in the sense orientation. In varying embodiments, the plasmid further comprises a control promoter. In varying embodiments, the control promoter is functional in a prokaryotic cell. In varying embodiments, the control promoter is positioned upstream of or 5' to the mini-monomer cassette. In varying embodiments, the promoter functional in a prokaryotic cell comprises a bacteriophage promoter, e.g., selected from the group consisting of T7, T3 and SP6. In varying embodiments, the plasmid or plasmid backbone comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 1. In varying embodiments, the plasmid backbone comprises an expression cassette encoding a selection marker. In varying embodiments, the expression cassette is in the antisense orientation from the ribozyme catalytic core. In varying embodiments, the expression cassette is in the sense orientation to the ribozyme catalytic core. In varying embodiments, the selection marker comprises a polynucleotide encoding a gene or protein conferring antibiotic resistance, heat tolerance, fluorescence, luminescence or rescue of auxotrophic growth for specific amino acids or nucleotides. In varying embodiments, the step of transcribing the population of plasmids into RNA is performed in the presence and absence of an adjusted external factor. In varying embodiments, the adjusted external factor is selected from the group consisting of temperature, pH, ion concentrations, ionic strength, salt concentration, calcium concentration, endoplasmic reticulum stress, hormones and ligands, heavy metals, toxins, glucose, the presence of virus, fungi, bacteria or other pathogens.

In a further aspect, provided are methods of identifying functional promoter sequences. In some embodiments, the methods comprise:

a) providing a population of plasmids as described above and herein;

b) transcribing the population of plasmids into RNA; wherein the second ribozyme cleavage site is transcribed by a RNA polymerase when the inserted polynucleotide comprises a functional promoter; wherein RNA transcripts comprising the mini-monomer cassette self-cleave from the transcript, thereby forming a population of circularized RNA transcripts of self-cleaved mini-monomer cassettes;

c) reverse transcribing into cDNA the population of circularized RNA transcripts of self-cleaved mini-monomer cassettes, thereby forming a population of cDNA reverse-transcripts of self-cleaved mini-monomer cassettes; and d) sequencing the inserted polynucleotides comprising a functional promoter in the population of cDNA reverse-transcripts of self-cleaved mini-monomer cassettes, whereby functional promoter sequences are identified. In varying embodiments, the step of transcribing the population of plasmids into RNA is performed in vitro. In varying embodiments, the step of transcribing the population of plasmids into RNA is performed in vivo. In varying embodiments, the functional promoter is functional in a eukaryotic cell. In varying embodiments, the functional promoter is functional in a prokaryotic cell. In varying embodiments, the methods further comprise, after step b), the step of purifying or isolating RNA from non-RNA. In varying embodiments, the methods further comprise, after step b), the step of purifying or isolating the population of circularized RNA transcripts of self-cleaved mini-monomer cassettes. In some embodiments, the reverse transcribing step comprises amplifying from the forward and reverse primer annealing polynucleotides. In some embodiments, the sequencing step comprises deep sequencing. In some embodiments, statistical analyses of a population of RT-PCR products are performed and the identified promoters are ordered by strength. In some embodiments, the sequencing step comprises amplifying from the forward and reverse primer annealing polynucleotides (e.g., for PCR or RT-PCR).

In a related aspect, provided is a DNA plasmid useful for identifying a RNA stability modifier or a transcription modifier. In some embodiments, the DNA plasmid comprises operably linked polynucleotides encoding in the 5' to 3' direction:

(a) a test promoter, wherein the test promoter is functional in a eukaryotic cell or in a prokaryotic cell;

(b) a mini-monomer cassette, comprising:
  (i) a first ribozyme cleavage site;
  (ii) a ribozyme catalytic core;
  (iii) a reverse primer annealing polynucleotide (e.g., for PCR or RT-PCR);
  (iv) a forward primer annealing polynucleotide (e.g., for PCR or RT-PCR);
  (v) an inserted polynucleotide suspected of comprising a RNA stability modifier or a transcription modifier;
  (vi) a second ribozyme cleavage site;

(c) a plasmid backbone comprising an origin of replication.

In another aspect, provided is a DNA plasmid useful for identifying a RNA stability modifier or a transcription modifier. In some embodiments, the DNA plasmid comprises operably linked polynucleotides encoding in the 5' to 3' direction:

(a) a test promoter, wherein the test promoter is functional in a eukaryotic cell or in a prokaryotic cell;

(b) a first mini-monomer cassette, comprising:
  (i) a first ribozyme cleavage site;
  (ii) a first ribozyme catalytic core;
  (iii) a first reverse primer annealing polynucleotide;
  (iv) a first forward primer annealing polynucleotide;
  (v) a barcode polynucleotide
  (vi) a second ribozyme cleavage site;

(c) a second mini-monomer cassette, comprising:
  (i) the second ribozyme cleavage site;
  (ii) a second ribozyme catalytic core;

(iii) a second reverse primer annealing polynucleotide;
(iv) a second forward primer annealing polynucleotide;
(v) an inserted polynucleotide suspected of comprising a RNA stability modifier or a transcription modifier;
(vi) a third ribozyme cleavage site;
(d) a plasmid backbone comprising an origin of replication. In varying embodiments, the barcode polynucleotide comprises a random DNA sequence comprising from about 10 to about 20 N residues. In varying embodiments, the primer annealing polynucleotides are reverse transcriptase polymerase chain reaction (RT-PCR) primer annealing polynucleotides.

In varying embodiments of the DNA plasmid useful for identifying a RNA stability modifier or a transcription modifier, the polynucleotide suspected of comprising a RNA stability modifier or a transcription modifier has from about 50 bp to about 1000 bp. In varying embodiments, the polynucleotide suspected of comprising a RNA stability modifier or a transcription modifier comprises an enhancer. In varying embodiments, the inserted polynucleotide suspected of comprising a RNA stability modifier or a transcription modifier is located 5' of the first ribozyme cleavage site. In varying embodiments, the promoter functional in a eukaryotic cell comprises a promoter from the same species as the inserted polynucleotide suspected of comprising a RNA stability modifier or a transcription modifier. In some embodiments, the inserted polynucleotide suspected of comprising a RNA stability modifier or a transcription modifier is from a library of randomized chemically synthesized DNA sequences. In varying embodiments, the inserted polynucleotide suspected of comprising a RNA stability modifier or a transcription modifier is from a genomic DNA library. In varying embodiments, the inserted polynucleotide suspected of comprising a RNA stability modifier or a transcription modifier comprises a mutagenized RNA stability modifier or a transcription modifier. In varying embodiments, the first and second ribozyme catalytic cores are independently derived from first and second hairpin ribozymes. In varying embodiments, the first and second ribozyme catalytic cores are independently derived from the negative strand self-cleavage domain (e.g., a hairpin ribozyme catalytic core) of a plant virus satellite RNA selected from the group consisting of the satellite RNA of tobacco ringspot virus (sTRSV), the satellite RNA of arabis mosaic virus (sArMV), and the satellite RNA of chicory yellow mottle virus (sCYMV). In some embodiments, the first and second ribozyme catalytic cores are different. In varying embodiments, the first and second ribozyme catalytic cores are the same. In varying embodiments, the first or second ribozyme catalytic core is derived from the negative strand self-cleavage domain the satellite RNA of tobacco ringspot virus (sTRSV). In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 8. In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 3. In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 4. In varying embodiments, the first and/or second ribozyme catalytic core comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 5. In varying embodiments, the first, second and/or third ribozyme cleavage sites are hairpin ribozyme cleavage sites or sites cleavable by a hairpin ribozyme catalytic core. In varying embodiments, the first, second and/or third ribozyme cleavage sites comprise a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 7. In varying embodiments, the first, second and/or third ribozyme cleavage sites have a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 6. In varying embodiments, the plasmid or plasmid backbone comprises a polynucleotide having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 2. In varying embodiments, the plasmid does not comprise upstream of or 5' to the mini-monomer cassette, a promoter functional in a prokaryotic cell that promotes the transcription of the mini-monomer cassette in the sense orientation. In varying embodiments, the plasmid further comprises a control promoter. In varying embodiments, the control promoter is functional in a prokaryotic cell. In varying embodiments, the control promoter is positioned upstream of or 5' to the mini-monomer cassette. In varying embodiments, the promoter functional in a prokaryotic cell comprises a bacteriophage promoter, e.g., selected from the group consisting of T7, T3 and SP6. In varying embodiments, the plasmid backbone comprises an expression cassette encoding a selection marker. In varying embodiments, the expression cassette is in the antisense orientation from the ribozyme catalytic core. In varying embodiments, the expression cassette is in the sense orientation to the ribozyme catalytic core. In varying embodiments, the selection marker comprises a polynucleotide encoding a gene or protein conferring antibiotic resistance, heat tolerance, fluorescence, luminescence or rescue of auxotrophic growth for specific amino acids or nucleotides. In varying embodiments, the promoter functional in a eukaryotic cell is located 3' of the third ribozyme cleavage site. In such embodiments, the plasmid has from about 1800 bp to about 3800 bp, e.g., from about 1900 bp to about 2900 bp. In varying embodiments, the promoter functional in a eukaryotic cell is located 5' of the first ribozyme cleavage site. In such embodiments, the construct has no upper size limit, but the plasmid optionally can have from about 2100 bp to about 3100 bp, e.g., from about 2100 bp to about 2250 bp.

In a further aspect, provided are methods of identifying RNA stability modifying and/or transcription modifying sequences. In some embodiments, the method comprises:

a) providing a population of plasmids useful for identifying a RNA stability modifier or a transcription modifier as described above and herein;

b) sequencing the first and second mini-monomer cassettes; thereby linking the barcode polynucleotide to a unique inserted polynucleotide suspected of comprising a RNA stability modifier;

c) transcribing in vitro the population of plasmids into RNA from a control promoter (e.g., a promoter functional in a prokaryotic cell), wherein RNA transcripts comprising the first and second mini-monomer cassettes self-cleave from the transcript;

d) sequencing the self-cleaved first and second mini-monomer cassettes transcribed in vitro in step c); thereby controlling for cleavage and circularization efficiency;

e) transcribing either in vitro or in a population of host cells the population of plasmids into RNA from a test promoter, wherein the test promoter is functional in a eukaryotic cell or in a prokaryotic cell, wherein RNA transcripts comprising the first and second mini-monomer cassettes self-cleave from the transcript;

f) sequencing the self-cleaved first and second mini-monomer cassettes transcribed in step e);

g) comparing the relative abundance or frequency of the self-cleaved second mini-monomer cassettes transcribed in vitro in step c) with the self-cleaved second mini-monomer cassettes transcribed in step e), wherein a higher or increased relative abundance or frequency of the self-cleaved second mini-monomer cassettes transcribed in step e) identifies RNA stabilizing sequences or transcription enhancer sequences in the second mini-monomer cassette, and wherein a lower or decreased relative abundance or frequency of the self-cleaved second mini-monomer cassettes transcribed in step e) identifies RNA destabilizing sequences or transcription reduction sequences in the second mini-monomer cassette; and h) comparing the ratios of the relative abundance or frequency of the self-cleaved first mini-monomers to their linked self-cleaved second mini-monomers produced in vitro in step c) with those produced in step e), wherein a substantially unchanged and/or a substantially 1:1 ratio, and an increased relative abundance or frequency of the self-cleaved second mini-monomer cassettes transcribed in step e) identifies a transcriptional enhancer;

wherein a ratio showing a higher relative abundance of the self-cleaved second mini-monomer, and an increased relative abundance or frequency of the self-cleaved second mini-monomer cassettes transcribed in step e) identifies a RNA stabilizing sequence;

wherein a substantially unchanged and/or a substantially 1:1 ratio, and a decreased relative abundance or frequency of the self-cleaved second mini-monomer cassettes transcribed in step e) identifies a transcriptional reducing sequence; and wherein a ratio showing a lower relative abundance of the self-cleaved second mini-monomer, and a decreased relative abundance or frequency of the self-cleaved second mini-monomer cassettes transcribed in a host cell in step g) identifies a RNA destabilizing sequence.

In a further aspect, provided are methods of identifying a polynucleotide sequence bound by a transcription factor, comprising:

a) providing a population of plasmids as described above and herein for use in identifying RNA stability/transcription modifying sequences;

b) sequencing the first and second mini-monomer cassettes; thereby linking the barcode polynucleotide to a unique inserted polynucleotide suspected of comprising a RNA stability modifier;

c) transcribing in vitro the population of plasmids into RNA from the control promoter (e.g., a promoter functional in a prokaryotic cell), wherein RNA transcripts comprising the first and second mini-monomer cassettes self-cleave from the transcript;

d) sequencing the self-cleaved first and second mini-monomer cassettes transcribed in vitro; thereby controlling for cleavage and circularization efficiency;

e) transcribing the population of plasmids into RNA from the test promoter (e.g., a promoter functional in a eukaryotic or a prokaryotic cell), wherein the transcribing is performed in a population of host cells and in the presence and absence of an inhibitory nucleic acid that inhibits or reduces the expression of the transcription factor, wherein RNA transcripts comprising the first and second mini-monomer cassettes self-cleave from the transcript;

f) sequencing the self-cleaved first and second mini-monomer cassettes transcribed in a host cell;

g) comparing the relative abundance or frequency of the self-cleaved second mini-monomer cassettes transcribed in the host cell in the presence of the inhibitory nucleic acid with the self-cleaved second mini-monomer cassettes transcribed in a host cell in the absence of the inhibitory nucleic acid, wherein a higher or increased relative abundance or frequency of the self-cleaved second mini-monomer cassettes transcribed in a host cell in the absence of the inhibitory nucleic acid identifies the polynucleotide sequence bound by the transcription factor. In varying embodiments, the inhibitory nucleic acid is an interfering RNA polynucleotide (RNAi).

In varying embodiments of the methods, the step of transcribing the population of plasmids into RNA is performed in the presence and absence of an adjusted external factor. In varying embodiments, the adjusted external factor is selected from the group consisting of temperature, pH, ion concentrations, ionic strength, salt concentration, calcium concentration, endoplasmic reticulum stress, hormones and ligands, heavy metals, toxins, glucose, the presence of virus, fungi, bacteria or other pathogens. In varying embodiments, the methods further comprise, after step c), the step of purifying or isolating RNA from non-RNA. In varying embodiments, the methods further comprise, after step c), the step of purifying or isolating the population of circularized RNA transcripts of self-cleaved mini-monomer cassettes. In varying embodiments, the reverse-transcribing step comprises amplifying from the first forward and reverse primer annealing polynucleotides (e.g., for PCR or RT-PCR) and the second forward and reverse primer annealing polynucleotides (e.g., for PCR or RT-PCR), respectively. In varying embodiments, the sequencing step comprises deep sequencing. In varying embodiments, the sequencing step comprises amplifying from the first forward and reverse primer annealing polynucleotides (e.g., for PCR or RT-PCR) and the second forward and reverse primer annealing polynucleotides (e.g., for PCR or RT-PCR), respectively. In varying embodiments, statistical analyses of a population of RT-PCR products are performed and the identified RNA stability modifying and/or transcription modifying sequences are ordered by strength.

In a further aspect, provided is a host cell or a population of host cells comprising a DNA plasmid or a population of DNA plasmids, as described above and herein. In varying embodiments, the host cell or population of host cells is a prokaryotic cell or a eukaryotic cell. In varying embodiments, the host cell or population of host cells is selected from an archael cell, a bacterial cell, an animal cell (e.g., a mammalian cell or an insect cell), a plant cell, or a fungal cell.

In a further aspect, provided are kits comprising one or more plasmids or one or more populations of plasmids, as described above and herein.

In a further aspect, provided is a polynucleotides comprising one or more promoters selected from the group consisting of SEQ ID NOs: 10-73473. Also provided is an expression cassette comprising one or more promoters selected from the group consisting of SEQ ID NOs: 10-73473. Also provided is a plasmid comprising an expression cassette comprising one or more promoters selected from the group consisting of SEQ ID NOs: 10-73473. Also provided is a host cell or a population of host cells, each comprising an expression cassette comprising one or more promoters selected from the group consisting of SEQ ID NOs: 10-73473. In some embodiments, the expression cassette is in a plasmid. In some embodiments, the expression cassette is incorporated into the genome of the host cell. In some embodiments, the host cell is selected from an archael cell, a bacterial cell, an animal cell, a plant cell, or a fungal cell.

In a further aspect, provided are methods for producing an RNA polynucleotide of interest. In some embodiments, the methods comprise expressing an RNA molecule from a polynucleotide operably linked to one or more promoters selected from the group consisting of SEQ ID NOs: 10-73473. In varying embodiments, the RNA molecule encodes a protein. In varying embodiments, the RNA molecule is non-coding RNA. In varying embodiments, the RNA molecule is selected from the group consisting of mRNA, rRNA, tRNA, guide RNA and micro RNA. In varying embodiments, the method is performed in vivo (e.g., in a cell) or in vitro.

Definitions

The term "RNA stability modifier" refers to a DNA motif that modulates (e.g., increases or decreases) the rate of degradation of the RNA and thus change the half-life of the RNA. Mechanisms include binding of proteins or polynucleotides to the "RNA stability modifier" that create this change (e.g., in iron regulation or in cells exposed to hormones). See, e.g., Addess, et al., *J. Mol. Biol.* 274 (1): 72-83. Reference to "RNA stability modifier" includes polynucleotides that bind a polynucleotide involved in decreasing RNA stability thus increasing RNA turnover, double stranded polynucleotides that are cleaved by a RNAse (e.g., Dicer) and transcriptional terminators.

The term "transcription modifier" refers to a DNA motif that modulates (e.g., increases or decreases) promoter strength.

As used herein, "promoter strength" or "promoter efficiency" interchangeably refer to the number completed transcripts per unit time which is obtained by sequencing the RT-PCR product population.

The term "enhancer" refers to a DNA motif that increases promoter strength. Enhancers recruit transcription factors to bind in the vicinity of promoters, thus increasing effectiveness of the promoter or promoter specificity to certain external factors (light, hormones, etc.).

The term "repressor" refers to a DNA motif that decreases promoter strength. Repressors recruit transcription factors to bind in the vicinity of promoters, thus decreasing effectiveness of the promoter or promoter specificity to certain external factors (light, hormones, etc.).

The term "mini-monomer cassette" refers to a polynucleotide sequence comprising a ribozyme catalytic core and upstream and downstream ribozyme cleavage sites, such that when transcribed into RNA, the ribozyme catalytic core self-cleaves the mini-monomer cassette at the upstream and downstream ribozyme cleavage sites out of the context of a longer polynucleotide. The 5' and 3' ends of the excised polynucleotide ligate to form a circularized polynucleotide.

The term "ribozyme catalytic core" refers to the subsequence of a ribozyme capable of carrying out cleavage of a RNA molecule.

The term "ribozyme cleavage site" refers to the sequences recognized and cleaved by a ribozyme catalytic core.

The terms "identical" or percent "identity," and variants thereof in the context of two or more polynucleotide or two or more amino acid sequences, refer to two or more sequences or subsequences that are the same. Sequences are "substantially identical" if they have a specified percentage of nucleic acid residues or amino acid residues that are the same (i.e., at least 60% identity, optionally at least 65%, 70%, 75%, 80%, 85%, 90%, 95%, 96%, 97%, 98%, or 99% identity to a reference sequence (e.g., SEQ ID NOs: 1-73473) over a specified region (or the whole reference sequence when not specified)), when compared and aligned for maximum correspondence over a comparison window, or designated region as measured using any sequence comparison algorithm known in the art (GAP, BESTFIT, BLAST, Align, FASTA, and TFASTA in the Wisconsin Genetics Software Package, Genetics Computer Group (GCG), 575 Science Dr., Madison, Wis.), Karlin and Altschul Proc. Natl. Acad. Sci. (U.S.A.) 87:2264-2268 (1990) set to default settings, or by manual alignment and visual inspection (see, e.g., Ausubel et al., Current Protocols in Molecular Biology (1995-2014). Optionally, the identity exists over a region that is at least about 100, 200, 300, 400, 500, 600, 800, 1000, or more, nucleic acids in length, or over the full-length of the sequence.

BRIEF DESCRIPTION OF THE DRAWINGS

FIGS. 2A-E illustrate an annotated polynucleotide sequence of a vector map for a plasmid useful for screening for promoters.

FIG. 4A-F illustrate an annotated polynucleotide sequence of a vector map for a plasmid useful for screening for RNA stability modifiers and/or transcription modifiers.

FIGS. 16A-F illustrate six functional arrangements between the ribozyme cleavage sites of the ribozyme core, MCS that will contain the test promoter sequence, and the primer 1 and 2 sequences, where the primer 1 and 2 sequences are adjacent to each other. When these illustrative mini-monomer cassettes are transcribed, ribozyme cleaved and ligated, reverse-transcribed and PCR amplified the test promoter sequence is recovered.

FIGS. 17A-B illustrate two additional functional arrangements between the ribozyme cleavage sites of the ribozyme core, MCS that will contain the test promoter sequence, and the primer 1 and 2 sequences, where the primer 1 and 2 sequences are not adjacent to each other. When these illustrative mini-monomer cassettes are transcribed, ribozyme cleaved and ligated, reverse-transcribed and PCR amplified, the test promoter sequence is recovered.

FIGS. 18A-F illustrate six functional arrangements between the ribozyme cleavage sites in which the MCS (with or without comprising an insert comprising a test promoter sequence) is inserted into loop 2 of stem 4 (see, FIG. 5) of the ribozyme core and the primer 1 and 2 sequences, where the primer 1 and 2 sequences are either adjacent to each other (FIG. 18A-D) or are not adjacent to each other (FIG. 18E-F). L-sTRSV $E_{48}$ and R-sTRSVE$_{48}$ represent the left and right halves of the ribozyme catalytic core respectively. When these illustrative mini-monomer cassettes are transcribed, ribozyme cleaved and ligated, reverse-transcribed and PCR amplified, the test promoter sequence is recovered.

Due to the number of sequences shown, the y-axis is a log axis to compress its length. Of the unique double mutants possible, an analysis of 1223 out of the possible 1224 is shown (99.9%).

Figure 21:
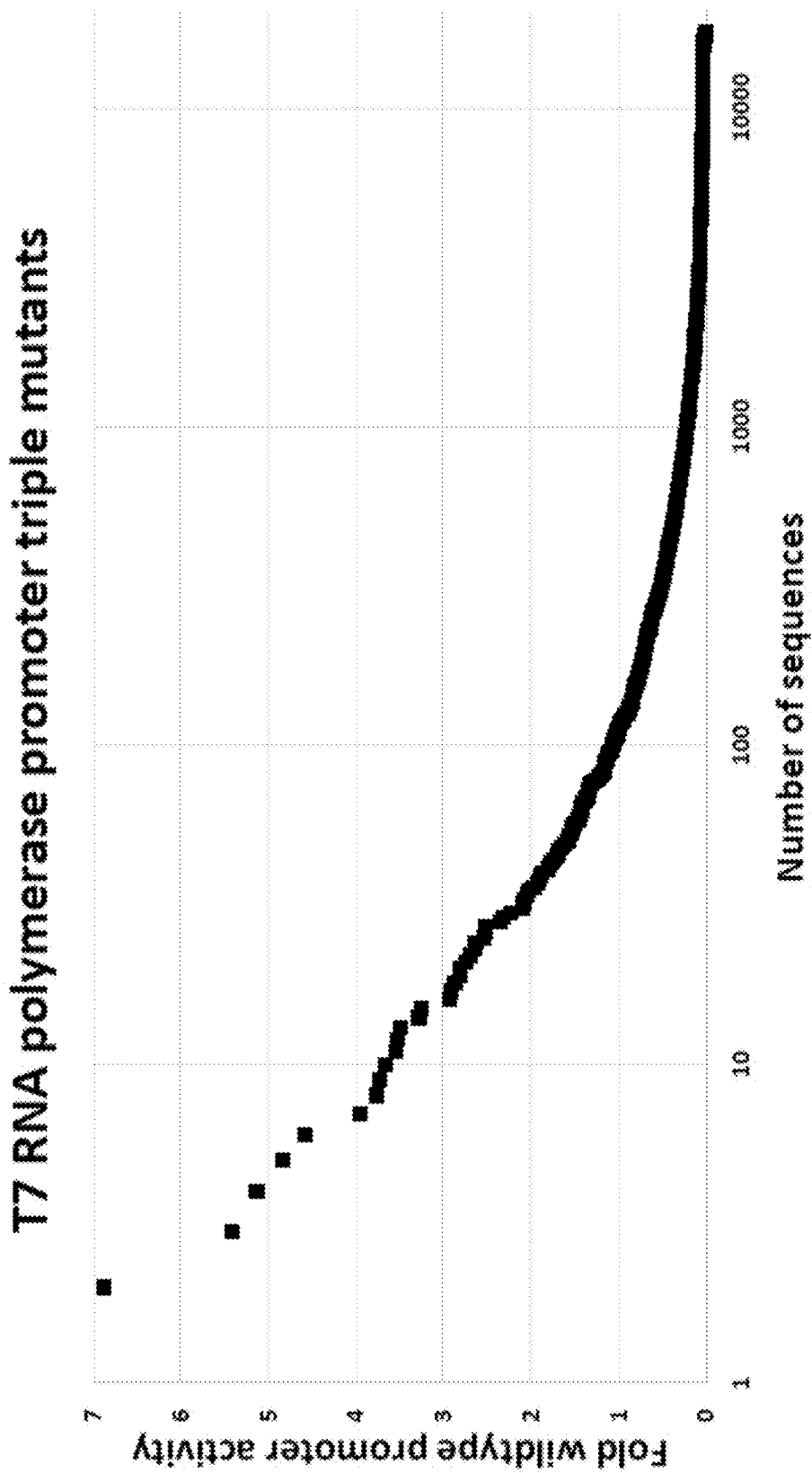

FIG. 21 illustrates the relative in vivo activity of 17281 triple mutants of the mutated T7 RNA polymerase promoter whose construction is described in Example 4. Mutant promoter activity is shown on the y-axis and is normalized to the wildtype promoter activity as described in Example 4. The triple mutants were placed in activity order from highest to lowest relative to wildtype. The number of individual triple mutants analyzed is shown on the x-axis. Due to the number of sequences shown, the y-axis is a log axis to compress its length. Of the unique triple mutants possible, an analysis of 17281 out of the possible 18340 is shown (94.1%).

FIG. 22 illustrates the measured transcription ratios and their relationship to in vivo protein expression levels for 5 selected mutant T7 RNA polymerase promoters. Constructions containing the coding sequence for the green fluorescent protein (GFP) downstream of the selected mutant T7 RNA polymerase promoters were made and inserted into T7 RNA polymerase-expressing cells. Induction of T7 RNA polymerase activity was done in vivo for 2 hours, just as was done for the expression at the time of mini-monomer RNA production as part of the mutant promoter activity assay. Protein was extracted and run on a SDS-polyacrylamide gel, transferred to a PVDF membrane, and an immunoblot was done with anti-GFP antibodies. The gel was scanned and the area under the peak of detected protein was estimated with the image analysis software package, ImageJ. See, e.g., Rasband, W. S., ImageJ, U. S. National Institutes of Health, Bethesda, Md., USA, http://imagej.nih.gov/ij/, 1997-2016. A comparison of the ratio of transcription and the amount of protein produced by the mutant and wildtype T7 RNA polymerase promoters is shown. This comparison shows good agreement for the first two selected promoters, but deviates somewhat for the last three. It is likely that this is due to the narrow linear range of immunoblots.

Figure 23:
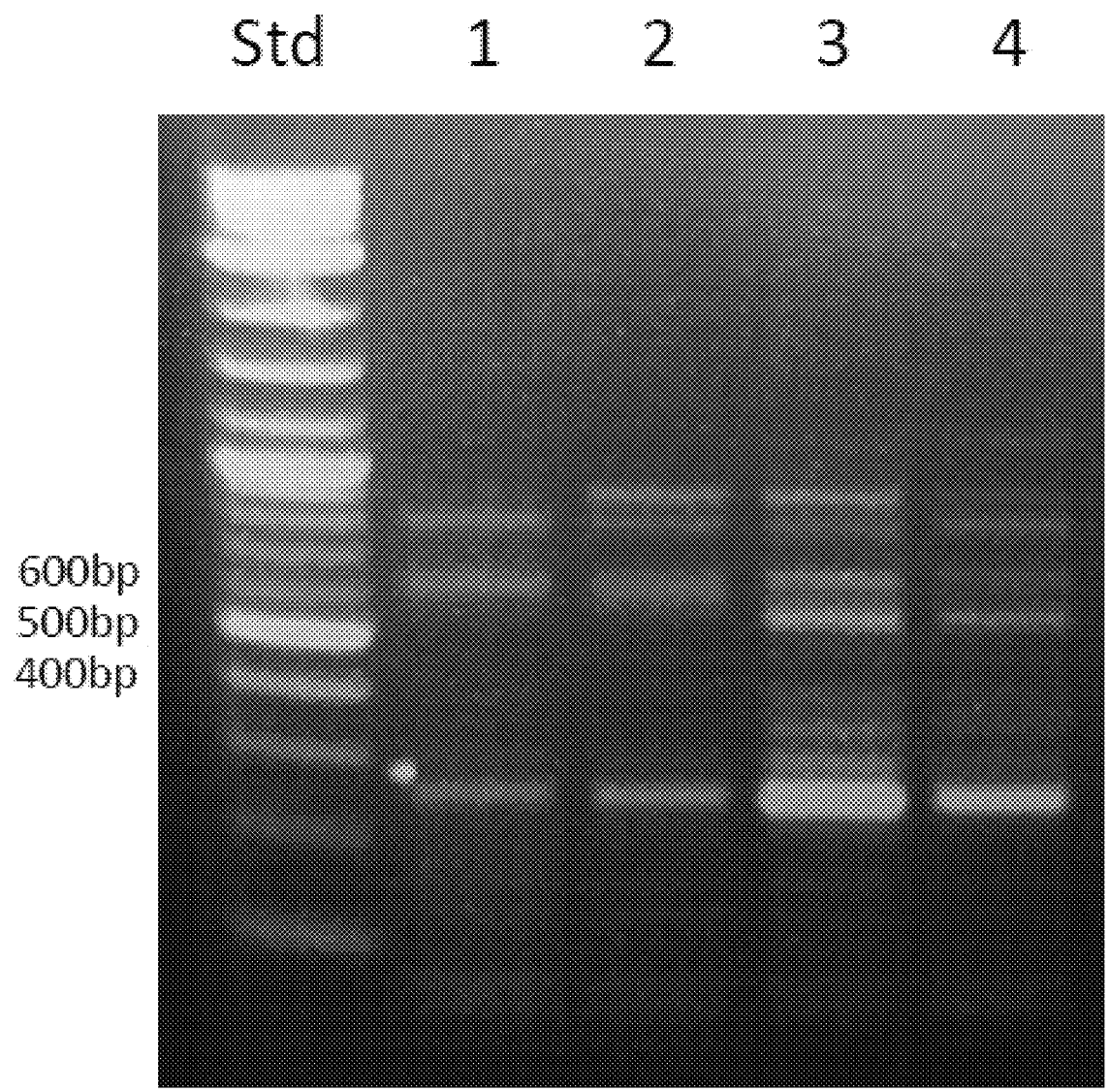

FIG. 23 illustrates RT-PCR of mini-monomer RNAs from yeast constructs containing either the known yeast (*Saccharomyces cerevisiae*) TEF promoter or a fragment of the GFP gene in a yeast 2 micron vector containing a mini-monomer cassette. Extracted yeast total RNA was extracted, reverse transcribed and subjected to 35 cycles of PCR with primers 1 and 2 (e.g., reverse and forward primer annealing polynucleotides, respectively). The appropriate sized fragment should be 595 base pairs long. This band is only seen in the RNA samples from the yeast containing the TEF promoter in the mini-monomer cassette. Lanes: (Std) 2-Log DNA ladder from New England Biolabs; (1) Total yeast RNA from mini-monomer construct containing the GFP coding sequence; (2) Duplicate total yeast RNA from mini-monomer construct containing the GFP coding sequence; (3) Total yeast RNA from mini-monomer construct containing the known yeast TEF promoter; (4) Duplicate total yeast RNA from mini-monomer construct containing the known yeast TEF promoter.

Figure 24:
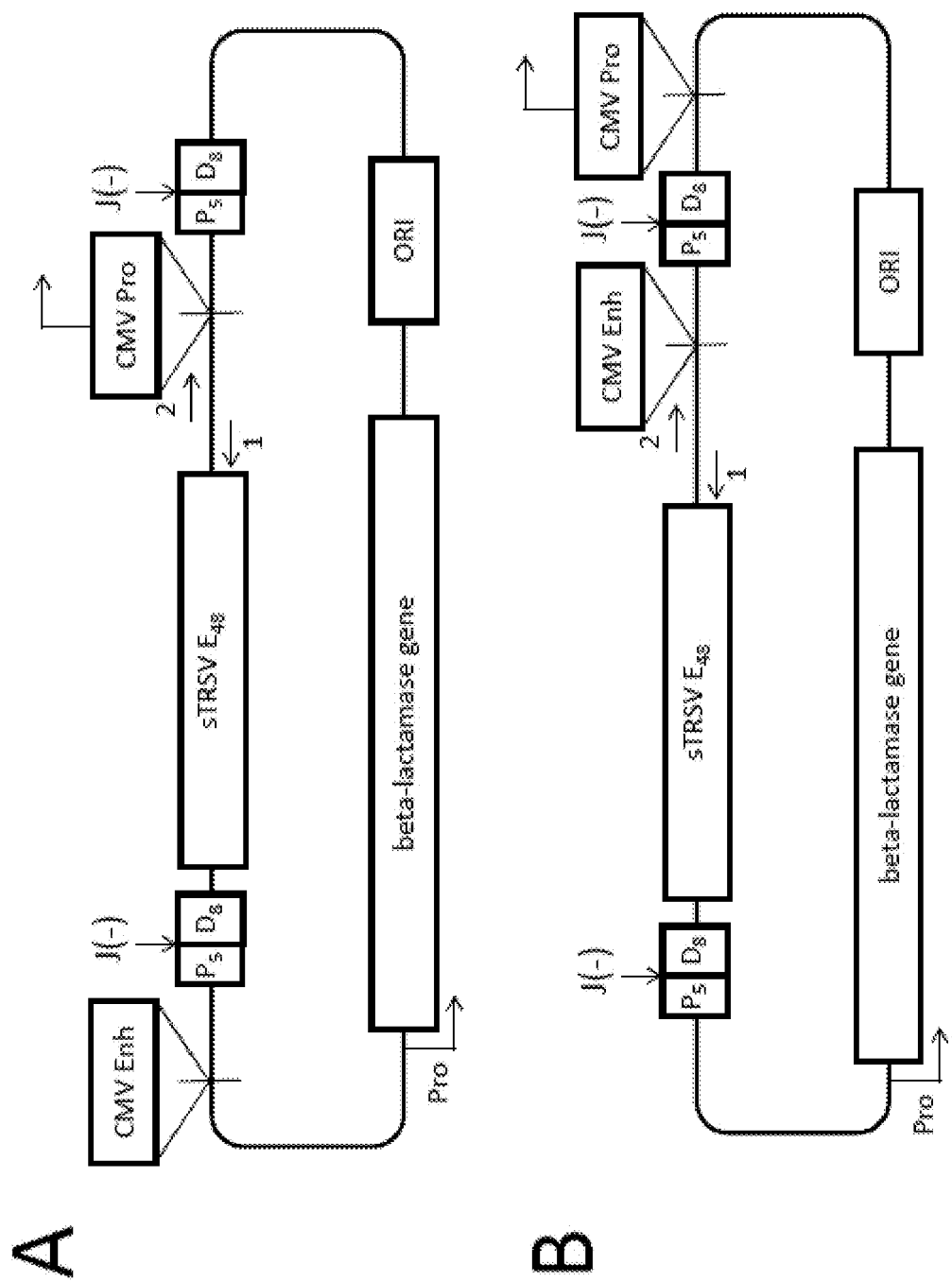

FIGS. 24A-B. (A) Construct for recovery of CMV Pro sequences after mini-monomer circularization. Enhancer function provided by upstream CMV Enh sequence. (B) Construct for recovery of CMV Enh sequences after mini-monomer circularization. Core promoter function provided by downstream CMV Pro sequence.

Figure 25:
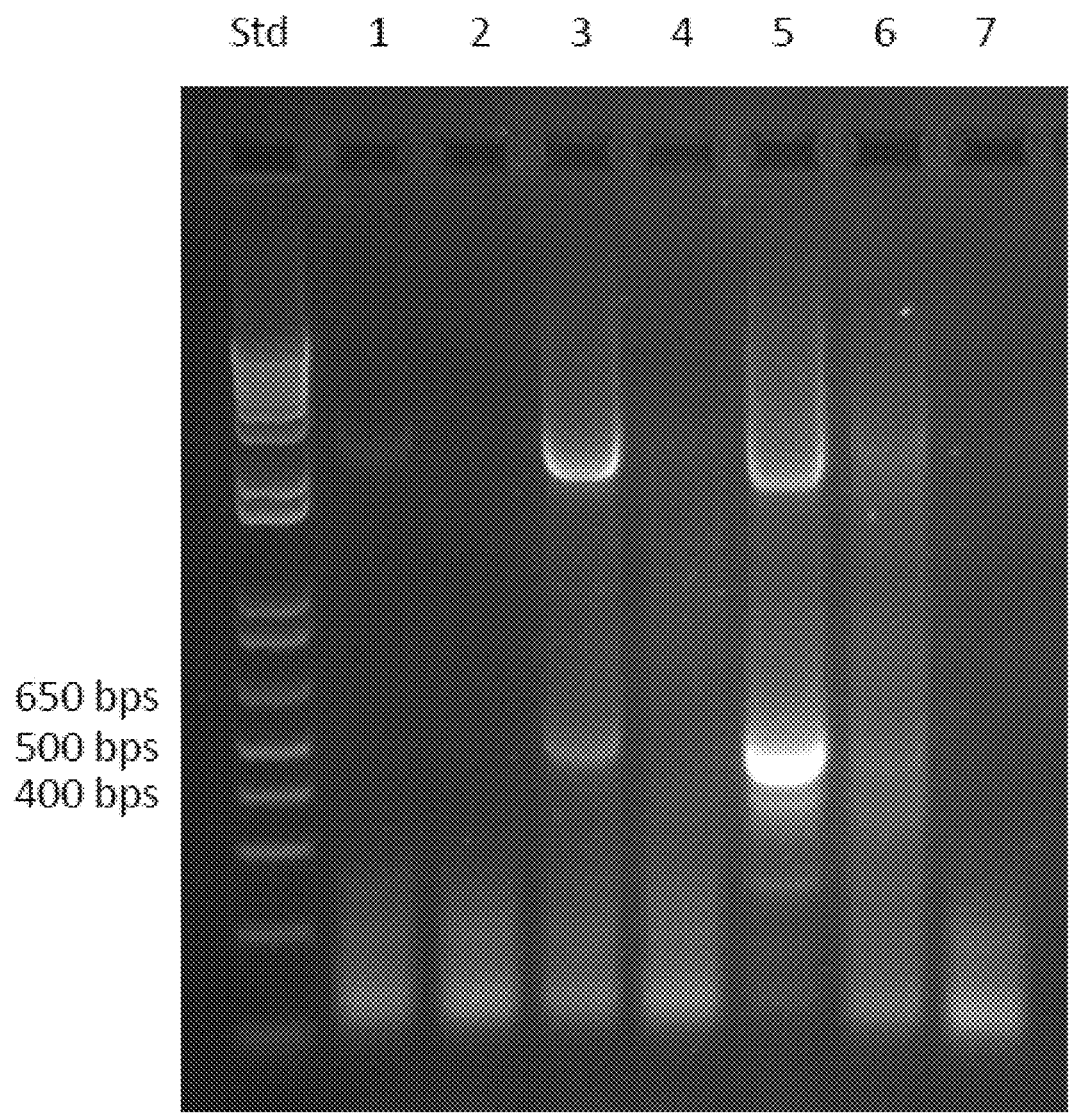

FIG. 25 illustrates RT-PCR of mini-monomer RNAs containing either the CMV core promoter or the CMV enhancer within a mini-monomer cassette transfected into Chinese Hamster Ovary (CHO) cells. Total RNA was extracted, reverse transcribed and subjected to 35 cycles of PCR with primers 1 and 2 (e.g., reverse and forward primer annealing polynucleotides, respectively). The appropriate sized fragments should be 432 and 560 base pairs long respectively. The bands are only seen in the RNA samples containing the appropriate construct Lanes: (Std) 1 Kb+DNA ladder from New England Biolabs; (1) Total CHO RNA from transfection reagent only without DNase treatment on the column; (2) Total CHO RNA from transfection reagent only with DNase treatment on the column; (3) Total CHO RNA from transfection reagent and CMV Enh mini-monomer construct without DNase treatment on the column; (4) Total CHO RNA from transfection reagent and CMV Enh mini-monomer construct with DNase treatment on the column; (5) Total CHO RNA from transfection reagent and CMV Pro mini-monomer construct without DNase treatment on the column; (6) Total CHO RNA from transfection reagent and CMV Pro mini-monomer construct with DNase treatment on the column; (7) PCR negative control (no added cDNA). Residual DNase seems to be present in treated samples as evidenced by the reduction in the expected band intensity.

DETAILED DESCRIPTION

1. Introduction

Provided are constructs designed for cloning of either prokaryotic, eukaryotic or random nucleotide DNA fragments within a self-cleaving and circularizing derivative of a ribozyme catalytic core of the (-) strand of the satellite RNA (e.g., tobacco ringspot virus (sTRSV)) in a small circular DNA plasmid that allows production of longer than unit length RNAs when the cloned fragment contains a promoter sequence. Ribozyme cleavage and circularization of said longer than unit length RNAs allows for recovery of the promoter containing sequences by reverse transcriptase-polymerase chain reaction (RT-PCR) either before or after purification of the now smaller RNA circles. The constructs facilitate the easy selection of desired polynucleotides (e.g., functional promoters, RNA stability modifiers, transcriptional modifiers) within DNA fragments with a natural selection by the amount of circular RNA produced of promoters based on their respective abilities to produce RNA.

Employing straightforward methods, desired sequences can be identified and recovered in a short time period. As desired, functional promoters, RNA stability modifying sequences and transcriptional modifying sequences can be directly recovered without the need to have or determine upstream sequences as is the case where promoters are found indirectly by cloning expressed sequence tags (ESTs). Promoters, RNA stability modifying sequences and transcriptional modifying sequences can be found in the DNA from any eukaryotic organism or can be found among random DNA sequences thus obviating the need to use promoters from heterologous organisms. Promoters, RNA stability modifying sequences and transcriptional modifying sequences can be recovered either from in vivo expression or in vitro expression systems. Randomization of identified promoters, RNA stability modifying sequences and transcriptional modifying sequences can be easily done to increase or decrease promoter/modifier strength. Using deep sequencing of recovered reverse transcriptase-polymerase chain reaction (RT-PCR) products, the relative strength of the population of promoters/modifiers recovered is naturally related to the fraction of the total each sequence represents.

2. Constructs/DNA Plasmids

The constructs described herein are generally synthetic and/or recombinant. The constructs can be comprised wholly of naturally occurring nucleic acids, or in certain embodiments can contain one or more nucleic acid analogues or derivatives. The nucleic acid analogues can include backbone analogues and/or nucleic acid base analogues and/or utilize non-naturally occurring base pairs. Illustrative artificial nucleic acids that can be used in the present constructs include, without limitation, nucleic backbone analogs peptide nucleic acids (PNA), morpholino and locked nucleic acids (LNA), bridged nucleic acids (BNA), glycol nucleic acids (GNA) and threose nucleic acids (TNA). Nucleic acid base analogues that can be used in the present constructs include, without limitation, fluorescent analogs (e.g., 2-aminopurine (2-AP), 3-Methylindole (3-MI), 6-methyl isoxanthopterin (6-MI), 6-MAP, pyrrolo-dC and derivatives thereof, furan-modified bases, 1,3-Diaza-2-oxophenothiazine (tC), 1,3-diaza-2-oxophenoxazine); non-canonical bases (e.g., : inosine, thiouridine, pseudouridine, dihydrouridine, queuosine and wyosine), 2-aminoadenine, thymine analogue 2,4-difluorotoluene (F), adenine analogue 4-methylbenzimidazole (Z), isoguanine, isocytosine; diaminopyrimidine, xanthine, isoquinoline, pyrrolo[2,3-b]pyridine; 2-amino-6-(2-thienyl)purine, pyrrole-2-carbaldehyde, and universal bases (e.g., 2' deoxyinosine (hypoxanthine deoxynucleotide) derivatives, nitroazole analogues). Non-naturally occurring base pairs that can be used in the present constructs include, without limitation, isoguanine and isocytosine; diaminopyrimidine and xanthine; 2-aminoadenine and thymine; isoquinoline and pyrrolo[2,3-b]pyridine; 2-amino-6-(2-thienyl)purine and pyrrole-2-carbaldehyde; two 2,6-bis(ethylthiomethyl)pyridine (SPy) with a silver ion; pyridine-2,6-dicarboxamide (Dipam) and a mondentate pyridine (Py) with a copper ion.

a. For Identification of Functional Promoter Sequences

Generally, constructs useful for the screening and identification of functional promoter sequences comprise a mini-monomer cassette in a minimal DNA plasmid backbone having an origin of replication and, optionally, an expression cassette for a selection gene. A specific illustration and polynucleotide sequence of a DNA plasmid useful for the screening and identification of functional promoter sequences is provided in FIGS. 1 and 2A-E.

Components of the mini-monomer cassette within the ribozyme cleavage sites—e.g., the multiple cloning site (MCS) with or without insert, the reverse and forward primer annealing sites, the ribozyme catalytic core—can be arranged in any number of several possible ways, with the following considerations:

1. The mini-monomer cassette is flanked by two ribozyme cleavage sites;
2. Primer 1 (reverse primer) is positioned upstream or 5' to primer 2 (forward primer); and
3. The RT-PCR product made by reverse transcription with primer 1 followed by PCR with primers 1 and 2 of the circular RNA made after transcription, cleavage and ligation includes the MCS with insert.

Figure 1:
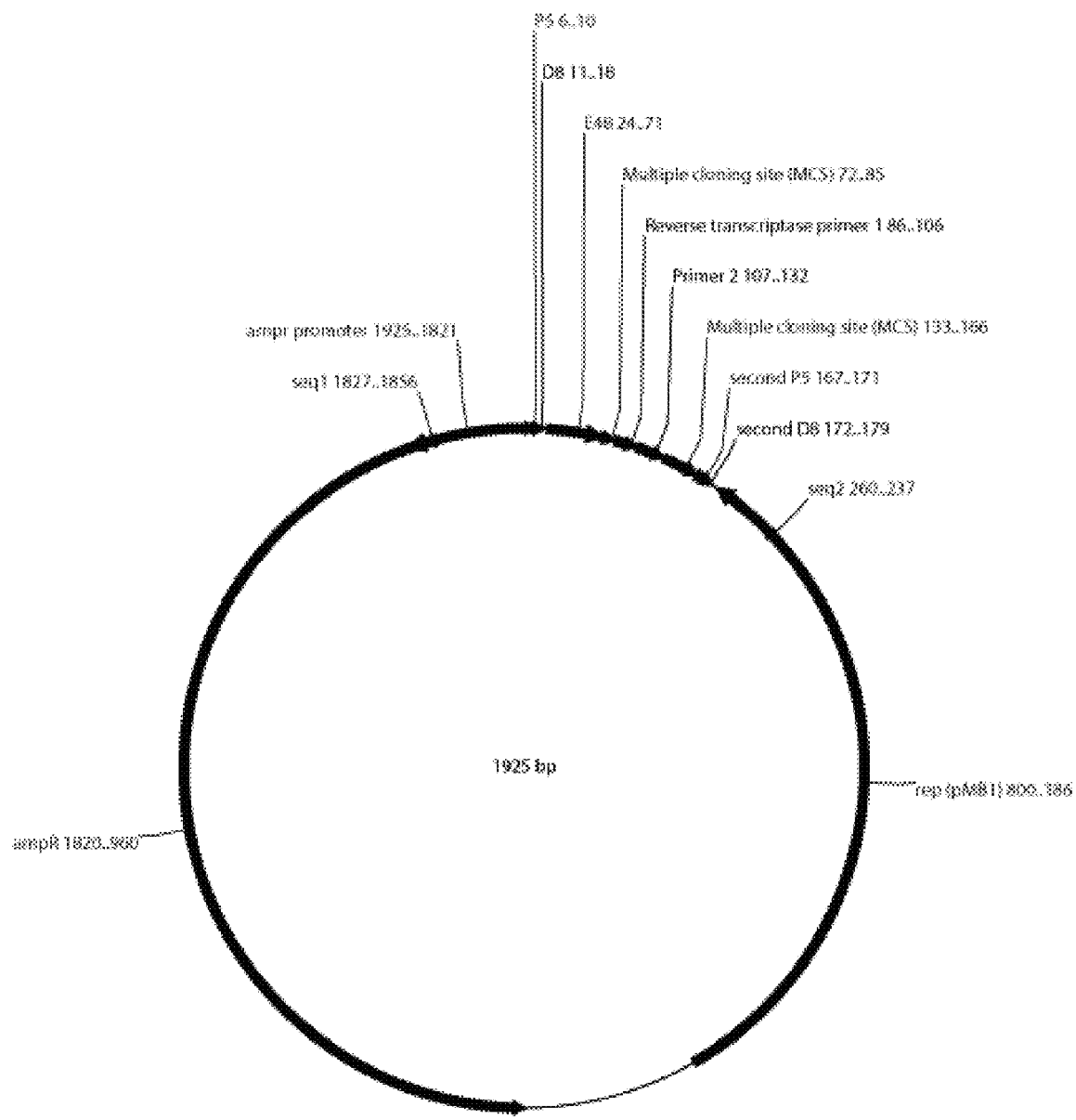
FIG. 1 illustrates a schematic of a vector map for a plasmid useful for screening for promoters.
Figure 3:
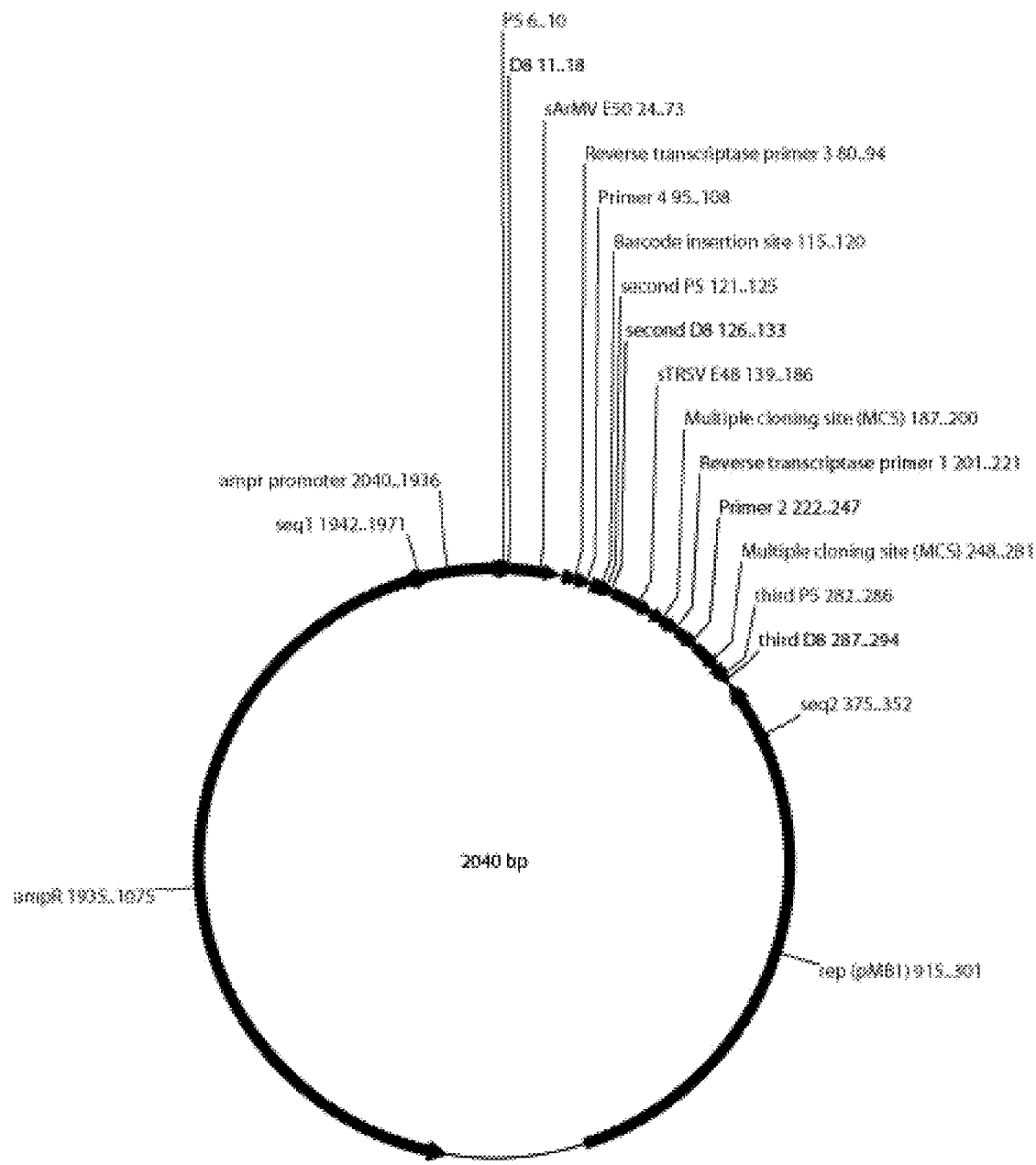
FIG. 3 illustrates a schematic of a vector map for a plasmid useful for screening for RNA stability modifiers and/or transcription modifiers.
Figure 5:
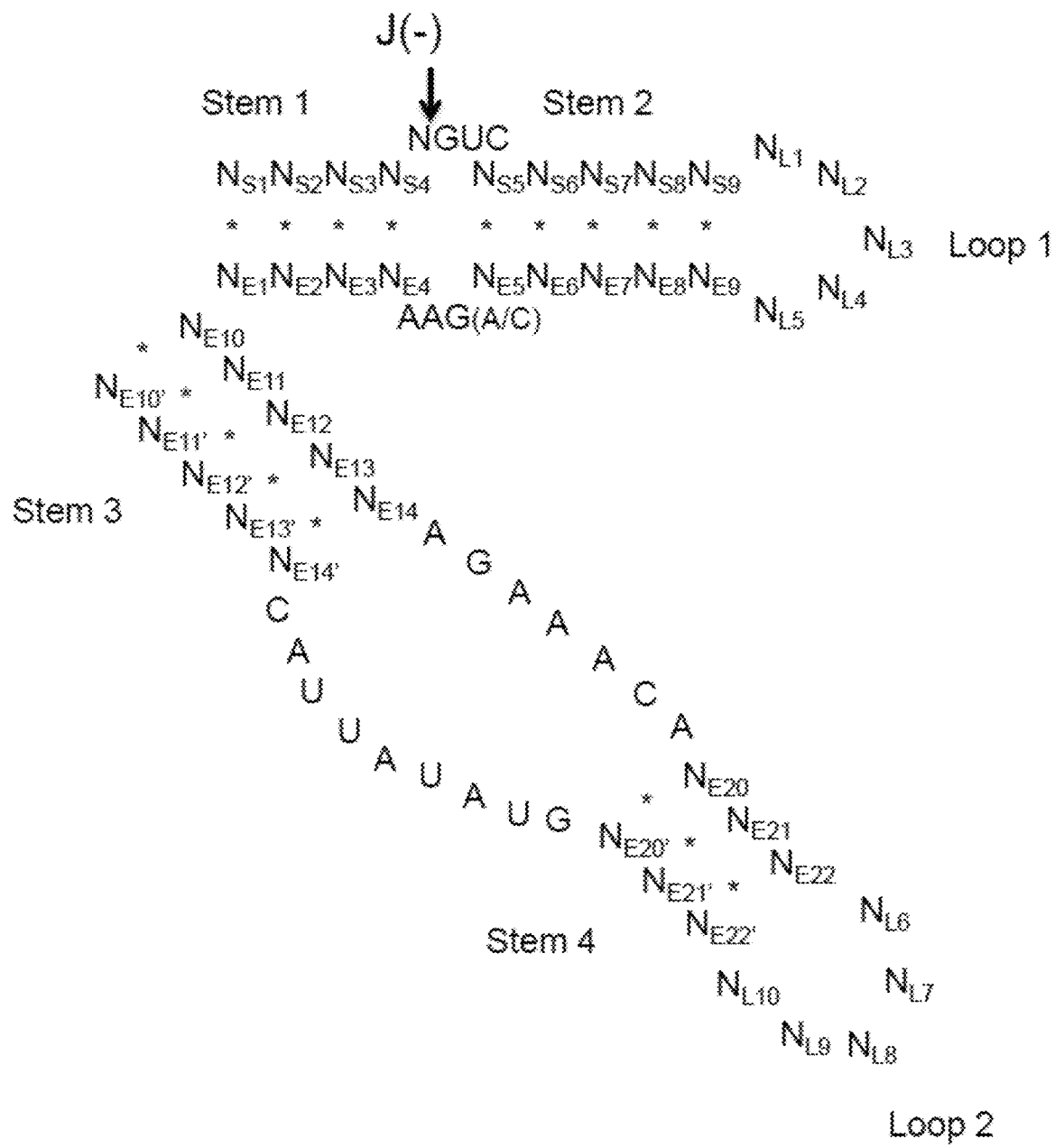
FIG. 5 illustrates a depiction of a generalized structure of the P-D regions and ribozyme core regions and their interactions.

Further, the ribozyme catalytic core can be separated at loop 2 (see, the bottom of stem 4 in FIG. 5). Several illustrative arrangements of the primers, ribozyme core and MCS with insert are depicted in FIGS. 16-18. In the arrangements depicted in FIGS. 16A-F, the reverse and forward primer annealing sites (e.g., primer 1 and primer 2) are adjacent to or abut each other. In the arrangements depicted in FIGS. 17A-B, the reverse and forward primers 1 and 2 are flanking the ribozyme core. A PCR product made with the constructs of FIGS. 17A-B would not recover or amplify the ribozyme core sequence.

Further, the MCS with or without insert and/or the forward and/or reverse primer annealing sites can be inserted into loop 2 at the bottom of stem 4 of FIG. 5. The ribozyme can be opened and/or expanded at loop 2 and still retain activity. FIGS. 18A-F illustrates arrangements wherein the ribozyme core is split or expanded at loop 2 into a left half (L-sTRSV $E_{48}$) and a right half (R-sTRSV $E_{48}$). FIGS. 18E-F depicts the reverse and forward primer annealing sites separated by either the left half of the ribozyme core or the right half of the ribozyme core, respectively. Again, a PCR product made with primer annealing sites that straddle entirely or partially the ribozyme core will not recover or amplify either the entire or partial ribozyme core polynucleotide sequence, respectively.

In an embodiment prior to the insertion of a polynucleotide suspected of containing a functional promoter, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a multiple cloning site polynucleotide comprising plurality of restriction endonuclease cleavage sites; and (iii) a reverse primer annealing polynucleotide (e.g., for PCR or RT-PCR) located upstream or 5' to a forward primer annealing polynucleotide (e.g., for PCR or RT-PCR); and (b) a plasmid backbone, comprising an origin of replication. Illustrative ordering or relative positioning of the ribozyme catalytic core; the multiple cloning site, the reverse primer annealing polynucleotide, and the forward primer annealing polynucleotide can be as depicted in FIGS. 6, 7, 16, 17 and/or 18. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a multiple cloning site polynucleotide comprising plurality of restriction endonuclease cleavage sites, a reverse primer annealing polynucleotide and a forward primer annealing polynucleotide (e.g., for PCR or RT-PCR); and (iv) a second ribozyme cleavage site; and (b) a plasmid backbone, comprising an origin of replication. In some embodiments, the plasmid backbone further comprises an expression cassette encoding a selection marker.

In an embodiment of the construct containing a polynucleotide suspected of containing a functional promoter, the DNA plasmid comprises operably linked polynucleotides encoding: (a) a mini-monomer cassette, comprising a first ribozyme cleavage site and a second ribozyme cleavage site, and comprising between the first ribozyme cleavage site and the second ribozyme cleavage site: (i) a ribozyme catalytic core; (ii) a reverse primer annealing polynucleotide; (iii) a forward primer annealing polynucleotide; and (iv) an inserted polynucleotide suspected of comprising a promoter; and (b) a plasmid backbone, comprising an origin of replication. Illustrative ordering or relative positioning of the ribozyme catalytic core; the multiple cloning site containing the insert, the reverse primer annealing polynucleotide, and the forward primer annealing polynucleotide can be as depicted in FIGS. 6, 7, 16, 17 and/or 18. In some embodiments, the DNA plasmid comprises operably linked polynucleotides encoding: (a) a mini-monomer cassette, comprising in the 5' to 3' direction: (i) a first ribozyme cleavage site; (ii) a ribozyme catalytic core; (iii) a reverse primer annealing polynucleotide; (iv) a forward primer annealing polynucleotide; (v) an inserted polynucleotide suspected of comprising a promoter; (vi) a second ribozyme cleavage site; (b) a plasmid backbone, comprising an origin of replication. In some embodiments, the plasmid backbone further comprises an expression cassette encoding a selection marker.

i. Ribozyme Catalytic Core

The constructs or DNA plasmids described herein can comprise any functional ribozyme catalytic core capable of being circularized by ribozyme or enzymatic function. Enzymatic circularization can also work in cases where the reverse transcription reaction bypasses the ligation site. Illustrative ribozyme catalytic cores of use include, e.g., the hammerhead ribozyme, the hepatitis delta positive strand ribozyme, the hepatitis delta negative strand ribozyme, the Neurospora Varkud Satellite ribozyme, or group I or group II self-processing intron-derived ribozymes.

In varying embodiments, the ribozyme catalytic core is a hairpin ribozyme catalytic core. The hairpin ribozyme catalytic core polynucleotides of use are capable of self-cleaving itself and flanking sequences within ribozyme cleavage sites out of the context of a longer polynucleotide sequence and then ligating the excised polynucleotide into a circularized polynucleotide. In varying embodiments, the hairpin ribozyme catalytic core can be derived from a naturally occurring source. For example, Rubino, et al, *J Gen Virol* (1990) 71:1897-1903 describes examples of naturally-derived and consensus sequences of ribozyme catalytic core polynucleotides. In varying embodiments, the ribozyme catalytic core is or is derived from the negative strand self-cleavage domain (e.g., a hairpin ribozyme catalytic core) of a plant virus satellite RNA, e.g., the satellite RNA of tobacco ringspot virus (sTRSV), the satellite RNA of arabis mosaic virus (sArMV), and the satellite RNA of chicory yellow mottle virus (sCYMV). In varying embodiments, the ribozyme catalytic core is or is derived from the negative strand self-cleavage domain of a satellite RNA of the plant virus tobacco ringspot virus (sTRSV). In some embodiments, the ribozyme catalytic core polynucleotide is a synthetic sequence, e.g., based on naturally occurring or consensus ribozyme catalytic core sequences. The general structure for a hairpin ribozyme catalytic core is provided in FIG. 5. The structure of hairpin ribozyme catalytic cores are well known in the art, and described, e.g., in Müller, et al., *IUBMB Life*. (2012) 64(1):36-47; Fedor, *J Mol Biol*. (2000) 297(2):269-91; and Ferré-D'Amaré, *Biopolymers*. (2004) 73(1):71-8.

A generalized or consensus negative strand self-cleavage domain (e.g., a hairpin ribozyme catalytic core) is provided in SEQ ID NO: 8. The polynucleotide sequences of illustrative ribozyme catalytic core molecules are provided herein as SEQ ID NOs: 3, 4 and 5. In varying embodiments, the ribozyme catalytic core comprises a polynucleotide sequence having at least about 60% sequence identity, e.g., at least about 65%, 70%, 75%, 80%, 85%, 90%, 91%, 92%, 93%, 94%, 95%, 96%, 97%, 98%, 99% or 100% sequence identity to any one of SEQ ID NOs: 3, 4 or 5.

In varying embodiments, the ribozyme catalytic core can be or can be derived from a circularizing ribozyme. Examples include the Neurospora Varkud Satellite ribozyme ("VS ribozyme") and circularizing group I intron ribozyme (e.g., circularizing introns from Tetrahymena. The structure and sequence of the VS ribozyme is known in the art, and described, e.g., in Bonneau, et al., *Biochemistry* (2014) 53(39):6264-75; Bouchard, et al., *RNA*. (2014) 20(9):1451-64; and Desjardins, et al, *Nucleic Acids Res*. (2011) 39(10): 4427-37. The structure and sequence of circularizing group I intron ribozymes, including circularizing introns from Tetrahymena, are known in the art and described, e.g., in Puttaraju and Been, *Nucl. Acid Res*. (1992), 20:5357-64; Puttaraju and Been, *J Biol Chem* (1996), 271:26081-7, Ford and Ares, *Proc Natl Acad Sci USA* (1994), 91:3117-21. Ribozyme structures and mechanisms are also reviewed in Doherty, et al., *Annu Rev Biochem*. (2000) 69:597-615.

In varying embodiments, ribozyme catalytic cores other than those that naturally have substantial ligation activity could be used to identify promoter and/or transcriptional modifying sequences. In such embodiments constructs can have two functional ribozymes to produce the equivalent of a hairpin ribozyme-derived "mini-monomer" and use enzymatic ligation for formation of circles (e.g., via rolling circle replication) that can then be recovered by RT-PCR. This is shown in FIG. 15.

Figure 15:
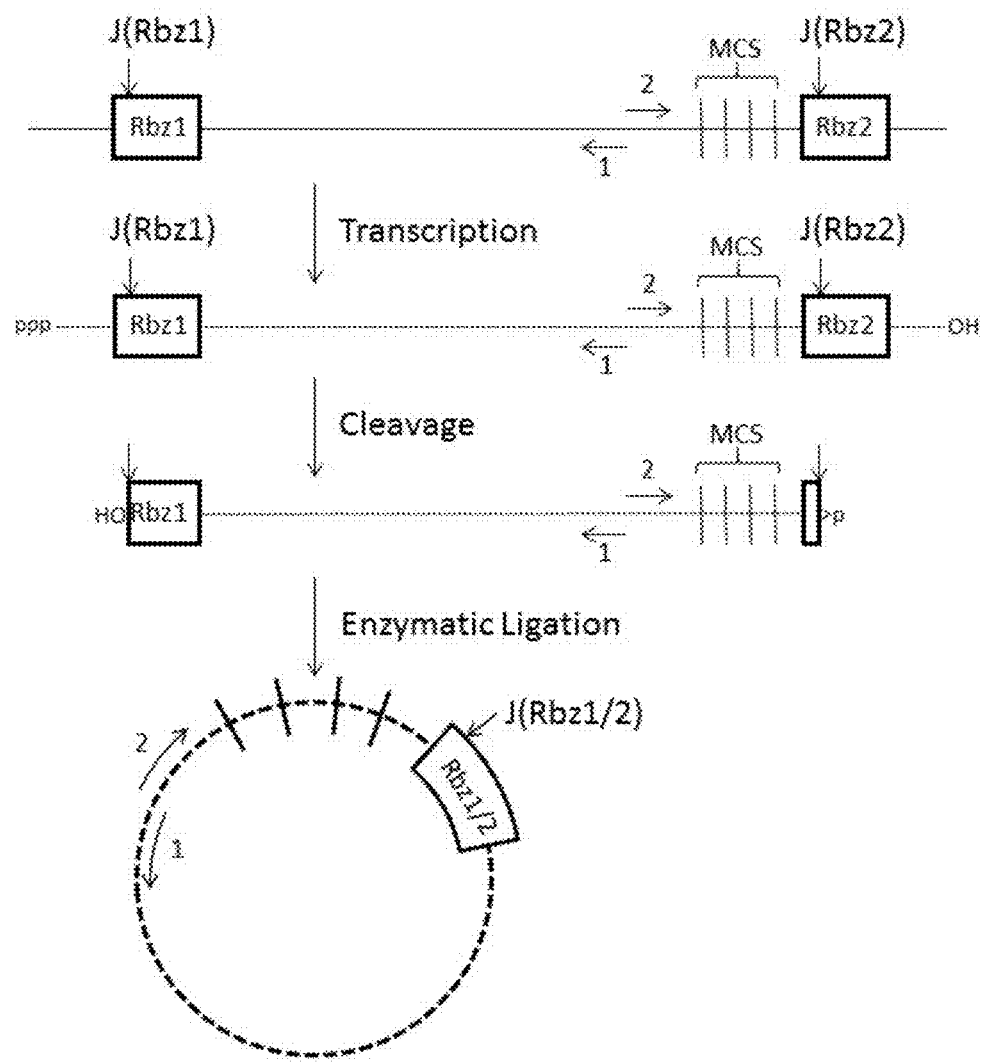
FIG. 15 illustrates an alternative scheme using generic cleaving ribozymes and enzymatic ligation to form circles containing promoter or other transcription/RNA stability modifying sequences. Note that this is just one possible form for circular RNA. The ribozyme catalytic core need not be present within the circular RNA.
Figure 19:
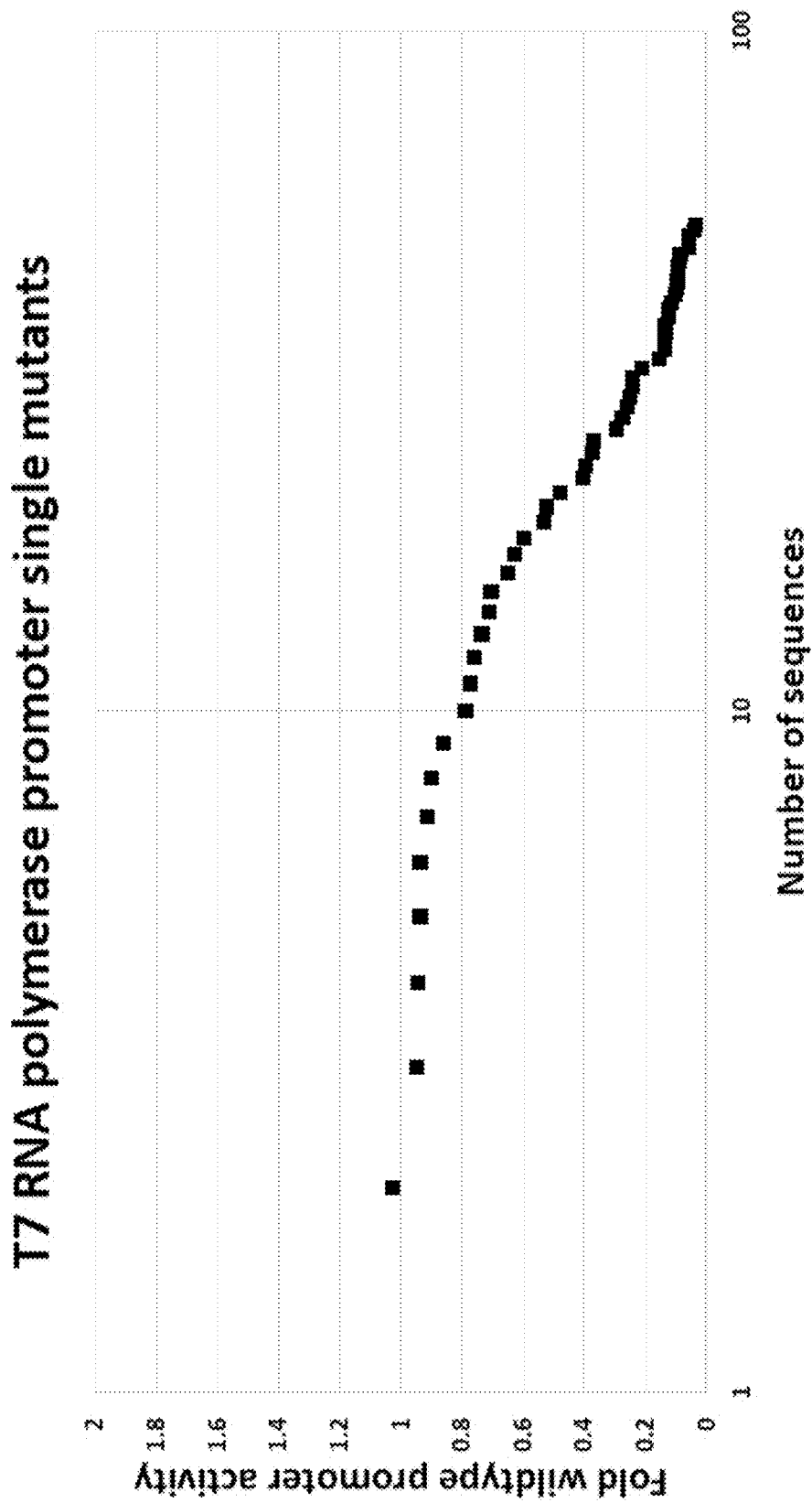
FIG. 19 illustrates the relative in vivo activity of 51 single mutants of the mutated T7 RNA polymerase promoter whose construction is described in Example 4. Mutant promoter activity is shown on the y-axis and is normalized to the wildtype promoter activity as described in Example 4. The single mutants were placed in activity order from highest to lowest relative to wildtype. The number of individual single mutants analyzed is shown on the x-axis. Due to the number of sequences shown, the y-axis is a log axis to compress its length. Of the unique single mutants possible, an analysis of 51 out of the possible 51 is shown (100%).
Figure 20:
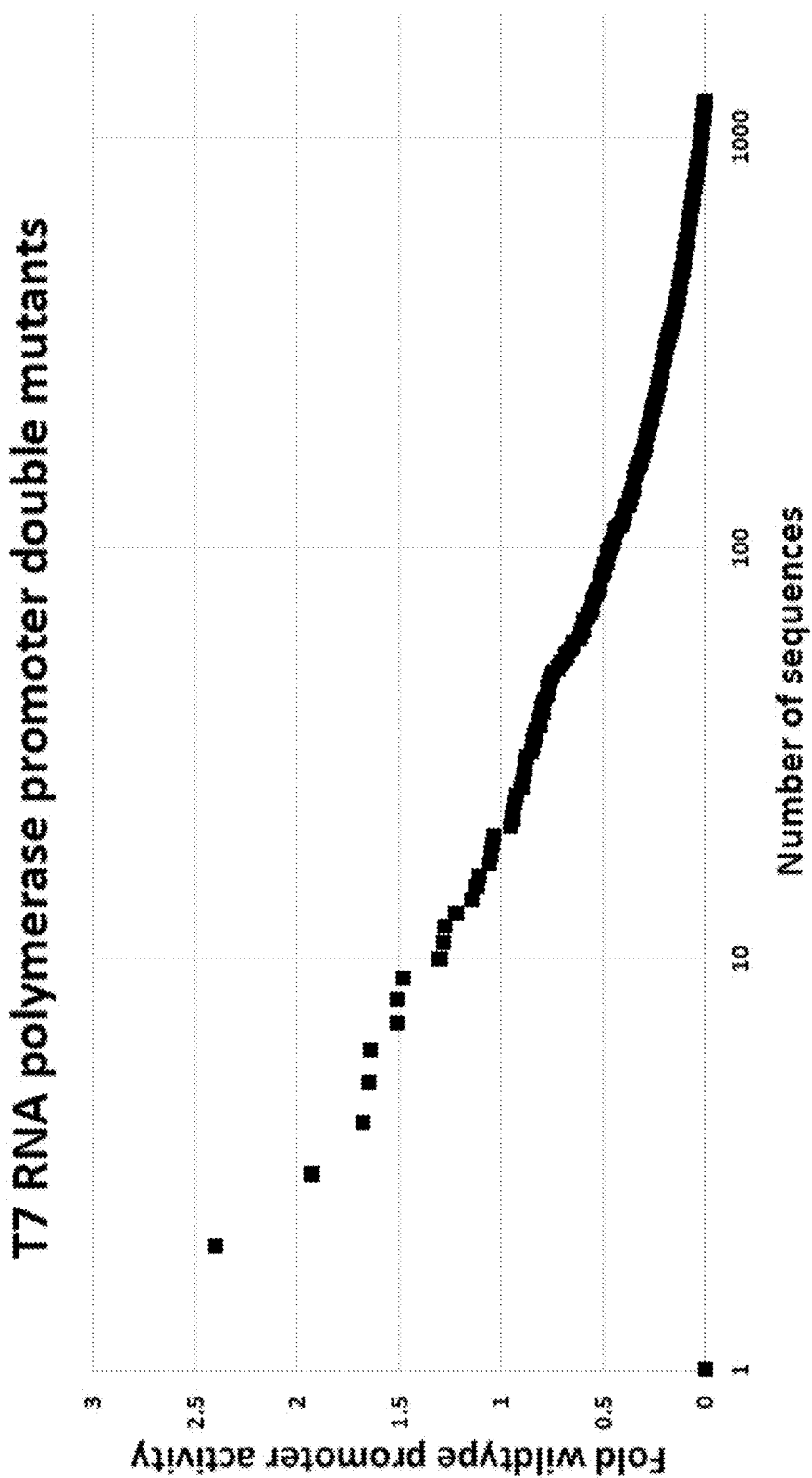
FIG. 20 illustrates the relative in vivo activity of 1223 double mutants of the mutated T7 RNA polymerase promoter whose construction is described in Example 4. Mutant promoter activity is shown on the y-axis and is normalized to the wildtype promoter activity as described in Example 4. The double mutants were placed in activity order from highest to lowest relative to wildtype. The number of individual double mutants analyzed is shown on the x-axis.

In the circular RNA-producing system shown in FIG. 15, the first or upstream ribozyme catalytic core (Rbz 1) can be from any kind of ribozyme, including, e.g., a hairpin ribozyme, a hammerhead ribozyme (e.g., a type III, or a type I hammerhead ribozyme); a hepatitis delta virus (HDV) positive strand ribozyme; or a HDV negative strand ribozyme. In various embodiments, the construct is designed with the first or upstream ribozyme catalytic core positioned or located 5' relative to the first or upstream ribozyme cleavage site (depicted as J(Rbz1)). In the circular RNA-producing system depicted in FIG. 15, the second or downstream ribozyme catalytic core (Rbz 2) also can be from any kind of ribozyme including, e.g., a hairpin ribozyme, a hammerhead ribozyme (e.g., a type III, or a type I hammerhead ribozyme); a HDV positive strand ribozyme; or a HDV negative strand ribozyme. In varying embodiments, the construct is designed with the second or downstream ribozyme catalytic core positioned or located 3' relative to the second or downstream ribozyme cleavage site (depicted as J(Rbz2)). Any ribozyme that leaves a hydroxyl group at the 5'-end and/or a 2':3' cyclic phosphodiester bond at the 3'-end can be used. The requirements for these terminal structures for enzymatic ligation would make type I or type II self-splicing intron-derived ribozyme inappropriate. The secondary structure of the cleaved RNA that forms the circular RNA is circularized most efficiently if the 5' and 3' ends are juxtaposed such that they are within a short distance—e.g., less than 5 nucleotides apart at the 3' and 5' ends of stable stems—of each other in stable secondary structures.

Accordingly, in varying embodiments, the ribozyme catalytic core can be or can be derived from a hammerhead ribozyme. The minimal hammerhead sequence required for the self-cleavage reaction includes approximately 13 conserved or invariant "core" nucleotides, most of which are not involved in forming canonical Watson-Crick base-pairs. The core region is flanked by Stems I, II and III, which are in general made of canonical Watson-Crick base-pairs but are otherwise not constrained with respect to sequence. Functionally, a hammerhead ribozyme performs a chemical reaction that results in the breakage of the substrate strand of RNA, specifically at C17, the cleavage-site nucleotide. Structurally, the hammerhead ribozyme is composed of three base paired helices, separated by short linkers of conserved sequences. These helices are called I, II and III. Hammerhead ribozymes can be classified into three types based on which helix the 5' and 3' ends are found in. If the 5' and 3' ends of the sequence contribute to stem I then it is a type I hammerhead ribozyme, to stem II is a type II and to stem III then it is a type III hammerhead ribozyme. In varying embodiments, the first and 5'-most hammerhead ribozyme catalytic core can be a Type I, Type II, Type III, HH9 and HH10 hammerhead ribozyme catalytic core. The structure and function of hammerhead ribozymes is well-characterized in the art, and has been reviewed in, e.g., Scott, et al., Prog Mol Biol Transl Sci. (2013) 120:1-23; Lee, et al., Prog Mol Biol Transl Sci. (2013) 120:25-91; and Hammann, et al., RNA. (2012) 18(5):871-85.

In varying embodiments, the second ribozyme catalytic core can be or can be derived from a positive or negative strand hepatitis delta virus (HDV) ribozyme catalytic core or a ribozyme catalytic core from a member of the HDV family. The structure of hepatitis delta virus (HDV) and HDV family members are known in the art. See, e.g., Riccitelli, et al., Prog Mol Biol Transl Sci. (2013) 120:123-71; Kapral, et al., Nucleic Acids Res. (2014) 42(20): 12833-46.

ii. Ribozyme Cleavage Sites

The ribozyme cleavage sites can be any polynucleotide sequence capable of being cleaved by a ribozyme. A generalized or consensus ribozyme is provided in SEQ ID NO: 7. As depicted in FIG. 5, the sequence and structure of the ribozyme cleavage sites are guided by the polynucleotide sequence of the ribozyme catalytic core. Interactions between the ribozyme cleavage site (as generalized in SEQ ID NO: 7) and the negative strand self-cleavage domain (as generalized in SEQ ID NO: 8) are via hydrogen bonds forming two stems—1 and 2 (as depicted in FIG. 5).

Stem 1 is formed by hydrogen bonds between NS1 and NE1, NS2 and NE2, NS3 and NE3, NS4 and NE4

Stem 2 is formed by hydrogen bonds between NS5 and NE5, NS6 and NE6, NS7 and NE7, NS8 and NE8, NS9 and NE9

Interactions within the generalized negative strand self-cleavage and ligation domain form 2 stems—3 and 4

Stem 3 is formed by hydrogen bonds between NE10 and NE10', NE11 and NE11', NE12 and NE12', NE13 and NE13', NE14 and NE14'

Stem 4 is formed by hydrogen bonds between NE20 and NE20', NE21 and NE21', and NE22 and NE22'

Stem 1 is essentially universally 4 base pairs long

Stem 2 can be as short as 4 base pairs, but can be longer

Stem 3 is essentially universally 5 base pairs long

Stem 4 is from 2 to 4 base pairs long depending on the source

Loop 1 can be as small as 4 nucleotides, if it is a special sequence called a tetra-loop, but can be longer, e.g., 100's of nucleotides up to 1000 nucleotides Loop 2 varies from 4 to 6 bases long in natural sequences The polynucleotide sequences of an illustrative ribozyme cleavage site is provided herein as SEQ ID NO: 6. In varying embodiments, the ribozyme cleavage site a polynucleotide sequence having at least about 60% sequence identity, e.g., at least about 65%, 70%, 75%, 80%, 85%, 90%, 91%, 92%, 93%, 94%, 95%, 96%, 97%, 98%, 99% or 100% sequence identity to SEQ ID NO: 6.

Generally, the polynucleotide sequences of the first and second ribozyme cleavage sites are the same.

iii. Multiple Cloning Site (MCS)

Test polynucleotides (e.g., polynucleotides suspected of encoding a functional promoter, a RNA stability modifying sequence or a transcriptional modifying sequence) are cloned into a multiple cloning site (MCS), which comprises two or more sites or sequences subject to restriction endonuclease cleavage. The positioning of the MCS and the forward and reverse primer annealing sequences (e.g., for PCR or RT-PCR) can vary in the present constructs or DNA plasmids. In varying embodiments, both the forward and reverse primer annealing sequences (e.g., for PCR or RT-PCR) are positioned 5' to the MCS. In varying embodiments, one or both of the forward and reverse primer annealing sequences (e.g., for PCR or RT-PCR) are positioned within the MCS (e.g., as depicted in FIGS. 1 and 2A-E). The MCS is located within the first and second (or upstream and downstream) ribozyme cleavage sites, but can be positioned 5' or 3' to the ribozyme catalytic core, embedded within loop 2 of the ribozyme catalytic core, and/or 5' or 3' to one or both of the reverse and forward primer annealing sites. In varying embodiments, the MCS with the insert is not positioned or located between the reverse and forward primer annealing sites. Various illustrative configurations of the components in the mini-monomer cassette are depicted in FIGS. 6, 7, 16, 17 and 18. In varying embodiments, both the forward and reverse primer annealing sequences (e.g., for PCR or RT-PCR) are positioned 3' to the MCS. In varying embodiments, both the forward and reverse primer annealing sequences (e.g., for PCR or RT-PCR) are positioned 5' to the MCS. In varying embodiments, the MCS is positioned within the mini-monomer cassette, located 3' to the ribozyme catalytic core and 5' to the second ribozyme cleavage site. In varying embodiments, the MCS is positioned within the mini-monomer cassette, located 5' to the ribozyme catalytic core and 3' to the first ribozyme cleavage site. See, e.g., FIGS. 6, 7, 16, 17 and 18.

iv. Forward and Reverse Primer Annealing Polynucleotide (e.g., for PCR or RT-PCR)

The forward and reverse primer annealing polynucleotides (e.g., for PCR or RT-PCR) are each unique sequences in the constructs or DNA plasmids and can abut each other or can be located proximally to each other (e.g., within about 500, 400, 300, 200, or 100 nucleotides from one another) with the reverse primer annealing polynucleotide (e.g., for PCR or RT-PCR) positioned 5' to the forward primer annealing polynucleotide (e.g., for PCR or RT-PCR). The forward and reverse primer annealing polynucleotides (e.g., for PCR or RT-PCR) are positioned or located such that the reverse primer annealing nucleotide (e.g., primer 1) is upstream or 5' relative to the forward primer annealing nucleotide (e.g., primer 2) and both reverse and forward primer annealing nucleotides are between the two ribozyme cleavage sites (e.g., the P-D regions) so they are excised as part of the mini-monomer cassette, and they face each other across the P-D region formed from ribozyme cleavage at the first and second P-D regions (or second and third P-D regions) followed by ribozyme ligation. The PCR product they make contains the insert region. Depending on the positioning of the reverse and forward primer annealing polynucleotides relative to the ribozyme catalytic core, the PCR product may include all of the ribozyme catalytic core, a partial polynucleotide of the ribozyme catalytic core, or exclude all of the ribozyme catalytic core. In varying embodiments, the forward and reverse primer annealing polynucleotides (e.g., for PCR or RT-PCR) are positioned such that they abut or are within the MCS. In varying embodiments, the forward and reverse primer annealing polynucleotides (e.g., for PCR or RT-PCR) are positioned within the mini-monomer cassette, located 3' to the ribozyme catalytic core and 5' to or 3' to or within the MCS, and also 5' to the second ribozyme cleavage site. In varying embodiments, the forward and reverse primer annealing polynucleotides (e.g., for PCR or RT-PCR) are positioned within the mini-monomer cassette, located 5' to the ribozyme catalytic core and 3' to or 5' to or within the MCS, and also 3' to the first ribozyme cleavage site. In varying embodiments, one or both of the forward and reverse primer annealing polynucleotides (e.g., for PCR or RT-PCR) are positioned or embedded within loop 2 of the ribozyme catalytic core. See, e.g., FIGS. 6, 7, 16, 17 and 18.

v. Inserted Polynucleotide Suspected of Comprising a Promoter

The inserted polynucleotide suspected of comprising a promoter can be from any source, for example, a randomly generated library, a naturally occurring source (e.g., a genomic library), a chemically synthesized source, a mutagenized known promoter, random polynucleotides, restriction fragments of eukaryotic DNA or prokaryotic DNA, or randomized PCR fragments of eukaryotic DNA or prokaryotic DNA. The inserted polynucleotides suspected of containing a functional promoter within the mini-monomer cassette can be functional in eukaryotes or prokaryotes. This is distinguished from the in vitro control promoter located externally and 5' to the mini-monomer cassette, which is functional in prokaryotic cells, but not eukaryotic cells.

Generally, the polynucleotide suspected of comprising a promoter has from about 50 bp to about 2000 bp, e.g., from about 100 bp to about 1000 bp. In varying embodiments, the polynucleotide suspected of comprising a promoter contains an entire promoter or a partial promoter. Within the inserted or captured polynucleotide suspected of comprising a promoter, the promoter may be centered or located more proximal to the 3' or 5' end. The methods of employing the DNA constructs described herein identify functional promoters, e.g., promoters capable of inducing, directing or promoting transcription, regardless of whether the entire promoter or a partial promoter is captured, or the location of the promoter within the captured insert. In varying embodiments, inserted polynucleotide suspected of comprising a promoter is cloned into the MCS, so therefore is positioned within the mini-monomer cassette, located 3' to the ribozyme catalytic core and 5' to the second ribozyme cleavage site. See, e.g., FIGS. 6 and 7.

vi. Plasmid Backbone for Promoter-Screening Plasmid

In the constructs or DNA plasmids that are designed for screening and identifying functional promoter sequences, the plasmid backbone has minimal features to minimize or reduce the entire size of the plasmid. In varying embodiments, the entire size of the DNA plasmids that are designed for screening and identifying functional promoter sequences is from about 1800 bp to about 3800 bp, e.g., from about 1900 bp to about 2900 bp. Generally, the plasmid backbone comprises an origin of replication and, optionally, an expression cassette for expressing a selection gene. In varying embodiments, the expression cassette for expressing a selection gene is in the antisense orientation from the mini-monomer cassette. In varying embodiments, the expression cassette for expressing a selection gene is in the sense orientation to the mini-monomer cassette. The expression cassette for expressing a selection gene can be either in the antisense or sense orientation. If the selection is being done in eukaryotic cells, the selection gene can be any marker known in the art for selection of a host cell that has been transformed with a desired plasmid. In varying embodiments, the selection marker comprises a polynucleotide encoding a gene or protein conferring antibiotic resistance, heat tolerance, fluorescence, luminescence or rescue of auxotrophic growth for specific amino acids or nucleotides. Such selection markers are well known in the art.

vii. Optional Control Promoter

The constructs or DNA plasmids designed for the screening of promoter sequences can optionally further contain a control promoter. In varying embodiments, the control promoter is a promoter functional in a prokaryotic host cell. Such a promoter is useful as an internal control for in vitro transcription. In some embodiments, the control promoter can be added to the library by PCR. Illustrative promoters functional in a prokaryotic cell of use include without limitation bacteriophage promoters T7, T3 and SP6.

Accordingly, in varying embodiments of the constructs or DNA plasmids designed for screening of promoters a promoter functional in a prokaryotic host cell is positioned 5' of the first ribozyme cleavage site. See, e.g., FIG. 8, lower embodiment.

Transcription of the plasmid library in vitro with a RNA polymerase (e.g., a T7, T3 or SP6 RNA polymerase) followed by RT-PCR with forward and reverse RT-PCR primers and sequencing (e.g., deep sequencing) produces a processing and library bias-controlled sequenced data set for comparison with sequenced data sets derived from internal promoters (e.g., the functional promoter within the test insert polynucleotide).

b. For Identification of RNA Stability/Transcription Modifying Sequences

Generally, constructs useful for the screening and identification of RNA stability/transcription modifying sequences comprise a mini-monomer cassette in a DNA plasmid backbone having an origin of replication, and optionally, an expression cassette for a selection gene. Generally, the plasmid backbones of the constructs useful for RNA Stability/Transcription modifier screening do not have an upper size limit.

Any under or overrepresented sequence may be due to an effect at a distance on the promoter by the insert, which can be functioning as an enhancer or repressor of transcription. Enhancer and repressors can function up to 10 Kb away from a promoter either upstream or downstream. One construct design that takes the effect a potential transcription enhancer or repressor has on a promoter is illustrated in FIGS. 3, 4A-F and 11. A specific illustration and polynucleotide sequence of a DNA plasmid useful for the screening and identification of functional promoter sequences utilizes first and second mini-monomer cassettes. The first mini-monomer cassette comprises a randomized barcode polynucleotide and the second mini-monomer cassette comprises an inserted polynucleotide suspected of comprising a RNA stability/transcription modifying sequence.

In one embodiment, the construct or DNA plasmid containing a polynucleotide suspected of containing a RNA stability/transcription modifying sequence comprises:
(a) a promoter functional in a eukaryotic cell or in a prokaryotic cell;
(b) a mini-monomer cassette, comprising:
 (i) a first ribozyme cleavage site;
 (ii) a ribozyme catalytic core;
 (iii) a reverse primer annealing polynucleotide (e.g., for PCR or RT-PCR);
 (iv) a forward primer annealing polynucleotide (e.g., for PCR or RT-PCR);
 (v) an inserted polynucleotide suspected of comprising a RNA stability modifier or a transcription modifier;
 (vi) a second ribozyme cleavage site;
(c) a plasmid backbone, comprising an origin of replication. In some embodiments, the plasmid backbone further comprises an expression cassette encoding a selection marker.

In one embodiment, the construct or DNA plasmid containing a polynucleotide suspected of containing a RNA stability/transcription modifying sequence comprises:
(a) a test promoter, wherein the test promoter is functional in a eukaryotic cell or in a prokaryotic cell;

(b) a first mini-monomer cassette, comprising:
(i) a first ribozyme cleavage site;
(ii) a first ribozyme catalytic core;
(iii) a first reverse primer annealing polynucleotide (e.g., for PCR or RT-PCR);
(iv) a first forward primer annealing polynucleotide (e.g., for PCR or RT-PCR);
(v) a barcode polynucleotide
(vi) a second ribozyme cleavage site;
(c) a second mini-monomer cassette, comprising:
(i) the second ribozyme cleavage site;
(ii) a second ribozyme catalytic core;
(iii) a second reverse primer annealing polynucleotide (e.g., for PCR or RT-PCR);
(iv) a second forward primer annealing polynucleotide (e.g., for PCR or RT-PCR);
(v) an inserted polynucleotide suspected of comprising a RNA stability modifier or a transcription modifier;
(vi) a third ribozyme cleavage site;
(d) a plasmid backbone, comprising an origin of replication. In some embodiments, the plasmid backbone further comprises an expression cassette encoding a selection marker.

In the constructs or DNA plasmids designed to screen for RNA stability/transcription modifying sequences, the ribozyme catalytic cores, ribozyme cleavage sites, multiple cloning sites, and forward and reverse RT-PCT primer annealing polynucleotide sequences are as described above for the DNA plasmids designed to screen for functional promoter sequences. Distinguished from the promoter screening plasmid, constructs or DNA plasmids designed to screen for RNA stability/transcription modifying sequences have a first mini-monomer cassette containing a barcode polynucleotide, and a second mini-monomer cassette containing an inserted polynucleotide suspected of comprising a RNA stability modifier or a transcription modifier. Further, the plasmid backbone can be minimal, but need not be minimal. A schematic of the constructs or DNA plasmids designed to screen for RNA stability/transcription modifying sequences is provided in FIG. 11. Like the DNA plasmid designed for screening promoters, a 5'-RNA polymerase control promoter (e.g., a promoter functional in a prokaryotic host cell) can optionally be included in the construct to serve as an internal control for in vitro transcription.

The positioning or the ordering of the components in the first and second mini-monomer cassettes, including the MCS (with or without an inserted polynucleotide), the reverse and forward primer annealing sites and the ribozyme catalytic core, can be varied as described above for the mini-monomer cassette in the constructs used to identify promoter sequences. Illustrative variations in the arrangement or positioning of the components between the ribozyme cleavage sites in the first and second mini-monomer cassettes are depicted in FIGS. 16-18. The positioning or the ordering of the components in the first and second mini-monomer cassettes, including the MCS, the reverse and forward primer annealing sites and the ribozyme catalytic core, can be the same or different.

i. First Mini-Monomer Cassette Containing Barcode Polynucleotide

The first mini-monomer cassette is located 5' to the second mini-monomer cassette. The first mini-monomer cassette contains a barcode polynucleotide positioned 3' to a first ribozyme catalytic core and first forward and first reverse primer annealing polynucleotides and 5' to a second ribozyme cleavage site. The barcode polynucleotide comprises a random DNA sequence comprising from about 10 to about 20 N residues, e.g., 10, 11, 12, 13, 14, 15, 16, 17, 18, 19, or 20 N residues. The barcode polynucleotide serves as a unique identifier of a particular DNA plasmid comprising an inserted polynucleotide suspected of comprising a RNA stability modifier or a transcription modifier in the second mini-monomer cassette, and allows tracking of each inserted polynucleotide suspected of comprising a RNA stability modifier or a transcription modifier. The first ribozyme catalytic core in the first mini-monomer cassette is as described above, and can be the same or different as the second ribozyme catalytic core in the second mini-monomer cassette. See, e.g., FIG. 11.

To reduce the possibility of recombination between two identical ribozyme core sequences, however, two different ribozyme cores can be used. For example, in one embodiment, the first mini-monomer cassette comprises a ribozyme catalytic core from the satellite RNA of arabis mosaic virus (sArMV) and the second mini-monomer cassette comprises a ribozyme catalytic core from the satellite RNA of tobacco ringspot virus (sTRSV). Utilizing ribozyme catalytic cores having slightly different polynucleotide sequences should not only decrease recombination between the two, but will also serve as an internal control for the sequencing (e.g., deep sequencing).

ii. Second Mini-Monomer Cassette Containing Inserted Polynucleotide Suspected of Comprising a RNA Stability Modifier or a Transcription Modifier The second mini-monomer cassette is located 3' to the first mini-monomer cassette. In varying embodiments, inserted polynucleotide suspected of comprising a RNA stability modifier or a transcription modifier is cloned into the MCS of the second mini-monomer cassette, so therefore is positioned within the second mini-monomer cassette, located 3' to the second ribozyme catalytic core and 5' to the third ribozyme cleavage site. See, e.g., FIG. 11.

The inserted polynucleotide suspected of comprising a RNA stability modifier or a transcription modifier can be from any source, for example, a randomly generated library, a naturally occurring source (e.g., a genomic library), a chemically synthesized source, random nucleotides, restriction fragments of eukaryotic DNA, or randomized PCR fragments of eukaryotic DNA. Generally, the polynucleotide suspected of comprising a RNA stability modifier or a transcription modifier has from about 50 bp to about 1000 bp. In varying embodiments, the polynucleotide suspected of comprising a RNA stability modifier or a transcription modifier contains an entire modifying sequence or a partial modifying sequence. Within the inserted or captured polynucleotide suspected of comprising a modifying sequence, the modifier may be centered or located more proximal to the 3' or 5' end. The methods of employing the DNA constructs described herein identify functional modifiers, e.g., polynucleotides capable of modifying (e.g., increasing or decreasing) RNA stability and/or transcription, regardless of whether the entire modifying sequence or a partial modifying sequence is captured, or the location of the modifying sequence within the captured insert. In varying embodiments, inserted polynucleotide suspected of comprising a RNA stability modifier or a transcription modifier is cloned into the MCS, so therefore is positioned within the mini-monomer cassette, located 3' to the ribozyme catalytic core and 5' to the second ribozyme cleavage site. See, e.g., FIG. 11.

Generally, the first, second and third ribozyme cleavage sites are the same.

iii. Plasmid Backbone of Construct for RNA Stability/Transcription Modifier Screening The plasmid backbone for the constructs or DNA plasmids designed to screen for RNA stability/transcription modifying sequences can but need not be minimized. Like the plasmid backbone for the constructs or DNA plasmids designed to screen for promoters, the plasmid backbone for the constructs or DNA plasmids designed to screen for RNA stability/transcription modifying sequences have an origin of replication, and optionally, an expression cassette for expressing a selection marker, as described above. The entire size of the DNA plasmids that are designed for screening for RNA stability/transcription modifying sequences is guided by the location of the promoter functional in a eukaryotic cell in relationship to the first and third ribozyme cleavage sites. In the case where the eukaryotic promoter is 3' of the third ribozyme cleavage site, the overall plasmid size is minimized. In embodiments where the eukaryotic promoter is 5' of the first ribozyme cleavage site, there is no size limitation on the plasmid. In the case where the eukaryotic promoter is 5' of the first ribozyme cleavage site, the plasmid can also contain other features (e.g., sequences for entry into cells, e.g., left and right border sequences for Agrobacterium-mediated transfer). Viral replicating vectors can also be used. Accordingly, in varying embodiments, the promoter functional in a eukaryotic cell is located 3' of the third ribozyme cleavage site. In such embodiments, the plasmid has from about 1800 bp to about 3800 bp, e.g., from about 1900 bp to about 2900 bp. In varying embodiments, the promoter functional in a eukaryotic cell is located 5' of the first ribozyme cleavage site. In such embodiments, there is no fixed upper size limit, but the plasmid optionally can have from about 2100 bp to about 3100 bp, e.g., from about 2100 bp to about 2250 bp.

iv. Optional Control Promoter

The constructs or DNA plasmids designed for the screening of RNA stability and/or transcription modifying sequences can optionally further contain a control promoter. In varying embodiments, the control promoter is a promoter functional in a prokaryotic host cell. In some embodiments, the control promoter can be added to the library by PCR. As discussed above for the promoter screening plasmids, such a promoter is useful as an internal control for in vitro transcription. Illustrative promoters functional in a prokaryotic cell of use include without limitation bacteriophage promoters T7, T3 and SP6.

Accordingly, in varying embodiments of the constructs or DNA plasmids designed for screening of promoters a control promoter functional in a prokaryotic host cell is positioned 5' of the first ribozyme cleavage site. See, e.g., FIG. 11.

Transcription of the plasmid library in vitro with a RNA polymerase (e.g., a T7, T3 or SP6 RNA polymerase) followed by RT-PCR with forward and reverse RT-PCR primers and sequencing (e.g., deep sequencing) produces a processing and library bias-controlled sequenced data set for comparison with sequenced data sets derived from internal promoters (e.g., the functional promoter within the test insert polynucleotide).

3. Methods a. For Identification of Functional Promoter Sequences

In varying embodiments, methods for screening for promoters entail the steps of:

a) providing a population of plasmids designed for screening promoters, the plasmids in the population containing an insert suspected of containing a functional promoter sequence, as described above and herein;

b) transcribing the population of plasmids into RNA;

c) reverse transcribing into cDNA the population of circularized RNA transcripts of self-cleaved mini-monomer cassettes; and d) sequencing the inserted polynucleotides comprising a functional promoter in the population of cDNA reverse-transcripts of self-cleaved mini-monomer cassettes.

i. Initial Transcriptional Control Step

In embodiments employing a plasmid further comprising a control promoter (e.g., a promoter functional in a prokaryotic host cell), positioned 5' to the mini-monomer cassette, in vitro transcription can additional and initially be performed from this promoter as an internal control for processing (e.g., self-cleaving) efficiency. In vitro transcription is performed using methodologies known in the art, as described below and herein.

ii. Transcribing the Population of Plasmids into RNA

The step of transcribing the population of plasmids into RNA can be performed using any methodologies known in the art. Such methodologies are described, e.g., in Green and Sambrook, Molecular Cloning, A Laboratory Manual, 4th Ed., Cold Spring Harbor Press, (2012).

Figure 7:
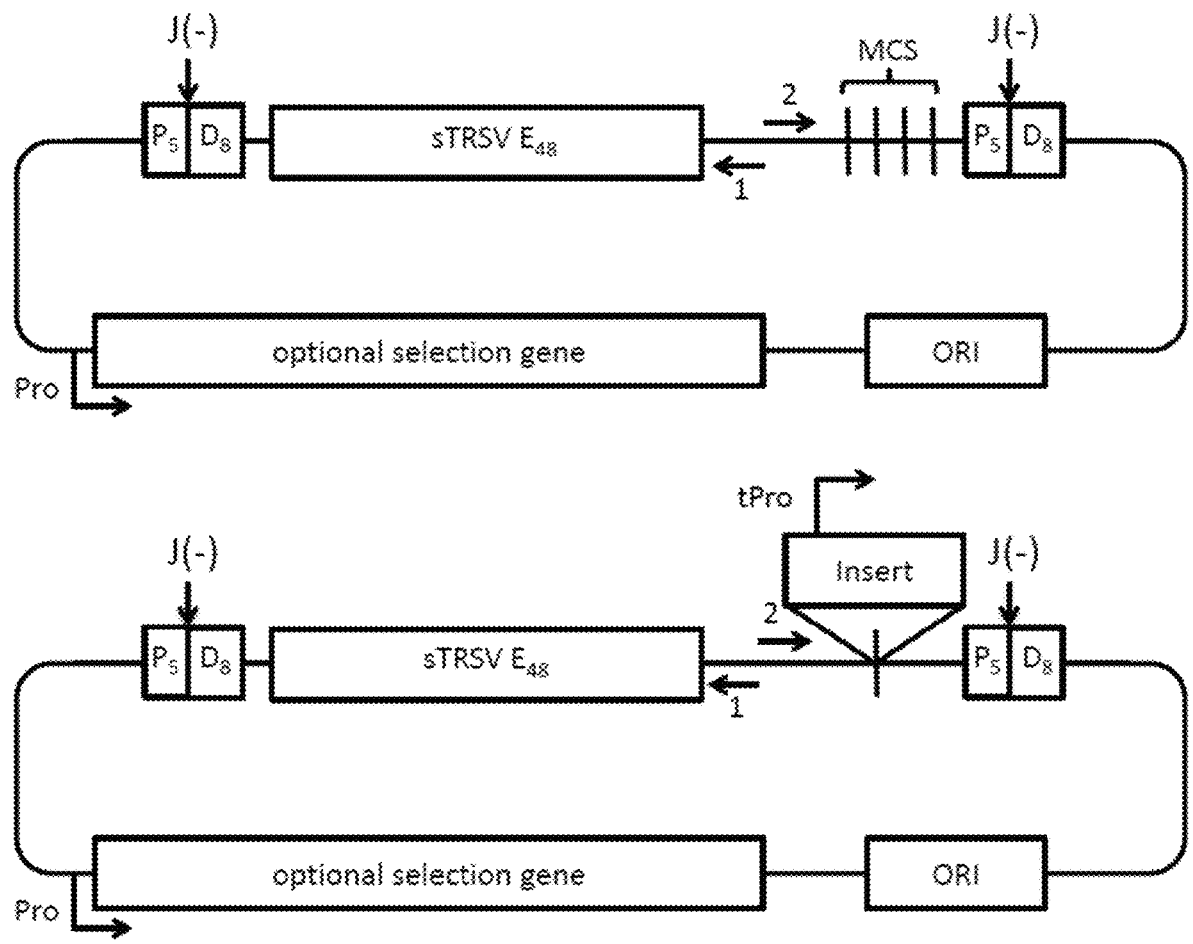
FIG. 7 illustrates cloning of the mini-monomer cassette into a plasmid backbone (e.g., pUN) followed by insertion of fragments into the mini-monomer cassette MCS. The upper construct is the plasmid backbone-ribozyme construct without potential test promoter-containing inserts (tPro). The lower construct is the same, but containing a polynucleotide suspected of encoding a test promoter-containing insert (tPro). In varying embodiments, the construct may further optionally contain an expression cassette for expression of a selection gene, in either the sense or antisense orientation in relation to the test promoter containing insert. In varying embodiments, the optional selection gene polynucleotide can be an antibiotic resistance gene (e.g., a beta-lactamase gene that confers resistance to carbenicillin or related antibiotics). The ORI refers to an origin of replication for plasmid replication.
Figure 8:
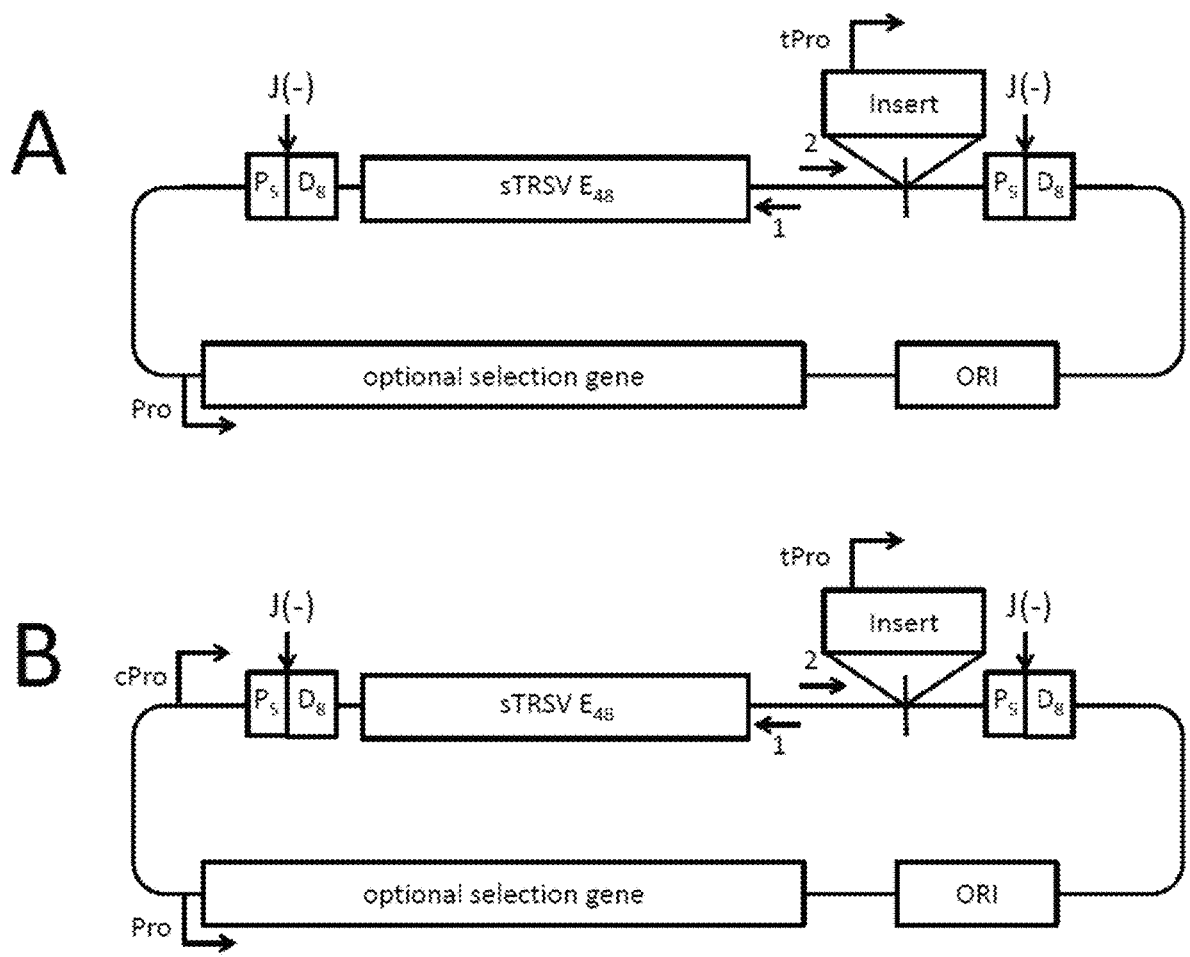
FIG. 8 illustrates a mini-monomer cassette into a plasmid backbone, with the optional addition of a control promoter (cPro), e.g., a promoter functional in a prokaryotic cell (e.g., a T7 polymerase promoter) as an internal control. Upper construct is the same as the lower construct in FIG. 7, above. Lower construct illustrates optional addition of a control promoter (cPro), e.g., a promoter functional in a prokaryotic cell (e.g., a T7 polymerase promoter). Here it is depicted 5' to the mini-monomer cassette.

As discussed above, constructs or DNA plasmids designed for screening for functional promoters have a ribozyme insert having two (-) strand ribozyme cleavage sites flanking a (-) strand ribozyme catalytic core and an inserted polynucleotide suspected of encoding a functional promoter (FIGS. 7 and 8). This ribozyme insert, inclusive of the ribozyme cleavage sites, the (-) strand ribozyme catalytic core, an inserted polynucleotide suspected of encoding a functional promoter, and forward and reverse primer annealing sequences, all between the two ribozyme cleavage sites, is referred to hereinafter as a "mini-monomer."

In varying embodiments, the step of transcribing the population of plasmids into RNA can be performed in vitro or in vivo. In vitro testing of DNA plasmids comprising a library of inserts suspected of comprising a functional promoter sequence can be achieved using nuclei preparations, nuclear extracts capable of giving in vitro transcription or purified RNA polymerases. In vivo methods entail the transformation of a suitable host cell of closed circular DNA plasmid using any method known in the art, e.g., by electroporation of protoplasts, fusion of liposomes to cell membranes, cell transfection methods using calcium ions or PEG, use of gold or tungsten microparticles coated with plasmid with the gene gun. The cells of all eukaryotic and prokaryotic organisms (plants, animals, fungi, bacteria, archaea etc.) can be used. Libraries of DNA inserts cloned into the mini-monomer cassette can be used to select promoter-containing fragments in a variety of ways. As one can only recover the PCR products after greater than full-length transcription which only occurs with the insertion of a polynucleotide encoding a functional promoter, functional promoter sequences can be readily identified from a mixed population of polynucleotide sequences with high specificity.

An insert containing a functional eukaryotic promoter is transcribed into RNA from its transcription start site. In varying embodiments, the functional promoter is functional in a eukaryotic cell or is functional in a prokaryotic cell. The primary transcript continues around the full length of the plasmid and produces the full-length mini-monomer RNA sequence containing the full insert on its second pass through that part of the plasmid backbone through to the second ribozyme cleavage site for a second time. See, e.g., FIG. 9. In the absence of a terminator, the primary transcript can be substantially longer than shown. When the inserted polynucleotide comprises a functional promoter, the first and second ribozyme cleavage site are transcribed into RNA by a RNA polymerase, and RNA transcripts comprising the mini-monomer cassette self-cleave from the transcript. A population of circularized RNA transcripts of self-cleaved mini-monomer cassettes is formed.

Figure 9:
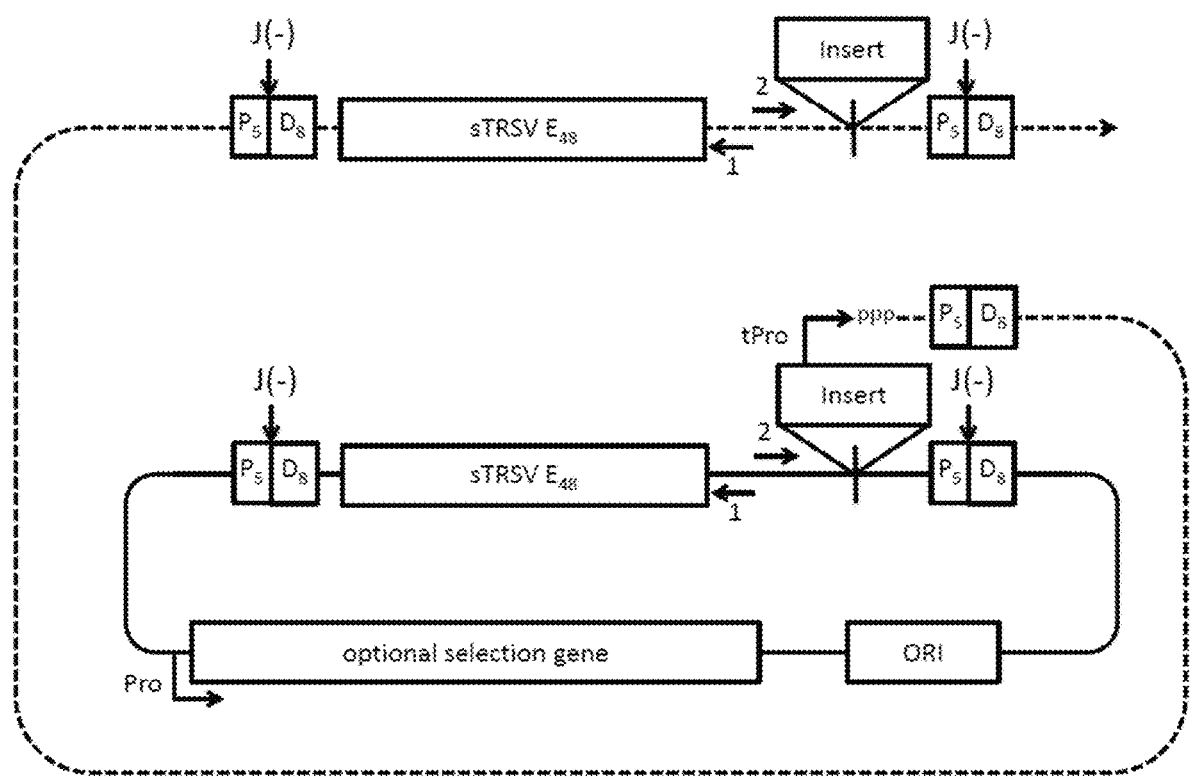
FIG. 9 illustrates a primary transcript from a plasmid comprising a mini-monomer cassette-DNA insert containing a test promoter (tPro). The dashed line represents the primary transcript. Orientation is shown by the 5' triphosphate (ppp) and the 3' hydroxyl (arrowhead at the right-hand end of the dashed line). Note that the transcript is not drawn to scale. In practice, the primary transcript is longer than depicted at the 3' end.
Figure 10:
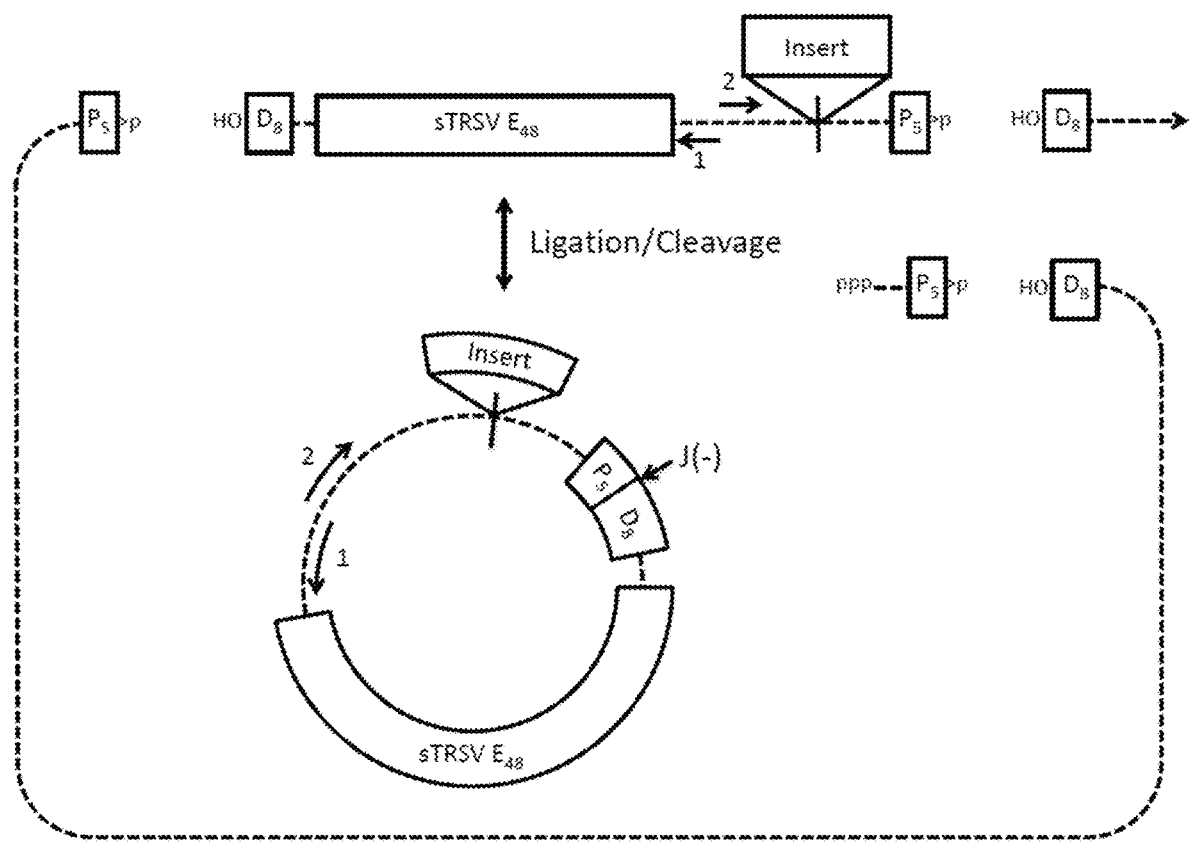
FIG. 10 illustrates complete processing products for greater than full-length RNA transcripts.

The primary transcript shown in FIG. 9 is processed (e.g., self-cleaved) to produce the excised and circularized mini-monomer cassette shown in FIG. 10. Partial processing products may also be present. Any transcript that is terminated after the ribozyme catalytic core ($E_{48}$), but before the second ribozyme cleavage site (e.g., $P_5$-$D_8$) immediately downstream of the catalytic core is processed, but is not able to form a circular mini-monomer containing the promoter-carrying insert. Any transcripts that terminate after the second ribozyme cleavage site (e.g., $P_5$-$D_8$) immediately downstream of the catalytic core is able to form a circular mini-monomer containing the promoter-carrying insert.

In varying embodiments, the methods further comprise the step of purifying or isolating the transcribed RNA from non-RNA. In varying embodiments, the methods further comprise the step of purifying or isolating the population of circularized RNA transcripts of self-cleaved mini-monomer cassettes. In varying embodiments, purifying or isolating circularized RNA transcripts of self-cleaved mini-monomer cassettes is performed by two-dimensional gel electrophoresis.

iii. Reverse-Transcribing into cDNA the Population of Circularized RNA Transcripts of Self-Cleaved Mini-Monomer Cassettes The step of reverse-transcribing the population of plasmids into cDNA can be performed using any methodologies known in the art. Such methodologies are described, e.g., in Green and Sambrook, Molecular Cloning, A Laboratory Manual, 4th Ed., Cold Spring Harbor Press, (2012). In varying embodiments, the reverse transcribing step comprises amplifying from the forward and reverse primer annealing polynucleotides (e.g., for PCR or RT-PCR).

cDNA can be synthesized from reverse transcription of the RNA of circularized and self-cleaved mini-monomer carrying a functional promoter (e.g., eukaryotic or prokaryotic) using a primer that binds at the reverse primer annealing sequence (e.g., for PCR or RT-PCR). Reverse transcription can be followed by PCR with the forward and reverse primers, thereby yielding a PCR product containing the mini-monomer sequence with the promoter-containing insert if the RNA template for reverse transcription is circular. If PCR product is amplified from residual circular plasmid DNA or on unprocessed transcripts, it will give a larger PCR product containing all of the plasmid backbone and mini-monomer cassette, which is substantially larger. Such oversized PCR product can be readily excluded, e.g., by adjusting PCR conditions or, in the case of residual DNA template, by treatment with DNase or the restriction endonuclease Dpn I. These RT PCR-derived DNAs can only be produced if a cloned DNA insert contains a functional eukaryotic promoter.

iv. Sequencing the Inserted Polynucleotides Comprising a Functional Promoter in the Population of cDNA Reverse-Transcripts of Self-Cleaved Mini-Monomer Cassettes The step of sequencing the inserted polynucleotides comprising a functional promoter in the population of cDNA reverse-transcripts of self-cleaved mini-monomer cassettes can be performed using any methodologies known in the art. Such methodologies are described, e.g., in Green and Sambrook, Molecular Cloning, A Laboratory Manual, 4th Ed., Cold Spring Harbor Press, (2012). In varying embodiments, next generation sequencing, deep sequencing or ultra deep sequencing methodologies are applied. Deep sequencing data analysis is described, e.g., in "Deep Sequencing Data Analysis (Methods in Molecular Biology)," Noam Shomron (Editor), Humana Press; 2013 edition. Next generation sequencing is described, e.g., in "Next-Generation DNA Sequencing Informatics," Stuart M. Brown (Editor), Cold Spring Harbor Laboratory Press; 1st edition (2013); "Next-generation Sequencing: Current Technologies and Applications," Jianping Xu (Editor), Caister Academic Press (2014); Wilhelm, et al., *Nature*. (2008) 453:1239-1243; Nagalakshmi, et al., *Science*. (2008) 320:1344-1349; and Mortazavi, et al., *Nat. Methods*. (2008) 5:621-628.

v. Exposure to External Influences

In varying embodiments, de novo selection and subsequent evolution of externally influenced promoters is performed. Using a library containing inserted polynucleotides suspected of comprising a functional promoter, as described above, insertion of this library into cells with or without some external factor (e.g., $Ca^{++}$ ions, salt, temperature stress, hormones, etc.), followed by analysis as described previously will allow detection of promoter sequences that are increased preferentially in the presence of the external factor. Analysis of these sequences allows determination of common features that can make the significant structural features more obvious. Reconstruction of a library of mutagenized sequences related to these initial sequences followed by reanalysis, again in the presence or absence of the external factor, will allow an evolutionary optimization of said sequences, ultimately leading to the selection of a de novo optimized promoter sequences that can be used in the construction of novel promoters or modified genes that are responsive to the external factor in question.

vi. Methods of Identifying Promoters Having Modulated Strengths or Transcription Efficiencies The methods described herein can be used to identify promoters derived from known promoters, but having increased or decreased transcription efficiencies. In varying embodiments, the insert suspected of comprising a functional promoter comprises a known promoter that has been mutated or mutagenized. The methods of promoter identification described above and herein allow one to take a known promoter sequence, mutagenize it, then run the mutagenized sequences through the promoter selection procedure, thereby generating a quasispecies of new promoters with a range of promoter strengths (ability to promote transcription). This procedure can be done iteratively or generationally (e.g., providing a population of polynucleotides comprising mutagenized promoters, selecting for promoters having increased or decreased transcription efficiency (as desired), recovering RT-PCR products, performing one or more further rounds of mutagenesis and then performing the steps of the methods again, as many iterations as necessary or desired).

In varying embodiments, methods for screening for promoters having modulated strength or transcription efficiencies entail the steps of:

a) providing a population of plasmids designed for screening promoters, the plasmids in the population containing an insert suspected of containing a functional promoter sequence, as described above and herein, wherein the promoter sequence comprises a polynucleotide from a known parent promoter that has been mutated;

b) transcribing the population of plasmids into RNA;

c) reverse transcribing into cDNA the population of circularized RNA transcripts of self-cleaved mini-monomer cassettes;

d) sequencing the inserted polynucleotides comprising a functional promoter in the population of cDNA reverse-transcripts of self-cleaved mini-monomer cassettes; and e) comparing the transcriptional strength or efficiency of the mutated promoter to the parent promoter.

Further embodiments of this method are the same as the methodologies described above and herein for identifying promoter polynucleotides.

vii. Methods of Identifying Natural Promoter Variants

The methods described herein can be used to identify genetic variation in the same promoter. Such variation may or may not correlate with a phenotypic difference (e.g., promoter strength and/or transcription efficiency). In varying embodiments, a library of inserts comprising the same known functional promoter from different individuals is created. The methods of promoter identification described above and herein allow one to take a known promoter sequence from a population of individuals to create a promoter library, and compare the promoter sequences of the different members of the library to identify sequence variation. For example, the promoter identification methods can be applied to the identification and comparison of the polynucleotide sequences of the same promoter from two or more different breeding line parents and the identification of variances in such promoter sequences, e.g., the identification of single nucleotide polymorphisms (SNPs). Natural variation can be found in regions of promoters that are not highly constrained and comparison of the polynucleotide sequences of the same promoter from two or more different individuals or a population of individuals can be used to identify SNPs and other longer regions within a promoter subject to variation. Genetic variation in a promoter may or may not correlate with variation in a phenotypic trait. This method applies the same methodologies described above for identifying promoter polynucleotides to two populations, e.g., one from each breeding line, and then comparing/aligning the promoter polynucleotide sequences found and looking for variation.

In varying embodiments, methods for identifying variation in a promoter sequence entail the steps of:

a) providing a population of plasmids designed for screening promoters, the plasmids in the population containing inserts suspected of containing functional promoter sequences, as described above and herein, wherein each population comprises the same potential promoter population from a different individual;

b) transcribing the population of plasmids into RNA;

c) reverse transcribing into cDNA the population of circularized RNA transcripts of self-cleaved mini-monomer cassettes;

d) sequencing the inserted polynucleotides comprising a functional promoter in the population of cDNA reverse-transcripts of self-cleaved mini-monomer cassettes; and e) comparing the polynucleotide sequences of the promoters from the different individuals, thereby identifying variation in the promoter sequence in the population.

Further embodiments of this method are the same as the methodologies described above and herein for identifying promoter polynucleotides.

b. For Identification of RNA Stability/Transcription Modifying Sequences

In varying embodiments, methods for screening for RNA stability/transcription modifying sequences entail the steps of:

a) providing a population of plasmids designed for screening for RNA stability/transcription modifying sequences, the plasmids in the population containing an insert suspected of having a RNA stability/transcription modifying sequence;

b) sequencing the first and second mini-monomer cassettes;

c) transcribing in vitro the population of plasmids into RNA from a control promoter (e.g., a promoter functional in a prokaryotic cell);

d) reverse transcribing into cDNA and sequencing the self-cleaved first and second mini-monomer cassettes transcribed in vitro in step c);

e) transcribing either in vitro or in a population of host cells the population of plasmids into RNA from a test promoter, wherein the test promoter is functional in a prokaryotic cell and/or in a eukaryotic cell;

f) reverse transcribing into cDNA and sequencing the self-cleaved first and second mini-monomer cassettes reverse transcribed in step e);

g) comparing the relative abundance or frequency of the self-cleaved second mini-monomer cassettes transcribed in vitro in step c) with the self-cleaved second mini-monomer cassettes transcribed in step e); and h) comparing the ratios of the relative abundance or frequency of the self-cleaved first mini-monomers to their linked self-cleaved second mini-monomers produced in step c) with those produced in step e).

Insertion of this library of DNA plasmids or constructs into cells or possibly transcriptionally active extracts and following the same basic protocol of RNA separation, isolation and/or purification, in vitro transcription, RT-PCR, and sequencing (e.g., deep sequencing) identifies RNA stabilizing or destabilizing inserts by screening for sequences that are increased or decreased in the deep sequencing population.

i. Sequencing the First and Second Mini-Monomer Cassettes

The first and second mini-monomer cassettes are sequenced using any methodologies known in the art. Such methodologies are described, e.g., in Green and Sambrook, Molecular Cloning, A Laboratory Manual, 4th Ed., Cold Spring Harbor Press, (2012). In varying embodiments, next generation sequencing, deep sequencing or ultra deep sequencing methodologies are applied, as described above.

A library of barcoded first mini-monomer/insert containing second mini-monomer is made. Construction of functional libraries begins with cloning of the barcodes into the first mini-monomer cassette, followed by sequencing (e.g., deep sequencing) to determine library extent. This first step barcoded library is then used to construct a library of inserts for functional testing. A subsequent round of sequencing (e.g., deep sequencing) of the barcode library and insert-containing library links any individual plasmid library member's barcode and insert sequence and shows the distribution of the sequences in the library (whether some more prevalent than others, for example).

ii. Transcribing In Vitro the Population of Plasmids into RNA

In vitro transcription of the first and second mini-monomers is performed, using methods known in the art, as discussed above. First and second mini-monomer cassettes that are fully transcribed into RNA, including downstream and then the upstream ribozyme cleavage sites, can self-cleave and circularize from the transcribed sequence.

Generally, transcription for this step is initiated from the control promoter (e.g., a promoter functional in a prokaryotic cell) positioned 5' to the first mini-monomer cassette as an internal control for processing efficiency. Mini-monomer cassettes that are transcribed into RNA over their full length, including the upstream and downstream ribozyme cleavage sites, self-cleave and circularize from the context of the DNA plasmid. The self-cleaved and circularized mini-monomer cassettes can be recovered.

Figure 11:
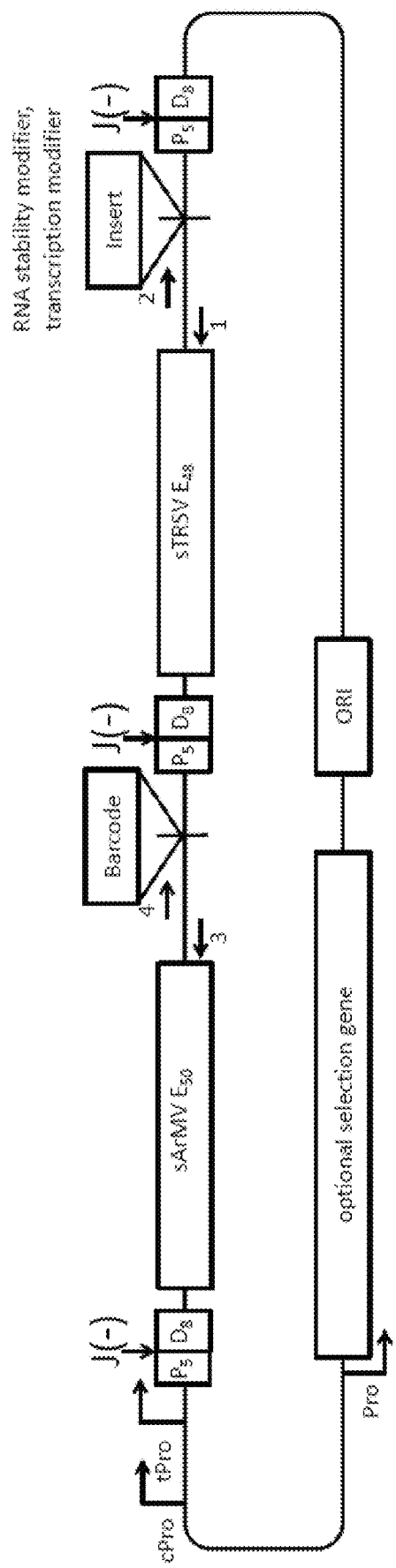
FIG. 11 illustrates an internally controlled, dimer mini-monomer construct. Notice the three P-D cleavage and ligation sites with two E ribozyme core sequences, in this embodiment, one from sArMV and one from sTRSV, between them. In some embodiments, the barcode sequence is a random DNA sequence with 15 N residues (approximately $1 \times 10^9$ different possible sequences).
Figure 12:
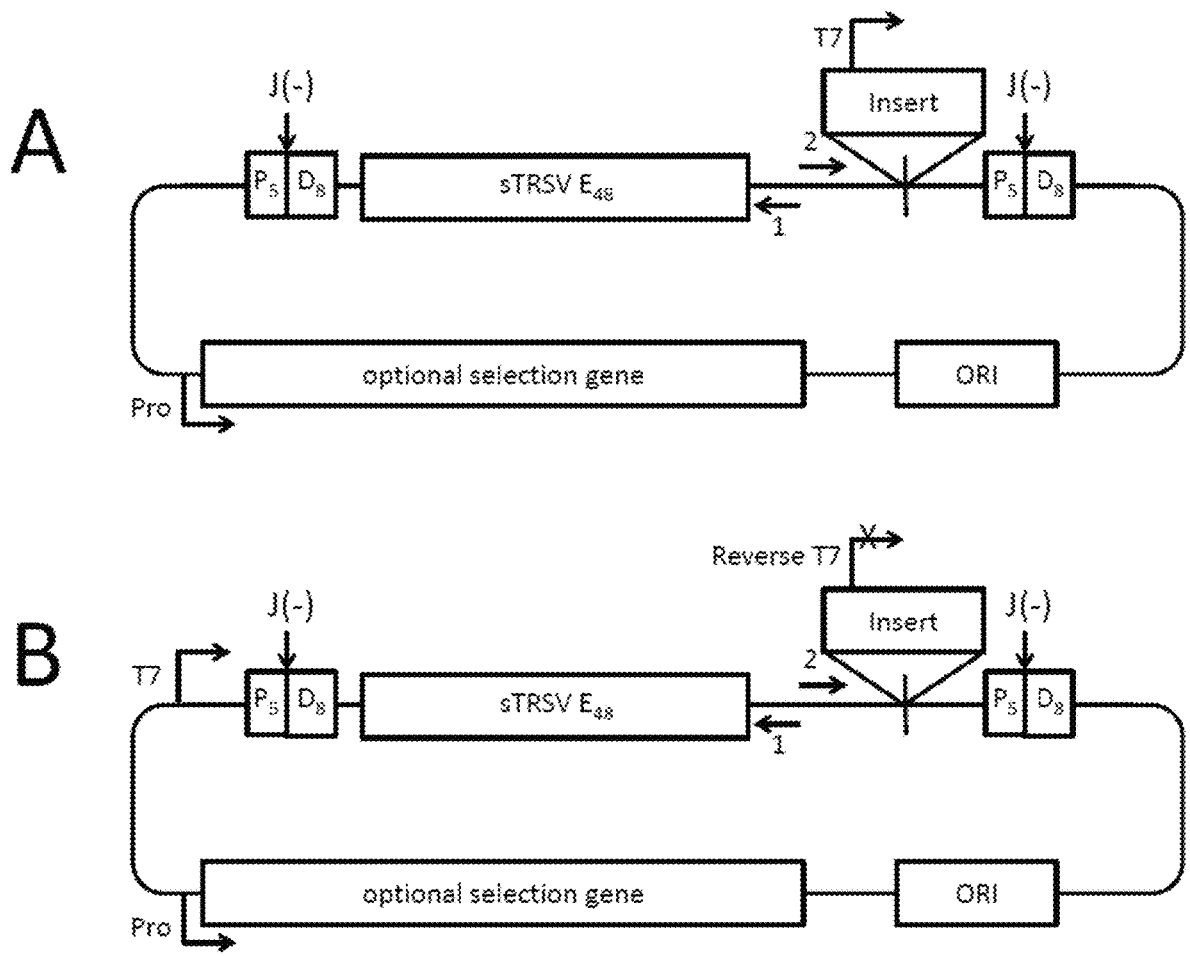
FIGS. 12A-B. (A) T7 construct containing a fully functional T7 RNA polymerase promoter as an insert. (B) reverse T7 ("7T") construct containing the reverse T7 RNA polymerase promoter (contains the T7 RNA polymerase promoter sequence written backwards) as a nonfunctional promoter as an insert.
Figure 13:
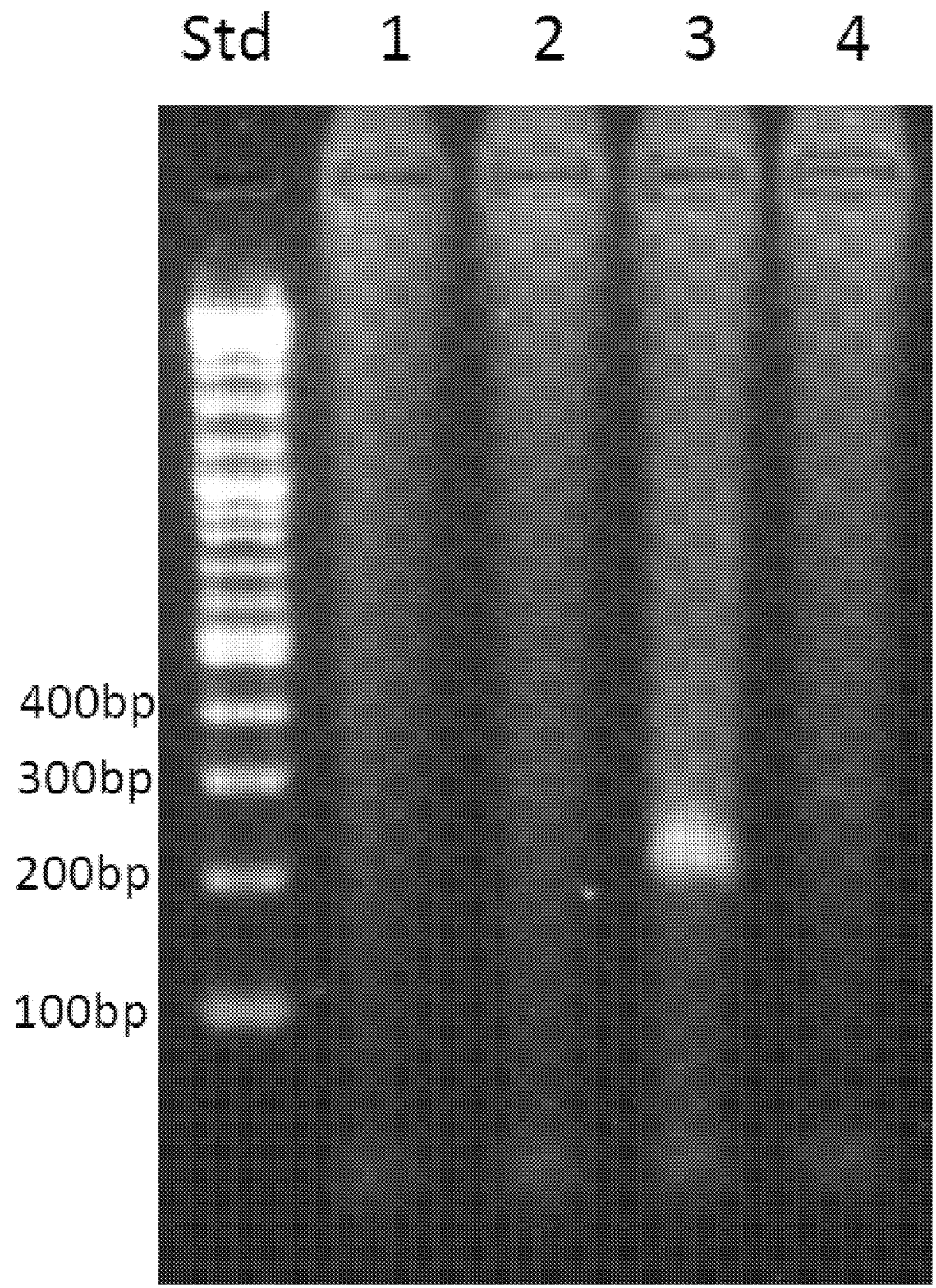
FIG. 13 illustrates T7 construct and reverse T7 construct incubated under transcription conditions with or without T7 RNA polymerase, phenol/chloroform/iso-amyl alcohol extracted, ethanol precipitated, reverse transcribed, and then subjected to 20 cycles of PCR with primers 1 and 2 (e.g., reverse and forward primer annealing polynucleotides, respectively). The appropriate sized fragment should be 221 base pairs long. This band is only seen in the T7 promoter construct incubated with T7 RNA polymerase under transcription conditions. Notice the faint band in lane 4 just below 300 base pairs. Lanes: (Std) 2-Log DNA ladder from New England Biolabs; (1) T7 promoter construct incubated without T7 RNA polymerase; (2) Reverse T7 promoter construct without T7 RNA polymerase; (3) T7 promoter construct with T7 RNA polymerase; and (4) Reverse T7 promoter construct with T7 RNA polymerase.
Figure 14:
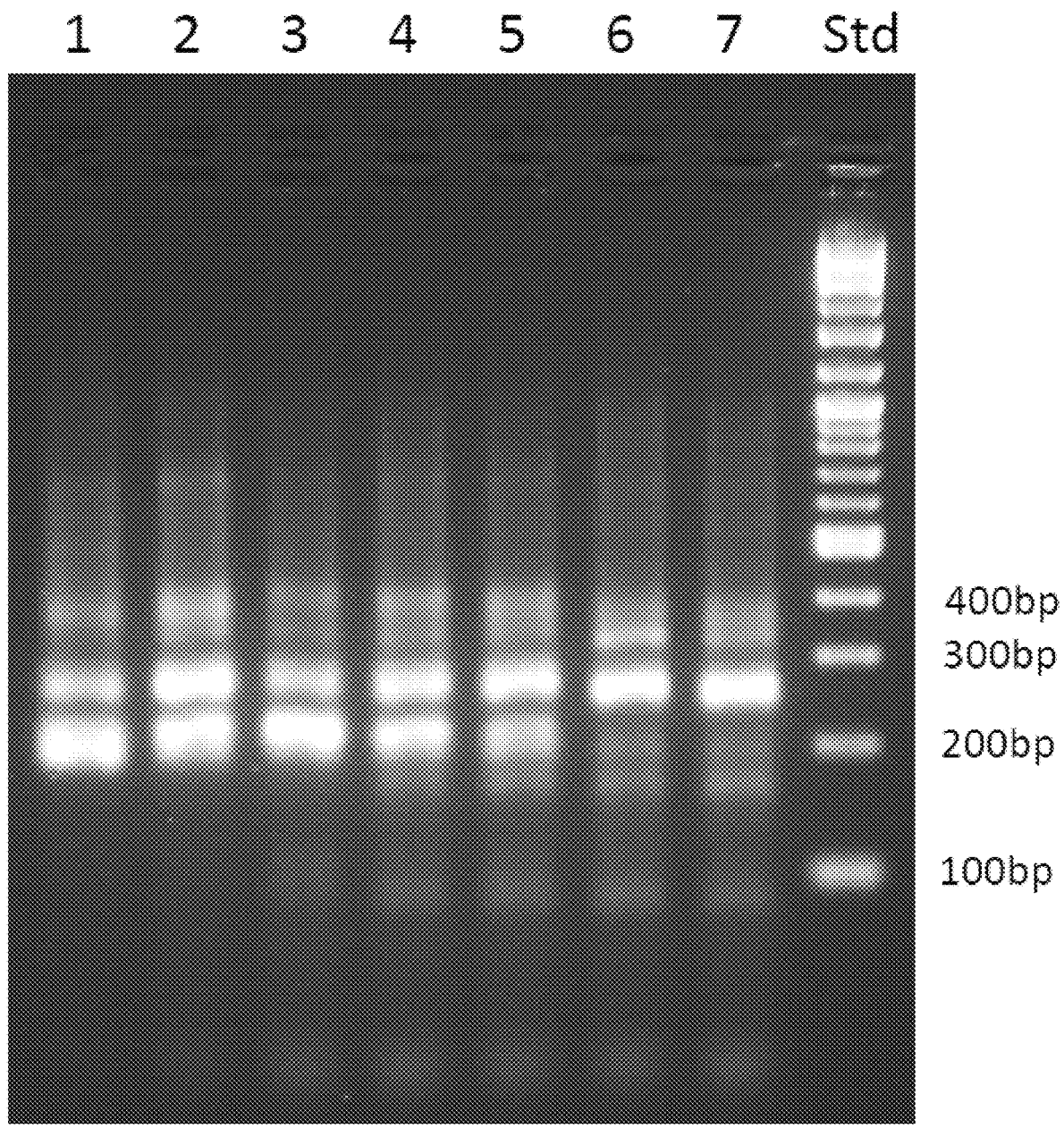
FIG. 14 illustrates a dilution series of the T7 construct mixed with a constant amount of the reverse T7 construct incubated under transcription conditions with T7 RNA polymerase, phenol/chloroform/iso-amyl alcohol extracted, ethanol precipitated, reverse transcribed, and then subjected to 35 cycles of PCR with primers 1 and 2. The appropriate sized fragment should be 221 base pairs long. This band is seen in the lane with $1:10^{-4}$ reverse T7 promoter construct: T7 promoter construct incubated with T7 RNA polymerase. Lanes: (1) 1:1 reverse T7 promoter construct:T7 promoter construct; (2) $1:10^{-1}$ reverse T7 promoter construct:T7 promoter construct; (3) $1:10^{-2}$ reverse T7 promoter construct: T7 promoter construct; (4) $1:10^{-3}$ reverse T7 promoter construct:T7 promoter construct; (5) $1:10^{-4}$ reverse T7 promoter construct:T7 promoter construct; (6) $1:10^{-5}$ reverse T7 promoter construct:T7 promoter construct; (7) reverse T7 promoter construct only; and (Std) 2-Log DNA ladder from New England Biolabs.

In varying embodiments, the methods further comprise the step of purifying or isolating the transcribed RNA from non-RNA. In varying embodiments, the methods further comprise the step of purifying or isolating the population of circularized RNA transcripts of self-cleaved mini-monomer cassettes. In varying embodiments, purifying or isolating circularized RNA transcripts of self-cleaved mini-monomer cassettes is performed by two-dimensional gel electrophoresis.

iii. Reverse Transcribing into cDNA and Sequencing the Self-Cleaved First and Second Mini-Monomer Cassettes Transcribed into RNA In Vitro The self-cleaved first and second mini-monomers that were transcribed into RNA in vitro are reverse-transcribed into cDNA and then sequenced (e.g., deep sequenced) using methods known in the art, as discussed above. Reverse transcription and sequencing (e.g., deep sequencing can be performed using any methods known in the art, as described above. Generally, reverse transcription in this step can be initiated from the first reverse primer annealing polynucleotide (e.g., for PCR or RT-PCR) for the first mini-monomer cassette and from the second reverse primer annealing polynucleotide (e.g., for PCR or RT-PCR) for the second mini-monomer cassette, wherein the location or positioning of the first and second forward and reverse primer annealing polynucleotides (e.g., for PCR or RT-PCR) is as depicted in FIG. 11. PCR is performed using the first forward and reverse primer annealing polynucleotides (e.g., for PCR or RT-PCR) for amplifying the first self-cleaved and circularized mini-monomer cassettes comprising the barcode polynucleotides and second forward and reverse primer annealing polynucleotides (e.g., for PCR or RT-PCR) for amplifying the second self-cleaved and circularized mini-monomer cassettes, comprising the insert suspected of encoding a RNA stability and/or transcriptional modifying sequence.

This step functions as an internal control for circularization efficiency within the first and second mini-monomer cassettes (barcode and insert containing RNA and/or transcription stability modifier). It is possible that particular barcodes or inserts have increased or decreased circularization when transcribed into RNA in vitro.

iv. Transcribing In Vitro or in a Population of Host Cells the Population of Plasmids into RNA The DNA plasmid library can be transcribed, in vitro or in a host cell. In varying embodiments, the DNA plasmid library is transcribed in vitro. This can be done according to methods known in the art, and described herein. In varying embodiments, the DNA plasmid library is transformed into a population of host cells, where they are transcribed into RNA, and the transcribed mini-monomers circularize and self-cleave within the host cell. Whether transcribed in vitro or in a host cell, the self-cleaved and circularized mini-monomers are recovered, reverse-transcribed into cDNA and sequenced (e.g., deep sequenced).

As discussed above, in vivo transformation of a suitable host cell with a closed circular DNA plasmid using any method known in the art, e.g., by electroporation of protoplasts, fusion of liposomes to cell membranes, cell transfection methods using calcium ions or PEG, use of gold or tungsten microparticles coated with plasmid with the gene gun. Mini-monomer cassettes that are transcribed into RNA along their full length, including the upstream and downstream ribozyme cleavage sites, can self-cleave and circularize. The self-cleaved and circularized mini-monomer cassettes can be recovered.

Accordingly, in varying embodiments, the methods further comprise the step of purifying or isolating the transcribed RNA from non-RNA. In varying embodiments, the methods further comprise the step of purifying or isolating the population of circularized RNA transcripts of self-cleaved mini-monomer cassettes. In varying embodiments, purifying or isolating circularized RNA transcripts of self-cleaved mini-monomer cassettes is performed by two-dimensional gel electrophoresis.

v. Reverse Transcribing into cDNA and Sequencing the Self-Cleaved First and Second Mini-Monomer Cassettes The self-cleaved first and second mini-monomers that were functionally transcribed into RNA either in vitro or in vivo (e.g., in a host cell) are reverse-transcribed into cDNA and then sequenced (e.g., deep sequenced) using methods known in the art, as discussed above. Reverse transcription and sequencing (e.g., deep sequencing can be performed using any methods known in the art, as described above. Generally, reverse transcription in this step can be initiated from the first reverse primer annealing polynucleotide (e.g., for PCR or RT-PCR) for the first mini-monomer cassette and from the second reverse primer annealing polynucleotide (e.g., for PCR or RT-PCR) for the second mini-monomer cassette, wherein the location or positioning of the first and second forward and reverse primer annealing polynucleotides (e.g., for PCR or RT-PCR) is as depicted in FIG. 11. PCR is performed using the first forward and reverse primer annealing polynucleotides for amplifying the first self-cleaved and circularized mini-monomer cassettes comprising the barcode polynucleotides and second forward and reverse primer annealing polynucleotides for amplifying the second self-cleaved and circularized mini-monomer cassettes, comprising the insert suspected of encoding a RNA stability and/or transcriptional modifying sequence.

vi. Comparing the Relative Abundance or Frequency of the Self-Cleaved Second Mini-Monomer Cassettes Reverse-Transcribed into cDNA In Vitro with the Self-Cleaved Second Mini-Monomer Cassettes Reverse-Transcribed into cDNA The frequency and abundance of circularized self-cleaved inserted polynucleotide sequences functionally transcribed into RNA either in vitro or in a host cell are compared with the frequency and abundance of circularized self-cleaved inserted polynucleotide sequences transcribed into RNA in the in vitro control. Any that have increased in relation to their frequency in the DNA library contain either a transcription enhancer or a RNA stabilizing sequence. Both possibilities can cause an increase in the amount of mini-monomer RNA with that sequence. Any that have decreased in relation to their frequency in the DNA library contain either a transcription decreasing sequence or a RNA destabilizing sequence. Both possibilities can cause a decrease in the amount of mini-monomer RNA with that sequence.

vii. Comparing the Ratios of the Relative Abundance or Frequency of the Self-Cleaved First Mini-Monomers to their Linked Self-Cleaved Second Mini-Monomers The ratios of the barcoded mini-monomers to their linked insert mini-monomers are compared. Reverse transcription can be performed, e.g., with the first and second reverse primers, followed by PCR with the second forward and reverse primers to measure the presence of the insert-containing mini-monomer and first forward and reverse primers to measure the presence of the barcode-containing mini-monomer. See, e.g., FIG. 11. Comparison of the ratio of the appropriate barcoded mini-monomer to its linked insert mini-monomer allows discrimination between those inserts that actually affect RNA stability and those that affect transcription. Those that affect RNA stability increase or decrease the insert mini-monomer relative to the barcode mini-monomer if they increase or decrease the RNA stability, respectively. Those that affect transcription only do not affect the ratio, instead increasing or decreasing both mini-monomers coordinately.

In the case of an increase, if the ratio is unchanged, then the sequence is a transcriptional enhancer. It causes both mini-monomers to increase the same amount. If the ratio is changed with the insert being higher, then it is a RNA stabilizing sequence. It only increases the amount of the insert mini-monomer. In the case of a decrease, if the ratio is unchanged, then the sequence is a transcriptional reducing sequence. It causes both mini-monomers to decrease the same amount. If the ratio is changed with the insert being lower, then it is a RNA destabilizing sequence. It only decreases the amount of the insert mini-monomer.

In varying embodiments, the ratio of the first bar-coded mini-monomer to the second insert-containing mini-monomer produced inside host cells can be normalized by division by the ratio of the first bar-coded mini-monomer to the second insert-containing mini-monomer produced in vitro. To provide an example, the ratio of the bar-coded mini-monomer to insert-containing mini-monomer is 0.5, e.g., due to a lower circularization efficiency of the bar-coded mini-monomer (presumably due to sequence specific effects on circularization by the bar code sequence). In the case of a transcriptional enhancer, an increase in the relative abundance of the insert-containing mini-monomer produced in the host cell is observed relative to that produced in vitro, but the ratio of the bar-coded mini-monomer to insert-containing mini-monomer produced in the host cells remains at 0.5. Likewise, in the case of a transcriptional repressor, a decrease in the relative abundance of the insert-containing mini-monomer produced in the host cell is observed relative to that produced in vitro, but the ratio of the bar-coded mini-monomer to insert-containing mini-monomer produced in the host cells remains at 0.5. In the case of a RNA stabilizing sequence, an increase in the relative abundance of the insert-containing mini-monomer produced in the host cell is observed relative to that produced in vitro, but the ratio of the bar-coded mini-monomer to insert-containing mini-monomer produced in the host cells is lower than 0.5 (more insert-containing mini-monomer relative to bar-coded mini-monomer). The ratio between the bar-coded mini-monomer and the insert-containing mini-monomer could be greater or less than 1.

viii. Exposure to External Influences

In varying embodiments, de novo selection and subsequent evolution of externally influenced transcriptional or RNA stability sequences is performed. Using a library containing inserted polynucleotides suspected of comprising a RNA stability/transcription modifying sequence, as described above, insertion of this library into cells with or without some external factor (e.g., $Ca^{++}$ ions, salt, temperature stress, hormones, etc.), followed by analysis as described previously will allow detection of sequences that are increased preferentially in the presence of the external factor. Analysis of these sequences allows determination of common features that can make the significant structural features more obvious. Reconstruction of a library of mutagenized sequences related to these initial sequences followed by reanalysis, again in the presence or absence of the external factor, will allow an evolutionary optimization of said sequences, ultimately leading to the selection of a de novo optimized transcriptional or RNA stability sequence that can be used in the construction of novel promoters or modified genes that are responsive to the external factor in question.

ix. Methods of Identifying Modulated RNA Stability/Transcription Modifying Sequences The methods described herein can be used to identify RNA stability/transcription modifying sequences derived from known RNA stability/transcription modifying sequences, but having increased or decreased RNA stability/transcription modifying efficiencies or strengths. In varying embodiments, the insert suspected of comprising a RNA stability/transcription modifying sequence comprises a known RNA stability/transcription modifying sequence that has been mutated or mutagenized. The methods of RNA stability/transcription modifying sequence identification described above and herein allow one to take a known RNA stability/transcription modifying sequence, mutagenize it, then run the mutagenized sequences through the RNA stability/transcription modifying sequences selection procedure, thereby generating a quasispecies of new RNA stability/transcription modifying sequences with a range of RNA stability/transcription modifying sequences strengths (ability to increase or decrease RNA stability and/or transcription). This procedure can be done iteratively or generationally (e.g., providing a population of polynucleotides comprising mutagenized promoters, selecting for RNA stability/transcription modifying sequences having increased or decreased transcription efficiency (as desired), recovering RT-PCR products, performing one or more further rounds of mutagenesis and then performing the steps of the methods again, as many iterations as necessary or desired).

4. Method of Identifying a Polynucleotide Sequence Bound by a Transcription Factor Further provided are methods of identifying a polynucleotide sequence bound by a transcription factor. The methods are useful to identify the polynucleotide sequence or sequences bound by any transcription factor known in the art. Sequences identified to be bound by one or more transcription factors can be mutagenized, rerun through the steps of the methods as described herein, and then used to determine stronger or weaker binding site for the transcription factor, as desired. The method entails using a inhibitory nucleic acid, e.g., an RNAi, to reduce the expression and/or activity of the transcription factor being tested. In varying embodiments, the steps of the method comprise:

a) providing a population of plasmids as described above and herein for use in identifying RNA stability/transcription modifying sequences.

b) sequencing the first and second mini-monomer cassettes; thereby linking the barcode polynucleotide to a unique inserted polynucleotide suspected of comprising a RNA stability modifier;

c) transcribing in vitro the population of plasmids into RNA from a control promoter (e.g., a promoter functional in a prokaryotic cell), wherein RNA transcripts comprising the first and second mini-monomer cassettes self-cleave from the transcript;

d) sequencing the self-cleaved first and second mini-monomer cassettes transcribed in vitro; thereby controlling for cleavage and circularization efficiency;

e) transcribing the population of plasmids into RNA from the promoter functional in a eukaryotic cell, wherein the transcribing is performed in a population of host cells and in the presence and absence of an inhibitory nucleic acid that inhibits or reduces the expression of the transcription factor, wherein RNA transcripts comprising the first and second mini-monomer cassettes self-cleave from the transcript;

f) sequencing the self-cleaved first and second mini-monomer cassettes transcribed in a host cell;

g) comparing the relative abundance or frequency of the self-cleaved second mini-monomer cassettes transcribed in the host cell in the presence of the inhibitory nucleic acid with the self-cleaved second mini-monomer cassettes transcribed in a host cell in the absence of the inhibitory nucleic acid, wherein a higher or increased relative abundance or frequency of the self-cleaved second mini-monomer cassettes transcribed in a host cell in the absence of the inhibitory nucleic acid identifies the polynucleotide sequence bound by the transcription factor. In varying embodiments, the inhibitory nucleic acid is an interfering RNA polynucleotide (RNAi). The transcription and sequencing steps can be performed as described above. Further embodiments of the method are as described above for the methods of identifying RNA stability/transcription modifying sequences.

5. Kits

Further provided are kits containing one or more of the constructs or DNA plasmids for screening for promoters or for RNA or transcriptional modifying sequences, as described herein. In varying embodiments, the kits can further comprise in one or more containers or vessels buffers, reagents, nucleotides, enzymes, control polynucleotides, and instructions for use. In varying embodiments, the kits comprise a library of DNA plasmids for use in screening for RNA or transcriptional modifying sequences, wherein in each member of the library, the first mini-monomer cassette has already been preloaded with a unique barcode polynucleotide. Accordingly, each member of the library of DNA plasmids contains a first mini-monomer cassette comprising a different barcode polynucleotide.

EXAMPLES

The following examples are offered to illustrate, but not to limit the claimed invention.

Example 1

An Illustrative Protocol for Selection of Promoters

Materials
1. A plasmid containing
   a. a selectable marker for identifying *E. coli* bacteria containing said plasmid
   b. an origin of replication for maintenance of the plasmid within the *E. coli* bacteria
   c. a mini-monomer cassette containing
      i. a ribozyme catalytic core from the negative strand of the satellite RNA of tobacco ringspot virus (sTRSV)
      ii. two ribozyme cleavage/ligation sites capable of being cleaved and ligated by the ribozyme catalytic core
      iii. binding sites for primers appropriate for reverse transcriptase-polymerase chain reaction (RT-PCR)
      iv. a multiple cloning site (MCS) containing multiple sequentially arranged, adjacent restriction endonuclease cleavage sites for cloning. See, e.g., FIGS. 1-2A-E and 6-8.
2. Random DNA fragments inserted into the MCS from any of the following sources
   a. In vivo-derived DNAs from any biological organism including, but not limited to plants, animals, fungi, protists, bacteria, or Archaea
   b. In vitro-derived DNAs from chemical or enzymatic DNA synthesis
   c. Said random DNA fragments prepared by total or partial DNA degradation by restriction endonuclease cleavage, physical fragmentation followed by ligation of DNA linkers, PCR with random nonamers attached to specific primers followed by PCR with these specific primers, or other methods of DNA fragmentation appropriate for cloning into one or more MCS restriction endonuclease cleavage sites,
3. Reagents for preparation and ligation of random DNA fragments into plasmid to create plasmid libraries
   a. Restriction endonucleases
   b. T4 DNA ligase
   c. Deoxyribonucleotide triphosphates
   d. Klenow fragment of *E. coli* DNA polymerase
4. Reagents for introduction and amplification of plasmid libraries in *E. coli*
   a. Electroporation-quality competent *E. coli* cells
   b. Bacterial growth media, both as plates and liquid
   c. Plasmid DNA preparation materials
5. A source of RNA polymerase activity, such as:
   a. Living cells
   b. Isolated nuclei
   c. Transcriptionally-active cell extracts
   d. Purified RNA polymerases
6. Buffers, salts and ribonucleotide triphosphates appropriate for RNA synthesis if done outside living cells (in vitro)
7. Material for delivery of plasmid DNA to living cells (in vivo), including, but not limited to
   a. Liposomes
   b. Microparticles for particle bombardment made of
      i. Gold, tungsten or other material
8. Reagents for:
   a. Separation, isolation and/or purification of RNA
   b. Removal of any residual DNA
9. A primer (primer 1) complementary to any mini-monomer RNA synthesized
10. A primer (primer 2) with the same sequence as any mini-monomer RNA synthesized
11. Reverse transcriptase
12. Buffers, salts and deoxyribonucleotide triphosphates appropriate for cDNA synthesis in vitro
13. Thermo-stable DNA polymerase for PCR
14. Buffers, salts and deoxyribonucleotide triphosphates appropriate for PCR in vitro
15. Materials for cloning PCR products
16. Materials for direct sequencing Method An illustrative method for producing illustrative mini-monomer RNAs containing promoter sequences
I. Construction of Plasmid Library (Listed in Materials)

Mini-monomer cassette-containing plasmid is digested at one of the restriction endonuclease cleavage sites within the MCS, an example of which would be the restriction endonuclease, Sal I, which leaves a four base palindromic 5' overhang of TCGA. Addition of dTTP, dCTP and the Klenow fragment of *E. coli* DNA polymerase will convert the four base, palindromic 5' overhang left after Sal I cleavage to a two base, non-palindromic 5' overhang. TC 5' extensions will no longer ligate to each other. This reduces the background of re-ligated plasmid during the cloning of the DNA library. The plasmid is now ready to receive the random DNA fragments.

The random DNA fragments can be produced in a variety of ways.

A desired organism's DNA must be purified by either a commercial DNA purification kit (DNAeasy) or other previously established non-commercial method (CTAB, etc.). The simplest method of producing the random DNA fragments from this purified DNA is complete digestion with a restriction endonuclease that will ultimately be compatible with the half-filled, Sal I digested mini-monomer cassette-containing plasmid, an example would be the restriction endonuclease, Sau3AI, which recognizes and cleaves the 4 base sequence GATC, leaves a 4 base palindromic 5' overhang, and should cut randomly approximately every 256 base pairs. Addition of dGTP, dATP and the Klenow fragment of E. coli DNA polymerase will convert the four base, palindromic 5' overhang left after Sau3AI cleavage to a two base, non-palindromic 5' overhang just as was done for the Sal I cleaved plasmid. The 2 base, non-palindromic 5' overhangs of the Sal I-cleaved plasmid and the Sau3AI-cleaved DNA are not compatible with themselves, but are compatible with each other. This should reduce the background of plasmid self-ligation, ligation of insert DNAs to each other and ensure that most plasmids recovered during library construction will have one and only one insert. The use of Sal I and Sau3AI is not exclusive (see Korch C. "Cross index for improving cloning selectivity by partially filling in 5'-extensions of DNA produced by type II restriction endonucleases." Nucleic Acids Res. 1987 Apr. 24; 15(8):3199-220). Many other restriction endonuclease pairs can be used in the same way and the restriction endonuclease cleavage sites in the MCS are chosen to maximize the number of possible cloning choices.

Alternative preparation methods for the purified organismal DNA include partial rather than complete digestion with the desired restriction endonuclease, PCR with primers ending with random nonamer sequences (Robi D. Mitra and George M. Church. (1999) "In situ localized amplification and contact replication of many individual DNA molecules" Nucl. Acids Res. 27 (24)) followed by size selection followed by restriction endonuclease cleavage and filling as described, or random fragmentation and size fractionation of the DNA followed by ligation of linkers with compatible overhangs for ligation to the half-filled, Sal I cleaved plasmid, (See, e.g., Zabarovsky E R, Allikmets R L. (1986) "An improved technique for the efficient construction of gene libraries by partial filling-in of cohesive ends." Gene 42(1): 119-23; Sambrook, J. and Russell, D. W. (2001) "Molecular Cloning: A Laboratory Manual." Cold Spring Harbor Laboratory Press, Cold Spring Harbor, N.Y.)

An alternative to the use of organismal DNA is the use of chemically-synthesized random DNA and selection of any functional promoters from that random DNA population. Ligation of the inserts into the mini-monomer vector makes a plasmid library.

II. Introduce the Plasmid Library (from 1 Listed in Materials) Using Materials (from 3 or 4) into an Environment Containing RNA Polymerase (from 2) Under Appropriate Conditions for RNA Synthesis Either In Vitro or In Vivo.

An In Vitro Example

Prepare a library of randomized chemically synthesized DNA sequences based on the existing bacteriophage T7 RNA polymerase promoter cloned into the mini-monomer vector. Incubate this library with purified bacteriophage T7 RNA polymerase.

An In Vivo Example

For tobacco promoters, use inserts from tobacco genomic DNA cloned into the mini-monomer vector to make a library. Prepare plasmid DNA from the complete library, coat gold or tungsten particles (from 7b) with the library plasmid DNA, then use a biolistic particle delivery system to transfer the library of plasmids into plant nuclei (Julie R. Kikkert, Jose R. Vidal, and Bruce I. Reisch "Stable Transformation of Plant Cells by Particle Bombardment/Biolistics" Methods in Molecular Biology, vol. 286: Transgenic Plants: Methods and Protocols Edited by: L. Peña © Humana Press Inc., Totowa, N.J.).

III. Purification of Total RNA and Removal of any Residual DNA Using Appropriate Reagents (from 5).

In vitro synthesized RNA is purified after removal of the plasmid DNA library by digestion with commercial RNase-free DNase (Qiagen), followed by phenol/chloroform/isoamyl alcohol (25:24:1) extraction, removal of the aqueous phase to a new tube, and ethanol precipitation of the RNA from the aqueous phase with or without glycogen or linear acrylamide carrier.

In vivo synthesized RNA is purified with either a commercial kit (Qiagen RNAeasy) or with a TRIzol extraction protocol (Chomczynski, P., and Sacchi, N. (1987) Single Step Method of RNA Isolation by Acid Guanidinium Thiocyanate-Phenol-Chloroform Extraction. Anal. Biochem. 162, 156-159) (alternative protocols are used as needed depending on the source of the RNA to be purified).

IV. cDNA Synthesis Using Reverse Transcriptase, Buffer and Primer (from 9-12)

cDNA synthesis from purified total RNA is done using SuperScript II using the manufacturer's protocol (Life Technologies). Alternatively SuperScript III or other reverse transcriptase can be used. Primer 1 (from 9) is added to the total RNA in water and deoxynucleotide triphosphates, heated to 65 degrees C. for 5 minutes followed by quick chilling on ice. The other components necessary for cDNA synthesis is added (first strand reverse transcriptase buffer, dithiothreitol (DTT), and the mixture incubated at 42 for 2 minutes. Reverse transcriptase is added and the entire mixture is incubated at 42 degrees C. for 50 minutes, followed by enzyme inactivation at 70 degrees C. for 15 minutes.

V. PCR Using the Primers, Buffers, and Thermo-Stable DNA Polymerase (from 9, 10, 13 and 14)

PCR reactions are done on the synthesized cDNA using Herculase II Fusion DNA polymerase (Agilent Genomics) using the manufacturer's protocol. Alternatively, other thermostable DNA polymerases can be substituted such as Phusion DNA polymerase (NewEnglandBiolabs).

Annealing conditions for the PCR are adjusted depending on the melting temperatures based on the specific sequences of primers 1 and 2 (from 9 and 10). Extension times should be minimized to amplify only the smaller products derived from cDNA derived from the total RNA containing the circular ribozyme-ligated RNA. The number of PCR cycles necessary should be determined empirically depending on the concentration of amplifiable cDNA present.

Newly synthesized PCR products are checked on either 1 to 2 percent TBE or TAE agarose gels or on 5% non-denaturing TBE polyacrylamide gels depending on the resolution desired for a given experiment. Purification of any individual strong bands can be achieved from either of these gel types, if desired.

VI. Cloning Newly Synthesized PCR Products (from 15) or Direct Sequencing of New Synthesized PCR Products (from 16)

Once synthesized, PCR products can either be cloned as blunt ended DNA fragments by TOPO cloning (Life Technologies) using the manufacturer's protocol, or by restriction endonuclease cleavage of the PCR products at restriction endonuclease cleavage sites incorporated into primers 1 and 2 back into the mini-monomer plasmid for subsequent analysis or further rounds of selection, or into any other plasmid containing compatible restriction endonuclease cleavage sites. These clones represent individual promoter sequences. General mutation, for example through mutagenic PCR, of these individual promoters followed by subsequent selection and analysis of the promoter strength in vitro or in vivo leads to potentially patentable material.

Direct sequencing is an essential aspect of this method and depends on the use of primer 1 and 2 (from 9 and 10) chosen to match existing deep sequencing primer sets, for example those for MiSeq or HiSeq (Illumina), including the ability to use "bar coding" to get sequences from multiple experiments in a single deep sequence run due to sequencing costs (Illumina). The selection of MiSeq, which produces fewer total sequences (10s of millions), or HiSeq, which produces more total sequences (100s of millions) are made based on the expectation of the complexity of the potential promoter population being examined and the need for getting sufficient numbers of sequences for statistical analysis.

Example 2

An Illustration of Promoter Selection

This example illustrates an embodiment of the methods for selection of polynucleotides encoding a promoter.

Figure 6:
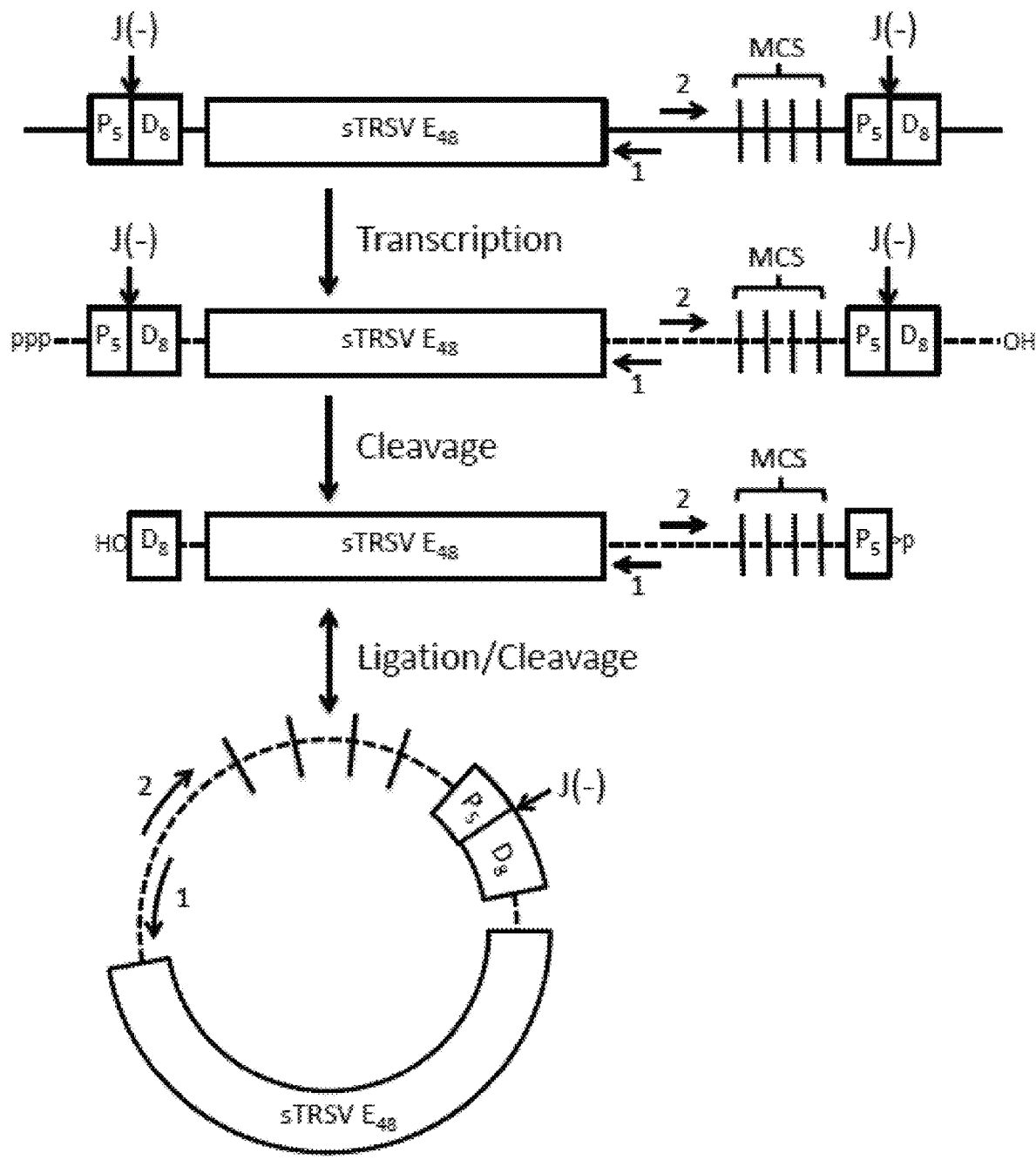
FIG. 6 illustrates a mini-monomer cassette. P and D represent the 5' and 3' sides of the (-) strand ribozyme cleavage size. E represents the (-) strand ribozyme catalytic core. The subscripted numbers represent the number of ribozyme catalytic core nucleotides present in each of these sections. The J(-) designated by the black down arrows represents the cleavage and ligation sites used by the ribozyme catalytic core. The multiple cloning site (MCS) has a number of unique restriction endonuclease cleavage sites. The black arrows labeled 1 and 2 represent primers for RT-PCR. The arrows represent the 3' end of the primers. Transcription produces a primary transcript beginning with a 5' triphosphate (ppp) and a 3' hydroxyl (OH). Ribozyme-mediated processing (e.g., self-cleaving) at the J(-) sites giving a linear mini-monomer RNA with a 5' hydroxyl (HO) and a 2':3' cyclic phosphodiester (>p). Intramolecular ligation and cleavage interconverts the linear mini-monomer RNA to a circular mini-monomer RNA.

The initial construct can have the following form. Two (-) strand ribozyme cleavage sites along with a (-) strand ribozyme catalytic core is cloned along with a multiple cloning site in the follow order (FIG. 6). This ribozyme insert is referred to as a mini-monomer.

Transcription of this insert by a promoter outside the mini-monomer insert produces a primary transcript shown in FIG. 6. Complete ribozyme-mediated cleavage of this primary transcript produces the linear mini-monomer RNA (FIG. 6). The other cleavage products as well as partial ribozyme-mediated cleavage products are not shown, but would be present. Intramolecular ligation and cleavage interconverts this product from a linear mini-monomer to a circular mini-monomer form and from a circular mini-monomer to a linear mini-monomer form respectively.

This mini-monomer cassette is cloned into a plasmid backbone. In this example pUN is used. pUN is a minimal plasmid derived from pUC18 by removal of all but the origin of replication and the selection gene (here, an antibiotic resistance gene, e.g., a beta-lactamase (bla) gene). In this example, the plasmid backbone contains two unique restriction sites, EcoRV and NotI. pUN was selected for its short length to maximize the chances of greater than full length transcripts being produced. The mini-monomer cassette is cloned directionally such that transcription from the bla gene promoter produces the antisense version of the ribozyme fragment (FIG. 7).

FIG. 7 shows the plasmid backbone with mini-monomer cassette construct (e.g, pUN1). Notice that the promoter for the beta-lactamase gene is oriented such that any transcription from it gives the antisense of the mini-monomer cassette. This lowers the possibility of accidental promoter discovery due to the beta-lactamase promoter, however it could be in either orientation. Inserts possibly containing eukaryotic promoters are cloned into the mini-monomer cassette MCS of the plasmid backbone (e.g, pUN1)-minimonomer cassette plasmid. These inserts can have a large number of sources such as fragments containing random nucleotides, restriction fragments of eukaryotic DNA, or randomized PCR fragments of eukaryotic DNA, most likely size selected. This is not an exhaustive list of possible insert DNA sources.

An insert containing a functional eukaryotic promoter is transcribed into RNA from its transcription start site. Notice that while part of the insert is found at the 5' end of the primary transcript, most, if not all, of the promoter itself is not found until later. However, as the plasmid backbone (e.g., pUN) is small and is designed not to contain a functional eukaryotic terminator, the primary transcript continues around the full length of the plasmid and the full insert on its second pass through that part of the plasmid. In the absence of a terminator, the primary transcript can be substantially longer than shown, and will produce the full-length mini-monomer RNA sequence containing the functional promoter.

Optionally, a control promoter (cPro), e.g., a promoter functional in a prokaryotic cell (e.g., a T7 RNA polymerase promoter and can be placed immediately 5' of the initial ribozyme cleavage site as shown in the lower construct FIG. 8. Transcription of the plasmid library in vitro with T7 RNA polymerase followed by RT-PCR with primers 1 and 2 and deep sequencing gives a processing and library bias-controlled deep sequencing data set for comparison with deep sequencing data sets derived from internal promoters (tPro in the lower construct in FIG. 8). This is not absolutely necessary as there are other ways of dealing with this issue. For example, one can perform PCR of the plasmid library with primers where the upstream primer has a RNA polymerase promoter (e.g., bacteriophage T3, T7 or SP6) attached.

The primary transcript from a test polynucleotide suspected of containing a functional promoter is shown in FIG. 9 and the complete processing products are shown in FIG. 10. In reality, partial processing products can also be present. Any transcript that is terminated after the ribozyme catalytic core ($E_{48}$), but before the $P_5$-$D_8$ immediately downstream of the catalytic core is processed, but are not able to form a circular mini-monomer containing the promoter-carrying insert. Any transcripts that terminate after the $P_5$-$D_8$ immediately downstream of the catalytic core can form a circular mini-monomer containing the promoter-carrying insert.

Synthesized cDNA from reverse transcription of RNA expressed from any insert carrying a functional eukaryotic promoter using primer 1, followed by PCR with primer 1 and primer 2 gives a PCR product, containing the mini-monomer sequence with the promoter-containing insert if the RNA template for reverse transcription is circular. Unprocessed transcripts are not circular. If PCR product is made on residual circular plasmid DNA, it gives a larger PCR product containing all of pUN-mini-monomer-insert DNA sequence, which is substantially larger and can be excluded by adjusting PCR conditions or, in the case of residual DNA template, by treatment with DNase or the restriction endonuclease Dpn I. These RT-PCR-derived DNAs can only be produced if a cloned DNA insert contains a functional eukaryotic promoter.

An alternative method to using total RNA involves purification of circular RNAs from all other RNAs using a two-dimensional gel system. The first dimension consists of a denaturing 7M urea, 1×TBE polyacrylamide gel of 5 to 6.5% total acrylamide concentration with 39:1 acrylamide: bis-acrylamide ratio. The second dimension consists of a denaturing 7M urea, 1×TBE polyacrylamide gel of the same total acrylamide concentration with 38:2 acrylamide:bis-acrylamide ratio. The two dimensions are cast together, the extracted total RNA is run first in the first dimension, which is then removed from the gel apparatus, rotated 90 degrees then put back on the gel apparatus and run in the second dimension. In a typical two-dimensional gel, two diagonals are seen—one for the linear RNAs and one for the circular RNAs. The circular RNAs are well separated from the linear RNAs. Due to the greater electrophoretic mobility of the linear RNAs in both the first and second dimensions compared to the circular RNAs, which are preferentially retarded in the second dimension gel compared to the linear RNAs, one also sees that the linear RNAs are not only on the linear diagonal, but also are farther down the linear diagonal than the circular RNAs are down the circular diagonal. Circular RNA size standards can be made without the primer binding sites to more easily delineate the diagonal of circles.

Using purified circular RNAs should give a much cleaner result. It also allows for a different approach to the reverse transcription as well. The primer binding sites can be positioned or located on opposite sides of the DNA insert with primer 1 being moved towards the 3' side of the insert. This change is not required, but is possible.

Example 3

An Illustration of RNA Stability/Transcription Modifier Selection

This example illustrates an embodiment of the methods for selection of polynucleotides encoding a RNA stability modifier or a transcription modifier.

In one embodiment, a promoter functional in a prokaryotic cell (e.g., a T7 RNA polymerase promoter) is retained for generating the same control described in Example 1, above. Adjacent to the control promoter (cPro, e.g., T7 RNA polymerase promoter) is a test promoter (tPro in FIG. 11) from the organism whose RNA stability and transcription modifying sequences are being sought. One difference between this construct and the one above is that the plasmid backbone itself need not be a minimal plasmid as transcription all the way around is not necessary. The use of a larger plasmid has the advantage of minimizing the chance of generating any competing PCR products all the way around the plasmid DNA.

As before an in vitro transcription with a control promoter (e.g., T7 RNA polymerase promoter) serves as an internal control as described above. As before, the library can be derived from natural sequences from an organism's DNA or can be randomized DNA (25 or 50 N residues, for example). Insertion of this plasmid library into cells or possibly transcriptionally active extracts followed by the same basic protocol of RT-PCR then deep sequencing gives RNA stabilizing or destabilizing inserts by looking for sequences that are increased or decreased in the deep sequenced population.

One possibility that must be considered is that any under or overrepresented sequence is due to a distance effect on the promoter by the insert, which is functioning as an enhancer or repressor of transcription. These can function up to 10 kilobases away from a promoter either upstream or downstream. To overcome to this problem, a construct as depicted in FIG. 11 can be used.

To reduce the possibility of recombination between two identical ribozyme core sequences, two related ribozyme cores can be used—for example, one from the satellite RNA of tobacco ringspot virus (sTRSV) as in the constructs described in Examples 1 and 2, and one from the satellite RNA of arabis mosaic virus (sArMV). The slightly different sequences not only decrease recombination between the two ribozyme cores, but also serve as an internal control for the deep sequencing. Construction of functional libraries begins with cloning of the barcodes into the first (e.g., sArMV) mini-monomer construct, followed by deep sequencing to determine library extent. This first step barcoded library is then used to construct a library of inserts for functional testing. Deep sequencing of this insert-containing library links any individual plasmid library member's barcode and insert sequence. Experimentation is performed as described previously with the variation of reverse transcription with primers 1 and 3, followed by PCR with primer sets 1 and 2 to measure the presence of the insert-containing mini-monomer and 3 and 4 to measure the presence of the barcode-containing mini-monomer. Comparison of the ratio of the appropriate barcoded mini-monomer to its linked insert mini-monomer allows discrimination between those inserts that actually affect RNA stability and those that affect transcription. Those that affect RNA stability increase or decrease the insert mini-monomer relative to the barcode mini-monomer if they increase or decrease the RNA stability respectively. Those that affect transcription only do not affect the ratio, instead increasing or decreasing both mini-monomers coordinately.

One attractive application of this approach is the de novo selection and subsequent evolution of externally influenced transcriptional or RNA stability sequences. Using a library containing random DNA fragments as insert sequences, insertion of this library into cells with or without some external factor (e.g., $Ca^{2+}$ ions, salt, temperature stress, hormones, etc.), followed by analysis as described previously allows detection of sequences that are increased preferentially in the presence of the external factor. Analysis of these sequences allows determination of common features that can make the significant structural features more obvious. Reconstruction of a library of mutagenized sequences related to these initial sequences followed by reanalysis, again in the presence or absence of the external factor, allows an evolutionary optimization of said sequences, ultimately leading to the selection of a de novo optimized transcriptional or RNA stability sequence that can be used in the construction of novel promoters or modified genes that are responsive to the external factor in question.

Example 4

Illustrative Selection of Functional Mutant T7 RNA Polymerase Promoters

Randomized oligonucleotides with 75% correct T7 RNA polymerase nucleotides at each of 17 positions were cloned into a mini-monomer cassette-containing plasmid forming a library containing approximately 500,000 unique sequences. Transcription with T7 RNA polymerase, phenol/chloroform/iso-amyl alcohol extraction, ethanol precipitation, and reverse transcription were performed as described for Examples 1 and 2, above. PCR was done of the resulting cDNA with primers that added appropriate indexed sequences for Illumina deep sequencing, as described above and herein. PCR was also done directly on the library plasmid, again adding the appropriate sequences for Illumina deep sequencing, but with a different index. The appropriately sized PCR products from the cDNA and from the plasmid library were gel purified. An equal mass amount of the two products were mixed and submitted for Illumina MiSeq deep sequencing. Approximately 5 million sequences were generated for each of the cDNA and plasmid library after separation based on the primer indices. For both cDNA and library PCR products, non-promoter sequences were trimmed, promoter sequences were separated based on the number of mutations present in each sequence, and the number of times any given sequence was present was determined. Comparing the ratio of the fraction of wildtype T7 RNA polymerase promoter present in the cDNA PCR products with the fraction of wildtype T7 RNA polymerase promoter present in the plasmid library PCR products with that for any given mutant provides an indication of the relative strength, defined as the promoter's ability to produce RNA, of the particular mutant promoter and the wildtype promoter. 73464 functional mutant T7 RNA polymerase promoters were selected in this manner. See, SEQ ID NOs: 10-73473 listed in the text-formatted computer readable sequence listing filed herewith, and incorporated herein by reference. They represent almost all possible double mutants, roughly half of the possible triple mutants and a smaller fraction of the possible quadruple and quintuple mutants. Sequences containing 6 or more mutations were not considered due to their low prevalence in the plasmid library. Only those mutants that were recovered as a cDNA and whose sequence was present in the initial plasmid library were included. Also, a few known double mutant promoters from an earlier T7 promoter paper were removed. The identified mutant T7 RNA polymerase promoters of SEQ ID NOs: 10-73473 find use to express coding and non-coding RNA molecules of interest, e.g., using methods well-known in the art.

Example 5

Illustrative Selection of Functional Mutant T7 RNA Polymerase Promoters In Vivo

The random library of approximately 500,000 unique T7 RNA polymerase promoters from Example 4 was inserted by electroporation into *E. coli* Shuffle T7 (New England Biolabs) cells, which contains an inducible T7 RNA polymerase gene. A small fraction of the cells was plated to determine that the entire library of 500,000 variants was represented. 2,000,000 transformants were made ensuring reasonable representation of the original library's complexity. The remaining cells were grown overnight at 37° C. to stationary phase. A fresh culture of the library was started and expression of the T7 RNA polymerase in vivo was induced by the addition of the inducer isopropyl β-D-1 thiogalactopyranoside (IPTG). After two hours, total RNA was purified from the cells (SigmaAldritch GenElute Universal Total RNA purification kit). Reverse transcription were performed as described for Examples 1 and 2, above. PCR was done of the resulting cDNA with primers that added appropriate indexed sequences for Illumina deep sequencing, as described above and herein. PCR was also done directly on the library plasmid prepared from a separate fraction of the same cells used for the total RNA purification at the same time point (2 hours after IPTG induction), again adding the appropriate sequences for Illumina deep sequencing, but with a different index. The appropriately sized PCR products from the cDNA and from the plasmid library were gel purified. An equal mass amount of the two products were mixed and submitted for Illumina MiSeq deep sequencing. Approximately 8 and 10 million sequences were generated respectively for the cDNA and plasmid library after separation based on the primer indices. For both cDNA and library PCR products, non-promoter sequences were trimmed, promoter sequences were separated based on the number of mutations present in each sequence, and the number of times any given sequence was present was determined. Comparing the ratio of the fraction of wildtype T7 RNA polymerase promoter present in the cDNA PCR products with the fraction of wildtype T7 RNA polymerase promoter present in the plasmid library PCR products with that for any given mutant provides an indication of the relative strength, defined as the promoter's ability to produce RNA, of the particular mutant promoter and the wildtype promoter. In this case, analysis was limited to single, double and triple mutants. We were able to analyze all possible single mutants, 99.9% of all possible double mutants, and 94.1% of all possible triple mutants. A smaller number of quadruple mutants were analyzed, but not beyond measuring their relative activity to wildtype. Five examples of mutant T7 RNA polymerase promoters with higher than wildtype activity were selected and inserted into plasmids with the coding sequence for the GFP protein. Increased in vivo expression of this gene was found after immunoblot with anti-GFP antibody.

Example 6

Illustrative Recovery of a Known Yeast Promoter Sequence after In Vivo Expression A yeast 2 micron plasmid containing a mini-monomer cassette was constructed beginning by doing PCR of the yeast 2 micron plasmid, pYES2 to delete gal promoters and leave a BglII, NotI and XbaI sites. The mini-monomer cassette was inserted into this as a BglII-XbaI fragment to give the desired construct. The TEF promoter construct was made by amplifying the TEF promoter by PCR as a BamHI-SalI fragment from the plasmid p427-TEF and cloned into the yeast 2 micron plasmid with the mini-monomer cassette as a BamHI-SalI fragment. The control construct (used the EGFP coding sequence in the antisense orientation) was made by moving the GFP coding sequence as a BglII-SalI fragment into the BamHI-SalI sites of the yeast 2 micron plasmid with the mini-monomer cassette. These plasmids were constructed and amplified using *E. coli* NEB5alpha. Plasmids were purified from carbenicillin resistant *E. coli* using Zymoresearch Zyppy™ Plasmid Miniprep Kit. The *Saccharomyces cerevisiae* yeast strain, INVSc1, was made competent and transformed using Zymoresearch Frozen-EZ Yeast Transformation II Kit™. Transformed yeast was selected and maintained on synthetic defined media lacking uracil. Selected yeast colonies were scraped from plates, crushed with sand in a morter and pestle in ice cold RLT Buffer and RNA isolated using a Qiagen RNeasy kit. Reverse transcription and PCR were as described in Example 1 and 2.

Example 7

Illustrative Recovery of Known Cytomegalovirus Core Promoter and Enhancer Sequences after In Vivo Expression The Cytomegalovirus (CMV) enhancer (Enh) was cloned upstream of a mini-monomer cassette. Into the multiple cloning site (MCS) was cloned the CMV core promoter (Pro). A second construction was made with the CMV Pro downstream of a mini-monomer cassette. Into the MCS of this second construct was cloned the CMV Enh. These plasmids were amplified in *E. coli* DH5alpha. Mirus CHO cell Transfection reagent was used to transfect CHO cells with each construct. A control with the transfection reagent but no plasmid DNA was done in parallel. Total RNA extracts were prepared after 24 hours using the SigmaAldrich GenElute Universal RNA extraction kit either with or without DNase treatment on the column. Reverse transcription and PCR were as described in Example 1 and 2.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

| INFORMAL SEQUENCE LISTING |
|---|
| Sequence ID No: 1-Nucleic acid sequence of Plasmid for Screening Promoters
AGATCTGACCGTCCTGTCCGTATGACAGAGAAGTCAACCAGAGAAACACACGTTGTGGTATA
TTACCTGGTGGCGCGCCGAATTCTGGAATTCTCGGGTGCCAAGGGTTCAGAGTTCTACAGTC
CGACGATCGCGGCCGCGTCGACGGATCCAAGCTTCCTGCAGGTGACCGTCCTGTCTCTAGAC
GCGTTGCTGGCGTTTTTCCATAGGCTCCGCCCCCCTGACGAGCATCACAAAAATCGACGCTC
AAGTCAGAGGTGGCGAAACCCGACAGGACTATAAAGATACCAGGCGTTTCCCCCTGGAAGCT
CCCTCGTGCGCTCTCCTGTTCCGACCCTGCCGCTTACCGGATACCTGTCCGCCTTTCTCCCT
TCGGGAAGCGTGGCGCTTTCTCATAGCTCACGCTGTAGGTATCTCAGTTCGGTGTAGGTCGT
TCGCTCCAAGCTGGGCTGTGTGCACGAACCCCCCGTTCAGCCCGACCGCTGCGCCTTATCCG
GTAACTATCGTCTTGAGTCCAACCCGGTAAGACACGACTTATCGCCACTGGCAGCAGCCACT
GGTAACAGGATTAGCAGAGCGAGGTATGTAGGCGGTGCTACAGAGTTCTTGAAGTGGTGGCC
TAACTACGGCTACACTAGAAGAACAGTATTTGGTATCTGCGCTCTGCTGAAGCCAGTTACCT
TCGGAAAAAGAGTTGGTAGCTCTTGATCCGGCAAACAAACCACCGCTGGTAGCGGTGGTTTT
TTTGTTTGCAAGCAGCAGATTACGCGCAGAAAAAAAGGATCTCAAGAAGATCCTTTGATCTT
TTCTACGGGGTCTGACGCTCAGTGGAACGAAAACTCACGTTAAGGGATTTTGGTCATGAGAT
TATCAAAAAGGATCTTCACCTAGATCCTTTTAAATTAAAAATGAAGTTTTAAATCAATCTAA
AGTATATATGAGTAAACTTGGTCTGACAGTTACCAATGCTTAATCAGTGAGGCACCTATCTC
AGCGATCTGTCTATTTCGTTCATCCATAGTTGCCTGACTCCCCGTCGTGTAGATAACTACGA
TACGGGAGGGCTTACCATCTGGCCCCAGTGCTGCAATGATACCGCGAGACCCACGCTCACCG
GCTCCAGATTTATCAGCAATAAACCAGCCAGCCGGAAGGGCCGAGCGCAGAAGTGGTCCTGC
AACTTTATCCGCCTCCATCCAGTCTATTAATTGTTGCCGGGAAGCTAGAGTAAGTAGTTCGC
CAGTTAATAGTTTGCGCAACGTTGTTGCCATTGCTACAGGCATCGTGGTGTCACGCTCGTCG
TTTGGTATGGCTTCATTCAGCTCCGGTTCCCAACGATCAAGGCGAGTTACATGATCCCCCAT
GTTGTGCAAAAAAGCGGTTAGCTCCTTCGGTCCTCCGATCGTTGTCAGAAGTAAGTTGGCCG
CAGTGTTATCACTCATGGTTATGGCAGCACTGCATAATTCTCTTACTGTCATGCCATCCGTA
AGATGCTTTTCTGTGACTGGTGAGTACTCAACCAAGTCATTCTGAGAATAGTGTATGCGGCG
ACCGAGTTGCTCTTGCCCGGCGTCAATACGGGATAATACCGCGCCACATAGCAGAACTTTAA
AAGTGCTCATCATTGGAAAACGTTCTTCGGGGCGAAAACTCTCAAGGATCTTACCGCTGTTG
AGATCCAGTTCGATGTAACCCACTCGTGCACCCAACTGATCTTCAGCATCTTTTACTTTCAC
CAGCGTTTCTGGGTGAGCAAAAACAGGAAGGCAAAATGCCGCAAAAAAGGGAATAAGGGCGA
CACGGAAATGTTGAATACTCATACTCTTCCTTTTTCAATATTATTGAAGCATTTATCAGGGT
TATTGTCTCATGAGCGGATACATATTTGAATGTATTTAGAAAAATAAACAAATAGGGGTTCC
GCG |

SEQ ID NO: 1-Feature list

| Name | Location |
|---|---|
| ampR | rev: 960 . . . 1820 |
| rep (pMB1) | rev: 186 . . . 800 |
| ampr promoter | rev: 1821 . . . 1925 |
| seq1 | 1827 . . . 1856 |
| seq2 | rev: 237 . . . 260 |
| P5 | 6 . . . 10 |
| D8 | 11 . . . 18 |
| E48 | 24 . . . 71 |
| Multiple cloning site (MCS) | 72 . . . 85 |
| Reverse transcriptase primer 1 | 86 . . . 106 |
| Primer 2 | 107 . . . 132 |
| Multiple cloning site (MCS) | 133 . . . 166 |
| second P5 | 167 . . . 171 |
| second D8 | 172 . . . 179 |

Sequence ID No: 2-Nucleic acid sequence of Plasmid for Screening RNA Stability and/or transcription modifiers
AGATCTGACAGTACTGTCCGTATGACAGCGAAGTCAAACGGCGAAACACACCTTGTGGTA
TATTACCCGTTCCTAGGGTCTCGTGGGCTCGGTCGTCGGCAGCGTCGGTACCACTAGTTGAC
CGTCCTGTCCGTATGACAGAGAAGTCAACCAGAGAAACACACGTTGTGGTATATTACCTGGT
GGCGCGCCGAATTCTGGAATTCTCGGGTGCCAAGGGTTCAGAGTTCTACAGTCCGACGATCG
CGGCCGCGTCGACGGATCCAAGCTTCCTGCAGGTGACCGTCCTGTCTCTAGACGCGTTGCTG
GCGTTTTTCCATAGGCTCCGCCCCCCTGACGAGCATCACAAAAATCGACGCTCAAGTCAGAG
GTGGCGAAACCCGACAGGACTATAAAGATACCAGGCGTTTCCCCCTGGAAGCTCCCTCGTGC
GCTCTCCTGTTCCGACCCTGCCGCTTACCGGATACCTGTCCGCCTTTCTCCCTTCGGGAAGC
GTGGCGCTTTCTCATAGCTCACGCTGTAGGTATCTCAGTTCGGTGTAGGTCGTTCGCTCCAA
GCTGGGCTGTGTGCACGAACCCCCCGTTCAGCCCGACCGCTGCGCCTTATCCGGTAACTATC
GTCTTGAGTCCAACCCGGTAAGACACGACTTATCGCCACTGGCAGCAGCCACTGGTAACAGG

INFORMAL SEQUENCE LISTING

```
ATTAGCAGAGCGAGGTATGTAGGCGGTGCTACAGAGTTCTTGAAGTGGTGGCCTAACTACGG
CTACACTAGAAGAACAGTATTTGGTATCTGCGCTCTGCTGAAGCCAGTTACCTTCGGAAAAA
GAGTTGGTAGCTCTTGATCCGGCAAACAAACCACCGCTGGTAGCGGTGGTTTTTTTGTTTGC
AAGCAGCAGATTACGCGCAGAAAAAAAGGATCTCAAGAAGATCCTTTGATCTTTTCTACGGG
GTCTGACGCTCAGTGGAACGAAAACTCACGTTAAGGGATTTTGGTCATGAGATTATCAAAAA
GGATCTTCACCTAGATCCTTTTAAATTAAAAATGAAGTTTTAAATCAATCTAAAGTATATAT
GAGTAAACTTGGTCTGACAGTTACCAATGCTTAATCAGTGAGGCACCTATCTCAGCGATCTG
TCTATTTCGTTCATCCATAGTTGCCTGACTCCCCGTCGTGTAGATAACTACGATACGGGAGG
GCTTACCATCTGGCCCCAGTGCTGCAATGATACCGCGAGACCCACGCTCACCGGCTCCAGAT
TTATCAGCAATAAACCAGCCAGCCGGAAGGGCCGAGCGCAGAAGTGGTCCTGCAACTTTATC
CGCCTCCATCCAGTCTATTAATTGTTGCCGGGAAGCTAGAGTAAGTAGTTCGCCAGTTAATA
GTTTGCGCAACGTTGTTGCCATTGCTACAGGCATCGTGGTGTCACGCTCGTCGTTTGGTATG
GCTTCATTCAGCTCCGGTTCCCAACGATCAAGGCGAGTTACATGATCCCCCATGTTGTGCAA
AAAAGCGGTTAGCTCCTTCGGTCCTCCGATCGTTGTCAGAAGTAAGTTGGCCGCAGTGTTAT
CACTCATGGTTATGGCAGCACTGCATAATTCTCTTACTGTCATGCCATCCGTAAGATGCTTT
TCTGTGACTGGTGAGTACTCAACCAAGTCATTCTGAGAATAGTGTATGCGGCGACCGAGTTG
CTCTTGCCCGGCGTCAATACGGGATAATACCGCGCCACATAGCAGAACTTTAAAAGTGCTCA
TCATTGGAAAACGTTCTTCGGGGCGAAAACTCTCAAGGATCTTACCGCTGTTGAGATCCAGT
TCGATGTAACCCACTCGTGCACCCAACTGATCTTCAGCATCTTTTACTTTCACCAGCGTTTC
TGGGTGAGCAAAAACAGGAAGGCAAATGCCGCAAAAAAGGGAATAAGGGCGACACGGAAAT
GTTGAATACTCATACTCTTCCTTTTTCAATATTATTGAAGCATTTATCAGGGTTATTGTCTC
ATGAGCGGATACATATTTGAATGTATTTAGAAAAATAAACAAATAGGGGTTCCGCG
```

SEQ ID NO: 2-Feature list

| Name | Location |
|---|---|
| ampR | rev: 1075 . . . 1935 |
| rep (pMB1) | rev: 301 . . . 915 |
| ampr promoter | rev: 1936 . . . 2040 |
| seq1 | 1942 . . . 1971 |
| seq2 | rev: 352 . . . 375 |
| P5 | 6 . . . 10 |
| D8 | 11 . . . 18 |
| sArMV E50 | 24 . . . 73 |
| Reverse transcriptase primer 3 | 80 . . . 94 |
| Primer 4 | 95 . . . 108 |
| Barcode insertion site | 115 . . . 120 |
| second P5 | 121 . . . 125 |
| second D8 | 126 . . . 133 |
| sTRSV E48 | 139 . . . 186 |
| Multiple cloning site (MCS) | 187 . . . 200 |
| Multiple cloning site (MCS) | 248 . . . 281 |
| Reverse transcriptase primer 1 | 201 . . . 221 |
| Primer 2 | 222 . . . 247 |
| third P5 | 282 . . . 286 |
| third D8 | 287 . . . 294 |

Sequence ID No: 3-negative strand self-cleavage domain of the satellite RNA of tobacco ringspot virus (sTRSV)
GACAGAGAAGTCAACCAGAGAAACACACGTTGTGGTATATTACCTGGT Sequence ID No: 4-negative strand self-cleavage domain of the satellite RNA of arabis mosaic virus (sArMV)
GACAGCGAAGTCAAACGGCGAAACACACCTTGTGTGGTATATTACCCGTT Sequence ID No: 5-negative strand self-cleavage domain of the satellite RNA of the satellite RNA of chicory yellow mottle virus (sCYMV)
GACAGCGAAGTCAGCCAGGGAAACACACCATGTGTGGTATATTATCTGGC Sequence ID No: 6-ribozyme cleavage site
TGACCGTCCTGTC Sequence ID No: 7-Generalized ribozyme cleavage site
$N_{S1}N_{S2}N_{S3}N_{S4}NGUCN_{S5}N_{S6}N_{S7}N_{S8}N_{S9}$
Wherein N = Any nucleotide (For RNA, A, C, G or U)

SEQ ID NO: 8 -generalized negative strand self-cleavage domain
$N_{E9}N_{E8}N_{E7}N_{E6}N_{E5}$(A/C)
$GAAN_{E4}N_{E3}N_{E2}N_{E1}N_{E10}N_{E11}N_{E12}N_{E13}N_{E14}AGAAACAN_{E20}N_{E21}N_{E22}N_{L6}$
$N_{L7}N_{L8}N_{L9}N_{L10}N_{E22'}N_{E21'}N_{E20'}GUAUAUUACN_{E14'}N_{E13'}N_{E12'}N_{E11'}N_{E10'}$ Wherein N = Any nucleotide (For RNA, A, C, G or U)

-continued

INFORMAL SEQUENCE LISTING

Interactions between the generalized ribozyme cleavage site (SEQ ID NO: 7) and the generalized negative strand self-cleavage domain (SEQ ID NO: 8) are via hydrogen bonds forming two stems-1 and 2

Stem 1 is formed by hydrogen bonds between $N_{S1}$ and $N_{E1}$, $N_{S2}$ and $N_{E2}$, $N_{S3}$ and $N_{E3}$, $N_{S4}$ and $N_{E4}$.

Stem 2 is formed by hydrogen bonds between $N_{S5}$ and $N_{E5}$, $N_{S6}$ and $N_{E6}$, $N_{S7}$ and $N_{E7}$, $N_{S8}$ and $N_{E8}$, $N_{S9}$ and $N_{E9}$.

Interactions within the generalized negative strand self-cleavage domain form 2 stems-3 and 4.

Stem 3 is formed by hydrogen bonds between $N_{E10}$ and $N_{E10'}$, $N_{E11}$ and $N_{E11'}$, $N_{E12}$ and $N_{E12'}$, $N_{E13}$ and $N_{E13'}$, $N_{E14}$ and $N_{E14'}$, Stem 4 is formed by hydrogen bonds between $N_{E20}$ and $N_{E20'}$, $N_{E21}$ and $N_{E21'}$, and $N_{E22}$ and $N_{E22'}$.

Stem 1 is essentially universally 4 base pairs long
Stem 2 can be as short as 4 base pairs, but can be longer
Stem 3 is essentially universally 5 base pairs long
Stem 4 is from 2 to 4 base pairs long depending on the source Loop 1 can be as small as 4 nucleotides, if it is a special sequence called a tetra-loop, but can be longer, e.g., 100's of nucleotides up to 1000 nucleotides
Loop 2 varies from 4 to 6 bases long in natural sequences Sequence ID No: 9-intentionally left blank Sequence ID Nos: 10-73473-listed in the text-formatted computer readable sequence listing filed herewith, and incorporated herein by reference.

SEQUENCE LISTING (73473 sequences)

SEQ ID NO: 1 - DNA, 1925 bp, Artificial Sequence
  Synthetic DNA
  misc_feature (6)..(10): P5 sequence
  misc_feature (11)..(18): D8 sequence
  misc_feature (24)..(71): E48 sequence
  misc_feature (72)..(85): Multiple cloning site (MCS)
  primer_bind (86)..(106): Reverse transcriptase primer 1 binding site
  primer_bind (107)..(132): Primer 2 binding site
  misc_feature (133)..(166): Multiple cloning site (MCS)
  misc_feature (167)..(171): Second P5 sequence
  misc_feature (172)..(179): Second D8 sequence
  rep_origin (186)..(800): pMB1 origin of replication in the reverse orientation
  primer_bind (237)..(260): Seq2 primer binding site
  gene (960)..(1820): Beta-lactamase gene in the reverse orientation
  promoter (1821)..(1925): beta-lactamase promoter in the reverse orientation
  primer_bind (1827)..(1856): Seq1 primer binding site
agatctgaccgtcctgtccgtatgacagagaagtcaaccagagaaacacacgttgtggtatattacctggtggcgcgccgaattctggaattctcgggtgccaagggttcagagttctacagtccgacgatcgcggccgcgtcgacggatccaagcttcctgcaggtgaccgtcctgtctctagacgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcg

SEQ ID NO: 2 - DNA, 2040 bp, Artificial Sequence
  Synthetic DNA
  misc_feature (6)..(10): P5 sequence
  misc_feature (11)..(18): D8 sequence
  misc_feature (24)..(73): sArMV E50 sequence
  primer_bind (80)..(94): Reverse transcriptase primer 3 binding site
  primer_bind (95)..(108): Primer 4 binding site
  misc_feature (115)..(120): Barcode insertion site
  misc_feature (121)..(125): Second P5 sequence
  primer_bind (126)..(133): Second D8 sequence
  misc_feature (139)..(186): sTRSV E48 sequence
  misc_feature (187)..(200): Multiple cloning site (MCS)
  primer_bind (201)..(221): Reverse transcriptase primer 1 binding site
  primer_bind (222)..(247): Primer 2 binding site
  misc_feature (248)..(281): Multiple cloning site (MCS)
  misc_feature (282)..(286): Third P5 sequence
  misc_feature (287)..(294): Third D8 sequence
  rep_origin (301)..(915): pMB1 origin or replication in the reverse orientation
  primer_bind (352)..(375): Seq2 primer binding site
  gene (1075)..(1935): Beta-lactamase gene in the reverse orientation
  promoter (1936)..(2040): beta-lactamase gene promoter in the reverse orientation
  primer_bind (1942)..(1971): Seq 1 primer binding site
agatctgacagtactgtccgtatgacagcgaagtcaaacggcgaaacacaccttgtgtggtatattacccgttcctagggtctcgtgggctcggtcgtcggcagcgtcggtaccactagttgaccgtcctgtccgtatgacagagaagtcaaccagagaaacacacgttgtggtatattacctggtggcgcgccgaattctggaattctcgggtgccaagggttcagagttctacagtccgacgatcgcggccgcgtcgacggatccaagcttcctgcaggtgaccgtcctgtctctagacgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcg

SEQ ID NO: 3 - DNA, 48 bp, Satellite tobacco ringspot virus
gacagagaagtcaaccagagaaacacacgttgtggtatattacctggt

SEQ ID NO: 4 - DNA, 50 bp, Satellite arabis mosaic virus
gacagcgaagtcaaacggcgaaacacaccttgtgtggtatattacccgtt

SEQ ID NO: 5 - DNA, 50 bp, Satellite chicory yellow mottle virus
gacagcgaagtcagccagggaaacacaccatgtgtggtatattatctggc

SEQ ID NO: 6 - DNA, 13 bp, Artificial Sequence
  Synthetic DNA
tgaccgtcctgtc

SEQ ID NO: 7 - RNA, 13 nt, Artificial Sequence
  Synthetic RNA
  misc_feature: n=A, C, G, or U
  misc_feature (1)..(5): n is a, c, g, or u
  misc_feature (9)..(13): n is a, c, g, or u
nnnnngucnnnnn

SEQ ID NO: 8 - RNA, 50 nt, Artificial Sequence
  Synthetic RNA
  misc_feature: n=A, C, G or U; m=A or C
  misc_feature (1)..(5): n is a, c, g, or u
  misc_feature (10)..(18): n is a, c, g, or u
  misc_feature (26)..(36): n is a, c, g, or u
  misc_feature (46)..(50): n is a, c, g, or u
nnnnnmgaannnnnnnnnagaaacannnnnnnnnnnguauauuacnnnnn

SEQ ID NO: 9 - skipped

SEQ ID NO: 10 - DNA, 18 bp, Artificial Sequence
  Synthetic DNA
taatacgactcgctatcg

SEQ ID NO: 11 - DNA, 18 bp, Artificial Sequence
  Synthetic DNA
taattcgactcgctatag

SEQ ID NO: 12 - DNA, 18 bp, Artificial Sequence
  Synthetic DNA
taatacgactcgctattg

SEQ ID NO: 13 - DNA, 18 bp, Artificial Sequence
  Synthetic DNA
taattcgactcactatcg

SEQ ID NO: 14 - DNA, 18 bp, Artificial Sequence
  Synthetic DNA
taatgcgcctcactatag

SEQ ID NO: 15 - DNA, 18 bp, Artificial Sequence
  Synthetic DNA
taatgcgactcactaaag

SEQ ID NO: 16 - DNA, 18 bp, Artificial Sequence
  Synthetic DNA
taatgcgactcactagag

SEQ ID NO: 17 - DNA, 18 bp, Artificial Sequence
  Synthetic DNA
taatacgcctcactatat

SEQ ID NO: 18 - DNA, 18 bp, Artificial Sequence
  Synthetic DNA
taatacgactcgctacag

SEQ ID NO: 19 - DNA, 18 bp, Artificial Sequence
  Synthetic DNA
taatgcgactcactacag

SEQ ID NO: 20 - DNA, 18 bp, Artificial Sequence
  Synthetic DNA
taatgcgactcactatcg

SEQ ID NO: 21 - DNA, 18 bp, Artificial Sequence
  Synthetic DNA
taatgcgactcaccatag

SEQ ID NO: 22 - DNA, 18 bp, Artificial Sequence
  Synthetic DNA
taatacgactcacgatat

SEQ ID NO: 23 - DNA, 18 bp, Artificial Sequence
  Synthetic DNA
taatgcgactcactttag

SEQ ID NO: 24 - DNA, 18 bp, Artificial Sequence
  Synthetic DNA
taatgcgactcactctag

SEQ ID NO: 25 - DNA, 18 bp, Artificial Sequence
  Synthetic DNA
taataggactcactctag

SEQ ID NO: 26 - DNA, 18 bp, Artificial Sequence
  Synthetic DNA
taatgcgtctcactatag

SEQ ID NO: 27 - DNA, 18 bp, Artificial Sequence
  Synthetic DNA
taatacgactcactccag

SEQ ID NO: 28 - DNA, 18 bp, Artificial Sequence
  Synthetic DNA
taatgcgactcactgtag

SEQ ID NO: 29 - DNA, 18 bp, Artificial Sequence
  Synthetic DNA
taatacgcctcactaaag

SEQ ID NO: 30 - DNA, 18 bp, Artificial Sequence
  Synthetic DNA
taaagcgactcactatag

SEQ ID NO: 31 - DNA, 18 bp, Artificial Sequence
  Synthetic DNA
taacacgactcactatat

SEQ ID NO: 32 - DNA, 18 bp, Artificial Sequence
  Synthetic DNA
taatgcgactcactattg

SEQ ID NO: 33 - DNA, 18 bp, Artificial Sequence
  Synthetic DNA
taatacgcatcactatag

SEQ ID NO: 34 - DNA, 18 bp, Artificial Sequence
  Synthetic DNA
taatgcgactcgctatag

SEQ ID NO: 35 - DNA, 18 bp, Artificial Sequence
  Synthetic DNA
taatacgactcactaccg

SEQ ID NO: 36 - DNA, 18 bp, Artificial Sequence
  Synthetic DNA
taatacgactcgccatag

SEQ ID NO: 37 - DNA, 18 bp, Artificial Sequence
  Synthetic DNA
taataggactcactacag

SEQ ID NO: 38 - DNA, 18 bp, Artificial Sequence
  Synthetic DNA
taattcggctcactatag

SEQ ID NO: 39 - DNA, 18 bp, Artificial Sequence
  Synthetic DNA
taatacgcctcactacag

SEQ ID NO: 40 - DNA, 18 bp, Artificial Sequence
  Synthetic DNA
taatacgcctcactctag

SEQ ID NO: 41 - DNA, 18 bp, Artificial Sequence
  Synthetic DNA
taatatgactcactgtag

SEQ ID NO: 42 - DNA, 18 bp, Artificial Sequence
  Synthetic DNA
ttatgcgactcactatag

SEQ ID NO: 43 - DNA, 18 bp, Artificial Sequence
  Synthetic DNA
ttatacgcctcactatag

SEQ ID NO: 44 - DNA, 18 bp, Artificial Sequence
  Synthetic DNA
tattgcgactcactatag

SEQ ID NO: 45 - DNA, 18 bp, Artificial Sequence
  Synthetic DNA
taatacgacccactatac

SEQ ID NO: 46 - DNA, 18 bp, Artificial Sequence
  Synthetic DNA
taatacgacgcactatac

SEQ ID NO: 47 - DNA, 18 bp, Artificial Sequence
  Synthetic DNA
taatacgcctcactatcg

SEQ ID NO: 48 - DNA, 18 bp, Artificial Sequence
  Synthetic DNA
taatacgcctcactattg

SEQ ID NO: 49 - DNA, 18 bp, Artificial Sequence
  Synthetic DNA
taaaacgactcgctatag

SEQ ID NO: 50 - DNA, 18 bp, Artificial Sequence
  Synthetic DNA
taataggactcagtatag

SEQ ID NO: 51 - DNA, 18 bp, Artificial Sequence
  Synthetic DNA
taataggactcactttag

SEQ ID NO: 52 - DNA, 18 bp, Artificial Sequence
  Synthetic DNA
taatacgactcacgagag

SEQ ID NO: 53 - DNA, 18 bp, Artificial Sequence
  Synthetic DNA
taatacgactcgctctag

SEQ ID NO: 54 - DNA, 18 bp, Artificial Sequence
  Synthetic DNA
taatgcgactcagtatag

SEQ ID NO: 55 - DNA, 18 bp, Artificial Sequence
  Synthetic DNA
taatacgcctcactttag

SEQ ID NO: 56 - DNA, 18 bp, Artificial Sequence
  Synthetic DNA
taattcgcctcactatag

SEQ ID NO: 57 - DNA, 18 bp, Artificial Sequence
  Synthetic DNA
taaaacgcctcactatag

SEQ ID NO: 58 - DNA, 18 bp, Artificial Sequence
  Synthetic DNA
taatacgactcgctagag

SEQ ID NO: 59 - DNA, 18 bp, Artificial Sequence
  Synthetic DNA
taatacggctcactatcg

SEQ ID NO: 60 - DNA, 18 bp, Artificial Sequence
  Synthetic DNA
taatacggctcactattg

SEQ ID NO: 61 - DNA, 18 bp, Artificial Sequence
  Synthetic DNA
taatacgtctcactataa

SEQ ID NO: 62 - DNA, 18 bp, Artificial Sequence
  Synthetic DNA
ttatacgactcgctatag

SEQ ID NO: 63 - DNA, 18 bp, Artificial Sequence
  Synthetic DNA
taacgcgactcactatag

SEQ ID NO: 64 - DNA, 18 bp, Artificial Sequence
  Synthetic DNA
taatacgacgcactattg

SEQ ID NO: 65 - DNA, 18 bp, Artificial Sequence
  Synthetic DNA
taatccgcctcactatag

SEQ ID NO: 66 - DNA, 18 bp, Artificial Sequence
  Synthetic DNA
tgatgcgactcactatag

SEQ ID NO: 67 - DNA, 18 bp, Artificial Sequence
  Synthetic DNA
taataggactcgctatag

SEQ ID NO: 68 - DNA, 18 bp, Artificial Sequence
  Synthetic DNA
gaatacgactcaccatag

SEQ ID NO: 69 - DNA, 18 bp, Artificial Sequence
  Synthetic DNA
taattcgacgcactatag

SEQ ID NO: 70 - DNA, 18 bp, Artificial Sequence
  Synthetic DNA
taatccgactcactctag

SEQ ID NO: 71 - DNA, 18 bp, Artificial Sequence
  Synthetic DNA
taatacaactcactatcg

SEQ ID NO: 72 - DNA, 18 bp, Artificial Sequence
  Synthetic DNA
caatgcgactcactatag

SEQ ID NO: 73 - DNA, 18 bp, Artificial Sequence
  Synthetic DNA
taatacaactcactctag

SEQ ID NO: 74 - DNA, 18 bp, Artificial Sequence
  Synthetic DNA
taaaacgactcactgtag

SEQ ID NO: 75 - DNA, 18 bp, Artificial Sequence
  Synthetic DNA
taatacgtctcactatat

SEQ ID NO: 76 - DNA, 18 bp, Artificial Sequence
  Synthetic DNA
taatacgtctcactaaag

SEQ ID NO: 77 - DNA, 18 bp, Artificial Sequence
  Synthetic DNA
taatacgactcaccattg

SEQ ID NO: 78 - DNA, 18 bp, Artificial Sequence
  Synthetic DNA
taatacgactcaccacag

SEQ ID NO: 79 - DNA, 18 bp, Artificial Sequence
  Synthetic DNA
taatacgcctcactagag

SEQ ID NO: 80 - DNA, 18 bp, Artificial Sequence
  Synthetic DNA
taaaacgactcactctag

SEQ ID NO: 81 - DNA, 18 bp, Artificial Sequence
  Synthetic DNA
taataagactcactacag

SEQ ID NO: 82 - DNA, 18 bp, Artificial Sequence
  Synthetic DNA
taatacgcctcagtatag

SEQ ID NO: 83 - DNA, 18 bp, Artificial Sequence
  Synthetic DNA
taatacgactcactctgg

SEQ ID NO: 84 - DNA, 18 bp, Artificial Sequence
  Synthetic DNA
taattcgtctcactatag

SEQ ID NO: 85 - DNA, 18 bp, Artificial Sequence
  Synthetic DNA
taatacgactcactctat

SEQ ID NO: 86 - DNA, 18 bp, Artificial Sequence
  Synthetic DNA
taatacgactcactgttg

SEQ ID NO: 87 - DNA, 18 bp, Artificial Sequence
  Synthetic DNA
taatacgactcaccctag

SEQ ID NO: 88 - DNA, 18 bp, Artificial Sequence
  Synthetic DNA
taataagactcactctag

SEQ ID NO: 89 - DNA, 18 bp, Artificial Sequence
  Synthetic DNA
taatacgactcgctaaag

SEQ ID NO: 90 - DNA, 18 bp, Artificial Sequence
  Synthetic DNA
taatccgactcactagag

SEQ ID NO: 91 - DNA, 18 bp, Artificial Sequence
  Synthetic DNA
taatacgacgcactatcg

SEQ ID NO: 92 - DNA, 18 bp, Artificial Sequence
  Synthetic DNA
ttatacgactcactctag

SEQ ID NO: 93 - DNA, 18 bp, Artificial Sequence
  Synthetic DNA
taatgcgactcactatat

SEQ ID NO: 94 - DNA, 18 bp, Artificial Sequence
  Synthetic DNA
taatacgactcacttttg

SEQ ID NO: 95 - DNA, 18 bp, Artificial Sequence
  Synthetic DNA
taatccgactcactgtag

SEQ ID NO: 96 - DNA, 18 bp, Artificial Sequence
  Synthetic DNA
ttatacgactcactatcg

SEQ ID NO: 97 - DNA, 18 bp, Artificial Sequence
  Synthetic DNA
tattacgcctcactatag

SEQ ID NO: 98 - DNA, 18 bp, Artificial Sequence
  Synthetic DNA
taatacaactcgctatag

SEQ ID NO: 99 - DNA, 18 bp, Artificial Sequence
  Synthetic DNA
taataggactcactaaag

SEQ ID NO: 100 - DNA, 18 bp, Artificial Sequence
  Synthetic DNA
taatacgactcactacat

SEQ ID NO: 101 - DNA, 18 bp, Artificial Sequence
  Synthetic DNA
taatacgcctcactgtag

SEQ ID NO: 102 - DNA, 18 bp, Artificial Sequence
  Synthetic DNA
taataggactcaccatag

SEQ ID NO: 103 - DNA, 18 bp, Artificial Sequence
  Synthetic DNA
taatacgactcaatatat

SEQ ID NO: 104 - DNA, 18 bp, Artificial Sequence
  Synthetic DNA
taatacgtctcgctatag

SEQ ID NO: 105 - DNA, 18 bp, Artificial Sequence
  Synthetic DNA
taataggactcacgatag

SEQ ID NO: 106 - DNA, 18 bp, Artificial Sequence
  Synthetic DNA
taattcgactcaccatag

SEQ ID NO: 107 - DNA, 18 bp, Artificial Sequence
  Synthetic DNA
taatgcgactcactatgg

SEQ ID NO: 108 - DNA, 18 bp, Artificial Sequence
  Synthetic DNA
taatacgactcaggatag

SEQ ID NO: 109 - DNA, 18 bp, Artificial Sequence
  Synthetic DNA
ttatacgactcactgtag

SEQ ID NO: 110 - DNA, 18 bp, Artificial Sequence
  Synthetic DNA
taatacgactcactcaag

SEQ ID NO: 111 - DNA, 18 bp, Artificial Sequence
  Synthetic DNA
tgatacgactcactctag

SEQ ID NO: 112 - DNA, 18 bp, Artificial Sequence
  Synthetic DNA
taatatgactcactagag

SEQ ID NO: 113 - DNA, 18 bp, Artificial Sequence
  Synthetic DNA
taatacgtctcactctag

SEQ ID NO: 114 - DNA, 18 bp, Artificial Sequence
  Synthetic DNA
taattcgactcactgtag

SEQ ID NO: 115 - DNA, 18 bp, Artificial Sequence
  Synthetic DNA
taataggactcactatcg

SEQ ID NO: 116 - DNA, 18 bp, Artificial Sequence
  Synthetic DNA
taatacgcgtcactatag

SEQ ID NO: 117 - DNA, 18 bp, Artificial Sequence
  Synthetic DNA
taatacgactcgctatat

SEQ ID NO: 118 - DNA, 18 bp, Artificial Sequence
  Synthetic DNA
taatacgactcagtacag

SEQ ID NO: 119 - DNA, 18 bp, Artificial Sequence
  Synthetic DNA
gaatacgcctcactatag

SEQ ID NO: 120 - DNA, 18 bp, Artificial Sequence
  Synthetic DNA
gaatgcgactcactatag

SEQ ID NO: 121 - DNA, 18 bp, Artificial Sequence
  Synthetic DNA
taatacgactcagtctag

SEQ ID NO: 122 - DNA, 18 bp, Artificial Sequence
  Synthetic DNA
taatacgtctcactacag

SEQ ID NO: 123 - DNA, 18 bp, Artificial Sequence
  Synthetic DNA
taatgcgactcacgatag

SEQ ID NO: 124 - DNA, 18 bp, Artificial Sequence
  Synthetic DNA
taatacgactcaccagag

SEQ ID NO: 125 - DNA, 18 bp, Artificial Sequence
  Synthetic DNA
caatacgactcactctag

SEQ ID NO: 126 - DNA, 18 bp, Artificial Sequence
  Synthetic DNA
taatacgactcattatat

SEQ ID NO: 127 - DNA, 18 bp, Artificial Sequence
  Synthetic DNA
tgatacgactcactataa

SEQ ID NO: 128 - DNA, 18 bp, Artificial Sequence
  Synthetic DNA
caatacgactcactatat

SEQ ID NO: 129 - DNA, 18 bp, Artificial Sequence
  Synthetic DNA
taataggactcactagag

SEQ ID NO: 130 - DNA, 18 bp, Artificial Sequence
  Synthetic DNA
taatacgactcactatct

SEQ ID NO: 131 - DNA, 18 bp, Artificial Sequence
  Synthetic DNA
taatacgactcacttcag

SEQ ID NO: 132 - DNA, 18 bp, Artificial Sequence
  Synthetic DNA
taattggactcactatag

SEQ ID NO: 133 - DNA, 18 bp, Artificial Sequence
  Synthetic DNA
taatgcgacgcactatag

SEQ ID NO: 134 - DNA, 18 bp, Artificial Sequence
  Synthetic DNA
taaaacgtctcactatag

SEQ ID NO: 135 - DNA, 18 bp, Artificial Sequence
  Synthetic DNA
tattacgactcactctag

SEQ ID NO: 136 - DNA, 18 bp, Artificial Sequence
  Synthetic DNA
taatacgactcacactag

SEQ ID NO: 137 - DNA, 18 bp, Artificial Sequence
  Synthetic DNA
taatacgactcactactg

SEQ ID NO: 138 - DNA, 18 bp, Artificial Sequence
  Synthetic DNA
taatacaactcactacag

SEQ ID NO: 139 - DNA, 18 bp, Artificial Sequence
  Synthetic DNA
gaataggactcactatag

SEQ ID NO: 140 - DNA, 18 bp, Artificial Sequence
  Synthetic DNA
taattcgactcactctag

SEQ ID NO: 141 - DNA, 18 bp, Artificial Sequence
  Synthetic DNA
taatacgactcagtatcg

SEQ ID NO: 142 - DNA, 18 bp, Artificial Sequence
  Synthetic DNA
taataggactcactgtag

SEQ ID NO: 143 - DNA, 18 bp, Artificial Sequence
  Synthetic DNA
aaatgcgactcactatag

SEQ ID NO: 144 - DNA, 18 bp, Artificial Sequence
  Synthetic DNA
taattcgactcactattg

SEQ ID NO: 145 - DNA, 18 bp, Artificial Sequence
  Synthetic DNA
gaatacgtctcactatag

SEQ ID NO: 146 - DNA, 18 bp, Artificial Sequence
  Synthetic DNA
ttatacgtctcactatag

SEQ ID NO: 147 - DNA, 18 bp, Artificial Sequence
  Synthetic DNA
taatacgcctcaccatag

SEQ ID NO: 148 - DNA, 18 bp, Artificial Sequence
  Synthetic DNA
taataagactcactagag

SEQ ID NO: 149 - DNA, 18 bp, Artificial Sequence
  Synthetic DNA
taatacgactcagtttag

SEQ ID NO: 150 - DNA, 18 bp, Artificial Sequence
  Synthetic DNA
taattcgactcactacag

SEQ ID NO: 151 - DNA, 18 bp, Artificial Sequence
  Synthetic DNA
tattaggactcactatag

SEQ ID NO: 152 - DNA, 18 bp, Artificial Sequence
  Synthetic DNA
taatacgactcagtaaag

SEQ ID NO: 153 - DNA, 18 bp, Artificial Sequence
  Synthetic DNA
caaaacgactcactatag

SEQ ID NO: 154 - DNA, 18 bp, Artificial Sequence
  Synthetic DNA
taatgggactcactatag

SEQ ID NO: 155 - DNA, 18 bp, Artificial Sequence
  Synthetic DNA
taataagcctcactatag

SEQ ID NO: 156 - DNA, 18 bp, Artificial Sequence
  Synthetic DNA
tgatacgcctcactatag

SEQ ID NO: 157 - DNA, 18 bp, Artificial Sequence
  Synthetic DNA
taatacgactcactcttg

SEQ ID NO: 158 - DNA, 18 bp, Artificial Sequence
  Synthetic DNA
taaaaggactcactatag

SEQ ID NO: 159 - DNA, 18 bp, Artificial Sequence
  Synthetic DNA
taataagactcactgtag

SEQ ID NO: 160 - DNA, 18 bp, Artificial Sequence
  Synthetic DNA
taataggactcactattg

SEQ ID NO: 161 - DNA, 18 bp, Artificial Sequence
  Synthetic DNA
taatacgactcactttat

SEQ ID NO: 162 - DNA, 18 bp, Artificial Sequence
  Synthetic DNA
taatacgactcactttaa

SEQ ID NO: 163 - DNA, 18 bp, Artificial Sequence
  Synthetic DNA
taatacgcctcactataa

SEQ ID NO: 164 - DNA, 18 bp, Artificial Sequence
  Synthetic DNA
taaaacgactcactatat

SEQ ID NO: 165 - DNA, 18 bp, Artificial Sequence
  Synthetic DNA
taatccgactcactataa

SEQ ID NO: 166 - DNA, 18 bp, Artificial Sequence
  Synthetic DNA
gaatacgactcactatat

SEQ ID NO: 167 - DNA, 18 bp, Artificial Sequence
  Synthetic DNA
taatacgtctcactagag

SEQ ID NO: 168 - DNA, 18 bp, Artificial Sequence
  Synthetic DNA
taatacgcctcactatgg

SEQ ID NO: 169 - DNA, 18 bp, Artificial Sequence
  Synthetic DNA
taataagactcgctatag

SEQ ID NO: 170 - DNA, 18 bp, Artificial Sequence
  Synthetic DNA
taatacgactcagtagag

SEQ ID NO: 171 - DNA, 18 bp, Artificial Sequence
  Synthetic DNA
taatgcaactcactatag

SEQ ID NO: 172 - DNA, 18 bp, Artificial Sequence
  Synthetic DNA
taatacgactcactgtgg

SEQ ID NO: 173 - DNA, 18 bp, Artificial Sequence
  Synthetic DNA
taatacgactcactcgag

SEQ ID NO: 174 - DNA, 18 bp, Artificial Sequence
  Synthetic DNA
taatacgactcactatca

SEQ ID NO: 175 - DNA, 18 bp, Artificial Sequence
  Synthetic DNA
taatacgtctcactatac

SEQ ID NO: 176 - DNA, 18 bp, Artificial Sequence
  Synthetic DNA
taatacgtctcactgtag

SEQ ID NO: 177 - DNA, 18 bp, Artificial Sequence
  Synthetic DNA
taatagcactcactatag

SEQ ID NO: 178 - DNA, 18 bp, Artificial Sequence
  Synthetic DNA
taatacgacgcgctatag

SEQ ID NO: 179 - DNA, 18 bp, Artificial Sequence
  Synthetic DNA
taatacgactcacgctag

SEQ ID NO: 180 - DNA, 18 bp, Artificial Sequence
  Synthetic DNA
taatacgactcacgaaag

SEQ ID NO: 181 - DNA, 18 bp, Artificial Sequence
  Synthetic DNA
taatacgtctcactatcg

SEQ ID NO: 182 - DNA, 18 bp, Artificial Sequence
  Synthetic DNA
ttatacgacgcactatag

SEQ ID NO: 183 - DNA, 18 bp, Artificial Sequence
  Synthetic DNA
tgatacgactcactttag

SEQ ID NO: 184 - DNA, 18 bp, Artificial Sequence
  Synthetic DNA
taatacgcctcacaatag

SEQ ID NO: 185 - DNA, 18 bp, Artificial Sequence
  Synthetic DNA
taatccgactcactacag

SEQ ID NO: 186 - DNA, 18 bp, Artificial Sequence
  Synthetic DNA
aaatacgactcactctag

SEQ ID NO: 187 - DNA, 18 bp, Artificial Sequence
  Synthetic DNA
taataccactccctatag

SEQ ID NO: 188 - DNA, 18 bp, Artificial Sequence
  Synthetic DNA
taaaacgactcactatcg

SEQ ID NO: 189 - DNA, 18 bp, Artificial Sequence
  Synthetic DNA
tgatacgactcactgtag

SEQ ID NO: 190 - DNA, 18 bp, Artificial Sequence
  Synthetic DNA
taatacggctcaccatag

SEQ ID NO: 191 - DNA, 18 bp, Artificial Sequence
  Synthetic DNA
tattacgactcactgtag

SEQ ID NO: 192 - DNA, 18 bp, Artificial Sequence
  Synthetic DNA
taatacgactcacgttag

SEQ ID NO: 193 - DNA, 18 bp, Artificial Sequence
  Synthetic DNA
ttatacgactcactatac

SEQ ID NO: 194 - DNA, 18 bp, Artificial Sequence
  Synthetic DNA
taatacgactcagtatat

SEQ ID NO: 195 - DNA, 18 bp, Artificial Sequence
  Synthetic DNA
taatacgtctcactttag

SEQ ID NO: 196 - DNA, 18 bp, Artificial Sequence
  Synthetic DNA
taaaacgactcactttag

SEQ ID NO: 197 - DNA, 18 bp, Artificial Sequence
  Synthetic DNA
ttataggactcactatag

SEQ ID NO: 198 - DNA, 18 bp, Artificial Sequence
  Synthetic DNA
taatccgagtcactatag

SEQ ID NO: 199 - DNA, 18 bp, Artificial Sequence
  Synthetic DNA
taatacgacgcactctag

SEQ ID NO: 200 - DNA, 18 bp, Artificial Sequence
  Synthetic DNA
tgatacgactcactacag

SEQ ID NO: 201 - DNA, 18 bp, Artificial Sequence
  Synthetic DNA
aaataggactcactatag

SEQ ID NO: 202 - DNA, 18 bp, Artificial Sequence
  Synthetic DNA
ttatacgactcactacag

SEQ ID NO: 203 - DNA, 18 bp, Artificial Sequence
  Synthetic DNA
caatacgactcactgtag

SEQ ID NO: 204 - DNA, 18 bp, Artificial Sequence
  Synthetic DNA
taatacgactcacgattg

SEQ ID NO: 205 - DNA, 18 bp, Artificial Sequence
  Synthetic DNA
taatatgactcactctag

SEQ ID NO: 206 - DNA, 18 bp, Artificial Sequence
  Synthetic DNA
taaaacgactcactagag

SEQ ID NO: 207 - DNA, 18 bp, Artificial Sequence
  Synthetic DNA
caataggactcactatag

SEQ ID NO: 208 - DNA, 18 bp, Artificial Sequence
  Synthetic DNA
taatacgactcaatatac

SEQ ID NO: 209 - DNA, 18 bp, Artificial Sequence
  Synthetic DNA
taatacgactcgctataa

SEQ ID NO: 210 - DNA, 18 bp, Artificial Sequence
  Synthetic DNA
taatccgactcgctatag

SEQ ID NO: 211 - DNA, 18 bp, Artificial Sequence
  Synthetic DNA
tattacgactcactatat

SEQ ID NO: 212 - DNA, 18 bp, Artificial Sequence
  Synthetic DNA
tattacgactcgctatag

SEQ ID NO: 213 - DNA, 18 bp, Artificial Sequence
  Synthetic DNA
taatagaactcactatag

SEQ ID NO: 214 - DNA, 18 bp, Artificial Sequence
  Synthetic DNA
ttatatgactcactatag

SEQ ID NO: 215 - DNA, 18 bp, Artificial Sequence
  Synthetic DNA
taatccggctcactatag

SEQ ID NO: 216 - DNA, 18 bp, Artificial Sequence
  Synthetic DNA
taatctgactcactatag

SEQ ID NO: 217 - DNA, 18 bp, Artificial Sequence
  Synthetic DNA
taatacaactcactttag

SEQ ID NO: 218 - DNA, 18 bp, Artificial Sequence
  Synthetic DNA
taacaggactcactatag

SEQ ID NO: 219 - DNA, 18 bp, Artificial Sequence
  Synthetic DNA
ttatacgactcactagag

SEQ ID NO: 220 - DNA, 18 bp, Artificial Sequence
  Synthetic DNA
taacacgactcactatac

SEQ ID NO: 221 - DNA, 18 bp, Artificial Sequence
  Synthetic DNA
taatacgactcaccatat

SEQ ID NO: 222 - DNA, 18 bp, Artificial Sequence
  Synthetic DNA
taatacggctcactatac

SEQ ID NO: 223 - DNA, 18 bp, Artificial Sequence
  Synthetic DNA
taatacgactcaccaaag

SEQ ID NO: 224 - DNA, 18 bp, Artificial Sequence
  Synthetic DNA
taatacaactcagtatag

SEQ ID NO: 225 - DNA, 18 bp, Artificial Sequence
  Synthetic DNA
taatacgactcactttcg

SEQ ID NO: 226 - DNA, 18 bp, Artificial Sequence
  Synthetic DNA
aaatacgactcactgtag

SEQ ID NO: 227 - DNA, 18 bp, Artificial Sequence
  Synthetic DNA
taatgcgacttactatag

SEQ ID NO: 228 - DNA, 18 bp, Artificial Sequence
  Synthetic DNA
taaaacgactcactacag

SEQ ID NO: 229 - DNA, 18 bp, Artificial Sequence
  Synthetic DNA
taataagactcactttag

SEQ ID NO: 230 - DNA, 18 bp, Artificial Sequence
  Synthetic DNA
taatgcgactcacaatag

SEQ ID NO: 231 - DNA, 18 bp, Artificial Sequence
  Synthetic DNA
ttatacgactcaccatag

SEQ ID NO: 232 - DNA, 18 bp, Artificial Sequence
  Synthetic DNA
taatacgactcacttgag

SEQ ID NO: 233 - DNA, 18 bp, Artificial Sequence
  Synthetic DNA
taattcgactcactttag

SEQ ID NO: 234 - DNA, 18 bp, Artificial Sequence
  Synthetic DNA
taatacaactcactatat

SEQ ID NO: 235 - DNA, 18 bp, Artificial Sequence
  Synthetic DNA
taataagactcagtatag

SEQ ID NO: 236 - DNA, 18 bp, Artificial Sequence
  Synthetic DNA
taaaccgactcactatag

SEQ ID NO: 237 - DNA, 18 bp, Artificial Sequence
  Synthetic DNA
ttatacgactcagtatag

SEQ ID NO: 238 - DNA, 18 bp, Artificial Sequence
  Synthetic DNA
taatacgcctcgctatag

SEQ ID NO: 239 - DNA, 18 bp, Artificial Sequence
  Synthetic DNA
taataggtctcactatag

SEQ ID NO: 240 - DNA, 18 bp, Artificial Sequence
  Synthetic DNA
taatacaacgcactatag

SEQ ID NO: 241 - DNA, 18 bp, Artificial Sequence
  Synthetic DNA
taattcgactcactatat

SEQ ID NO: 242 - DNA, 18 bp, Artificial Sequence
  Synthetic DNA
taatacgacgcactaaag

SEQ ID NO: 243 - DNA, 18 bp, Artificial Sequence
  Synthetic DNA
taatacaactcactgtag

SEQ ID NO: 244 - DNA, 18 bp, Artificial Sequence
  Synthetic DNA
caatatgactcactatag

SEQ ID NO: 245 - DNA, 18 bp, Artificial Sequence
  Synthetic DNA
taataagactcactatcg

SEQ ID NO: 246 - DNA, 18 bp, Artificial Sequence
  Synthetic DNA
taatacgactcagtgtag

SEQ ID NO: 247 - DNA, 18 bp, Artificial Sequence
  Synthetic DNA
taatacgactcactagcg

SEQ ID NO: 248 - DNA, 18 bp, Artificial Sequence
  Synthetic DNA
taatacgactcgctgtag

SEQ ID NO: 249 - DNA, 18 bp, Artificial Sequence
  Synthetic DNA
ccatacgactcactatag

SEQ ID NO: 250 - DNA, 18 bp, Artificial Sequence
  Synthetic DNA
taacacgactcactctag

SEQ ID NO: 251 - DNA, 18 bp, Artificial Sequence
  Synthetic DNA
taataagactcactaaag

SEQ ID NO: 252 - DNA, 18 bp, Artificial Sequence
  Synthetic DNA
aaatacgactcgctatag

SEQ ID NO: 253 - DNA, 18 bp, Artificial Sequence
  Synthetic DNA
taatacgactctctctag

SEQ ID NO: 254 - DNA, 18 bp, Artificial Sequence
  Synthetic DNA
taatacgcctcactatac

SEQ ID NO: 255 - DNA, 18 bp, Artificial Sequence
  Synthetic DNA
taatgcgactcactatac

SEQ ID NO: 256 - DNA, 18 bp, Artificial Sequence
  Synthetic DNA
taatacaactcactagag

SEQ ID NO: 257 - DNA, 18 bp, Artificial Sequence
  Synthetic DNA
taatacgtctcactattg

SEQ ID NO: 258 - DNA, 18 bp, Artificial Sequence
  Synthetic DNA
taatacgactctgtatag

SEQ ID NO: 259 - DNA, 18 bp, Artificial Sequence
  Synthetic DNA
taatccgtctcactatag

SEQ ID NO: 260 - DNA, 18 bp, Artificial Sequence
  Synthetic DNA
tattacgtctcactatag

SEQ ID NO: 261 - DNA, 18 bp, Artificial Sequence
  Synthetic DNA
caatacgactcactacag

SEQ ID NO: 262 - DNA, 18 bp, Artificial Sequence
  Synthetic DNA
taataaaactcactatag

SEQ ID NO: 263 - DNA, 18 bp, Artificial Sequence
  Synthetic DNA
taattcgactcactaaag

SEQ ID NO: 264 - DNA, 18 bp, Artificial Sequence
  Synthetic DNA
taatacgactcgcgatag

SEQ ID NO: 265 - DNA, 18 bp, Artificial Sequence
  Synthetic DNA
taatacggctcacgatag

SEQ ID NO: 266 - DNA, 18 bp, Artificial Sequence
  Synthetic DNA
taataagactcaccatag

SEQ ID NO: 267 - DNA, 18 bp, Artificial Sequence
  Synthetic DNA
tagtgcgactcactatag

SEQ ID NO: 268 - DNA, 18 bp, Artificial Sequence
  Synthetic DNA
taatacgtgtcactatag

SEQ ID NO: 269 - DNA, 18 bp, Artificial Sequence
  Synthetic DNA
caatacgcctcactatag

SEQ ID NO: 270 - DNA, 18 bp, Artificial Sequence
  Synthetic DNA
taatacggcgcactatag

SEQ ID NO: 271 - DNA, 18 bp, Artificial Sequence
  Synthetic DNA
taatacgactctctagag

SEQ ID NO: 272 - DNA, 18 bp, Artificial Sequence
  Synthetic DNA
taatacgactcagaatag

SEQ ID NO: 273 - DNA, 18 bp, Artificial Sequence
  Synthetic DNA
tgttacgactcactatag

SEQ ID NO: 274 - DNA, 18 bp, Artificial Sequence
  Synthetic DNA
tattacgactcactttag

SEQ ID NO: 275 - DNA, 18 bp, Artificial Sequence
  Synthetic DNA
taatacgactcacgatcg

SEQ ID NO: 276 - DNA, 18 bp, Artificial Sequence
  Synthetic DNA
caatacgactcaccatag

SEQ ID NO: 277 - DNA, 18 bp, Artificial Sequence
  Synthetic DNA
gaataagactcactatag

SEQ ID NO: 278 - DNA, 18 bp, Artificial Sequence
  Synthetic DNA
taatacgactcgctatgg

SEQ ID NO: 279 - DNA, 18 bp, Artificial Sequence
  Synthetic DNA
taatacgactcactgaag

SEQ ID NO: 280 - DNA, 18 bp, Artificial Sequence
  Synthetic DNA
taatgagactcactatag

SEQ ID NO: 281 - DNA, 18 bp, Artificial Sequence
  Synthetic DNA
taatacaactcactaaag

SEQ ID NO: 282 - DNA, 18 bp, Artificial Sequence
  Synthetic DNA
ttatacgactcactaaag

SEQ ID NO: 283 - DNA, 18 bp, Artificial Sequence
  Synthetic DNA
tgattcgactcactatag

SEQ ID NO: 284 - DNA, 18 bp, Artificial Sequence
  Synthetic DNA
taatacggctcgctatag

SEQ ID NO: 285 - DNA, 18 bp, Artificial Sequence
  Synthetic DNA
tattacgactcactacag

SEQ ID NO: 286 - DNA, 18 bp, Artificial Sequence
  Synthetic DNA
ttttacgactcactatag

SEQ ID NO: 287 - DNA, 18 bp, Artificial Sequence
  Synthetic DNA
taattcgactcactataa

SEQ ID NO: 288 - DNA, 18 bp, Artificial Sequence
  Synthetic DNA
taatccgactcactttag

SEQ ID NO: 289 - DNA, 18 bp, Artificial Sequence
  Synthetic DNA
taattcgactcacgatag

SEQ ID NO: 290 - DNA, 18 bp, Artificial Sequence
  Synthetic DNA
taaaaagactcactatag

SEQ ID NO: 291 - DNA, 18 bp, Artificial Sequence
  Synthetic DNA
tagtacgactcactagag

SEQ ID NO: 292 - DNA, 18 bp, Artificial Sequence
  Synthetic DNA
taacacgcctcactatag

SEQ ID NO: 293 - DNA, 18 bp, Artificial Sequence
  Synthetic DNA
ttatacgactcactttag

SEQ ID NO: 294 - DNA, 18 bp, Artificial Sequence
  Synthetic DNA
caatacgactcactagag

SEQ ID NO: 295 - DNA, 18 bp, Artificial Sequence
  Synthetic DNA
ttatacgactcactattg

SEQ ID NO: 296 - DNA, 18 bp, Artificial Sequence
  Synthetic DNA
tattacgactcactatcg

SEQ ID NO: 297 - DNA, 18 bp, Artificial Sequence
  Synthetic DNA
taatacgacggactatag

SEQ ID NO: 298 - DNA, 18 bp, Artificial Sequence
  Synthetic DNA
taataggactcacaatag

SEQ ID NO: 299 - DNA, 18 bp, Artificial Sequence
  Synthetic DNA
taattcgactcactatac

SEQ ID NO: 300 - DNA, 18 bp, Artificial Sequence
  Synthetic DNA
taatacgcctcacgatag

SEQ ID NO: 301 - DNA, 18 bp, Artificial Sequence
  Synthetic DNA
tagtacgactcaccatag

SEQ ID NO: 302 - DNA, 18 bp, Artificial Sequence
  Synthetic DNA
taatccaactcactatag

SEQ ID NO: 303 - DNA, 18 bp, Artificial Sequence
  Synthetic DNA
caatccgactcactatag

SEQ ID NO: 304 - DNA, 18 bp, Artificial Sequence
  Synthetic DNA
taatacgcttcactatag

SEQ ID NO: 305 - DNA, 18 bp, Artificial Sequence
  Synthetic DNA
caatacgactcactaaag

SEQ ID NO: 306 - DNA, 18 bp, Artificial Sequence
  Synthetic DNA
caattcgactcactatag

SEQ ID NO: 307 - DNA, 18 bp, Artificial Sequence
  Synthetic DNA
taatccgactcactatcg

SEQ ID NO: 308 - DNA, 18 bp, Artificial Sequence
  Synthetic DNA
tgatacgtctcactatag

SEQ ID NO: 309 - DNA, 18 bp, Artificial Sequence
  Synthetic DNA
taatacgactcactacac

SEQ ID NO: 310 - DNA, 18 bp, Artificial Sequence
  Synthetic DNA
taatacgacgcaccatag

SEQ ID NO: 311 - DNA, 18 bp, Artificial Sequence
  Synthetic DNA
taatttgactcactatag

SEQ ID NO: 312 - DNA, 18 bp, Artificial Sequence
  Synthetic DNA
taatacgactcacaatgg

SEQ ID NO: 313 - DNA, 18 bp, Artificial Sequence
  Synthetic DNA
taatacgactcacttaag

SEQ ID NO: 314 - DNA, 18 bp, Artificial Sequence
  Synthetic DNA
aaatacgactcactagag

SEQ ID NO: 315 - DNA, 18 bp, Artificial Sequence
  Synthetic DNA
taatacgactctctatat

SEQ ID NO: 316 - DNA, 18 bp, Artificial Sequence
  Synthetic DNA
tagtacgactcactgtag

SEQ ID NO: 317 - DNA, 18 bp, Artificial Sequence
  Synthetic DNA
tactacgacgcactatag

SEQ ID NO: 318 - DNA, 18 bp, Artificial Sequence
  Synthetic DNA
taatccgactcaccatag

SEQ ID NO: 319 - DNA, 18 bp, Artificial Sequence
  Synthetic DNA
taatacgactcactgcag

SEQ ID NO: 320 - DNA, 18 bp, Artificial Sequence
  Synthetic DNA
taatacgactcactagtg

SEQ ID NO: 321 - DNA, 18 bp, Artificial Sequence
  Synthetic DNA
taatacgactcacaataa

SEQ ID NO: 322 - DNA, 18 bp, Artificial Sequence
  Synthetic DNA
taatacagctcactatag

SEQ ID NO: 323 - DNA, 18 bp, Artificial Sequence
  Synthetic DNA
taatacgactctctgtag

SEQ ID NO: 324 - DNA, 18 bp, Artificial Sequence
  Synthetic DNA
taatatgactcactaaag

SEQ ID NO: 325 - DNA, 18 bp, Artificial Sequence
  Synthetic DNA
taatacgactcactgtaa

SEQ ID NO: 326 - DNA, 18 bp, Artificial Sequence
  Synthetic DNA
taatatgcctcactatag

SEQ ID NO: 327 - DNA, 18 bp, Artificial Sequence
  Synthetic DNA
taattagactcactatag

SEQ ID NO: 328 - DNA, 18 bp, Artificial Sequence
  Synthetic DNA
tattaagactcactatag

SEQ ID NO: 329 - DNA, 18 bp, Artificial Sequence
  Synthetic DNA
tgatacgactcactaaag

SEQ ID NO: 330 - DNA, 18 bp, Artificial Sequence
  Synthetic DNA
taatacgactcactaatg

SEQ ID NO: 331 - DNA, 18 bp, Artificial Sequence
  Synthetic DNA
taattcgactcactagag

SEQ ID NO: 332 - DNA, 18 bp, Artificial Sequence
  Synthetic DNA
ttatacaactcactatag

SEQ ID NO: 333 - DNA, 18 bp, Artificial Sequence
  Synthetic DNA
aaatacgactcacgatag

SEQ ID NO: 334 - DNA, 18 bp, Artificial Sequence
  Synthetic DNA
tattacgactcaccatag

SEQ ID NO: 335 - DNA, 18 bp, Artificial Sequence
  Synthetic DNA
gagtacgactcactatag

SEQ ID NO: 336 - DNA, 18 bp, Artificial Sequence
  Synthetic DNA
taatacgactcacggtag

SEQ ID NO: 337 - DNA, 18 bp, Artificial Sequence
  Synthetic DNA
taatcggactcactatag

SEQ ID NO: 338 - DNA, 18 bp, Artificial Sequence
  Synthetic DNA
taatacgactcactaggg

SEQ ID NO: 339 - DNA, 18 bp, Artificial Sequence
  Synthetic DNA
tgatacgactcactagag

SEQ ID NO: 340 - DNA, 18 bp, Artificial Sequence
  Synthetic DNA
aaatacgcctcactatag

SEQ ID NO: 341 - DNA, 18 bp, Artificial Sequence
  Synthetic DNA
taataccactcactataa

SEQ ID NO: 342 - DNA, 18 bp, Artificial Sequence
  Synthetic DNA
taaatcgactcactatag

SEQ ID NO: 343 - DNA, 18 bp, Artificial Sequence
  Synthetic DNA
ggatacgactcactatag

SEQ ID NO: 344 - DNA, 18 bp, Artificial Sequence
  Synthetic DNA
taatatgactcactataa

SEQ ID NO: 345 - DNA, 18 bp, Artificial Sequence
  Synthetic DNA
taatacgactcactaagg

SEQ ID NO: 346 - DNA, 18 bp, Artificial Sequence
  Synthetic DNA
taatacgactcactgtcg

SEQ ID NO: 347 - DNA, 18 bp, Artificial Sequence
  Synthetic DNA
taatacgactcaccttag

SEQ ID NO: 348 - DNA, 18 bp, Artificial Sequence
  Synthetic DNA
tattccgactcactatag

SEQ ID NO: 349 - DNA, 18 bp, Artificial Sequence
  Synthetic DNA
taatacaactcaccatag

SEQ ID NO: 350 - DNA, 18 bp, Artificial Sequence
  Synthetic DNA
gaatacgactcactatgg

SEQ ID NO: 351 - DNA, 18 bp, Artificial Sequence
  Synthetic DNA
taataggactctctatag

SEQ ID NO: 352 - DNA, 18 bp, Artificial Sequence
  Synthetic DNA
taaaacgactcactaaag

SEQ ID NO: 353 - DNA, 18 bp, Artificial Sequence
  Synthetic DNA
tattacgactcacgatag

SEQ ID NO: 354 - DNA, 18 bp, Artificial Sequence
  Synthetic DNA
aaatatgactcactatag

SEQ ID NO: 355 - DNA, 18 bp, Artificial Sequence
  Synthetic DNA
taaaacgactcactataa

SEQ ID NO: 356 - DNA, 18 bp, Artificial Sequence
  Synthetic DNA
ctatacgactcactatag

SEQ ID NO: 357 - DNA, 18 bp, Artificial Sequence
  Synthetic DNA
tgatacgactcactatgg

SEQ ID NO: 358 - DNA, 18 bp, Artificial Sequence
  Synthetic DNA
ttatacgactcacgatag

SEQ ID NO: 359 - DNA, 18 bp, Artificial Sequence
  Synthetic DNA
taatacaactcacaatag

SEQ ID NO: 360 - DNA, 18 bp, Artificial Sequence
  Synthetic DNA
caataagactcactatag

SEQ ID NO: 361 - DNA, 18 bp, Artificial Sequence
  Synthetic DNA
taatacgacttactatcg

SEQ ID NO: 362 - DNA, 18 bp, Artificial Sequence
  Synthetic DNA
taatccgactcacgatag

SEQ ID NO: 363 - DNA, 18 bp, Artificial Sequence
  Synthetic DNA
tgaaacgactcactatag

SEQ ID NO: 364 - DNA, 18 bp, Artificial Sequence
  Synthetic DNA
tgatacgactcgctatag

SEQ ID NO: 365 - DNA, 18 bp, Artificial Sequence
  Synthetic DNA
taatacgactcaccataa

SEQ ID NO: 366 - DNA, 18 bp, Artificial Sequence
  Synthetic DNA
taatacgtctcaccatag

SEQ ID NO: 367 - DNA, 18 bp, Artificial Sequence
  Synthetic DNA
taataagactcactataa

SEQ ID NO: 368 - DNA, 18 bp, Artificial Sequence
  Synthetic DNA
taatacgactcgctttag

SEQ ID NO: 369 - DNA, 18 bp, Artificial Sequence
  Synthetic DNA
aaatacgactcactttag

SEQ ID NO: 370 - DNA, 18 bp, Artificial Sequence
  Synthetic DNA
tatttcgactcactatag

SEQ ID NO: 371 - DNA, 18 bp, Artificial Sequence
  Synthetic DNA
tattatgactcactatag

SEQ ID NO: 372 - DNA, 18 bp, Artificial Sequence
  Synthetic DNA
taatacaactcactattg

SEQ ID NO: 373 - DNA, 18 bp, Artificial Sequence
  Synthetic DNA
taatacgccgcactatag

SEQ ID NO: 374 - DNA, 18 bp, Artificial Sequence
  Synthetic DNA
taatacgactcactatgc

SEQ ID NO: 375 - DNA, 18 bp, Artificial Sequence
  Synthetic DNA
taatacgactcacaatat

SEQ ID NO: 376 - DNA, 18 bp, Artificial Sequence
  Synthetic DNA
taatacgacgcactatat

SEQ ID NO: 377 - DNA, 18 bp, Artificial Sequence
  Synthetic DNA
taatacgactcactatgt

SEQ ID NO: 378 - DNA, 18 bp, Artificial Sequence
  Synthetic DNA
taataggactcactatat

SEQ ID NO: 379 - DNA, 18 bp, Artificial Sequence
  Synthetic DNA
taataagactcactatgg

SEQ ID NO: 380 - DNA, 18 bp, Artificial Sequence
  Synthetic DNA
taaaacgactcactattg

SEQ ID NO: 381 - DNA, 18 bp, Artificial Sequence
  Synthetic DNA
tattacgactcactagag

SEQ ID NO: 382 - DNA, 18 bp, Artificial Sequence
  Synthetic DNA
tactgcgactcactatag

SEQ ID NO: 383 - DNA, 18 bp, Artificial Sequence
  Synthetic DNA
taataagactcactattg

SEQ ID NO: 384 - DNA, 18 bp, Artificial Sequence
  Synthetic DNA
taatacgactcagtattg

SEQ ID NO: 385 - DNA, 18 bp, Artificial Sequence
  Synthetic DNA
gaatacgactcactctag

SEQ ID NO: 386 - DNA, 18 bp, Artificial Sequence
  Synthetic DNA
cattacgactcactatag

SEQ ID NO: 387 - DNA, 18 bp, Artificial Sequence
  Synthetic DNA
taatacgtctcagtatag

SEQ ID NO: 388 - DNA, 18 bp, Artificial Sequence
  Synthetic DNA
taatacaactcactataa

SEQ ID NO: 389 - DNA, 18 bp, Artificial Sequence
  Synthetic DNA
taatacgactcggtatag

SEQ ID NO: 390 - DNA, 18 bp, Artificial Sequence
  Synthetic DNA
taataggactcactatgg

SEQ ID NO: 391 - DNA, 18 bp, Artificial Sequence
  Synthetic DNA
taatacgactcacaattg

SEQ ID NO: 392 - DNA, 18 bp, Artificial Sequence
  Synthetic DNA
tagtacgactcactacag

SEQ ID NO: 393 - DNA, 18 bp, Artificial Sequence
  Synthetic DNA
taatgcgagtcactatag

SEQ ID NO: 394 - DNA, 18 bp, Artificial Sequence
  Synthetic DNA
tattacaactcactatag

SEQ ID NO: 395 - DNA, 18 bp, Artificial Sequence
  Synthetic DNA
taatacgactctctaaag

SEQ ID NO: 396 - DNA, 18 bp, Artificial Sequence
  Synthetic DNA
taattcaactcactatag

SEQ ID NO: 397 - DNA, 18 bp, Artificial Sequence
  Synthetic DNA
taataagactcacgatag

SEQ ID NO: 398 - DNA, 18 bp, Artificial Sequence
  Synthetic DNA
taattcgactcagtatag

SEQ ID NO: 399 - DNA, 18 bp, Artificial Sequence
  Synthetic DNA
taatacgacgcactacag

SEQ ID NO: 400 - DNA, 18 bp, Artificial Sequence
  Synthetic DNA
tgatacggctcactatag

SEQ ID NO: 401 - DNA, 18 bp, Artificial Sequence
  Synthetic DNA
taatacgaccgactatag

SEQ ID NO: 402 - DNA, 18 bp, Artificial Sequence
  Synthetic DNA
ttaaacgactcactatag

SEQ ID NO: 403 - DNA, 18 bp, Artificial Sequence
  Synthetic DNA
tgatacgactcacgatag

SEQ ID NO: 404 - DNA, 18 bp, Artificial Sequence
  Synthetic DNA
taatccgactcactaaag

SEQ ID NO: 405 - DNA, 18 bp, Artificial Sequence
  Synthetic DNA
tattacgactcactaaag

SEQ ID NO: 406 - DNA, 18 bp, Artificial Sequence
  Synthetic DNA
gaatacgactcactagag

SEQ ID NO: 407 - DNA, 18 bp, Artificial Sequence
  Synthetic DNA
aaatacgactcactacag

SEQ ID NO: 408 - DNA, 18 bp, Artificial Sequence
  Synthetic DNA
gattacgactcactatag

SEQ ID NO: 409 - DNA, 18 bp, Artificial Sequence
  Synthetic DNA
ttataagactcactatag

SEQ ID NO: 410 - DNA, 18 bp, Artificial Sequence
  Synthetic DNA
taatacggctcactctag

SEQ ID NO: 411 - DNA, 18 bp, Artificial Sequence
  Synthetic DNA
taatcagactcactatag

SEQ ID NO: 412 - DNA, 18 bp, Artificial Sequence
  Synthetic DNA
taatacgactcactacgg

SEQ ID NO: 413 - DNA, 18 bp, Artificial Sequence
  Synthetic DNA
tgatacgactcactatcg

SEQ ID NO: 414 - DNA, 18 bp, Artificial Sequence
  Synthetic DNA
taatacgactcactaacg

SEQ ID NO: 415 - DNA, 18 bp, Artificial Sequence
  Synthetic DNA
taataggactcaatatag

SEQ ID NO: 416 - DNA, 18 bp, Artificial Sequence
  Synthetic DNA
taataagtctcactatag

SEQ ID NO: 417 - DNA, 18 bp, Artificial Sequence
  Synthetic DNA
caatacgactcactattg

SEQ ID NO: 418 - DNA, 18 bp, Artificial Sequence
  Synthetic DNA
taatacgactcactctac

SEQ ID NO: 419 - DNA, 18 bp, Artificial Sequence
  Synthetic DNA
aaatacgactcactatat

SEQ ID NO: 420 - DNA, 18 bp, Artificial Sequence
  Synthetic DNA
caatacgactcactttag

SEQ ID NO: 421 - DNA, 18 bp, Artificial Sequence
  Synthetic DNA
aattacgactcactatag

SEQ ID NO: 422 - DNA, 18 bp, Artificial Sequence
  Synthetic DNA
tcatacgactcaccatag

SEQ ID NO: 423 - DNA, 18 bp, Artificial Sequence
  Synthetic DNA
ttgtacgactcactatag

SEQ ID NO: 424 - DNA, 18 bp, Artificial Sequence
  Synthetic DNA
taatataactcactatag

SEQ ID NO: 425 - DNA, 18 bp, Artificial Sequence
  Synthetic DNA
taaaacgactcagtatag

SEQ ID NO: 426 - DNA, 18 bp, Artificial Sequence
  Synthetic DNA
tcaaacgactcactatag

SEQ ID NO: 427 - DNA, 18 bp, Artificial Sequence
  Synthetic DNA
taatacgactctctacag

SEQ ID NO: 428 - DNA, 18 bp, Artificial Sequence
  Synthetic DNA
taatacgactcactttac

SEQ ID NO: 429 - DNA, 18 bp, Artificial Sequence
  Synthetic DNA
taaaacaactcactatag

SEQ ID NO: 430 - DNA, 18 bp, Artificial Sequence
  Synthetic DNA
tattacgactcagtatag

SEQ ID NO: 431 - DNA, 18 bp, Artificial Sequence
  Synthetic DNA
taatacgactcacgacag

SEQ ID NO: 432 - DNA, 18 bp, Artificial Sequence
  Synthetic DNA
tcatgcgactcactatag

SEQ ID NO: 433 - DNA, 18 bp, Artificial Sequence
  Synthetic DNA
taatatgactcactatgg

SEQ ID NO: 434 - DNA, 18 bp, Artificial Sequence
  Synthetic DNA
tcatacgactcactataa

SEQ ID NO: 435 - DNA, 18 bp, Artificial Sequence
  Synthetic DNA
taagacgactcgctatag

SEQ ID NO: 436 - DNA, 18 bp, Artificial Sequence
  Synthetic DNA
taaaacgactcactatgg

SEQ ID NO: 437 - DNA, 18 bp, Artificial Sequence
  Synthetic DNA
taatacggctcagtatag

SEQ ID NO: 438 - DNA, 18 bp, Artificial Sequence
  Synthetic DNA
aaatacgactcactaaag

SEQ ID NO: 439 - DNA, 18 bp, Artificial Sequence
  Synthetic DNA
taatatgactcacgatag

SEQ ID NO: 440 - DNA, 18 bp, Artificial Sequence
  Synthetic DNA
taatgtgactcactatag

SEQ ID NO: 441 - DNA, 18 bp, Artificial Sequence
  Synthetic DNA
taatatgacgcactatag

SEQ ID NO: 442 - DNA, 18 bp, Artificial Sequence
  Synthetic DNA
taatacgactcaccgtag

SEQ ID NO: 443 - DNA, 18 bp, Artificial Sequence
  Synthetic DNA
taatacgactcactacaa

SEQ ID NO: 444 - DNA, 18 bp, Artificial Sequence
  Synthetic DNA
gtatacgactcactatag

SEQ ID NO: 445 - DNA, 18 bp, Artificial Sequence
  Synthetic DNA
taatacgactctctatcg

SEQ ID NO: 446 - DNA, 18 bp, Artificial Sequence
  Synthetic DNA
aaatacgactcagtatag

SEQ ID NO: 447 - DNA, 18 bp, Artificial Sequence
  Synthetic DNA
gaatacgactcgctatag

SEQ ID NO: 448 - DNA, 18 bp, Artificial Sequence
  Synthetic DNA
tcatacgactcactctag

SEQ ID NO: 449 - DNA, 18 bp, Artificial Sequence
  Synthetic DNA
aaatacgactcactataa

SEQ ID NO: 450 - DNA, 18 bp, Artificial Sequence
  Synthetic DNA
taatacgactcactaaat

SEQ ID NO: 451 - DNA, 18 bp, Artificial Sequence
  Synthetic DNA
taatacgagtcgctatag

SEQ ID NO: 452 - DNA, 18 bp, Artificial Sequence
  Synthetic DNA
taaaatgactcactatag

SEQ ID NO: 453 - DNA, 18 bp, Artificial Sequence
  Synthetic DNA
tagtacgactcactattg

SEQ ID NO: 454 - DNA, 18 bp, Artificial Sequence
  Synthetic DNA
taatacgactcactaaaa

SEQ ID NO: 455 - DNA, 18 bp, Artificial Sequence
  Synthetic DNA
ttatacggctcactatag

SEQ ID NO: 456 - DNA, 18 bp, Artificial Sequence
  Synthetic DNA
taatacgcctaactatag

SEQ ID NO: 457 - DNA, 18 bp, Artificial Sequence
  Synthetic DNA
taatatgtctcactatag

SEQ ID NO: 458 - DNA, 18 bp, Artificial Sequence
  Synthetic DNA
tgataagactcactatag

SEQ ID NO: 459 - DNA, 18 bp, Artificial Sequence
  Synthetic DNA
tattacgactcactattg

SEQ ID NO: 460 - DNA, 18 bp, Artificial Sequence
  Synthetic DNA
taatacgagccactatag

SEQ ID NO: 461 - DNA, 18 bp, Artificial Sequence
  Synthetic DNA
taaaacgactcacaatag

SEQ ID NO: 462 - DNA, 18 bp, Artificial Sequence
  Synthetic DNA
caatacgtctcactatag

SEQ ID NO: 463 - DNA, 18 bp, Artificial Sequence
  Synthetic DNA
taatacgactcaccatgg

SEQ ID NO: 464 - DNA, 18 bp, Artificial Sequence
  Synthetic DNA
taatacggctccctatag

SEQ ID NO: 465 - DNA, 18 bp, Artificial Sequence
  Synthetic DNA
taatacgaatcgctatag

SEQ ID NO: 466 - DNA, 18 bp, Artificial Sequence
  Synthetic DNA
taatacgactctctttag

SEQ ID NO: 467 - DNA, 18 bp, Artificial Sequence
  Synthetic DNA
taatgcggctcactatag

SEQ ID NO: 468 - DNA, 18 bp, Artificial Sequence
  Synthetic DNA
ttatacgactcactataa

SEQ ID NO: 469 - DNA, 18 bp, Artificial Sequence
  Synthetic DNA
taatacgactcactattt

SEQ ID NO: 470 - DNA, 18 bp, Artificial Sequence
  Synthetic DNA
taatacgacttactatac

SEQ ID NO: 471 - DNA, 18 bp, Artificial Sequence
  Synthetic DNA
taatatgactcactatat

SEQ ID NO: 472 - DNA, 18 bp, Artificial Sequence
  Synthetic DNA
tgatacgactcaccatag

SEQ ID NO: 473 - DNA, 18 bp, Artificial Sequence
  Synthetic DNA
gaatacgactcacaatag

SEQ ID NO: 474 - DNA, 18 bp, Artificial Sequence
  Synthetic DNA
taatacgactctcgatag

SEQ ID NO: 475 - DNA, 18 bp, Artificial Sequence
  Synthetic DNA
cgatacgactcactatag

SEQ ID NO: 476 - DNA, 18 bp, Artificial Sequence
  Synthetic DNA
taataaggctcactatag

SEQ ID NO: 477 - DNA, 18 bp, Artificial Sequence
  Synthetic DNA
caatacgactcagtatag

SEQ ID NO: 478 - DNA, 18 bp, Artificial Sequence
  Synthetic DNA
tcatacgactcactgtag

SEQ ID NO: 479 - DNA, 18 bp, Artificial Sequence
  Synthetic DNA
taatacgactctctattg

SEQ ID NO: 480 - DNA, 18 bp, Artificial Sequence
  Synthetic DNA
aaacacgactcactatag

SEQ ID NO: 481 - DNA, 18 bp, Artificial Sequence
  Synthetic DNA
caatacaactcactatag

SEQ ID NO: 482 - DNA, 18 bp, Artificial Sequence
  Synthetic DNA
taacacgactcactacag

SEQ ID NO: 483 - DNA, 18 bp, Artificial Sequence
  Synthetic DNA
taatacgactctctatac

SEQ ID NO: 484 - DNA, 18 bp, Artificial Sequence
  Synthetic DNA
tagtacgactcactttag

SEQ ID NO: 485 - DNA, 18 bp, Artificial Sequence
  Synthetic DNA
taatacgactcacagtag

SEQ ID NO: 486 - DNA, 18 bp, Artificial Sequence
  Synthetic DNA
taatacgagtcactaaag

SEQ ID NO: 487 - DNA, 18 bp, Artificial Sequence
  Synthetic DNA
taacacgactcactattg

SEQ ID NO: 488 - DNA, 18 bp, Artificial Sequence
  Synthetic DNA
gaaaacgactcactatag

SEQ ID NO: 489 - DNA, 18 bp, Artificial Sequence
  Synthetic DNA
taataccgctcactatag

SEQ ID NO: 490 - DNA, 18 bp, Artificial Sequence
  Synthetic DNA
taaaacgagtcactatag

SEQ ID NO: 491 - DNA, 18 bp, Artificial Sequence
  Synthetic DNA
taatacgagtcagtatag

SEQ ID NO: 492 - DNA, 18 bp, Artificial Sequence
  Synthetic DNA
taatacgactaactatac

SEQ ID NO: 493 - DNA, 18 bp, Artificial Sequence
  Synthetic DNA
tgatacgactcactatat

SEQ ID NO: 494 - DNA, 18 bp, Artificial Sequence
  Synthetic DNA
agatacgactcactatag

SEQ ID NO: 495 - DNA, 18 bp, Artificial Sequence
  Synthetic DNA
tagcacgactcactatag

SEQ ID NO: 496 - DNA, 18 bp, Artificial Sequence
  Synthetic DNA
tataacgactcactatag

SEQ ID NO: 497 - DNA, 18 bp, Artificial Sequence
  Synthetic DNA
aaatacgtctcactatag

SEQ ID NO: 498 - DNA, 18 bp, Artificial Sequence
  Synthetic DNA
tatcacgactcactatag

SEQ ID NO: 499 - DNA, 18 bp, Artificial Sequence
  Synthetic DNA
aaataagactcactatag

SEQ ID NO: 500 - DNA, 18 bp, Artificial Sequence
  Synthetic DNA
taatacgactcaatataa

SEQ ID NO: 501 - DNA, 18 bp, Artificial Sequence
  Synthetic DNA
tcatacgactcactacag

SEQ ID NO: 502 - DNA, 18 bp, Artificial Sequence
  Synthetic DNA
taataggcctcactatag

SEQ ID NO: 503 - DNA, 18 bp, Artificial Sequence
  Synthetic DNA
taatacaactcactatgg

SEQ ID NO: 504 - DNA, 18 bp, Artificial Sequence
  Synthetic DNA
tgatacgactcactattg

SEQ ID NO: 505 - DNA, 18 bp, Artificial Sequence
  Synthetic DNA
tactacgactcactaaag

SEQ ID NO: 506 - DNA, 18 bp, Artificial Sequence
  Synthetic DNA
tagtacgactcactctag

SEQ ID NO: 507 - DNA, 18 bp, Artificial Sequence
  Synthetic DNA
taatacgactcattataa

SEQ ID NO: 508 - DNA, 18 bp, Artificial Sequence
  Synthetic DNA
taatacgactaactctag

SEQ ID NO: 509 - DNA, 18 bp, Artificial Sequence
  Synthetic DNA
taattcgactctctatag

SEQ ID NO: 510 - DNA, 18 bp, Artificial Sequence
  Synthetic DNA
tagtacgacttactatag

SEQ ID NO: 511 - DNA, 18 bp, Artificial Sequence
  Synthetic DNA
aaattcgactcactatag

SEQ ID NO: 512 - DNA, 18 bp, Artificial Sequence
  Synthetic DNA
tagtacaactcactatag

SEQ ID NO: 513 - DNA, 18 bp, Artificial Sequence
  Synthetic DNA
gaatacgactcactaaag

SEQ ID NO: 514 - DNA, 18 bp, Artificial Sequence
  Synthetic DNA
taatacgtcttactatag

SEQ ID NO: 515 - DNA, 18 bp, Artificial Sequence
  Synthetic DNA
taatatgactcactacag

SEQ ID NO: 516 - DNA, 18 bp, Artificial Sequence
  Synthetic DNA
aaatacgactcactatac

SEQ ID NO: 517 - DNA, 18 bp, Artificial Sequence
  Synthetic DNA
taatacgacacactatat

SEQ ID NO: 518 - DNA, 18 bp, Artificial Sequence
  Synthetic DNA
taatacgactcactagac

SEQ ID NO: 519 - DNA, 18 bp, Artificial Sequence
  Synthetic DNA
ttatccgactcactatag

SEQ ID NO: 520 - DNA, 18 bp, Artificial Sequence
  Synthetic DNA
taatacgacgcactttag

SEQ ID NO: 521 - DNA, 18 bp, Artificial Sequence
  Synthetic DNA
caatacgactcactatcg

SEQ ID NO: 522 - DNA, 18 bp, Artificial Sequence
  Synthetic DNA
taatgcgaatcactatag

SEQ ID NO: 523 - DNA, 18 bp, Artificial Sequence
  Synthetic DNA
tattacgactcactatgg

SEQ ID NO: 524 - DNA, 18 bp, Artificial Sequence
  Synthetic DNA
taatacgactcaatctag

SEQ ID NO: 525 - DNA, 18 bp, Artificial Sequence
  Synthetic DNA
tgatccgactcactatag

SEQ ID NO: 526 - DNA, 18 bp, Artificial Sequence
  Synthetic DNA
taatacgaatccctatag

SEQ ID NO: 527 - DNA, 18 bp, Artificial Sequence
  Synthetic DNA
tattacgactcacaatag

SEQ ID NO: 528 - DNA, 18 bp, Artificial Sequence
  Synthetic DNA
taatacgactgactttag

SEQ ID NO: 529 - DNA, 18 bp, Artificial Sequence
  Synthetic DNA
taatgcgactcaatatag

SEQ ID NO: 530 - DNA, 18 bp, Artificial Sequence
  Synthetic DNA
taatacgactcagtatgg

SEQ ID NO: 531 - DNA, 18 bp, Artificial Sequence
  Synthetic DNA
gaatacgactcactattg

SEQ ID NO: 532 - DNA, 18 bp, Artificial Sequence
  Synthetic DNA
taatactactcactataa

SEQ ID NO: 533 - DNA, 18 bp, Artificial Sequence
  Synthetic DNA
taatacgacgctctatag

SEQ ID NO: 534 - DNA, 18 bp, Artificial Sequence
  Synthetic DNA
taatacgcctcaatatag

SEQ ID NO: 535 - DNA, 18 bp, Artificial Sequence
  Synthetic DNA
aaatacaactcactatag

SEQ ID NO: 536 - DNA, 18 bp, Artificial Sequence
  Synthetic DNA
taatgcgactctctatag

SEQ ID NO: 537 - DNA, 18 bp, Artificial Sequence
  Synthetic DNA
taatacgactcacgatgg

SEQ ID NO: 538 - DNA, 18 bp, Artificial Sequence
  Synthetic DNA
caatacgactcacgatag

SEQ ID NO: 539 - DNA, 18 bp, Artificial Sequence
  Synthetic DNA
taatacgactcacaaaag

SEQ ID NO: 540 - DNA, 18 bp, Artificial Sequence
  Synthetic DNA
caagacgactcactatag

SEQ ID NO: 541 - DNA, 18 bp, Artificial Sequence
  Synthetic DNA
taatactgctcactatag

SEQ ID NO: 542 - DNA, 18 bp, Artificial Sequence
  Synthetic DNA
ttatacgactctctatag

SEQ ID NO: 543 - DNA, 18 bp, Artificial Sequence
  Synthetic DNA
tagtacgactcactaaag

SEQ ID NO: 544 - DNA, 18 bp, Artificial Sequence
  Synthetic DNA
ttatacgactcactatgg

SEQ ID NO: 545 - DNA, 18 bp, Artificial Sequence
  Synthetic DNA
tagtacgactcgctatag

SEQ ID NO: 546 - DNA, 18 bp, Artificial Sequence
  Synthetic DNA
tagtacgactcagtatag

SEQ ID NO: 547 - DNA, 18 bp, Artificial Sequence
  Synthetic DNA
aaagacgactcactatag

SEQ ID NO: 548 - DNA, 18 bp, Artificial Sequence
  Synthetic DNA
taataagactccctatag

SEQ ID NO: 549 - DNA, 18 bp, Artificial Sequence
  Synthetic DNA
taatacgcctccctatag

SEQ ID NO: 550 - DNA, 18 bp, Artificial Sequence
  Synthetic DNA
tcatacgactcgctatag

SEQ ID NO: 551 - DNA, 18 bp, Artificial Sequence
  Synthetic DNA
taatacgactcgcaatag

SEQ ID NO: 552 - DNA, 18 bp, Artificial Sequence
  Synthetic DNA
taatacgactcaatagag

SEQ ID NO: 553 - DNA, 18 bp, Artificial Sequence
  Synthetic DNA
taacaagactcactatag

SEQ ID NO: 554 - DNA, 18 bp, Artificial Sequence
  Synthetic DNA
ttattcgactcactatag

SEQ ID NO: 555 - DNA, 18 bp, Artificial Sequence
  Synthetic DNA
taatactcctcactatag

SEQ ID NO: 556 - DNA, 18 bp, Artificial Sequence
  Synthetic DNA
taacacaactcactatag

SEQ ID NO: 557 - DNA, 18 bp, Artificial Sequence
  Synthetic DNA
tactaggactcactatag

SEQ ID NO: 558 - DNA, 18 bp, Artificial Sequence
  Synthetic DNA
taatacgtctcactatgg

SEQ ID NO: 559 - DNA, 18 bp, Artificial Sequence
  Synthetic DNA
taatccgacttactatag

SEQ ID NO: 560 - DNA, 18 bp, Artificial Sequence
  Synthetic DNA
taaggcgactcactatag

SEQ ID NO: 561 - DNA, 18 bp, Artificial Sequence
  Synthetic DNA
taatccgactcactattg

SEQ ID NO: 562 - DNA, 18 bp, Artificial Sequence
  Synthetic DNA
taatatgactcactttag

SEQ ID NO: 563 - DNA, 18 bp, Artificial Sequence
  Synthetic DNA
tgctacgactcactatag

SEQ ID NO: 564 - DNA, 18 bp, Artificial Sequence
  Synthetic DNA
taacccgactcactatag

SEQ ID NO: 565 - DNA, 18 bp, Artificial Sequence
  Synthetic DNA
ttagacgactcactatag

SEQ ID NO: 566 - DNA, 18 bp, Artificial Sequence
  Synthetic DNA
taatacgaatcactttag

SEQ ID NO: 567 - DNA, 18 bp, Artificial Sequence
  Synthetic DNA
aaatacgacacactatag

SEQ ID NO: 568 - DNA, 18 bp, Artificial Sequence
  Synthetic DNA
taacacgactcgctatag

SEQ ID NO: 569 - DNA, 18 bp, Artificial Sequence
  Synthetic DNA
aaatacgactcacaatag

SEQ ID NO: 570 - DNA, 18 bp, Artificial Sequence
  Synthetic DNA
taatacgagtcactttag

SEQ ID NO: 571 - DNA, 18 bp, Artificial Sequence
  Synthetic DNA
taataagaatcactatag

SEQ ID NO: 572 - DNA, 18 bp, Artificial Sequence
  Synthetic DNA
taatacgactaactatcg

SEQ ID NO: 573 - DNA, 18 bp, Artificial Sequence
  Synthetic DNA
taatccgactcactatgg

SEQ ID NO: 574 - DNA, 18 bp, Artificial Sequence
  Synthetic DNA
tagtacgagtcactatag

SEQ ID NO: 575 - DNA, 18 bp, Artificial Sequence
  Synthetic DNA
tgatacgacgcactatag

SEQ ID NO: 576 - DNA, 18 bp, Artificial Sequence
  Synthetic DNA
taatacgactcactagaa

SEQ ID NO: 577 - DNA, 18 bp, Artificial Sequence
  Synthetic DNA
taatacaactctctatag

SEQ ID NO: 578 - DNA, 18 bp, Artificial Sequence
  Synthetic DNA
taatacggctcactaaag

SEQ ID NO: 579 - DNA, 18 bp, Artificial Sequence
  Synthetic DNA
taatacggctcactacag

SEQ ID NO: 580 - DNA, 18 bp, Artificial Sequence
  Synthetic DNA
tagtacgactgactatag

SEQ ID NO: 581 - DNA, 18 bp, Artificial Sequence
  Synthetic DNA
aaatacgactcactattg

SEQ ID NO: 582 - DNA, 18 bp, Artificial Sequence
  Synthetic DNA
tgatacgactaactatag

SEQ ID NO: 583 - DNA, 18 bp, Artificial Sequence
  Synthetic DNA
caatacgactccctatag

SEQ ID NO: 584 - DNA, 18 bp, Artificial Sequence
  Synthetic DNA
taagacgcctcactatag

SEQ ID NO: 585 - DNA, 18 bp, Artificial Sequence
  Synthetic DNA
taatacgattcactataa

SEQ ID NO: 586 - DNA, 18 bp, Artificial Sequence
  Synthetic DNA
taatacgaatcactctag

SEQ ID NO: 587 - DNA, 18 bp, Artificial Sequence
  Synthetic DNA
taacacgactcactgtag

SEQ ID NO: 588 - DNA, 18 bp, Artificial Sequence
  Synthetic DNA
aagtacgactcactatag

SEQ ID NO: 589 - DNA, 18 bp, Artificial Sequence
  Synthetic DNA
taaaacgactcacgatag

SEQ ID NO: 590 - DNA, 18 bp, Artificial Sequence
  Synthetic DNA
aaaaacgactcactatag

SEQ ID NO: 591 - DNA, 18 bp, Artificial Sequence
  Synthetic DNA
taataccactcactagag

SEQ ID NO: 592 - DNA, 18 bp, Artificial Sequence
  Synthetic DNA
ttctacgactcactatag

SEQ ID NO: 593 - DNA, 18 bp, Artificial Sequence
  Synthetic DNA
taatgctactcactatag

SEQ ID NO: 594 - DNA, 18 bp, Artificial Sequence
  Synthetic DNA
taataggagtcactatag

SEQ ID NO: 595 - DNA, 18 bp, Artificial Sequence
  Synthetic DNA
taatacgactccctgtag

SEQ ID NO: 596 - DNA, 18 bp, Artificial Sequence
  Synthetic DNA
taacacgtctcactatag

SEQ ID NO: 597 - DNA, 18 bp, Artificial Sequence
  Synthetic DNA
taatacgactgactatcg

SEQ ID NO: 598 - DNA, 18 bp, Artificial Sequence
  Synthetic DNA
taatacgactgaccatag

SEQ ID NO: 599 - DNA, 18 bp, Artificial Sequence
  Synthetic DNA
taatacgacccactatgg

SEQ ID NO: 600 - DNA, 18 bp, Artificial Sequence
  Synthetic DNA
taatacgaatcactagag

SEQ ID NO: 601 - DNA, 18 bp, Artificial Sequence
  Synthetic DNA
tattacggctcactatag

SEQ ID NO: 602 - DNA, 18 bp, Artificial Sequence
  Synthetic DNA
taatacgactcaatacag

SEQ ID NO: 603 - DNA, 18 bp, Artificial Sequence
  Synthetic DNA
taatacgactctctatgg

SEQ ID NO: 604 - DNA, 18 bp, Artificial Sequence
  Synthetic DNA
tagtacgactcactatgg

SEQ ID NO: 605 - DNA, 18 bp, Artificial Sequence
  Synthetic DNA
taataagactcactatac

SEQ ID NO: 606 - DNA, 18 bp, Artificial Sequence
  Synthetic DNA
taatacgactcgctatac

SEQ ID NO: 607 - DNA, 18 bp, Artificial Sequence
  Synthetic DNA
taatacgacttactttag

SEQ ID NO: 608 - DNA, 18 bp, Artificial Sequence
  Synthetic DNA
ttatacgactcacaatag

SEQ ID NO: 609 - DNA, 18 bp, Artificial Sequence
  Synthetic DNA
taatacgactcacaacag

SEQ ID NO: 610 - DNA, 18 bp, Artificial Sequence
  Synthetic DNA
taaaacgactcaatatag

SEQ ID NO: 611 - DNA, 18 bp, Artificial Sequence
  Synthetic DNA
taatacgactcacaatac

SEQ ID NO: 612 - DNA, 18 bp, Artificial Sequence
  Synthetic DNA
taacacgactcactatcg

SEQ ID NO: 613 - DNA, 18 bp, Artificial Sequence
  Synthetic DNA
taatacgactcactggag

SEQ ID NO: 614 - DNA, 18 bp, Artificial Sequence
  Synthetic DNA
tcatacgacacactatag

SEQ ID NO: 615 - DNA, 18 bp, Artificial Sequence
  Synthetic DNA
taatacgacacactttag

SEQ ID NO: 616 - DNA, 18 bp, Artificial Sequence
  Synthetic DNA
taatacgtcgcactatag

SEQ ID NO: 617 - DNA, 18 bp, Artificial Sequence
  Synthetic DNA
taataccactcacgatag

SEQ ID NO: 618 - DNA, 18 bp, Artificial Sequence
  Synthetic DNA
gaatacgactcactgtag

SEQ ID NO: 619 - DNA, 18 bp, Artificial Sequence
  Synthetic DNA
taatacgacgcattatag

SEQ ID NO: 620 - DNA, 18 bp, Artificial Sequence
  Synthetic DNA
taatccgacccactatag

SEQ ID NO: 621 - DNA, 18 bp, Artificial Sequence
  Synthetic DNA
taatatgactcagtatag

SEQ ID NO: 622 - DNA, 18 bp, Artificial Sequence
  Synthetic DNA
tcatacgactgactatag

SEQ ID NO: 623 - DNA, 18 bp, Artificial Sequence
  Synthetic DNA
caatacgactcgctatag

SEQ ID NO: 624 - DNA, 18 bp, Artificial Sequence
  Synthetic DNA
taatatgactcactatcg

SEQ ID NO: 625 - DNA, 18 bp, Artificial Sequence
  Synthetic DNA
gaatacgactctctatag

SEQ ID NO: 626 - DNA, 18 bp, Artificial Sequence
  Synthetic DNA
taatacgactcacgataa

SEQ ID NO: 627 - DNA, 18 bp, Artificial Sequence
  Synthetic DNA
taatacgactccctatcg

SEQ ID NO: 628 - DNA, 18 bp, Artificial Sequence
  Synthetic DNA
taaaacgacgcactatag

SEQ ID NO: 629 - DNA, 18 bp, Artificial Sequence
  Synthetic DNA
tagtacgactcattatag

SEQ ID NO: 630 - DNA, 18 bp, Artificial Sequence
  Synthetic DNA
cagtacgactcactatag

SEQ ID NO: 631 - DNA, 18 bp, Artificial Sequence
  Synthetic DNA
taataggaatcactatag

SEQ ID NO: 632 - DNA, 18 bp, Artificial Sequence
  Synthetic DNA
taatacgacgcactatgg

SEQ ID NO: 633 - DNA, 18 bp, Artificial Sequence
  Synthetic DNA
taacacgactcacgatag

SEQ ID NO: 634 - DNA, 18 bp, Artificial Sequence
  Synthetic DNA
taattcgactcactatgg

SEQ ID NO: 635 - DNA, 18 bp, Artificial Sequence
  Synthetic DNA
tactacgtctcactatag

SEQ ID NO: 636 - DNA, 18 bp, Artificial Sequence
  Synthetic DNA
taataggactgactatag

SEQ ID NO: 637 - DNA, 18 bp, Artificial Sequence
  Synthetic DNA
tattacgacgcactatag

SEQ ID NO: 638 - DNA, 18 bp, Artificial Sequence
  Synthetic DNA
taacacgagtcactatag

SEQ ID NO: 639 - DNA, 18 bp, Artificial Sequence
  Synthetic DNA
tattacgactcactataa

SEQ ID NO: 640 - DNA, 18 bp, Artificial Sequence
  Synthetic DNA
tgatacaactcactatag

SEQ ID NO: 641 - DNA, 18 bp, Artificial Sequence
  Synthetic DNA
taatacgactcacattag

SEQ ID NO: 642 - DNA, 18 bp, Artificial Sequence
  Synthetic DNA
taagacaactcactatag

SEQ ID NO: 643 - DNA, 18 bp, Artificial Sequence
  Synthetic DNA
tagtacgacgcactatag

SEQ ID NO: 644 - DNA, 18 bp, Artificial Sequence
  Synthetic DNA
gaatacgactcactatcg

SEQ ID NO: 645 - DNA, 18 bp, Artificial Sequence
  Synthetic DNA
taatacgactaactataa

SEQ ID NO: 646 - DNA, 18 bp, Artificial Sequence
  Synthetic DNA
taatgcgactcactataa

SEQ ID NO: 647 - DNA, 18 bp, Artificial Sequence
  Synthetic DNA
taatacgacacactatac

SEQ ID NO: 648 - DNA, 18 bp, Artificial Sequence
  Synthetic DNA
taatactactcactatac

SEQ ID NO: 649 - DNA, 18 bp, Artificial Sequence
  Synthetic DNA
taatacgacttactaaag

SEQ ID NO: 650 - DNA, 18 bp, Artificial Sequence
  Synthetic DNA
taatacgtttcactatag

SEQ ID NO: 651 - DNA, 18 bp, Artificial Sequence
  Synthetic DNA
taatacgacccaatatag

SEQ ID NO: 652 - DNA, 18 bp, Artificial Sequence
  Synthetic DNA
tagaacgactcactatag

SEQ ID NO: 653 - DNA, 18 bp, Artificial Sequence
  Synthetic DNA
taatacgactaactatgg

SEQ ID NO: 654 - DNA, 18 bp, Artificial Sequence
  Synthetic DNA
taatacgtatcactatag

SEQ ID NO: 655 - DNA, 18 bp, Artificial Sequence
  Synthetic DNA
gaatacaactcactatag

SEQ ID NO: 656 - DNA, 18 bp, Artificial Sequence
  Synthetic DNA
tactacgcctcactatag

SEQ ID NO: 657 - DNA, 18 bp, Artificial Sequence
  Synthetic DNA
taataccactcactaaag

SEQ ID NO: 658 - DNA, 18 bp, Artificial Sequence
  Synthetic DNA
taatacgacccactattg

SEQ ID NO: 659 - DNA, 18 bp, Artificial Sequence
  Synthetic DNA
tcataggactcactatag

SEQ ID NO: 660 - DNA, 18 bp, Artificial Sequence
  Synthetic DNA
taaaacgactctctatag

SEQ ID NO: 661 - DNA, 18 bp, Artificial Sequence
  Synthetic DNA
tcatacgattcactatag

SEQ ID NO: 662 - DNA, 18 bp, Artificial Sequence
  Synthetic DNA
taatacgagtctctatag

SEQ ID NO: 663 - DNA, 18 bp, Artificial Sequence
  Synthetic DNA
taatgcgactgactatag

SEQ ID NO: 664 - DNA, 18 bp, Artificial Sequence
  Synthetic DNA
taatacgacacactgtag

SEQ ID NO: 665 - DNA, 18 bp, Artificial Sequence
  Synthetic DNA
tgatatgactcactatag

SEQ ID NO: 666 - DNA, 18 bp, Artificial Sequence
  Synthetic DNA
taatacgactcattctag

SEQ ID NO: 667 - DNA, 18 bp, Artificial Sequence
  Synthetic DNA
gaatatgactcactatag

SEQ ID NO: 668 - DNA, 18 bp, Artificial Sequence
  Synthetic DNA
taatacgaatcactatcg

SEQ ID NO: 669 - DNA, 18 bp, Artificial Sequence
  Synthetic DNA
tattacgactcactatac

SEQ ID NO: 670 - DNA, 18 bp, Artificial Sequence
  Synthetic DNA
tattacgactctctatag

SEQ ID NO: 671 - DNA, 18 bp, Artificial Sequence
  Synthetic DNA
taatacgactcaatttag

SEQ ID NO: 672 - DNA, 18 bp, Artificial Sequence
  Synthetic DNA
tcatacgacccactatag

SEQ ID NO: 673 - DNA, 18 bp, Artificial Sequence
  Synthetic DNA
taatactactcactatcg

SEQ ID NO: 674 - DNA, 18 bp, Artificial Sequence
  Synthetic DNA
tagtacgtctcactatag

SEQ ID NO: 675 - DNA, 18 bp, Artificial Sequence
  Synthetic DNA
taatacgacgaactatag

SEQ ID NO: 676 - DNA, 18 bp, Artificial Sequence
  Synthetic DNA
taatacgactcaatgtag

SEQ ID NO: 677 - DNA, 18 bp, Artificial Sequence
  Synthetic DNA
gaatacgactccctatag

SEQ ID NO: 678 - DNA, 18 bp, Artificial Sequence
  Synthetic DNA
taataagactctctatag

SEQ ID NO: 679 - DNA, 18 bp, Artificial Sequence
  Synthetic DNA
taataagactcaatatag

SEQ ID NO: 680 - DNA, 18 bp, Artificial Sequence
  Synthetic DNA
taatacgccccactatag

SEQ ID NO: 681 - DNA, 18 bp, Artificial Sequence
  Synthetic DNA
tactacgactcactttag

SEQ ID NO: 682 - DNA, 18 bp, Artificial Sequence
  Synthetic DNA
taatacgaatcactattg

SEQ ID NO: 683 - DNA, 18 bp, Artificial Sequence
  Synthetic DNA
taatacgattcaatatag

SEQ ID NO: 684 - DNA, 18 bp, Artificial Sequence
  Synthetic DNA
taatacgatccactatag

SEQ ID NO: 685 - DNA, 18 bp, Artificial Sequence
  Synthetic DNA
taatacgactcactattc

SEQ ID NO: 686 - DNA, 18 bp, Artificial Sequence
  Synthetic DNA
taatacgaggcactatag

SEQ ID NO: 687 - DNA, 18 bp, Artificial Sequence
  Synthetic DNA
taataggacgcactatag

SEQ ID NO: 688 - DNA, 18 bp, Artificial Sequence
  Synthetic DNA
aaatacgactcaccatag

SEQ ID NO: 689 - DNA, 18 bp, Artificial Sequence
  Synthetic DNA
taatacgaatcactaaag

SEQ ID NO: 690 - DNA, 18 bp, Artificial Sequence
  Synthetic DNA
ttatacgaatcactatag

SEQ ID NO: 691 - DNA, 18 bp, Artificial Sequence
  Synthetic DNA
tgatacgactgactatag

SEQ ID NO: 692 - DNA, 18 bp, Artificial Sequence
  Synthetic DNA
tacttcgactcactatag

SEQ ID NO: 693 - DNA, 18 bp, Artificial Sequence
  Synthetic DNA
tactacgactcagtatag

SEQ ID NO: 694 - DNA, 18 bp, Artificial Sequence
  Synthetic DNA
taatacgactcaacatag

SEQ ID NO: 695 - DNA, 18 bp, Artificial Sequence
  Synthetic DNA
taatacgacccagtatag

SEQ ID NO: 696 - DNA, 18 bp, Artificial Sequence
  Synthetic DNA
taacacgactcactaaag

SEQ ID NO: 697 - DNA, 18 bp, Artificial Sequence
  Synthetic DNA
taataccactcattatag

SEQ ID NO: 698 - DNA, 18 bp, Artificial Sequence
  Synthetic DNA
taattcgactccctatag

SEQ ID NO: 699 - DNA, 18 bp, Artificial Sequence
  Synthetic DNA
taatacgactaactagag

SEQ ID NO: 700 - DNA, 18 bp, Artificial Sequence
  Synthetic DNA
taatacgactgacaatag

SEQ ID NO: 701 - DNA, 18 bp, Artificial Sequence
  Synthetic DNA
gaatacgattcactatag

SEQ ID NO: 702 - DNA, 18 bp, Artificial Sequence
  Synthetic DNA
taatactactcaccatag

SEQ ID NO: 703 - DNA, 18 bp, Artificial Sequence
  Synthetic DNA
taatactactcgctatag

SEQ ID NO: 704 - DNA, 18 bp, Artificial Sequence
  Synthetic DNA
taatacgtctcaatatag

SEQ ID NO: 705 - DNA, 18 bp, Artificial Sequence
  Synthetic DNA
taatacgactgactgtag

SEQ ID NO: 706 - DNA, 18 bp, Artificial Sequence
  Synthetic DNA
taatacgactggctatag

SEQ ID NO: 707 - DNA, 18 bp, Artificial Sequence
  Synthetic DNA
taatacgacactctatag

SEQ ID NO: 708 - DNA, 18 bp, Artificial Sequence
  Synthetic DNA
taatacccctcactatag

SEQ ID NO: 709 - DNA, 18 bp, Artificial Sequence
  Synthetic DNA
taatacgactcacaatcg

SEQ ID NO: 710 - DNA, 18 bp, Artificial Sequence
  Synthetic DNA
aaatacgactcactatcg

SEQ ID NO: 711 - DNA, 18 bp, Artificial Sequence
  Synthetic DNA
taatacgagtcactctag

SEQ ID NO: 712 - DNA, 18 bp, Artificial Sequence
  Synthetic DNA
ttatacgactcaatatag

SEQ ID NO: 713 - DNA, 18 bp, Artificial Sequence
  Synthetic DNA
taatacggctcactttag

SEQ ID NO: 714 - DNA, 18 bp, Artificial Sequence
  Synthetic DNA
taaaacgactgactatag

SEQ ID NO: 715 - DNA, 18 bp, Artificial Sequence
  Synthetic DNA
caataccactcactatag

SEQ ID NO: 716 - DNA, 18 bp, Artificial Sequence
  Synthetic DNA
caatacgactctctatag

SEQ ID NO: 717 - DNA, 18 bp, Artificial Sequence
  Synthetic DNA
atatacgactcactatag

SEQ ID NO: 718 - DNA, 18 bp, Artificial Sequence
  Synthetic DNA
taatccgactcagtatag

SEQ ID NO: 719 - DNA, 18 bp, Artificial Sequence
  Synthetic DNA
gaatccgactcactatag

SEQ ID NO: 720 - DNA, 18 bp, Artificial Sequence
  Synthetic DNA
taatacgacgcactgtag

SEQ ID NO: 721 - DNA, 18 bp, Artificial Sequence
  Synthetic DNA
taatacaactcactatac

SEQ ID NO: 722 - DNA, 18 bp, Artificial Sequence
  Synthetic DNA
taatacgacttactctag

SEQ ID NO: 723 - DNA, 18 bp, Artificial Sequence
  Synthetic DNA
tcatacaactcactatag

SEQ ID NO: 724 - DNA, 18 bp, Artificial Sequence
  Synthetic DNA
taatacgacccactgtag

SEQ ID NO: 725 - DNA, 18 bp, Artificial Sequence
  Synthetic DNA
taatacgcctgactatag

SEQ ID NO: 726 - DNA, 18 bp, Artificial Sequence
  Synthetic DNA
taatacgactctccatag

SEQ ID NO: 727 - DNA, 18 bp, Artificial Sequence
  Synthetic DNA
tagtacggctcactatag

SEQ ID NO: 728 - DNA, 18 bp, Artificial Sequence
  Synthetic DNA
taacacgacgcactatag

SEQ ID NO: 729 - DNA, 18 bp, Artificial Sequence
  Synthetic DNA
caatacgagtcactatag

SEQ ID NO: 730 - DNA, 18 bp, Artificial Sequence
  Synthetic DNA
tactacgactcaccatag

SEQ ID NO: 731 - DNA, 18 bp, Artificial Sequence
  Synthetic DNA
taagacgactcactatcg

SEQ ID NO: 732 - DNA, 18 bp, Artificial Sequence
  Synthetic DNA
taatacgacccgctatag

SEQ ID NO: 733 - DNA, 18 bp, Artificial Sequence
  Synthetic DNA
tactacgactcactctag

SEQ ID NO: 734 - DNA, 18 bp, Artificial Sequence
  Synthetic DNA
taaaacgacccactatag

SEQ ID NO: 735 - DNA, 18 bp, Artificial Sequence
  Synthetic DNA
taatacgactccctatgg

SEQ ID NO: 736 - DNA, 18 bp, Artificial Sequence
  Synthetic DNA
taattcgactcacaatag

SEQ ID NO: 737 - DNA, 18 bp, Artificial Sequence
  Synthetic DNA
taatacgactagctatag

SEQ ID NO: 738 - DNA, 18 bp, Artificial Sequence
  Synthetic DNA
tcatacgactcactattg

SEQ ID NO: 739 - DNA, 18 bp, Artificial Sequence
  Synthetic DNA
tactacgactcactattg

SEQ ID NO: 740 - DNA, 18 bp, Artificial Sequence
  Synthetic DNA
taatacgagtcacgatag

SEQ ID NO: 741 - DNA, 18 bp, Artificial Sequence
  Synthetic DNA
taatacgaatcactataa

SEQ ID NO: 742 - DNA, 18 bp, Artificial Sequence
  Synthetic DNA
ttatacgactcactatat

SEQ ID NO: 743 - DNA, 18 bp, Artificial Sequence
  Synthetic DNA
taatacgagtcaccatag

SEQ ID NO: 744 - DNA, 18 bp, Artificial Sequence
  Synthetic DNA
taatacgactaactacag

SEQ ID NO: 745 - DNA, 18 bp, Artificial Sequence
  Synthetic DNA
tactacgactccctatag

SEQ ID NO: 746 - DNA, 18 bp, Artificial Sequence
  Synthetic DNA
taataagactcacaatag

SEQ ID NO: 747 - DNA, 18 bp, Artificial Sequence
  Synthetic DNA
taatacgacttactagag

SEQ ID NO: 748 - DNA, 18 bp, Artificial Sequence
  Synthetic DNA
taatacgacacactatcg

SEQ ID NO: 749 - DNA, 18 bp, Artificial Sequence
  Synthetic DNA
taagacgacacactatag

SEQ ID NO: 750 - DNA, 18 bp, Artificial Sequence
  Synthetic DNA
taagacgactcaatatag

SEQ ID NO: 751 - DNA, 18 bp, Artificial Sequence
  Synthetic DNA
taatacgactcaataaag

SEQ ID NO: 752 - DNA, 18 bp, Artificial Sequence
  Synthetic DNA
taatacgacccactatcg

SEQ ID NO: 753 - DNA, 18 bp, Artificial Sequence
  Synthetic DNA
taatccgattcactatag

SEQ ID NO: 754 - DNA, 18 bp, Artificial Sequence
  Synthetic DNA
taagacgtctcactatag

SEQ ID NO: 755 - DNA, 18 bp, Artificial Sequence
  Synthetic DNA
taattcgacttactatag

SEQ ID NO: 756 - DNA, 18 bp, Artificial Sequence
  Synthetic DNA
tactacgactcactgtag

SEQ ID NO: 757 - DNA, 18 bp, Artificial Sequence
  Synthetic DNA
taatacgacaaactatag

SEQ ID NO: 758 - DNA, 18 bp, Artificial Sequence
  Synthetic DNA
taatatgagtcactatag

SEQ ID NO: 759 - DNA, 18 bp, Artificial Sequence
  Synthetic DNA
gcatacgactcactatag

SEQ ID NO: 760 - DNA, 18 bp, Artificial Sequence
  Synthetic DNA
taatacgactcgatatag

SEQ ID NO: 761 - DNA, 18 bp, Artificial Sequence
  Synthetic DNA
taatccgaatcactatag

SEQ ID NO: 762 - DNA, 18 bp, Artificial Sequence
  Synthetic DNA
taatacgacttactattg

SEQ ID NO: 763 - DNA, 18 bp, Artificial Sequence
  Synthetic DNA
taataggattcactatag

SEQ ID NO: 764 - DNA, 18 bp, Artificial Sequence
  Synthetic DNA
taataccactcgctatag

SEQ ID NO: 765 - DNA, 18 bp, Artificial Sequence
  Synthetic DNA
taactcgactcactatag

SEQ ID NO: 766 - DNA, 18 bp, Artificial Sequence
  Synthetic DNA
taatacgaatcactacag

SEQ ID NO: 767 - DNA, 18 bp, Artificial Sequence
  Synthetic DNA
taatacgattcactgtag

SEQ ID NO: 768 - DNA, 18 bp, Artificial Sequence
  Synthetic DNA
taatacgactctcaatag

SEQ ID NO: 769 - DNA, 18 bp, Artificial Sequence
  Synthetic DNA
tcatacgactcactaaag

SEQ ID NO: 770 - DNA, 18 bp, Artificial Sequence
  Synthetic DNA
taaaacgaatcactatag

SEQ ID NO: 771 - DNA, 18 bp, Artificial Sequence
  Synthetic DNA
tcatacgactcactatcg

SEQ ID NO: 772 - DNA, 18 bp, Artificial Sequence
  Synthetic DNA
tagtccgactcactatag

SEQ ID NO: 773 - DNA, 18 bp, Artificial Sequence
  Synthetic DNA
taatacaaatcactatag

SEQ ID NO: 774 - DNA, 18 bp, Artificial Sequence
  Synthetic DNA
taatacgactcataatag

SEQ ID NO: 775 - DNA, 18 bp, Artificial Sequence
  Synthetic DNA
taatacgattcagtatag

SEQ ID NO: 776 - DNA, 18 bp, Artificial Sequence
  Synthetic DNA
aaatacgactcactatgg

SEQ ID NO: 777 - DNA, 18 bp, Artificial Sequence
  Synthetic DNA
taatacgcctctctatag

SEQ ID NO: 778 - DNA, 18 bp, Artificial Sequence
  Synthetic DNA
taagacgactcactaaag

SEQ ID NO: 779 - DNA, 18 bp, Artificial Sequence
  Synthetic DNA
taatacgactgactattg

SEQ ID NO: 780 - DNA, 18 bp, Artificial Sequence
  Synthetic DNA
taatacgaccccctatag

SEQ ID NO: 781 - DNA, 18 bp, Artificial Sequence
  Synthetic DNA
taatacgactcactatga

SEQ ID NO: 782 - DNA, 18 bp, Artificial Sequence
  Synthetic DNA
taacacgactcactataa

SEQ ID NO: 783 - DNA, 18 bp, Artificial Sequence
  Synthetic DNA
taatacgacagactatag

SEQ ID NO: 784 - DNA, 18 bp, Artificial Sequence
  Synthetic DNA
ttatacgactaactatag

SEQ ID NO: 785 - DNA, 18 bp, Artificial Sequence
  Synthetic DNA
taatacgtctctctatag

SEQ ID NO: 786 - DNA, 18 bp, Artificial Sequence
  Synthetic DNA
taatacgacacactctag

SEQ ID NO: 787 - DNA, 18 bp, Artificial Sequence
  Synthetic DNA
tactaagactcactatag

SEQ ID NO: 788 - DNA, 18 bp, Artificial Sequence
  Synthetic DNA
taatacgtctccctatag

SEQ ID NO: 789 - DNA, 18 bp, Artificial Sequence
  Synthetic DNA
taatacaactccctatag

SEQ ID NO: 790 - DNA, 18 bp, Artificial Sequence
  Synthetic DNA
taatacgactcaatatcg

SEQ ID NO: 791 - DNA, 18 bp, Artificial Sequence
  Synthetic DNA
taatacgagtcaatatag

SEQ ID NO: 792 - DNA, 18 bp, Artificial Sequence
  Synthetic DNA
tcataagactcactatag

SEQ ID NO: 793 - DNA, 18 bp, Artificial Sequence
  Synthetic DNA
taatacgactccctattg

SEQ ID NO: 794 - DNA, 18 bp, Artificial Sequence
  Synthetic DNA
aaatccgactcactatag

SEQ ID NO: 795 - DNA, 18 bp, Artificial Sequence
  Synthetic DNA
taatacgaatcacaatag

SEQ ID NO: 796 - DNA, 18 bp, Artificial Sequence
  Synthetic DNA
taacacgactctctatag

SEQ ID NO: 797 - DNA, 18 bp, Artificial Sequence
  Synthetic DNA
taatacgaataactatag

SEQ ID NO: 798 - DNA, 18 bp, Artificial Sequence
  Synthetic DNA
taagacgactcactctag

SEQ ID NO: 799 - DNA, 18 bp, Artificial Sequence
  Synthetic DNA
tcatacgcctcactatag

SEQ ID NO: 800 - DNA, 18 bp, Artificial Sequence
  Synthetic DNA
taatacgacacgctatag

SEQ ID NO: 801 - DNA, 18 bp, Artificial Sequence
  Synthetic DNA
taatacgactcattatcg

SEQ ID NO: 802 - DNA, 18 bp, Artificial Sequence
  Synthetic DNA
taatactactgactatag

SEQ ID NO: 803 - DNA, 18 bp, Artificial Sequence
  Synthetic DNA
taatacgactcattagag

SEQ ID NO: 804 - DNA, 18 bp, Artificial Sequence
  Synthetic DNA
tagtacgaatcactatag

SEQ ID NO: 805 - DNA, 18 bp, Artificial Sequence
  Synthetic DNA
taatacgaatcaccatag

SEQ ID NO: 806 - DNA, 18 bp, Artificial Sequence
  Synthetic DNA
caacacgactcactatag

SEQ ID NO: 807 - DNA, 18 bp, Artificial Sequence
  Synthetic DNA
tatgacgactcactatag

SEQ ID NO: 808 - DNA, 18 bp, Artificial Sequence
  Synthetic DNA
taatacgagtcactatcg

SEQ ID NO: 809 - DNA, 18 bp, Artificial Sequence
  Synthetic DNA
tgatacgactcacaatag

SEQ ID NO: 810 - DNA, 18 bp, Artificial Sequence
  Synthetic DNA
taataccactcactacag

SEQ ID NO: 811 - DNA, 18 bp, Artificial Sequence
  Synthetic DNA
tcatacgtctcactatag

SEQ ID NO: 812 - DNA, 18 bp, Artificial Sequence
  Synthetic DNA
taatacggctcattatag

SEQ ID NO: 813 - DNA, 18 bp, Artificial Sequence
  Synthetic DNA
taatacgaatcagtatag

SEQ ID NO: 814 - DNA, 18 bp, Artificial Sequence
  Synthetic DNA
taattcgactcaatatag

SEQ ID NO: 815 - DNA, 18 bp, Artificial Sequence
  Synthetic DNA
taatacgactgactagag

SEQ ID NO: 816 - DNA, 18 bp, Artificial Sequence
  Synthetic DNA
tagtacgactcactatcg

SEQ ID NO: 817 - DNA, 18 bp, Artificial Sequence
  Synthetic DNA
taatacgactcactctaa

SEQ ID NO: 818 - DNA, 18 bp, Artificial Sequence
  Synthetic DNA
tagtacgactctctatag

SEQ ID NO: 819 - DNA, 18 bp, Artificial Sequence
  Synthetic DNA
tactaccactcactatag

SEQ ID NO: 820 - DNA, 18 bp, Artificial Sequence
  Synthetic DNA
taattcgacacactatag

SEQ ID NO: 821 - DNA, 18 bp, Artificial Sequence
  Synthetic DNA
aaatacgactccctatag

SEQ ID NO: 822 - DNA, 18 bp, Artificial Sequence
  Synthetic DNA
taatacgactcaatattg

SEQ ID NO: 823 - DNA, 18 bp, Artificial Sequence
  Synthetic DNA
caatacgattcactatag

SEQ ID NO: 824 - DNA, 18 bp, Artificial Sequence
  Synthetic DNA
gaatacgacttactatag

SEQ ID NO: 825 - DNA, 18 bp, Artificial Sequence
  Synthetic DNA
tattacgagtcactatag

SEQ ID NO: 826 - DNA, 18 bp, Artificial Sequence
  Synthetic DNA
tactacgactcattatag

SEQ ID NO: 827 - DNA, 18 bp, Artificial Sequence
  Synthetic DNA
taatacgactcattgtag

SEQ ID NO: 828 - DNA, 18 bp, Artificial Sequence
  Synthetic DNA
taatactacgcactatag

SEQ ID NO: 829 - DNA, 18 bp, Artificial Sequence
  Synthetic DNA
taatacgacacactataa

SEQ ID NO: 830 - DNA, 18 bp, Artificial Sequence
  Synthetic DNA
taaaacgattcactatag

SEQ ID NO: 831 - DNA, 18 bp, Artificial Sequence
  Synthetic DNA
taacacgactcactttag

SEQ ID NO: 832 - DNA, 18 bp, Artificial Sequence
  Synthetic DNA
taatacaactcaatatag

SEQ ID NO: 833 - DNA, 18 bp, Artificial Sequence
  Synthetic DNA
taataccacccactatag

SEQ ID NO: 834 - DNA, 18 bp, Artificial Sequence
  Synthetic DNA
taatacgactaactattg

SEQ ID NO: 835 - DNA, 18 bp, Artificial Sequence
  Synthetic DNA
taatacgacccactaaag

SEQ ID NO: 836 - DNA, 18 bp, Artificial Sequence
  Synthetic DNA
tattaccactcactatag

SEQ ID NO: 837 - DNA, 18 bp, Artificial Sequence
  Synthetic DNA
taatacgactaactgtag

SEQ ID NO: 838 - DNA, 18 bp, Artificial Sequence
  Synthetic DNA
tagtatgactcactatag

SEQ ID NO: 839 - DNA, 18 bp, Artificial Sequence
  Synthetic DNA
tcatacgactcactttag

SEQ ID NO: 840 - DNA, 18 bp, Artificial Sequence
  Synthetic DNA
tactacgactcactacag

SEQ ID NO: 841 - DNA, 18 bp, Artificial Sequence
  Synthetic DNA
tattacgactcaatatag

SEQ ID NO: 842 - DNA, 18 bp, Artificial Sequence
  Synthetic DNA
taatacgactaaccatag

SEQ ID NO: 843 - DNA, 18 bp, Artificial Sequence
  Synthetic DNA
aaatacgactgactatag

SEQ ID NO: 844 - DNA, 18 bp, Artificial Sequence
  Synthetic DNA
taatacgacccactagag

SEQ ID NO: 845 - DNA, 18 bp, Artificial Sequence
  Synthetic DNA
taatactactcactattg

SEQ ID NO: 846 - DNA, 18 bp, Artificial Sequence
  Synthetic DNA
taatacgattcactaaag

SEQ ID NO: 847 - DNA, 18 bp, Artificial Sequence
  Synthetic DNA
taatgcgactaactatag

SEQ ID NO: 848 - DNA, 18 bp, Artificial Sequence
  Synthetic DNA
tagttcgactcactatag

SEQ ID NO: 849 - DNA, 18 bp, Artificial Sequence
  Synthetic DNA
tagtaggactcactatag

SEQ ID NO: 850 - DNA, 18 bp, Artificial Sequence
  Synthetic DNA
taatacgactccctctag

SEQ ID NO: 851 - DNA, 18 bp, Artificial Sequence
  Synthetic DNA
cactacgactcactatag

SEQ ID NO: 852 - DNA, 18 bp, Artificial Sequence
  Synthetic DNA
taatacgaatcacgatag

SEQ ID NO: 853 - DNA, 18 bp, Artificial Sequence
  Synthetic DNA
taatacgtcccactatag

SEQ ID NO: 854 - DNA, 18 bp, Artificial Sequence
  Synthetic DNA
taatacgagtgactatag

SEQ ID NO: 855 - DNA, 18 bp, Artificial Sequence
  Synthetic DNA
taacaccactcactatag

SEQ ID NO: 856 - DNA, 18 bp, Artificial Sequence
  Synthetic DNA
taatatgactcactattg

SEQ ID NO: 857 - DNA, 18 bp, Artificial Sequence
  Synthetic DNA
taatacgactcattttag

SEQ ID NO: 858 - DNA, 18 bp, Artificial Sequence
  Synthetic DNA
taatacgactcatcatag

SEQ ID NO: 859 - DNA, 18 bp, Artificial Sequence
  Synthetic DNA
taatactacccactatag

SEQ ID NO: 860 - DNA, 18 bp, Artificial Sequence
  Synthetic DNA
taatacgactcaagatag

SEQ ID NO: 861 - DNA, 18 bp, Artificial Sequence
  Synthetic DNA
gaatacgactcattatag

SEQ ID NO: 862 - DNA, 18 bp, Artificial Sequence
  Synthetic DNA
taatacgacgcagtatag

SEQ ID NO: 863 - DNA, 18 bp, Artificial Sequence
  Synthetic DNA
taatatgaatcactatag

SEQ ID NO: 864 - DNA, 18 bp, Artificial Sequence
  Synthetic DNA
taatcctactcactatag

SEQ ID NO: 865 - DNA, 18 bp, Artificial Sequence
  Synthetic DNA
taatgcgattcactatag

SEQ ID NO: 866 - DNA, 18 bp, Artificial Sequence
  Synthetic DNA
taatgcgactcattatag

SEQ ID NO: 867 - DNA, 18 bp, Artificial Sequence
  Synthetic DNA
tgatacgactcagtatag

SEQ ID NO: 868 - DNA, 18 bp, Artificial Sequence
  Synthetic DNA
taatacgacacactagag

SEQ ID NO: 869 - DNA, 18 bp, Artificial Sequence
  Synthetic DNA
taatacgactaagtatag

SEQ ID NO: 870 - DNA, 18 bp, Artificial Sequence
  Synthetic DNA
taatacgactcatgatag

SEQ ID NO: 871 - DNA, 18 bp, Artificial Sequence
  Synthetic DNA
aaatacgaatcactatag

SEQ ID NO: 872 - DNA, 18 bp, Artificial Sequence
  Synthetic DNA
aaataccactcactatag

SEQ ID NO: 873 - DNA, 18 bp, Artificial Sequence
  Synthetic DNA
taataggactccctatag

SEQ ID NO: 874 - DNA, 18 bp, Artificial Sequence
  Synthetic DNA
taatacgagacactatag

SEQ ID NO: 875 - DNA, 18 bp, Artificial Sequence
  Synthetic DNA
taataagacttactatag

SEQ ID NO: 876 - DNA, 18 bp, Artificial Sequence
  Synthetic DNA
taatacgattcactatcg

SEQ ID NO: 877 - DNA, 18 bp, Artificial Sequence
  Synthetic DNA
taatacgagtcactgtag

SEQ ID NO: 878 - DNA, 18 bp, Artificial Sequence
  Synthetic DNA
aaatacgactcattatag

SEQ ID NO: 879 - DNA, 18 bp, Artificial Sequence
  Synthetic DNA
taatactacacactatag

SEQ ID NO: 880 - DNA, 18 bp, Artificial Sequence
  Synthetic DNA
taatatcactcactatag

SEQ ID NO: 881 - DNA, 18 bp, Artificial Sequence
  Synthetic DNA
tagtaccactcactatag

SEQ ID NO: 882 - DNA, 18 bp, Artificial Sequence
  Synthetic DNA
taatacgactcattaaag

SEQ ID NO: 883 - DNA, 18 bp, Artificial Sequence
  Synthetic DNA
ttatacgactgactatag

SEQ ID NO: 884 - DNA, 18 bp, Artificial Sequence
  Synthetic DNA
taatatgacttactatag

SEQ ID NO: 885 - DNA, 18 bp, Artificial Sequence
  Synthetic DNA
tcatacgacttactatag

SEQ ID NO: 886 - DNA, 18 bp, Artificial Sequence
  Synthetic DNA
taataccactcactgtag

SEQ ID NO: 887 - DNA, 18 bp, Artificial Sequence
  Synthetic DNA
tcgtacgactcactatag

SEQ ID NO: 888 - DNA, 18 bp, Artificial Sequence
  Synthetic DNA
taacacgattcactatag

SEQ ID NO: 889 - DNA, 18 bp, Artificial Sequence
  Synthetic DNA
taatacgactccctacag

SEQ ID NO: 890 - DNA, 18 bp, Artificial Sequence
  Synthetic DNA
taataccactcactctag

SEQ ID NO: 891 - DNA, 18 bp, Artificial Sequence
  Synthetic DNA
taatacgagtcattatag

SEQ ID NO: 892 - DNA, 18 bp, Artificial Sequence
  Synthetic DNA
taatacgcctcattatag

SEQ ID NO: 893 - DNA, 18 bp, Artificial Sequence
  Synthetic DNA
taattcgaatcactatag

SEQ ID NO: 894 - DNA, 18 bp, Artificial Sequence
  Synthetic DNA
taataccacttactatag

SEQ ID NO: 895 - DNA, 18 bp, Artificial Sequence
  Synthetic DNA
taatacgactaactttag

SEQ ID NO: 896 - DNA, 18 bp, Artificial Sequence
  Synthetic DNA
taatacggcacactatag

SEQ ID NO: 897 - DNA, 18 bp, Artificial Sequence
  Synthetic DNA
taatacgaatcactgtag

SEQ ID NO: 898 - DNA, 18 bp, Artificial Sequence
  Synthetic DNA
taatatgacccactatag

SEQ ID NO: 899 - DNA, 18 bp, Artificial Sequence
  Synthetic DNA
gactacgactcactatag

SEQ ID NO: 900 - DNA, 18 bp, Artificial Sequence
  Synthetic DNA
taatacgacacactacag

SEQ ID NO: 901 - DNA, 18 bp, Artificial Sequence
  Synthetic DNA
tactacgacacactatag

SEQ ID NO: 902 - DNA, 18 bp, Artificial Sequence
  Synthetic DNA
taaaactactcactatag

SEQ ID NO: 903 - DNA, 18 bp, Artificial Sequence
  Synthetic DNA
taaaacgactccctatag

SEQ ID NO: 904 - DNA, 18 bp, Artificial Sequence
  Synthetic DNA
ttacacgactcactatag

SEQ ID NO: 905 - DNA, 18 bp, Artificial Sequence
  Synthetic DNA
ttatacgattcactatag

SEQ ID NO: 906 - DNA, 18 bp, Artificial Sequence
  Synthetic DNA
taacacgactcacaatag

SEQ ID NO: 907 - DNA, 18 bp, Artificial Sequence
  Synthetic DNA
tcatacgactcactagag

SEQ ID NO: 908 - DNA, 18 bp, Artificial Sequence
  Synthetic DNA
taatacgattcacaatag

SEQ ID NO: 909 - DNA, 18 bp, Artificial Sequence
  Synthetic DNA
taaaacgactcattatag

SEQ ID NO: 910 - DNA, 18 bp, Artificial Sequence
  Synthetic DNA
taatacgactccttatag

SEQ ID NO: 911 - DNA, 18 bp, Artificial Sequence
  Synthetic DNA
tgatacgactcaatatag

SEQ ID NO: 912 - DNA, 18 bp, Artificial Sequence
  Synthetic DNA
caatactactcactatag

SEQ ID NO: 913 - DNA, 18 bp, Artificial Sequence
  Synthetic DNA
taatacggatcactatag

SEQ ID NO: 914 - DNA, 18 bp, Artificial Sequence
  Synthetic DNA
taatactaatcactatag

SEQ ID NO: 915 - DNA, 18 bp, Artificial Sequence
  Synthetic DNA
taagacgactcactttag

SEQ ID NO: 916 - DNA, 18 bp, Artificial Sequence
  Synthetic DNA
taatacgacttacgatag

SEQ ID NO: 917 - DNA, 18 bp, Artificial Sequence
  Synthetic DNA
tcatacgactccctatag

SEQ ID NO: 918 - DNA, 18 bp, Artificial Sequence
  Synthetic DNA
taatagtactcactatag

SEQ ID NO: 919 - DNA, 18 bp, Artificial Sequence
  Synthetic DNA
taatacgactgaatatag

SEQ ID NO: 920 - DNA, 18 bp, Artificial Sequence
  Synthetic DNA
tgatacgaatcactatag

SEQ ID NO: 921 - DNA, 18 bp, Artificial Sequence
  Synthetic DNA
taatacgacacattatag

SEQ ID NO: 922 - DNA, 18 bp, Artificial Sequence
  Synthetic DNA
taatacgagttactatag

SEQ ID NO: 923 - DNA, 18 bp, Artificial Sequence
  Synthetic DNA
taatacgactgacgatag

SEQ ID NO: 924 - DNA, 18 bp, Artificial Sequence
  Synthetic DNA
gaacacgactcactatag

SEQ ID NO: 925 - DNA, 18 bp, Artificial Sequence
  Synthetic DNA
gaagacgactcactatag

SEQ ID NO: 926 - DNA, 18 bp, Artificial Sequence
  Synthetic DNA
taatgccactcactatag

SEQ ID NO: 927 - DNA, 18 bp, Artificial Sequence
  Synthetic DNA
taatacgattcactattg

SEQ ID NO: 928 - DNA, 18 bp, Artificial Sequence
  Synthetic DNA
taataccacacactatag

SEQ ID NO: 929 - DNA, 18 bp, Artificial Sequence
  Synthetic DNA
tacaacgactcactatag

SEQ ID NO: 930 - DNA, 18 bp, Artificial Sequence
  Synthetic DNA
taatacatctcactatag

SEQ ID NO: 931 - DNA, 18 bp, Artificial Sequence
  Synthetic DNA
taatatgactcaccatag

SEQ ID NO: 932 - DNA, 18 bp, Artificial Sequence
  Synthetic DNA
ttatacgactccctatag

SEQ ID NO: 933 - DNA, 18 bp, Artificial Sequence
  Synthetic DNA
taatacgactctatatag

SEQ ID NO: 934 - DNA, 18 bp, Artificial Sequence
  Synthetic DNA
taatccgactcaatatag

SEQ ID NO: 935 - DNA, 18 bp, Artificial Sequence
  Synthetic DNA
taatacgacttactacag

SEQ ID NO: 936 - DNA, 18 bp, Artificial Sequence
  Synthetic DNA
taatacgattcactagag

SEQ ID NO: 937 - DNA, 18 bp, Artificial Sequence
  Synthetic DNA
taattcgactgactatag

SEQ ID NO: 938 - DNA, 18 bp, Artificial Sequence
  Synthetic DNA
taatacgactcaatatgg

SEQ ID NO: 939 - DNA, 18 bp, Artificial Sequence
  Synthetic DNA
taattcgagtcactatag

SEQ ID NO: 940 - DNA, 18 bp, Artificial Sequence
  Synthetic DNA
tcatactactcactatag

SEQ ID NO: 941 - DNA, 18 bp, Artificial Sequence
  Synthetic DNA
ttatacgagtcactatag

SEQ ID NO: 942 - DNA, 18 bp, Artificial Sequence
  Synthetic DNA
taatatgactaactatag

SEQ ID NO: 943 - DNA, 18 bp, Artificial Sequence
  Synthetic DNA
aaatacgactctctatag

SEQ ID NO: 944 - DNA, 18 bp, Artificial Sequence
  Synthetic DNA
taatacgactcattacag

SEQ ID NO: 945 - DNA, 18 bp, Artificial Sequence
  Synthetic DNA
taatacggctgactatag

SEQ ID NO: 946 - DNA, 18 bp, Artificial Sequence
  Synthetic DNA
aaatacgactcaatatag

SEQ ID NO: 947 - DNA, 18 bp, Artificial Sequence
  Synthetic DNA
taatacgactcccaatag

SEQ ID NO: 948 - DNA, 18 bp, Artificial Sequence
  Synthetic DNA
taatacggctaactatag

SEQ ID NO: 949 - DNA, 18 bp, Artificial Sequence
  Synthetic DNA
taatactactcactaaag

SEQ ID NO: 950 - DNA, 18 bp, Artificial Sequence
  Synthetic DNA
taatacgacccacgatag

SEQ ID NO: 951 - DNA, 18 bp, Artificial Sequence
  Synthetic DNA
taatacgagtcactatgg

SEQ ID NO: 952 - DNA, 18 bp, Artificial Sequence
  Synthetic DNA
gaatacgagtcactatag

SEQ ID NO: 953 - DNA, 18 bp, Artificial Sequence
  Synthetic DNA
tcatacgactcacaatag

SEQ ID NO: 954 - DNA, 18 bp, Artificial Sequence
  Synthetic DNA
taatacggttcactatag

SEQ ID NO: 955 - DNA, 18 bp, Artificial Sequence
  Synthetic DNA
taatacgtctaactatag

SEQ ID NO: 956 - DNA, 18 bp, Artificial Sequence
  Synthetic DNA
taatacgattcaccatag

SEQ ID NO: 957 - DNA, 18 bp, Artificial Sequence
  Synthetic DNA
taatacgactatctatag

SEQ ID NO: 958 - DNA, 18 bp, Artificial Sequence
  Synthetic DNA
taatacaactaactatag

SEQ ID NO: 959 - DNA, 18 bp, Artificial Sequence
  Synthetic DNA
taatacgaccaactatag

SEQ ID NO: 960 - DNA, 18 bp, Artificial Sequence
  Synthetic DNA
tattacgaatcactatag

SEQ ID NO: 961 - DNA, 18 bp, Artificial Sequence
  Synthetic DNA
tattacgacacactatag

SEQ ID NO: 962 - DNA, 18 bp, Artificial Sequence
  Synthetic DNA
taatacgagtaactatag

SEQ ID NO: 963 - DNA, 18 bp, Artificial Sequence
  Synthetic DNA
taatacgacacaccatag

SEQ ID NO: 964 - DNA, 18 bp, Artificial Sequence
  Synthetic DNA
tcatacgactcactatgg

SEQ ID NO: 965 - DNA, 18 bp, Artificial Sequence
  Synthetic DNA
taatactactcactctag

SEQ ID NO: 966 - DNA, 18 bp, Artificial Sequence
  Synthetic DNA
taatacgtctcattatag

SEQ ID NO: 967 - DNA, 18 bp, Artificial Sequence
  Synthetic DNA
taatacgactaacgatag

SEQ ID NO: 968 - DNA, 18 bp, Artificial Sequence
  Synthetic DNA
taataggacccactatag

SEQ ID NO: 969 - DNA, 18 bp, Artificial Sequence
  Synthetic DNA
taatacgacacacgatag

SEQ ID NO: 970 - DNA, 18 bp, Artificial Sequence
  Synthetic DNA
taataagattcactatag

SEQ ID NO: 971 - DNA, 18 bp, Artificial Sequence
  Synthetic DNA
taatacgattaactatag

SEQ ID NO: 972 - DNA, 18 bp, Artificial Sequence
  Synthetic DNA
taatacgaatcactatgg

SEQ ID NO: 973 - DNA, 18 bp, Artificial Sequence
  Synthetic DNA
taatacgactttctatag

SEQ ID NO: 974 - DNA, 18 bp, Artificial Sequence
  Synthetic DNA
taatacgacccactacag

SEQ ID NO: 975 - DNA, 18 bp, Artificial Sequence
  Synthetic DNA
taatgcgactccctatag

SEQ ID NO: 976 - DNA, 18 bp, Artificial Sequence
  Synthetic DNA
tgatacgactccctatag

SEQ ID NO: 977 - DNA, 18 bp, Artificial Sequence
  Synthetic DNA
taattcgacccactatag

SEQ ID NO: 978 - DNA, 18 bp, Artificial Sequence
  Synthetic DNA
taatccgactgactatag

SEQ ID NO: 979 - DNA, 18 bp, Artificial Sequence
  Synthetic DNA
taacacgactcactatgg

SEQ ID NO: 980 - DNA, 18 bp, Artificial Sequence
  Synthetic DNA
taagacggctcactatag

SEQ ID NO: 981 - DNA, 18 bp, Artificial Sequence
  Synthetic DNA
taatatgactcattatag

SEQ ID NO: 982 - DNA, 18 bp, Artificial Sequence
  Synthetic DNA
tactacgactcactatcg

SEQ ID NO: 983 - DNA, 18 bp, Artificial Sequence
  Synthetic DNA
tcttacgactcactatag

SEQ ID NO: 984 - DNA, 18 bp, Artificial Sequence
  Synthetic DNA
taatacgactacctatag

SEQ ID NO: 985 - DNA, 18 bp, Artificial Sequence
  Synthetic DNA
taatactactctctatag

SEQ ID NO: 986 - DNA, 18 bp, Artificial Sequence
  Synthetic DNA
tgataccactcactatag

SEQ ID NO: 987 - DNA, 18 bp, Artificial Sequence
  Synthetic DNA
taatacttctcactatag

SEQ ID NO: 988 - DNA, 18 bp, Artificial Sequence
  Synthetic DNA
tactacaactcactatag

SEQ ID NO: 989 - DNA, 18 bp, Artificial Sequence
  Synthetic DNA
tactacgattcactatag

SEQ ID NO: 990 - DNA, 18 bp, Artificial Sequence
  Synthetic DNA
taagaggactcactatag

SEQ ID NO: 991 - DNA, 18 bp, Artificial Sequence
  Synthetic DNA
taataagactgactatag

SEQ ID NO: 992 - DNA, 18 bp, Artificial Sequence
  Synthetic DNA
taatacgactcacaagag

SEQ ID NO: 993 - DNA, 18 bp, Artificial Sequence
  Synthetic DNA
taattcgactaactatag

SEQ ID NO: 994 - DNA, 18 bp, Artificial Sequence
  Synthetic DNA
aaatacgacgcactatag

SEQ ID NO: 995 - DNA, 18 bp, Artificial Sequence
  Synthetic DNA
taatacgacgcacaatag

SEQ ID NO: 996 - DNA, 18 bp, Artificial Sequence
  Synthetic DNA
taagccgactcactatag

SEQ ID NO: 997 - DNA, 18 bp, Artificial Sequence
  Synthetic DNA
taatacgacttaccatag

SEQ ID NO: 998 - DNA, 18 bp, Artificial Sequence
  Synthetic DNA
taacacgaatcactatag

SEQ ID NO: 999 - DNA, 18 bp, Artificial Sequence
  Synthetic DNA
taatacgactgagtatag

SEQ ID NO: 1000 - DNA, 18 bp, Artificial Sequence
  Synthetic DNA
tattacgacccactatag

SEQ ID NO: 1001 - DNA, 18 bp, Artificial Sequence
  Synthetic DNA
taatactactcactgtag

SEQ ID NO: 1002 - DNA, 18 bp, Artificial Sequence
  Synthetic DNA
tagtacgacacactatag

SEQ ID NO: 1003 - DNA, 18 bp, Artificial Sequence
  Synthetic DNA
taagacgactcactacag

SEQ ID NO: 1004 - DNA, 18 bp, Artificial Sequence
  Synthetic DNA
taatatgactcaatatag

SEQ ID NO: 1005 - DNA, 18 bp, Artificial Sequence
  Synthetic DNA
tactccgactcactatag

SEQ ID NO: 1006 - DNA, 18 bp, Artificial Sequence
  Synthetic DNA
taatatgactctctatag

SEQ ID NO: 1007 - DNA, 18 bp, Artificial Sequence
  Synthetic DNA
tcatacgactaactatag

SEQ ID NO: 1008 - DNA, 18 bp, Artificial Sequence
  Synthetic DNA
gaatacgactcactttag

SEQ ID NO: 1009 - DNA, 18 bp, Artificial Sequence
  Synthetic DNA
taatacgaccctctatag

SEQ ID NO: 1010 - DNA, 18 bp, Artificial Sequence
  Synthetic DNA
tactactactcactatag

SEQ ID NO: 1011 - DNA, 18 bp, Artificial Sequence
  Synthetic DNA
taatactacttactatag

SEQ ID NO: 1012 - DNA, 18 bp, Artificial Sequence
  Synthetic DNA
taattcgactcattatag

SEQ ID NO: 1013 - DNA, 18 bp, Artificial Sequence
  Synthetic DNA
tgagacgactcactatag

SEQ ID NO: 1014 - DNA, 18 bp, Artificial Sequence
  Synthetic DNA
tagtacgattcactatag

SEQ ID NO: 1015 - DNA, 18 bp, Artificial Sequence
  Synthetic DNA
taatacgacttactgtag

SEQ ID NO: 1016 - DNA, 18 bp, Artificial Sequence
  Synthetic DNA
taatacgacttattatag

SEQ ID NO: 1017 - DNA, 18 bp, Artificial Sequence
  Synthetic DNA
taacacgactcattatag

SEQ ID NO: 1018 - DNA, 18 bp, Artificial Sequence
  Synthetic DNA
tagtacgcctcactatag

SEQ ID NO: 1019 - DNA, 18 bp, Artificial Sequence
  Synthetic DNA
taatacgactaaatatag

SEQ ID NO: 1020 - DNA, 18 bp, Artificial Sequence
  Synthetic DNA
taatacgactccctttag

SEQ ID NO: 1021 - DNA, 18 bp, Artificial Sequence
  Synthetic DNA
taatacgatacactatag

SEQ ID NO: 1022 - DNA, 18 bp, Artificial Sequence
  Synthetic DNA
taatacgactctttatag

SEQ ID NO: 1023 - DNA, 18 bp, Artificial Sequence
  Synthetic DNA
tcatacgaatcactatag

SEQ ID NO: 1024 - DNA, 18 bp, Artificial Sequence
  Synthetic DNA
taatacgactcactgtac

SEQ ID NO: 1025 - DNA, 18 bp, Artificial Sequence
  Synthetic DNA
taatacctctcactatag

SEQ ID NO: 1026 - DNA, 18 bp, Artificial Sequence
  Synthetic DNA
caatacgactcaatatag

SEQ ID NO: 1027 - DNA, 18 bp, Artificial Sequence
  Synthetic DNA
taatacgacttcctatag

SEQ ID NO: 1028 - DNA, 18 bp, Artificial Sequence
  Synthetic DNA
taatacgaatctctatag

SEQ ID NO: 1029 - DNA, 18 bp, Artificial Sequence
  Synthetic DNA
tattacgactgactatag

SEQ ID NO: 1030 - DNA, 18 bp, Artificial Sequence
  Synthetic DNA
taatactactcactagag

SEQ ID NO: 1031 - DNA, 18 bp, Artificial Sequence
  Synthetic DNA
caatacgacacactatag

SEQ ID NO: 1032 - DNA, 18 bp, Artificial Sequence
  Synthetic DNA
taatacgattccctatag

SEQ ID NO: 1033 - DNA, 18 bp, Artificial Sequence
  Synthetic DNA
tactacgactcacaatag

SEQ ID NO: 1034 - DNA, 18 bp, Artificial Sequence
  Synthetic DNA
taatattactcactatag

SEQ ID NO: 1035 - DNA, 18 bp, Artificial Sequence
  Synthetic DNA
taatactattcactatag

SEQ ID NO: 1036 - DNA, 18 bp, Artificial Sequence
  Synthetic DNA
taatccgactcacaatag

SEQ ID NO: 1037 - DNA, 18 bp, Artificial Sequence
  Synthetic DNA
taataacactcactatag

SEQ ID NO: 1038 - DNA, 18 bp, Artificial Sequence
  Synthetic DNA
taattccactcactatag

SEQ ID NO: 1039 - DNA, 18 bp, Artificial Sequence
  Synthetic DNA
tagtactactcactatag

SEQ ID NO: 1040 - DNA, 18 bp, Artificial Sequence
  Synthetic DNA
tactacgactaactatag

SEQ ID NO: 1041 - DNA, 18 bp, Artificial Sequence
  Synthetic DNA
taatactactcactacag

SEQ ID NO: 1042 - DNA, 18 bp, Artificial Sequence
  Synthetic DNA
taatacgccacactatag

SEQ ID NO: 1043 - DNA, 18 bp, Artificial Sequence
  Synthetic DNA
caatacgactcactatgg

SEQ ID NO: 1044 - DNA, 18 bp, Artificial Sequence
  Synthetic DNA
taataccactcactatcg

SEQ ID NO: 1045 - DNA, 18 bp, Artificial Sequence
  Synthetic DNA
aaatacgactaactatag

SEQ ID NO: 1046 - DNA, 18 bp, Artificial Sequence
  Synthetic DNA
aaatacgacccactatag

SEQ ID NO: 1047 - DNA, 18 bp, Artificial Sequence
  Synthetic DNA
taatatgacacactatag

SEQ ID NO: 1048 - DNA, 18 bp, Artificial Sequence
  Synthetic DNA
taatacgactgtctatag

SEQ ID NO: 1049 - DNA, 18 bp, Artificial Sequence
  Synthetic DNA
taatacgattcactttag

SEQ ID NO: 1050 - DNA, 18 bp, Artificial Sequence
  Synthetic DNA
tattacgattcactatag

SEQ ID NO: 1051 - DNA, 18 bp, Artificial Sequence
  Synthetic DNA
taatgcgacccactatag

SEQ ID NO: 1052 - DNA, 18 bp, Artificial Sequence
  Synthetic DNA
tactacgactgactatag

SEQ ID NO: 1053 - DNA, 18 bp, Artificial Sequence
  Synthetic DNA
tgatacgacccactatag

SEQ ID NO: 1054 - DNA, 18 bp, Artificial Sequence
  Synthetic DNA
caatacgacgcactatag

SEQ ID NO: 1055 - DNA, 18 bp, Artificial Sequence
  Synthetic DNA
tattactactcactatag

SEQ ID NO: 1056 - DNA, 18 bp, Artificial Sequence
  Synthetic DNA
taatacaacacactatag

SEQ ID NO: 1057 - DNA, 18 bp, Artificial Sequence
  Synthetic DNA
tcctacgactcactatag

SEQ ID NO: 1058 - DNA, 18 bp, Artificial Sequence
  Synthetic DNA
taatactactcagtatag

SEQ ID NO: 1059 - DNA, 18 bp, Artificial Sequence
  Synthetic DNA
taataccactctctatag

SEQ ID NO: 1060 - DNA, 18 bp, Artificial Sequence
  Synthetic DNA
caatacgacttactatag

SEQ ID NO: 1061 - DNA, 18 bp, Artificial Sequence
  Synthetic DNA
ttataccactcactatag

SEQ ID NO: 1062 - DNA, 18 bp, Artificial Sequence
  Synthetic DNA
taatacgattcactctag

SEQ ID NO: 1063 - DNA, 18 bp, Artificial Sequence
  Synthetic DNA
taatactactcactttag

SEQ ID NO: 1064 - DNA, 18 bp, Artificial Sequence
  Synthetic DNA
taataccactcactattg

SEQ ID NO: 1065 - DNA, 18 bp, Artificial Sequence
  Synthetic DNA
taatacgacacagtatag

SEQ ID NO: 1066 - DNA, 18 bp, Artificial Sequence
  Synthetic DNA
taatacgagtcacaatag

SEQ ID NO: 1067 - DNA, 18 bp, Artificial Sequence
  Synthetic DNA
taatacgacgcacgatag

SEQ ID NO: 1068 - DNA, 18 bp, Artificial Sequence
  Synthetic DNA
taatactagtcactatag

SEQ ID NO: 1069 - DNA, 18 bp, Artificial Sequence
  Synthetic DNA
taatacgactccccatag

SEQ ID NO: 1070 - DNA, 18 bp, Artificial Sequence
  Synthetic DNA
taatacgactcattatgg

SEQ ID NO: 1071 - DNA, 18 bp, Artificial Sequence
  Synthetic DNA
taatacgtcacactatag

SEQ ID NO: 1072 - DNA, 18 bp, Artificial Sequence
  Synthetic DNA
taatacgactcaaaatag

SEQ ID NO: 1073 - DNA, 18 bp, Artificial Sequence
  Synthetic DNA
tcatacgactctctatag

SEQ ID NO: 1074 - DNA, 18 bp, Artificial Sequence
  Synthetic DNA
taataccactcacaatag

SEQ ID NO: 1075 - DNA, 18 bp, Artificial Sequence
  Synthetic DNA
tgacacgactcactatag

SEQ ID NO: 1076 - DNA, 18 bp, Artificial Sequence
  Synthetic DNA
tattacgacttactatag

SEQ ID NO: 1077 - DNA, 18 bp, Artificial Sequence
  Synthetic DNA
taatactactccctatag

SEQ ID NO: 1078 - DNA, 18 bp, Artificial Sequence
  Synthetic DNA
taatacgaatgactatag

SEQ ID NO: 1079 - DNA, 18 bp, Artificial Sequence
  Synthetic DNA
taagacgactcattatag

SEQ ID NO: 1080 - DNA, 18 bp, Artificial Sequence
  Synthetic DNA
taatacgattctctatag

SEQ ID NO: 1081 - DNA, 18 bp, Artificial Sequence
  Synthetic DNA
aactacgactcactatag

SEQ ID NO: 1082 - DNA, 18 bp, Artificial Sequence
  Synthetic DNA
taataggactaactatag

SEQ ID NO: 1083 - DNA, 18 bp, Artificial Sequence
  Synthetic DNA
taatacgactccctagag

SEQ ID NO: 1084 - DNA, 18 bp, Artificial Sequence
  Synthetic DNA
taatacgacccactttag

SEQ ID NO: 1085 - DNA, 18 bp, Artificial Sequence
  Synthetic DNA
taatacgattgactatag

SEQ ID NO: 1086 - DNA, 18 bp, Artificial Sequence
  Synthetic DNA
tagtaagactcactatag

SEQ ID NO: 1087 - DNA, 18 bp, Artificial Sequence
  Synthetic DNA
taatatgactcgctatag

SEQ ID NO: 1088 - DNA, 18 bp, Artificial Sequence
  Synthetic DNA
tcatacgactcacgatag

SEQ ID NO: 1089 - DNA, 18 bp, Artificial Sequence
  Synthetic DNA
taatacgactgcctatag

SEQ ID NO: 1090 - DNA, 18 bp, Artificial Sequence
  Synthetic DNA
taattctactcactatag

SEQ ID NO: 1091 - DNA, 18 bp, Artificial Sequence
  Synthetic DNA
caatacgactcacaatag

SEQ ID NO: 1092 - DNA, 18 bp, Artificial Sequence
  Synthetic DNA
taatacgacgtactatag

SEQ ID NO: 1093 - DNA, 18 bp, Artificial Sequence
  Synthetic DNA
taatacgacacactaaag

SEQ ID NO: 1094 - DNA, 18 bp, Artificial Sequence
  Synthetic DNA
taatacgattcgctatag

SEQ ID NO: 1095 - DNA, 18 bp, Artificial Sequence
  Synthetic DNA
tattacgactccctatag

SEQ ID NO: 1096 - DNA, 18 bp, Artificial Sequence
  Synthetic DNA
taatacgaatcaatatag

SEQ ID NO: 1097 - DNA, 18 bp, Artificial Sequence
  Synthetic DNA
taataatactcactatag

SEQ ID NO: 1098 - DNA, 18 bp, Artificial Sequence
  Synthetic DNA
taatacggcccactatag

SEQ ID NO: 1099 - DNA, 18 bp, Artificial Sequence
  Synthetic DNA
taaaacgactaactatag

SEQ ID NO: 1100 - DNA, 18 bp, Artificial Sequence
  Synthetic DNA
taatacggctcactatgg

SEQ ID NO: 1101 - DNA, 18 bp, Artificial Sequence
  Synthetic DNA
gaatactactcactatag

SEQ ID NO: 1102 - DNA, 18 bp, Artificial Sequence
  Synthetic DNA
tattacgactaactatag

SEQ ID NO: 1103 - DNA, 18 bp, Artificial Sequence
  Synthetic DNA
tgatacgacttactatag

SEQ ID NO: 1104 - DNA, 18 bp, Artificial Sequence
  Synthetic DNA
taatacgaagcactatag

SEQ ID NO: 1105 - DNA, 18 bp, Artificial Sequence
  Synthetic DNA
taatacaattcactatag

SEQ ID NO: 1106 - DNA, 18 bp, Artificial Sequence
  Synthetic DNA
tattacgactcattatag

SEQ ID NO: 1107 - DNA, 18 bp, Artificial Sequence
  Synthetic DNA
tgatacgattcactatag

SEQ ID NO: 1108 - DNA, 18 bp, Artificial Sequence
  Synthetic DNA
tactacgaatcactatag

SEQ ID NO: 1109 - DNA, 18 bp, Artificial Sequence
  Synthetic DNA
taatagggctcactatag

SEQ ID NO: 1110 - DNA, 18 bp, Artificial Sequence
  Synthetic DNA
tactacgactcactagag

SEQ ID NO: 1111 - DNA, 18 bp, Artificial Sequence
  Synthetic DNA
taatacgatttactatag

SEQ ID NO: 1112 - DNA, 18 bp, Artificial Sequence
  Synthetic DNA
taatacgaaacactatag

SEQ ID NO: 1113 - DNA, 18 bp, Artificial Sequence
  Synthetic DNA
caatacgaatcactatag

SEQ ID NO: 1114 - DNA, 18 bp, Artificial Sequence
  Synthetic DNA
taatacgattcattatag

SEQ ID NO: 1115 - DNA, 18 bp, Artificial Sequence
  Synthetic DNA
taatacgactccctaaag

SEQ ID NO: 1116 - DNA, 18 bp, Artificial Sequence
  Synthetic DNA
ttatactactcactatag

SEQ ID NO: 1117 - DNA, 18 bp, Artificial Sequence
  Synthetic DNA
taaaacggctcactatag

SEQ ID NO: 1118 - DNA, 18 bp, Artificial Sequence
  Synthetic DNA
taaaaccactcactatag

SEQ ID NO: 1119 - DNA, 18 bp, Artificial Sequence
  Synthetic DNA
taatccgactctctatag

SEQ ID NO: 1120 - DNA, 18 bp, Artificial Sequence
  Synthetic DNA
taatacgacttactatgg

SEQ ID NO: 1121 - DNA, 18 bp, Artificial Sequence
  Synthetic DNA
taatacgacccactctag

SEQ ID NO: 1122 - DNA, 18 bp, Artificial Sequence
  Synthetic DNA
taatacgtctcacgatag

SEQ ID NO: 1123 - DNA, 18 bp, Artificial Sequence
  Synthetic DNA
taaaacgacttactatag

SEQ ID NO: 1124 - DNA, 18 bp, Artificial Sequence
  Synthetic DNA
ttatacgacacactatag

SEQ ID NO: 1125 - DNA, 18 bp, Artificial Sequence
  Synthetic DNA
tactacgactctctatag

SEQ ID NO: 1126 - DNA, 18 bp, Artificial Sequence
  Synthetic DNA
tgataggactcactatag

SEQ ID NO: 1127 - DNA, 18 bp, Artificial Sequence
  Synthetic DNA
caatacggctcactatag

SEQ ID NO: 1128 - DNA, 18 bp, Artificial Sequence
  Synthetic DNA
taatacgactcattattg

SEQ ID NO: 1129 - DNA, 18 bp, Artificial Sequence
  Synthetic DNA
taataccactcactttag

SEQ ID NO: 1130 - DNA, 18 bp, Artificial Sequence
  Synthetic DNA
taaaacgacacactatag

SEQ ID NO: 1131 - DNA, 18 bp, Artificial Sequence
  Synthetic DNA
taatactactcacgatag

SEQ ID NO: 1132 - DNA, 18 bp, Artificial Sequence
  Synthetic DNA
taatacaagtcactatag

SEQ ID NO: 1133 - DNA, 18 bp, Artificial Sequence
  Synthetic DNA
aaatactactcactatag

SEQ ID NO: 1134 - DNA, 18 bp, Artificial Sequence
  Synthetic DNA
taagacgactcaccatag

SEQ ID NO: 1135 - DNA, 18 bp, Artificial Sequence
  Synthetic DNA
taatacgactaacaatag

SEQ ID NO: 1136 - DNA, 18 bp, Artificial Sequence
  Synthetic DNA
tactacgactcgctatag

SEQ ID NO: 1137 - DNA, 18 bp, Artificial Sequence
  Synthetic DNA
tagtacgacccactatag

SEQ ID NO: 1138 - DNA, 18 bp, Artificial Sequence
  Synthetic DNA
ttatacgacccactatag

SEQ ID NO: 1139 - DNA, 18 bp, Artificial Sequence
  Synthetic DNA
tcatacggctcactatag

SEQ ID NO: 1140 - DNA, 18 bp, Artificial Sequence
  Synthetic DNA
taatacggctctctatag

SEQ ID NO: 1141 - DNA, 18 bp, Artificial Sequence
  Synthetic DNA
taataagactaactatag

SEQ ID NO: 1142 - DNA, 18 bp, Artificial Sequence
  Synthetic DNA
taacacgacacactatag

SEQ ID NO: 1143 - DNA, 18 bp, Artificial Sequence
  Synthetic DNA
taatacgactgactatgg

SEQ ID NO: 1144 - DNA, 18 bp, Artificial Sequence
  Synthetic DNA
taatacgactgactaaag

SEQ ID NO: 1145 - DNA, 18 bp, Artificial Sequence
  Synthetic DNA
taatatgactccctatag

SEQ ID NO: 1146 - DNA, 18 bp, Artificial Sequence
  Synthetic DNA
taatacgacacacaatag

SEQ ID NO: 1147 - DNA, 18 bp, Artificial Sequence
  Synthetic DNA
aaatacggctcactatag

SEQ ID NO: 1148 - DNA, 18 bp, Artificial Sequence
  Synthetic DNA
taataagagtcactatag

SEQ ID NO: 1149 - DNA, 18 bp, Artificial Sequence
  Synthetic DNA
taatactactaactatag

SEQ ID NO: 1150 - DNA, 18 bp, Artificial Sequence
  Synthetic DNA
aaatacgattcactatag

SEQ ID NO: 1151 - DNA, 18 bp, Artificial Sequence
  Synthetic DNA
tagtacgactaactatag

SEQ ID NO: 1152 - DNA, 18 bp, Artificial Sequence
  Synthetic DNA
acatacgactcactatag

SEQ ID NO: 1153 - DNA, 18 bp, Artificial Sequence
  Synthetic DNA
tgatacgactctctatag

SEQ ID NO: 1154 - DNA, 18 bp, Artificial Sequence
  Synthetic DNA
taatacgactaattatag

SEQ ID NO: 1155 - DNA, 18 bp, Artificial Sequence
  Synthetic DNA
tactacgacttactatag

SEQ ID NO: 1156 - DNA, 18 bp, Artificial Sequence
  Synthetic DNA
taagacgactcacaatag

SEQ ID NO: 1157 - DNA, 18 bp, Artificial Sequence
  Synthetic DNA
gaatacgactaactatag

SEQ ID NO: 1158 - DNA, 18 bp, Artificial Sequence
  Synthetic DNA
caatacgactcattatag

SEQ ID NO: 1159 - DNA, 18 bp, Artificial Sequence
  Synthetic DNA
ttatacgactcattatag

SEQ ID NO: 1160 - DNA, 18 bp, Artificial Sequence
  Synthetic DNA
taatacgacttacaatag

SEQ ID NO: 1161 - DNA, 18 bp, Artificial Sequence
  Synthetic DNA
taataccactcaccatag

SEQ ID NO: 1162 - DNA, 18 bp, Artificial Sequence
  Synthetic DNA
taatacgacacaatatag

SEQ ID NO: 1163 - DNA, 18 bp, Artificial Sequence
  Synthetic DNA
tgatactactcactatag

SEQ ID NO: 1164 - DNA, 18 bp, Artificial Sequence
  Synthetic DNA
taatacgatgcactatag

SEQ ID NO: 1165 - DNA, 18 bp, Artificial Sequence
  Synthetic DNA
taatacgactcagcatag

SEQ ID NO: 1166 - DNA, 18 bp, Artificial Sequence
  Synthetic DNA
taatacgacccaccatag

SEQ ID NO: 1167 - DNA, 18 bp, Artificial Sequence
  Synthetic DNA
taataggacttactatag

SEQ ID NO: 1168 - DNA, 18 bp, Artificial Sequence
  Synthetic DNA
taacacgacttactatag

SEQ ID NO: 1169 - DNA, 18 bp, Artificial Sequence
  Synthetic DNA
taatacgagtcactattg

SEQ ID NO: 1170 - DNA, 18 bp, Artificial Sequence
  Synthetic DNA
taacacgactcaccatag

SEQ ID NO: 1171 - DNA, 18 bp, Artificial Sequence
  Synthetic DNA
taatacggctcactgtag

SEQ ID NO: 1172 - DNA, 18 bp, Artificial Sequence
  Synthetic DNA
taattcgattcactatag

SEQ ID NO: 1173 - DNA, 18 bp, Artificial Sequence
  Synthetic DNA
taatatgactcacaatag

SEQ ID NO: 1174 - DNA, 18 bp, Artificial Sequence
  Synthetic DNA
taatacgactaactaaag

SEQ ID NO: 1175 - DNA, 18 bp, Artificial Sequence
  Synthetic DNA
tcatacgactcaatatag

SEQ ID NO: 1176 - DNA, 18 bp, Artificial Sequence
  Synthetic DNA
taataccagtcactatag

SEQ ID NO: 1177 - DNA, 18 bp, Artificial Sequence
  Synthetic DNA
taacatgactcactatag

SEQ ID NO: 1178 - DNA, 18 bp, Artificial Sequence
  Synthetic DNA
taagactactcactatag

SEQ ID NO: 1179 - DNA, 18 bp, Artificial Sequence
  Synthetic DNA
taatactactcaatatag

SEQ ID NO: 1180 - DNA, 18 bp, Artificial Sequence
  Synthetic DNA
taatactactcacaatag

SEQ ID NO: 1181 - DNA, 18 bp, Artificial Sequence
  Synthetic DNA
taatatgattcactatag

SEQ ID NO: 1182 - DNA, 18 bp, Artificial Sequence
  Synthetic DNA
tcatacgactcagtatag

SEQ ID NO: 1183 - DNA, 18 bp, Artificial Sequence
  Synthetic DNA
tagtacgactcacaatag

SEQ ID NO: 1184 - DNA, 18 bp, Artificial Sequence
  Synthetic DNA
taatacgacatactatag

SEQ ID NO: 1185 - DNA, 18 bp, Artificial Sequence
  Synthetic DNA
taataggacacactatag

SEQ ID NO: 1186 - DNA, 18 bp, Artificial Sequence
  Synthetic DNA
taatacgccttactatag

SEQ ID NO: 1187 - DNA, 18 bp, Artificial Sequence
  Synthetic DNA
tcacacgactcactatag

SEQ ID NO: 1188 - DNA, 18 bp, Artificial Sequence
  Synthetic DNA
taacacggctcactatag

SEQ ID NO: 1189 - DNA, 18 bp, Artificial Sequence
  Synthetic DNA
tcatacgacgcactatag

SEQ ID NO: 1190 - DNA, 18 bp, Artificial Sequence
  Synthetic DNA
taatactactcattatag

SEQ ID NO: 1191 - DNA, 18 bp, Artificial Sequence
  Synthetic DNA
tgatacgagtcactatag

SEQ ID NO: 1192 - DNA, 18 bp, Artificial Sequence
  Synthetic DNA
taatacgactgattatag

SEQ ID NO: 1193 - DNA, 18 bp, Artificial Sequence
  Synthetic DNA
taatacgacccattatag

SEQ ID NO: 1194 - DNA, 18 bp, Artificial Sequence
  Synthetic DNA
tcattcgactcactatag

SEQ ID NO: 1195 - DNA, 18 bp, Artificial Sequence
  Synthetic DNA
taatacgaaccactatag

SEQ ID NO: 1196 - DNA, 18 bp, Artificial Sequence
  Synthetic DNA
taataccactcaatatag

SEQ ID NO: 1197 - DNA, 18 bp, Artificial Sequence
  Synthetic DNA
taatccgacgcactatag

SEQ ID NO: 1198 - DNA, 18 bp, Artificial Sequence
  Synthetic DNA
taatgcgacacactatag

SEQ ID NO: 1199 - DNA, 18 bp, Artificial Sequence
  Synthetic DNA
taacacgactccctatag

SEQ ID NO: 1200 - DNA, 18 bp, Artificial Sequence
  Synthetic DNA
taatacgattcactacag

SEQ ID NO: 1201 - DNA, 18 bp, Artificial Sequence
  Synthetic DNA
tcataccactcactatag

SEQ ID NO: 1202 - DNA, 18 bp, Artificial Sequence
  Synthetic DNA
taatacgacaccctatag

SEQ ID NO: 1203 - DNA, 18 bp, Artificial Sequence
  Synthetic DNA
taacacgactcaatatag

SEQ ID NO: 1204 - DNA, 18 bp, Artificial Sequence
  Synthetic DNA
taatccgactaactatag

SEQ ID NO: 1205 - DNA, 18 bp, Artificial Sequence
  Synthetic DNA
taatacgacctactatag

SEQ ID NO: 1206 - DNA, 18 bp, Artificial Sequence
  Synthetic DNA
taatacgacttgctatag

SEQ ID NO: 1207 - DNA, 18 bp, Artificial Sequence
  Synthetic DNA
caatacgacccactatag

SEQ ID NO: 1208 - DNA, 18 bp, Artificial Sequence
  Synthetic DNA
taatacgacccacaatag

SEQ ID NO: 1209 - DNA, 18 bp, Artificial Sequence
  Synthetic DNA
taatccgactcattatag

SEQ ID NO: 1210 - DNA, 18 bp, Artificial Sequence
  Synthetic DNA
taagacgactctctatag

SEQ ID NO: 1211 - DNA, 18 bp, Artificial Sequence
  Synthetic DNA
taagacgattcactatag

SEQ ID NO: 1212 - DNA, 18 bp, Artificial Sequence
  Synthetic DNA
taatccgactccctatag

SEQ ID NO: 1213 - DNA, 18 bp, Artificial Sequence
  Synthetic DNA
taataccactcagtatag

SEQ ID NO: 1214 - DNA, 18 bp, Artificial Sequence
  Synthetic DNA
taataagacccactatag

SEQ ID NO: 1215 - DNA, 18 bp, Artificial Sequence
  Synthetic DNA
taatacgaattactatag

SEQ ID NO: 1216 - DNA, 18 bp, Artificial Sequence
  Synthetic DNA
gaatacgacccactatag

SEQ ID NO: 1217 - DNA, 18 bp, Artificial Sequence
  Synthetic DNA
taatacaacttactatag

SEQ ID NO: 1218 - DNA, 18 bp, Artificial Sequence
  Synthetic DNA
taatacgactccgtatag

SEQ ID NO: 1219 - DNA, 18 bp, Artificial Sequence
  Synthetic DNA
taataagacgcactatag

SEQ ID NO: 1220 - DNA, 18 bp, Artificial Sequence
  Synthetic DNA
taataccaatcactatag

SEQ ID NO: 1221 - DNA, 18 bp, Artificial Sequence
  Synthetic DNA
taacacgactaactatag

SEQ ID NO: 1222 - DNA, 18 bp, Artificial Sequence
  Synthetic DNA
taatccgacacactatag

SEQ ID NO: 1223 - DNA, 18 bp, Artificial Sequence
  Synthetic DNA
taccacgactcactatag

SEQ ID NO: 1224 - DNA, 18 bp, Artificial Sequence
  Synthetic DNA
aaatacgacttactatag

SEQ ID NO: 1225 - DNA, 18 bp, Artificial Sequence
  Synthetic DNA
taatactactcactatgg

SEQ ID NO: 1226 - DNA, 18 bp, Artificial Sequence
  Synthetic DNA
taataccactaactatag

SEQ ID NO: 1227 - DNA, 18 bp, Artificial Sequence
  Synthetic DNA
gaataccactcactatag

SEQ ID NO: 1228 - DNA, 18 bp, Artificial Sequence
  Synthetic DNA
taatacgagtcactagag

SEQ ID NO: 1229 - DNA, 18 bp, Artificial Sequence
  Synthetic DNA
tcatatgactcactatag

SEQ ID NO: 1230 - DNA, 18 bp, Artificial Sequence
  Synthetic DNA
taacactactcactatag

SEQ ID NO: 1231 - DNA, 18 bp, Artificial Sequence
  Synthetic DNA
tggtacgactcactatag

SEQ ID NO: 1232 - DNA, 18 bp, Artificial Sequence
  Synthetic DNA
gaatacgacacactatag

SEQ ID NO: 1233 - DNA, 18 bp, Artificial Sequence
  Synthetic DNA
taatacgactcactatcc

SEQ ID NO: 1234 - DNA, 18 bp, Artificial Sequence
  Synthetic DNA
caatacgactaactatag

SEQ ID NO: 1235 - DNA, 18 bp, Artificial Sequence
  Synthetic DNA
tagtacgactccctatag

SEQ ID NO: 1236 - DNA, 18 bp, Artificial Sequence
  Synthetic DNA
taatacggctcaatatag

SEQ ID NO: 1237 - DNA, 18 bp, Artificial Sequence
  Synthetic DNA
taatacgacttaatatag

SEQ ID NO: 1238 - DNA, 18 bp, Artificial Sequence
  Synthetic DNA
taatacgacacactatgg

SEQ ID NO: 1239 - DNA, 18 bp, Artificial Sequence
  Synthetic DNA
taacacgactgactatag

SEQ ID NO: 1240 - DNA, 18 bp, Artificial Sequence
  Synthetic DNA
taataagacacactatag

SEQ ID NO: 1241 - DNA, 18 bp, Artificial Sequence
  Synthetic DNA
taatacggctcacaatag

SEQ ID NO: 1242 - DNA, 18 bp, Artificial Sequence
  Synthetic DNA
tacgacgactcactatag

SEQ ID NO: 1243 - DNA, 18 bp, Artificial Sequence
  Synthetic DNA
taatacaactcattatag

SEQ ID NO: 1244 - DNA, 18 bp, Artificial Sequence
  Synthetic DNA
taatacacctcactatag

SEQ ID NO: 1245 - DNA, 18 bp, Artificial Sequence
  Synthetic DNA
taatacaacccactatag

SEQ ID NO: 1246 - DNA, 18 bp, Artificial Sequence
  Synthetic DNA
taatacaactgactatag

SEQ ID NO: 1247 - DNA, 18 bp, Artificial Sequence
  Synthetic DNA
taatacgactcactatta

SEQ ID NO: 1248 - DNA, 18 bp, Artificial Sequence
  Synthetic DNA
taatatgactgactatag

SEQ ID NO: 1249 - DNA, 18 bp, Artificial Sequence
  Synthetic DNA
taatacgtctgactatag

SEQ ID NO: 1250 - DNA, 18 bp, Artificial Sequence
  Synthetic DNA
aaatacgagtcactatag

SEQ ID NO: 1251 - DNA, 18 bp, Artificial Sequence
  Synthetic DNA
taatacgattcactatgg

SEQ ID NO: 1252 - DNA, 18 bp, Artificial Sequence
  Synthetic DNA
taacacgactcagtatag

SEQ ID NO: 1253 - DNA, 18 bp, Artificial Sequence
  Synthetic DNA
taatacgactgactctag

SEQ ID NO: 1254 - DNA, 18 bp, Artificial Sequence
  Synthetic DNA
tgatacgacacactatag

SEQ ID NO: 1255 - DNA, 18 bp, Artificial Sequence
  Synthetic DNA
gaatacgactcactacag

SEQ ID NO: 1256 - DNA, 18 bp, Artificial Sequence
  Synthetic DNA
taagacgactcagtatag

SEQ ID NO: 1257 - DNA, 18 bp, Artificial Sequence
  Synthetic DNA
taagacgacttactatag

SEQ ID NO: 1258 - DNA, 18 bp, Artificial Sequence
  Synthetic DNA
tcatacgactcattatag

SEQ ID NO: 1259 - DNA, 18 bp, Artificial Sequence
  Synthetic DNA
taagacgacgcactatag

SEQ ID NO: 1260 - DNA, 18 bp, Artificial Sequence
  Synthetic DNA
taatacgaatcattatag

SEQ ID NO: 1261 - DNA, 18 bp, Artificial Sequence
  Synthetic DNA
tactacgactcactatgg

SEQ ID NO: 1262 - DNA, 18 bp, Artificial Sequence
  Synthetic DNA
taatacggctcactagag

SEQ ID NO: 1263 - DNA, 18 bp, Artificial Sequence
  Synthetic DNA
tactacggctcactatag

SEQ ID NO: 1264 - DNA, 18 bp, Artificial Sequence
  Synthetic DNA
taatacgagtcactacag

SEQ ID NO: 1265 - DNA, 18 bp, Artificial Sequence
  Synthetic DNA
tactatgactcactatag

SEQ ID NO: 1266 - DNA, 18 bp, Artificial Sequence
  Synthetic DNA
taatacgactcgttatag

SEQ ID NO: 1267 - DNA, 18 bp, Artificial Sequence
  Synthetic DNA
ttatacgacttactatag

SEQ ID NO: 1268 - DNA, 18 bp, Artificial Sequence
  Synthetic DNA
taagacgacccactatag

SEQ ID NO: 1269 - DNA, 18 bp, Artificial Sequence
  Synthetic DNA
taagacgactgactatag

SEQ ID NO: 1270 - DNA, 18 bp, Artificial Sequence
  Synthetic DNA
taataccattcactatag

SEQ ID NO: 1271 - DNA, 18 bp, Artificial Sequence
  Synthetic DNA
caatacgactgactatag

SEQ ID NO: 1272 - DNA, 18 bp, Artificial Sequence
  Synthetic DNA
gaatacgactcaatatag

SEQ ID NO: 1273 - DNA, 18 bp, Artificial Sequence
  Synthetic DNA
taacacgacccactatag

SEQ ID NO: 1274 - DNA, 18 bp, Artificial Sequence
  Synthetic DNA
tactacgactcaatatag

SEQ ID NO: 1275 - DNA, 18 bp, Artificial Sequence
  Synthetic DNA
tactacgacccactatag

SEQ ID NO: 1276 - DNA, 18 bp, Artificial Sequence
  Synthetic DNA
taagaagactcactatag

SEQ ID NO: 1277 - DNA, 18 bp, Artificial Sequence
  Synthetic DNA
tagtacgactcacgatag

SEQ ID NO: 1278 - DNA, 18 bp, Artificial Sequence
  Synthetic DNA
tgatacgactcattatag

SEQ ID NO: 1279 - DNA, 18 bp, Artificial Sequence
  Synthetic DNA
taatcccactcactatag

SEQ ID NO: 1280 - DNA, 18 bp, Artificial Sequence
  Synthetic DNA
taatacggcttactatag

SEQ ID NO: 1281 - DNA, 18 bp, Artificial Sequence
  Synthetic DNA
taataggactcattatag

SEQ ID NO: 1282 - DNA, 18 bp, Artificial Sequence
  Synthetic DNA
tcatacgagtcactatag

SEQ ID NO: 1283 - DNA, 18 bp, Artificial Sequence
  Synthetic DNA
taagacgactcactattg

SEQ ID NO: 1284 - DNA, 18 bp, Artificial Sequence
  Synthetic DNA
taacacgactcactagag

SEQ ID NO: 1285 - DNA, 18 bp, Artificial Sequence
  Synthetic DNA
taataccacgcactatag

SEQ ID NO: 1286 - DNA, 18 bp, Artificial Sequence
  Synthetic DNA
taatacgacgcaatatag

SEQ ID NO: 1287 - DNA, 18 bp, Artificial Sequence
  Synthetic DNA
taatacgactccatatag

SEQ ID NO: 1288 - DNA, 18 bp, Artificial Sequence
  Synthetic DNA
gaatacgaatcactatag

SEQ ID NO: 1289 - DNA, 18 bp, Artificial Sequence
  Synthetic DNA
taagatgactcactatag

SEQ ID NO: 1290 - DNA, 18 bp, Artificial Sequence
  Synthetic DNA
tagtacgactcaatatag

SEQ ID NO: 1291 - DNA, 18 bp, Artificial Sequence
  Synthetic DNA
taataccactgactatag

SEQ ID NO: 1292 - DNA, 18 bp, Artificial Sequence
  Synthetic DNA
taatacgagtccctatag

SEQ ID NO: 1293 - DNA, 18 bp, Artificial Sequence
  Synthetic DNA
taatacgactgactacag

SEQ ID NO: 1294 - DNA, 18 bp, Artificial Sequence
  Synthetic DNA
taatacgattcacgatag

SEQ ID NO: 1295 - DNA, 18 bp, Artificial Sequence
  Synthetic DNA
tactacgagtcactatag

SEQ ID NO: 1296 - DNA, 18 bp, Artificial Sequence
  Synthetic DNA
taatatggctcactatag

SEQ ID NO: 1297 - DNA, 18 bp, Artificial Sequence
  Synthetic DNA
taatacgagccactacag

SEQ ID NO: 1298 - DNA, 18 bp, Artificial Sequence
  Synthetic DNA
taatgcgactcgctatcg

SEQ ID NO: 1299 - DNA, 18 bp, Artificial Sequence
  Synthetic DNA
ttatacgactcactatca

SEQ ID NO: 1300 - DNA, 18 bp, Artificial Sequence
  Synthetic DNA
taatacgactcgctatct

SEQ ID NO: 1301 - DNA, 18 bp, Artificial Sequence
  Synthetic DNA
taattcgactcgctattg

SEQ ID NO: 1302 - DNA, 18 bp, Artificial Sequence
  Synthetic DNA
taattcgactcactatct

SEQ ID NO: 1303 - DNA, 18 bp, Artificial Sequence
  Synthetic DNA
taattcgactcgctatcg

SEQ ID NO: 1304 - DNA, 18 bp, Artificial Sequence
  Synthetic DNA
taataggactcgctagag

SEQ ID NO: 1305 - DNA, 18 bp, Artificial Sequence
  Synthetic DNA
taatacgactcgctactg

SEQ ID NO: 1306 - DNA, 18 bp, Artificial Sequence
  Synthetic DNA
gaatgcgactcactgtag

SEQ ID NO: 1307 - DNA, 18 bp, Artificial Sequence
  Synthetic DNA
ttatacgactcgctatcg

SEQ ID NO: 1308 - DNA, 18 bp, Artificial Sequence
  Synthetic DNA
caaaacgactcactatat

SEQ ID NO: 1309 - DNA, 18 bp, Artificial Sequence
  Synthetic DNA
taatacgactcgctatcc

SEQ ID NO: 1310 - DNA, 18 bp, Artificial Sequence
  Synthetic DNA
taattcgactcgctacag

SEQ ID NO: 1311 - DNA, 18 bp, Artificial Sequence
  Synthetic DNA
taattcgactcactactg

SEQ ID NO: 1312 - DNA, 18 bp, Artificial Sequence
  Synthetic DNA
taattcgactcgctaaag

SEQ ID NO: 1313 - DNA, 18 bp, Artificial Sequence
  Synthetic DNA
taatccgactcgctatcg

SEQ ID NO: 1314 - DNA, 18 bp, Artificial Sequence
  Synthetic DNA
ttatacgactcgctattg

SEQ ID NO: 1315 - DNA, 18 bp, Artificial Sequence
  Synthetic DNA
tagtacgcttcactatag

SEQ ID NO: 1316 - DNA, 18 bp, Artificial Sequence
  Synthetic DNA
taaaacgactcgctatat

SEQ ID NO: 1317 - DNA, 18 bp, Artificial Sequence
  Synthetic DNA
caatacggcgcactatag

SEQ ID NO: 1318 - DNA, 18 bp, Artificial Sequence
  Synthetic DNA
taatgcgcctcactgtag

SEQ ID NO: 1319 - DNA, 18 bp, Artificial Sequence
  Synthetic DNA
taattcgacgcactattg

SEQ ID NO: 1320 - DNA, 18 bp, Artificial Sequence
  Synthetic DNA
taatgcgactcgctattg

SEQ ID NO: 1321 - DNA, 18 bp, Artificial Sequence
  Synthetic DNA
taatacgacgcactaccg

SEQ ID NO: 1322 - DNA, 18 bp, Artificial Sequence
  Synthetic DNA
taaaacgactcgctattg

SEQ ID NO: 1323 - DNA, 18 bp, Artificial Sequence
  Synthetic DNA
taatacgactcacgccag

SEQ ID NO: 1324 - DNA, 18 bp, Artificial Sequence
  Synthetic DNA
taatagaactcactgtag

SEQ ID NO: 1325 - DNA, 18 bp, Artificial Sequence
  Synthetic DNA
tgattcgactcactatcg

SEQ ID NO: 1326 - DNA, 18 bp, Artificial Sequence
  Synthetic DNA
taattcggctcactatcg

SEQ ID NO: 1327 - DNA, 18 bp, Artificial Sequence
  Synthetic DNA
taattcgactcactaccg

SEQ ID NO: 1328 - DNA, 18 bp, Artificial Sequence
  Synthetic DNA
ttatgcgactcactgtag

SEQ ID NO: 1329 - DNA, 18 bp, Artificial Sequence
  Synthetic DNA
taataggactcactttgg

SEQ ID NO: 1330 - DNA, 18 bp, Artificial Sequence
  Synthetic DNA
taatgcgactcactgttg

SEQ ID NO: 1331 - DNA, 18 bp, Artificial Sequence
  Synthetic DNA
taatgcgactcactactg

SEQ ID NO: 1332 - DNA, 18 bp, Artificial Sequence
  Synthetic DNA
taatgcgactcactaccg

SEQ ID NO: 1333 - DNA, 18 bp, Artificial Sequence
  Synthetic DNA
taatgcgactcactgaag

SEQ ID NO: 1334 - DNA, 18 bp, Artificial Sequence
  Synthetic DNA
taatgcgcctcactaaag

SEQ ID NO: 1335 - DNA, 18 bp, Artificial Sequence
  Synthetic DNA
aaataggactcactagag

SEQ ID NO: 1336 - DNA, 18 bp, Artificial Sequence
  Synthetic DNA
taacgcgactcactgtag

SEQ ID NO: 1337 - DNA, 18 bp, Artificial Sequence
  Synthetic DNA
taattggactcactagag

SEQ ID NO: 1338 - DNA, 18 bp, Artificial Sequence
  Synthetic DNA
tagtgcaactcactatag

SEQ ID NO: 1339 - DNA, 18 bp, Artificial Sequence
  Synthetic DNA
taataggactcgctatgg

SEQ ID NO: 1340 - DNA, 18 bp, Artificial Sequence
  Synthetic DNA
gaattcgactcaccatag

SEQ ID NO: 1341 - DNA, 18 bp, Artificial Sequence
  Synthetic DNA
taatacgcctcactatct

SEQ ID NO: 1342 - DNA, 18 bp, Artificial Sequence
  Synthetic DNA
taataggactcactttac

SEQ ID NO: 1343 - DNA, 18 bp, Artificial Sequence
  Synthetic DNA
tagtacgacgcactaaag

SEQ ID NO: 1344 - DNA, 18 bp, Artificial Sequence
  Synthetic DNA
tattgcgactcactataa

SEQ ID NO: 1345 - DNA, 18 bp, Artificial Sequence
  Synthetic DNA
tgatacgactcgctatcg

SEQ ID NO: 1346 - DNA, 18 bp, Artificial Sequence
  Synthetic DNA
taattcgactcaccacag

SEQ ID NO: 1347 - DNA, 18 bp, Artificial Sequence
  Synthetic DNA
taatgcgactcaccattg

SEQ ID NO: 1348 - DNA, 18 bp, Artificial Sequence
  Synthetic DNA
taattcgactcaccattg

SEQ ID NO: 1349 - DNA, 18 bp, Artificial Sequence
  Synthetic DNA
taatacaactcgctatcg

SEQ ID NO: 1350 - DNA, 18 bp, Artificial Sequence
  Synthetic DNA
taattcggctcaccatag

SEQ ID NO: 1351 - DNA, 18 bp, Artificial Sequence
  Synthetic DNA
taattcgactcgccatag

SEQ ID NO: 1352 - DNA, 18 bp, Artificial Sequence
  Synthetic DNA
tattacgactcgctatcg

SEQ ID NO: 1353 - DNA, 18 bp, Artificial Sequence
  Synthetic DNA
taattcgactcacactag

SEQ ID NO: 1354 - DNA, 18 bp, Artificial Sequence
  Synthetic DNA
taattcggctcactattg

SEQ ID NO: 1355 - DNA, 18 bp, Artificial Sequence
  Synthetic DNA
taatgcgtctcactaaag

SEQ ID NO: 1356 - DNA, 18 bp, Artificial Sequence
  Synthetic DNA
taattcgacgcactatcg

SEQ ID NO: 1357 - DNA, 18 bp, Artificial Sequence
  Synthetic DNA
gattacgactcagtatag

SEQ ID NO: 1358 - DNA, 18 bp, Artificial Sequence
  Synthetic DNA
taatacgaatcgctatcg

SEQ ID NO: 1359 - DNA, 18 bp, Artificial Sequence
  Synthetic DNA
taatacgactcagtctgg

SEQ ID NO: 1360 - DNA, 18 bp, Artificial Sequence
  Synthetic DNA
taatgcgactcactaaat

SEQ ID NO: 1361 - DNA, 18 bp, Artificial Sequence
  Synthetic DNA
tagtacgacgcactattg

SEQ ID NO: 1362 - DNA, 18 bp, Artificial Sequence
  Synthetic DNA
ttatgcgcctcactatag

SEQ ID NO: 1363 - DNA, 18 bp, Artificial Sequence
  Synthetic DNA
taatccaactcacgatag

SEQ ID NO: 1364 - DNA, 18 bp, Artificial Sequence
  Synthetic DNA
taatacggctcacttcag

SEQ ID NO: 1365 - DNA, 18 bp, Artificial Sequence
  Synthetic DNA
ttatgcgactcactaaag

SEQ ID NO: 1366 - DNA, 18 bp, Artificial Sequence
  Synthetic DNA
taaaacggcccactatag

SEQ ID NO: 1367 - DNA, 18 bp, Artificial Sequence
  Synthetic DNA
taataagactcgctattg

SEQ ID NO: 1368 - DNA, 18 bp, Artificial Sequence
  Synthetic DNA
taattagactcactaaag

SEQ ID NO: 1369 - DNA, 18 bp, Artificial Sequence
  Synthetic DNA
gaataagactcactacag

SEQ ID NO: 1370 - DNA, 18 bp, Artificial Sequence
  Synthetic DNA
taatacgactcgctaccg

SEQ ID NO: 1371 - DNA, 18 bp, Artificial Sequence
  Synthetic DNA
taattcgtctcgctatag

SEQ ID NO: 1372 - DNA, 18 bp, Artificial Sequence
  Synthetic DNA
taataggactcactctcg

SEQ ID NO: 1373 - DNA, 18 bp, Artificial Sequence
  Synthetic DNA
taaagcgactcactacag

SEQ ID NO: 1374 - DNA, 18 bp, Artificial Sequence
  Synthetic DNA
taatgcgactcgctacag

SEQ ID NO: 1375 - DNA, 18 bp, Artificial Sequence
  Synthetic DNA
taataggactcactctgg

SEQ ID NO: 1376 - DNA, 18 bp, Artificial Sequence
  Synthetic DNA
caatccgactcactgtag

SEQ ID NO: 1377 - DNA, 18 bp, Artificial Sequence
  Synthetic DNA
ttatgcgactcactatcg

SEQ ID NO: 1378 - DNA, 18 bp, Artificial Sequence
  Synthetic DNA
taaaacgactcgctatcg

SEQ ID NO: 1379 - DNA, 18 bp, Artificial Sequence
  Synthetic DNA
taatacgcctcaccaaag

SEQ ID NO: 1380 - DNA, 18 bp, Artificial Sequence
  Synthetic DNA
taatcaggctcactatag

SEQ ID NO: 1381 - DNA, 18 bp, Artificial Sequence
  Synthetic DNA
ttatgcgactcaccatag

SEQ ID NO: 1382 - DNA, 18 bp, Artificial Sequence
  Synthetic DNA
ttattcgactcgctatag

SEQ ID NO: 1383 - DNA, 18 bp, Artificial Sequence
  Synthetic DNA
taatgcgactcactttcg

SEQ ID NO: 1384 - DNA, 18 bp, Artificial Sequence
  Synthetic DNA
gaatacgactcgctattg

SEQ ID NO: 1385 - DNA, 18 bp, Artificial Sequence
  Synthetic DNA
taatgcgactcactccag

SEQ ID NO: 1386 - DNA, 18 bp, Artificial Sequence
  Synthetic DNA
taatgcgactcactagtg

SEQ ID NO: 1387 - DNA, 18 bp, Artificial Sequence
  Synthetic DNA
taattcgcatcactatag

SEQ ID NO: 1388 - DNA, 18 bp, Artificial Sequence
  Synthetic DNA
tattacgcctcactacag

SEQ ID NO: 1389 - DNA, 18 bp, Artificial Sequence
  Synthetic DNA
tgatacgactcactgtgg

SEQ ID NO: 1390 - DNA, 18 bp, Artificial Sequence
  Synthetic DNA
aaatccgactcactagag

SEQ ID NO: 1391 - DNA, 18 bp, Artificial Sequence
  Synthetic DNA
tagtacgaccgactatag

SEQ ID NO: 1392 - DNA, 18 bp, Artificial Sequence
  Synthetic DNA
caatgcgactcactgtag

SEQ ID NO: 1393 - DNA, 18 bp, Artificial Sequence
  Synthetic DNA
taatatgagtcactagag

SEQ ID NO: 1394 - DNA, 18 bp, Artificial Sequence
  Synthetic DNA
taatgcgactcactagcg

SEQ ID NO: 1395 - DNA, 18 bp, Artificial Sequence
  Synthetic DNA
taatcagactcactagag

SEQ ID NO: 1396 - DNA, 18 bp, Artificial Sequence
  Synthetic DNA
taattcgtctcactatat

SEQ ID NO: 1397 - DNA, 18 bp, Artificial Sequence
  Synthetic DNA
gaattcgactcgctatag

SEQ ID NO: 1398 - DNA, 18 bp, Artificial Sequence
  Synthetic DNA
taaagcgactcactataa

SEQ ID NO: 1399 - DNA, 18 bp, Artificial Sequence
  Synthetic DNA
taataagactcacgacag

SEQ ID NO: 1400 - DNA, 18 bp, Artificial Sequence
  Synthetic DNA
taatacaactcactttat

SEQ ID NO: 1401 - DNA, 18 bp, Artificial Sequence
  Synthetic DNA
taatacgactcattatca

SEQ ID NO: 1402 - DNA, 18 bp, Artificial Sequence
  Synthetic DNA
taatacgactcgctattc

SEQ ID NO: 1403 - DNA, 18 bp, Artificial Sequence
  Synthetic DNA
taatacgactctctctaa

SEQ ID NO: 1404 - DNA, 18 bp, Artificial Sequence
  Synthetic DNA
taatatgactcactaaaa

SEQ ID NO: 1405 - DNA, 18 bp, Artificial Sequence
  Synthetic DNA
taatccgactcacgacag

SEQ ID NO: 1406 - DNA, 18 bp, Artificial Sequence
  Synthetic DNA
taatgcgactcactgtaa

SEQ ID NO: 1407 - DNA, 18 bp, Artificial Sequence
  Synthetic DNA
taatgcgactcactttaa

SEQ ID NO: 1408 - DNA, 18 bp, Artificial Sequence
  Synthetic DNA
taattggactcagtatag

SEQ ID NO: 1409 - DNA, 18 bp, Artificial Sequence
  Synthetic DNA
tagtacggcgcactatag

SEQ ID NO: 1410 - DNA, 18 bp, Artificial Sequence
  Synthetic DNA
tgatacgactcactatca

SEQ ID NO: 1411 - DNA, 18 bp, Artificial Sequence
  Synthetic DNA
taatgcgactcacttcag

SEQ ID NO: 1412 - DNA, 18 bp, Artificial Sequence
  Synthetic DNA
taaagcgactcactaaag

SEQ ID NO: 1413 - DNA, 18 bp, Artificial Sequence
  Synthetic DNA
caatgcgactcactctag

SEQ ID NO: 1414 - DNA, 18 bp, Artificial Sequence
  Synthetic DNA
taatataactcactctag

SEQ ID NO: 1415 - DNA, 18 bp, Artificial Sequence
  Synthetic DNA
taattcgactcgctagag

SEQ ID NO: 1416 - DNA, 18 bp, Artificial Sequence
  Synthetic DNA
taatgcgcctcactattg

SEQ ID NO: 1417 - DNA, 18 bp, Artificial Sequence
  Synthetic DNA
ttatgcgactcactttag

SEQ ID NO: 1418 - DNA, 18 bp, Artificial Sequence
  Synthetic DNA
aaatgcgactcactctag

SEQ ID NO: 1419 - DNA, 18 bp, Artificial Sequence
  Synthetic DNA
taatccgactcgctattg

SEQ ID NO: 1420 - DNA, 18 bp, Artificial Sequence
  Synthetic DNA
taataagactcgctatcg

SEQ ID NO: 1421 - DNA, 18 bp, Artificial Sequence
  Synthetic DNA
taatacaactcgctacag

SEQ ID NO: 1422 - DNA, 18 bp, Artificial Sequence
  Synthetic DNA
taattcgactcgctctag

SEQ ID NO: 1423 - DNA, 18 bp, Artificial Sequence
  Synthetic DNA
tactacgactctctatgg

SEQ ID NO: 1424 - DNA, 18 bp, Artificial Sequence
  Synthetic DNA
taattcgactcgctttag

SEQ ID NO: 1425 - DNA, 18 bp, Artificial Sequence
  Synthetic DNA
caatacgactcactcttg

SEQ ID NO: 1426 - DNA, 18 bp, Artificial Sequence
  Synthetic DNA
taatacgactcgccatcg

SEQ ID NO: 1427 - DNA, 18 bp, Artificial Sequence
  Synthetic DNA
ttatacgactcgctacag

SEQ ID NO: 1428 - DNA, 18 bp, Artificial Sequence
  Synthetic DNA
tattaggactcactctag

SEQ ID NO: 1429 - DNA, 18 bp, Artificial Sequence
  Synthetic DNA
gaatatgacccactatag

SEQ ID NO: 1430 - DNA, 18 bp, Artificial Sequence
  Synthetic DNA
ttatccgactcgctatag

SEQ ID NO: 1431 - DNA, 18 bp, Artificial Sequence
  Synthetic DNA
aaataggactcactctag

SEQ ID NO: 1432 - DNA, 18 bp, Artificial Sequence
  Synthetic DNA
tattgcgactcactagag

SEQ ID NO: 1433 - DNA, 18 bp, Artificial Sequence
  Synthetic DNA
ttatacgcctcactagag

SEQ ID NO: 1434 - DNA, 18 bp, Artificial Sequence
  Synthetic DNA
taaaatgactcacgatag

SEQ ID NO: 1435 - DNA, 18 bp, Artificial Sequence
  Synthetic DNA
ctatacgactcgctatag

SEQ ID NO: 1436 - DNA, 18 bp, Artificial Sequence
  Synthetic DNA
taaagcgactcactatgg

SEQ ID NO: 1437 - DNA, 18 bp, Artificial Sequence
  Synthetic DNA
caaaacgactcactgtag

SEQ ID NO: 1438 - DNA, 18 bp, Artificial Sequence
  Synthetic DNA
ttaagcgactcactatag

SEQ ID NO: 1439 - DNA, 18 bp, Artificial Sequence
  Synthetic DNA
taatgcgcctcactctag

SEQ ID NO: 1440 - DNA, 18 bp, Artificial Sequence
  Synthetic DNA
taattcgactcactccag

SEQ ID NO: 1441 - DNA, 18 bp, Artificial Sequence
  Synthetic DNA
taattcgactcactatca

SEQ ID NO: 1442 - DNA, 18 bp, Artificial Sequence
  Synthetic DNA
caatagaactcactatag

SEQ ID NO: 1443 - DNA, 18 bp, Artificial Sequence
  Synthetic DNA
cgatacgacccactatag

SEQ ID NO: 1444 - DNA, 18 bp, Artificial Sequence
  Synthetic DNA
taataggactcactttaa

SEQ ID NO: 1445 - DNA, 18 bp, Artificial Sequence
  Synthetic DNA
taatacgtctcgctatcg

SEQ ID NO: 1446 - DNA, 18 bp, Artificial Sequence
  Synthetic DNA
ttatgcgactcactctag

SEQ ID NO: 1447 - DNA, 18 bp, Artificial Sequence
  Synthetic DNA
ttataggacgcactatag

SEQ ID NO: 1448 - DNA, 18 bp, Artificial Sequence
  Synthetic DNA
tattacgactcgctattg

SEQ ID NO: 1449 - DNA, 18 bp, Artificial Sequence
  Synthetic DNA
taataggactcacgattg

SEQ ID NO: 1450 - DNA, 18 bp, Artificial Sequence
  Synthetic DNA
ttatacgactcactaccg

SEQ ID NO: 1451 - DNA, 18 bp, Artificial Sequence
  Synthetic DNA
taaaacgactcactctgg

SEQ ID NO: 1452 - DNA, 18 bp, Artificial Sequence
  Synthetic DNA
taataggactcaccctag

SEQ ID NO: 1453 - DNA, 18 bp, Artificial Sequence
  Synthetic DNA
taatttgactcactgtag

SEQ ID NO: 1454 - DNA, 18 bp, Artificial Sequence
  Synthetic DNA
gaaaacgactcactgtag

SEQ ID NO: 1455 - DNA, 18 bp, Artificial Sequence
  Synthetic DNA
taatacgcctcgctattg

SEQ ID NO: 1456 - DNA, 18 bp, Artificial Sequence
  Synthetic DNA
caattcgactcgctatag

SEQ ID NO: 1457 - DNA, 18 bp, Artificial Sequence
  Synthetic DNA
taaaacgactcgccatag

SEQ ID NO: 1458 - DNA, 18 bp, Artificial Sequence
  Synthetic DNA
taatgcgactcgctaaag

SEQ ID NO: 1459 - DNA, 18 bp, Artificial Sequence
  Synthetic DNA
taaaaggactcacgatag

SEQ ID NO: 1460 - DNA, 18 bp, Artificial Sequence
  Synthetic DNA
taataggactcgctatcg

SEQ ID NO: 1461 - DNA, 18 bp, Artificial Sequence
  Synthetic DNA
taatgcgactcactaatg

SEQ ID NO: 1462 - DNA, 18 bp, Artificial Sequence
  Synthetic DNA
taatgtgactcgctatag

SEQ ID NO: 1463 - DNA, 18 bp, Artificial Sequence
  Synthetic DNA
taaaacgactcactgttg

SEQ ID NO: 1464 - DNA, 18 bp, Artificial Sequence
  Synthetic DNA
tgataggactcactgtag

SEQ ID NO: 1465 - DNA, 18 bp, Artificial Sequence
  Synthetic DNA
caatacgactcgctattg

SEQ ID NO: 1466 - DNA, 18 bp, Artificial Sequence
  Synthetic DNA
ttattcgactcactatcg

SEQ ID NO: 1467 - DNA, 18 bp, Artificial Sequence
  Synthetic DNA
taatacaactcacggtag

SEQ ID NO: 1468 - DNA, 18 bp, Artificial Sequence
  Synthetic DNA
taatgagactcactctag

SEQ ID NO: 1469 - DNA, 18 bp, Artificial Sequence
  Synthetic DNA
taattcgacgcgctatag

SEQ ID NO: 1470 - DNA, 18 bp, Artificial Sequence
  Synthetic DNA
aaatgcgactcacgatag

SEQ ID NO: 1471 - DNA, 18 bp, Artificial Sequence
  Synthetic DNA
taatacgactcgccacag

SEQ ID NO: 1472 - DNA, 18 bp, Artificial Sequence
  Synthetic DNA
taatgcgcctcacaatag

SEQ ID NO: 1473 - DNA, 18 bp, Artificial Sequence
  Synthetic DNA
tatttcgactcgctatag

SEQ ID NO: 1474 - DNA, 18 bp, Artificial Sequence
  Synthetic DNA
caatacgactcacactag

SEQ ID NO: 1475 - DNA, 18 bp, Artificial Sequence
  Synthetic DNA
aaataggactcactttag

SEQ ID NO: 1476 - DNA, 18 bp, Artificial Sequence
  Synthetic DNA
taatacgactcaccaccg

SEQ ID NO: 1477 - DNA, 18 bp, Artificial Sequence
  Synthetic DNA
aaatgcgcctcactatag

SEQ ID NO: 1478 - DNA, 18 bp, Artificial Sequence
  Synthetic DNA
taaatcgactcgctatag

SEQ ID NO: 1479 - DNA, 18 bp, Artificial Sequence
  Synthetic DNA
tgatactactcactctag

SEQ ID NO: 1480 - DNA, 18 bp, Artificial Sequence
  Synthetic DNA
taatgcaactcactacag

SEQ ID NO: 1481 - DNA, 18 bp, Artificial Sequence
  Synthetic DNA
taatatgactcgctatcg

SEQ ID NO: 1482 - DNA, 18 bp, Artificial Sequence
  Synthetic DNA
tgattcgactcgctatag

SEQ ID NO: 1483 - DNA, 18 bp, Artificial Sequence
  Synthetic DNA
taattcgtctcactatcg

SEQ ID NO: 1484 - DNA, 18 bp, Artificial Sequence
  Synthetic DNA
taataggactcactgaag

SEQ ID NO: 1485 - DNA, 18 bp, Artificial Sequence
  Synthetic DNA
ttatacgactcactccag

SEQ ID NO: 1486 - DNA, 18 bp, Artificial Sequence
  Synthetic DNA
taattcgtctcactattg

SEQ ID NO: 1487 - DNA, 18 bp, Artificial Sequence
  Synthetic DNA
caataagactcactctag

SEQ ID NO: 1488 - DNA, 18 bp, Artificial Sequence
  Synthetic DNA
taatacaactcaccatcg

SEQ ID NO: 1489 - DNA, 18 bp, Artificial Sequence
  Synthetic DNA
ttatgcgactcgctatag

SEQ ID NO: 1490 - DNA, 18 bp, Artificial Sequence
  Synthetic DNA
tgatgcgactcactttag

SEQ ID NO: 1491 - DNA, 18 bp, Artificial Sequence
  Synthetic DNA
caatgcgactcactttag

SEQ ID NO: 1492 - DNA, 18 bp, Artificial Sequence
  Synthetic DNA
taatgcgactcagtaaag

SEQ ID NO: 1493 - DNA, 18 bp, Artificial Sequence
  Synthetic DNA
ttatacgcctcactaaag

SEQ ID NO: 1494 - DNA, 18 bp, Artificial Sequence
  Synthetic DNA
taaaacgactcacgaaag

SEQ ID NO: 1495 - DNA, 18 bp, Artificial Sequence
  Synthetic DNA
taattcggctcactacag

SEQ ID NO: 1496 - DNA, 18 bp, Artificial Sequence
  Synthetic DNA
taatacgactcgatatcg

SEQ ID NO: 1497 - DNA, 18 bp, Artificial Sequence
  Synthetic DNA
taatacgactcgccattg

SEQ ID NO: 1498 - DNA, 18 bp, Artificial Sequence
  Synthetic DNA
taatccgactcaccctag

SEQ ID NO: 1499 - DNA, 18 bp, Artificial Sequence
  Synthetic DNA
taataggactcactccag

SEQ ID NO: 1500 - DNA, 18 bp, Artificial Sequence
  Synthetic DNA
tgataggactcactctag

SEQ ID NO: 1501 - DNA, 18 bp, Artificial Sequence
  Synthetic DNA
taatgcgcctcactacag

SEQ ID NO: 1502 - DNA, 18 bp, Artificial Sequence
  Synthetic DNA
taatacgactcttcatag

SEQ ID NO: 1503 - DNA, 18 bp, Artificial Sequence
  Synthetic DNA
taatgggactcactaaag

SEQ ID NO: 1504 - DNA, 18 bp, Artificial Sequence
  Synthetic DNA
tattgcgactcactattg

SEQ ID NO: 1505 - DNA, 18 bp, Artificial Sequence
  Synthetic DNA
tattgcgactcactaaag

SEQ ID NO: 1506 - DNA, 18 bp, Artificial Sequence
  Synthetic DNA
aaattcgactcgctatag

SEQ ID NO: 1507 - DNA, 18 bp, Artificial Sequence
  Synthetic DNA
ttagacgactcactacag

SEQ ID NO: 1508 - DNA, 18 bp, Artificial Sequence
  Synthetic DNA
tgatgcgactcactaaag

SEQ ID NO: 1509 - DNA, 18 bp, Artificial Sequence
  Synthetic DNA
ttatacgactcgccatag

SEQ ID NO: 1510 - DNA, 18 bp, Artificial Sequence
  Synthetic DNA
aaataagactcactagag

SEQ ID NO: 1511 - DNA, 18 bp, Artificial Sequence
  Synthetic DNA
ttaaacgcctcactatag

SEQ ID NO: 1512 - DNA, 18 bp, Artificial Sequence
  Synthetic DNA
tattgcgtctcactatag

SEQ ID NO: 1513 - DNA, 18 bp, Artificial Sequence
  Synthetic DNA
tattaggactcactacag

SEQ ID NO: 1514 - DNA, 18 bp, Artificial Sequence
  Synthetic DNA
taaagcggctcactatag

SEQ ID NO: 1515 - DNA, 18 bp, Artificial Sequence
  Synthetic DNA
taatgcgactcaccatcg

SEQ ID NO: 1516 - DNA, 18 bp, Artificial Sequence
  Synthetic DNA
taatacgactcagtaacg

SEQ ID NO: 1517 - DNA, 18 bp, Artificial Sequence
  Synthetic DNA
aaatgcgactcactatcg

SEQ ID NO: 1518 - DNA, 18 bp, Artificial Sequence
  Synthetic DNA
caatacggctcactatcg

SEQ ID NO: 1519 - DNA, 18 bp, Artificial Sequence
  Synthetic DNA
gaatgcgactcactaaag

SEQ ID NO: 1520 - DNA, 18 bp, Artificial Sequence
  Synthetic DNA
taatgcgtctcactttag

SEQ ID NO: 1521 - DNA, 18 bp, Artificial Sequence
  Synthetic DNA
ttatgcgactcactacag

SEQ ID NO: 1522 - DNA, 18 bp, Artificial Sequence
  Synthetic DNA
tgatacgactcacttgag

SEQ ID NO: 1523 - DNA, 18 bp, Artificial Sequence
  Synthetic DNA
taattcgactcaccatcg

SEQ ID NO: 1524 - DNA, 18 bp, Artificial Sequence
  Synthetic DNA
taatacaactcgccatag

SEQ ID NO: 1525 - DNA, 18 bp, Artificial Sequence
  Synthetic DNA
taataggactcgctctag

SEQ ID NO: 1526 - DNA, 18 bp, Artificial Sequence
  Synthetic DNA
taaggcgactcactaaag

SEQ ID NO: 1527 - DNA, 18 bp, Artificial Sequence
  Synthetic DNA
taatacgcatcactatgg

SEQ ID NO: 1528 - DNA, 18 bp, Artificial Sequence
  Synthetic DNA
taatagcactcactctag

SEQ ID NO: 1529 - DNA, 18 bp, Artificial Sequence
  Synthetic DNA
taatacgacttgctatcg

SEQ ID NO: 1530 - DNA, 18 bp, Artificial Sequence
  Synthetic DNA
taatgcgcgtcactatag

SEQ ID NO: 1531 - DNA, 18 bp, Artificial Sequence
  Synthetic DNA
taatacgtctcactaaaa

SEQ ID NO: 1532 - DNA, 18 bp, Artificial Sequence
  Synthetic DNA
caataggactcaccatag

SEQ ID NO: 1533 - DNA, 18 bp, Artificial Sequence
  Synthetic DNA
taatagggctcactatcg

SEQ ID NO: 1534 - DNA, 18 bp, Artificial Sequence
  Synthetic DNA
taatgcgtctcactatat

SEQ ID NO: 1535 - DNA, 18 bp, Artificial Sequence
  Synthetic DNA
tattacgtctcactataa

SEQ ID NO: 1536 - DNA, 18 bp, Artificial Sequence
  Synthetic DNA
caatacgactcacaatac

SEQ ID NO: 1537 - DNA, 18 bp, Artificial Sequence
  Synthetic DNA
taatacaactcactatca

SEQ ID NO: 1538 - DNA, 18 bp, Artificial Sequence
  Synthetic DNA
taatacgactcaccacat

SEQ ID NO: 1539 - DNA, 18 bp, Artificial Sequence
  Synthetic DNA
taatacgactcagtgttg

SEQ ID NO: 1540 - DNA, 18 bp, Artificial Sequence
  Synthetic DNA
taatacgactggctatcg

SEQ ID NO: 1541 - DNA, 18 bp, Artificial Sequence
  Synthetic DNA
taatatgactcacgatcg

SEQ ID NO: 1542 - DNA, 18 bp, Artificial Sequence
  Synthetic DNA
taatgcgactcactacat

SEQ ID NO: 1543 - DNA, 18 bp, Artificial Sequence
  Synthetic DNA
taatgcgactcagtctag

SEQ ID NO: 1544 - DNA, 18 bp, Artificial Sequence
  Synthetic DNA
tactacgaggcactatag

SEQ ID NO: 1545 - DNA, 18 bp, Artificial Sequence
  Synthetic DNA
tgatccgacgcactatag

SEQ ID NO: 1546 - DNA, 18 bp, Artificial Sequence
  Synthetic DNA
ttatacgactcaccatac

SEQ ID NO: 1547 - DNA, 18 bp, Artificial Sequence
  Synthetic DNA
ttataggactcactataa

SEQ ID NO: 1548 - DNA, 18 bp, Artificial Sequence
  Synthetic DNA
aaatacgactcactagaa

SEQ ID NO: 1549 - DNA, 18 bp, Artificial Sequence
  Synthetic DNA
caatacgactcacgctag

SEQ ID NO: 1550 - DNA, 18 bp, Artificial Sequence
  Synthetic DNA
caatacgactcactaaat

SEQ ID NO: 1551 - DNA, 18 bp, Artificial Sequence
  Synthetic DNA
caatacgactcactacat

SEQ ID NO: 1552 - DNA, 18 bp, Artificial Sequence
  Synthetic DNA
caattcgactcactatat

SEQ ID NO: 1553 - DNA, 18 bp, Artificial Sequence
  Synthetic DNA
cactgcgactcactatag

SEQ ID NO: 1554 - DNA, 18 bp, Artificial Sequence
  Synthetic DNA
cagtacgactcactagag

SEQ ID NO: 1555 - DNA, 18 bp, Artificial Sequence
  Synthetic DNA
cattacgactcactataa

SEQ ID NO: 1556 - DNA, 18 bp, Artificial Sequence
  Synthetic DNA
gaagacgagtcactatag

SEQ ID NO: 1557 - DNA, 18 bp, Artificial Sequence
  Synthetic DNA
gaatacgacccaatatag

SEQ ID NO: 1558 - DNA, 18 bp, Artificial Sequence
  Synthetic DNA
gaatacgactcactaaaa

SEQ ID NO: 1559 - DNA, 18 bp, Artificial Sequence
  Synthetic DNA
gaatacgactcactgaag

SEQ ID NO: 1560 - DNA, 18 bp, Artificial Sequence
  Synthetic DNA
gaatacgactgaccatag

SEQ ID NO: 1561 - DNA, 18 bp, Artificial Sequence
  Synthetic DNA
gaatgcgactaactatag

SEQ ID NO: 1562 - DNA, 18 bp, Artificial Sequence
  Synthetic DNA
gaatgcgactcactttag

SEQ ID NO: 1563 - DNA, 18 bp, Artificial Sequence
  Synthetic DNA
gattacgcctcactatag

SEQ ID NO: 1564 - DNA, 18 bp, Artificial Sequence
  Synthetic DNA
taaaaagactcactataa

SEQ ID NO: 1565 - DNA, 18 bp, Artificial Sequence
  Synthetic DNA
taaaaagactcactatat

SEQ ID NO: 1566 - DNA, 18 bp, Artificial Sequence
  Synthetic DNA
taaaacgactcactacac

SEQ ID NO: 1567 - DNA, 18 bp, Artificial Sequence
  Synthetic DNA
taaaacgactcactttaa

SEQ ID NO: 1568 - DNA, 18 bp, Artificial Sequence
  Synthetic DNA
taaaccgactcactatac

SEQ ID NO: 1569 - DNA, 18 bp, Artificial Sequence
  Synthetic DNA
taacacgacgcactctag

SEQ ID NO: 1570 - DNA, 18 bp, Artificial Sequence
  Synthetic DNA
taacacgactcaatataa

SEQ ID NO: 1571 - DNA, 18 bp, Artificial Sequence
  Synthetic DNA
taacgcgactcactatat

SEQ ID NO: 1572 - DNA, 18 bp, Artificial Sequence
  Synthetic DNA
taagacgacccacgatag

SEQ ID NO: 1573 - DNA, 18 bp, Artificial Sequence
  Synthetic DNA
taagacgactcactatta

SEQ ID NO: 1574 - DNA, 18 bp, Artificial Sequence
  Synthetic DNA
taagacgactcactgtcg

SEQ ID NO: 1575 - DNA, 18 bp, Artificial Sequence
  Synthetic DNA
taagacgactcattagag

SEQ ID NO: 1576 - DNA, 18 bp, Artificial Sequence
  Synthetic DNA
taaggagactcactatag

SEQ ID NO: 1577 - DNA, 18 bp, Artificial Sequence
  Synthetic DNA
taataagactcactctac

SEQ ID NO: 1578 - DNA, 18 bp, Artificial Sequence
  Synthetic DNA
taataagacttactataa

SEQ ID NO: 1579 - DNA, 18 bp, Artificial Sequence
  Synthetic DNA
taataaggctcactataa

SEQ ID NO: 1580 - DNA, 18 bp, Artificial Sequence
  Synthetic DNA
taatacaactcacgatat

SEQ ID NO: 1581 - DNA, 18 bp, Artificial Sequence
  Synthetic DNA
taatacaactcactatct

SEQ ID NO: 1582 - DNA, 18 bp, Artificial Sequence
  Synthetic DNA
taatacaactcactctaa

SEQ ID NO: 1583 - DNA, 18 bp, Artificial Sequence
  Synthetic DNA
taataccactcgccatag

SEQ ID NO: 1584 - DNA, 18 bp, Artificial Sequence
  Synthetic DNA
taataccattcactgtag

SEQ ID NO: 1585 - DNA, 18 bp, Artificial Sequence
  Synthetic DNA
taatacgaatcaatataa

SEQ ID NO: 1586 - DNA, 18 bp, Artificial Sequence
  Synthetic DNA
taatacgaatcagcatag

SEQ ID NO: 1587 - DNA, 18 bp, Artificial Sequence
  Synthetic DNA
taatacgacacaatatac

SEQ ID NO: 1588 - DNA, 18 bp, Artificial Sequence
  Synthetic DNA
taatacgacacactacat

SEQ ID NO: 1589 - DNA, 18 bp, Artificial Sequence
  Synthetic DNA
taatacgacacactatga

SEQ ID NO: 1590 - DNA, 18 bp, Artificial Sequence
  Synthetic DNA
taatacgacacactttaa

SEQ ID NO: 1591 - DNA, 18 bp, Artificial Sequence
  Synthetic DNA
taatacgacagactatac

SEQ ID NO: 1592 - DNA, 18 bp, Artificial Sequence
  Synthetic DNA
taatacgacgaaccatag

SEQ ID NO: 1593 - DNA, 18 bp, Artificial Sequence
  Synthetic DNA
taatacgacgcactgtcg

SEQ ID NO: 1594 - DNA, 18 bp, Artificial Sequence
  Synthetic DNA
taatacgacgcgctatcg

SEQ ID NO: 1595 - DNA, 18 bp, Artificial Sequence
  Synthetic DNA
taatacgactcaagagag

SEQ ID NO: 1596 - DNA, 18 bp, Artificial Sequence
  Synthetic DNA
taatacgactcaccacac

SEQ ID NO: 1597 - DNA, 18 bp, Artificial Sequence
  Synthetic DNA
taatacgactcaccatct

SEQ ID NO: 1598 - DNA, 18 bp, Artificial Sequence
  Synthetic DNA
taatacgactcacgaacg

SEQ ID NO: 1599 - DNA, 18 bp, Artificial Sequence
  Synthetic DNA
taatacgactcactccaa

SEQ ID NO: 1600 - DNA, 18 bp, Artificial Sequence
  Synthetic DNA
taatacgactcactcgcg

SEQ ID NO: 1601 - DNA, 18 bp, Artificial Sequence
  Synthetic DNA
taatacgactcactctga

SEQ ID NO: 1602 - DNA, 18 bp, Artificial Sequence
  Synthetic DNA
taatacgactcactctgc

SEQ ID NO: 1603 - DNA, 18 bp, Artificial Sequence
  Synthetic DNA
taatacgactcacttcaa

SEQ ID NO: 1604 - DNA, 18 bp, Artificial Sequence
  Synthetic DNA
taatacgactcagtatcc

SEQ ID NO: 1605 - DNA, 18 bp, Artificial Sequence
  Synthetic DNA
taatacgactccccataa

SEQ ID NO: 1606 - DNA, 18 bp, Artificial Sequence
  Synthetic DNA
taatacgactcccgataa

SEQ ID NO: 1607 - DNA, 18 bp, Artificial Sequence
  Synthetic DNA
taatacgactcccggtag

SEQ ID NO: 1608 - DNA, 18 bp, Artificial Sequence
  Synthetic DNA
taatacgactcgccatat

SEQ ID NO: 1609 - DNA, 18 bp, Artificial Sequence
  Synthetic DNA
taatacgactcgctatca

SEQ ID NO: 1610 - DNA, 18 bp, Artificial Sequence
  Synthetic DNA
taatacgactcgctgtac

SEQ ID NO: 1611 - DNA, 18 bp, Artificial Sequence
  Synthetic DNA
taatacgactcgggatag

SEQ ID NO: 1612 - DNA, 18 bp, Artificial Sequence
  Synthetic DNA
taatacgactctctacac

SEQ ID NO: 1613 - DNA, 18 bp, Artificial Sequence
  Synthetic DNA
taatacgactgactattc

SEQ ID NO: 1614 - DNA, 18 bp, Artificial Sequence
  Synthetic DNA
taatacgattcacgataa

SEQ ID NO: 1615 - DNA, 18 bp, Artificial Sequence
  Synthetic DNA
taatacgattcactatct

SEQ ID NO: 1616 - DNA, 18 bp, Artificial Sequence
  Synthetic DNA
taatacgcatcactataa

SEQ ID NO: 1617 - DNA, 18 bp, Artificial Sequence
  Synthetic DNA
taatacgcctcactaaac

SEQ ID NO: 1618 - DNA, 18 bp, Artificial Sequence
  Synthetic DNA
taatacgcctcactacat

SEQ ID NO: 1619 - DNA, 18 bp, Artificial Sequence
  Synthetic DNA
taatacgcctcactattc

SEQ ID NO: 1620 - DNA, 18 bp, Artificial Sequence
  Synthetic DNA
taatacgcctcactctat

SEQ ID NO: 1621 - DNA, 18 bp, Artificial Sequence
  Synthetic DNA
taatacgcctcgctataa

SEQ ID NO: 1622 - DNA, 18 bp, Artificial Sequence
  Synthetic DNA
taatacggctcactattt

SEQ ID NO: 1623 - DNA, 18 bp, Artificial Sequence
  Synthetic DNA
taatacgtcgcactgtag

SEQ ID NO: 1624 - DNA, 18 bp, Artificial Sequence
  Synthetic DNA
taatacgtggcactatag

SEQ ID NO: 1625 - DNA, 18 bp, Artificial Sequence
  Synthetic DNA
taatactactcagtataa

SEQ ID NO: 1626 - DNA, 18 bp, Artificial Sequence
  Synthetic DNA
taataggacgcgctatag

SEQ ID NO: 1627 - DNA, 18 bp, Artificial Sequence
  Synthetic DNA
taataggactcactagcg

SEQ ID NO: 1628 - DNA, 18 bp, Artificial Sequence
  Synthetic DNA
taataggtctcactatat

SEQ ID NO: 1629 - DNA, 18 bp, Artificial Sequence
  Synthetic DNA
taatatgactcacaatat

SEQ ID NO: 1630 - DNA, 18 bp, Artificial Sequence
  Synthetic DNA
taatatgcctcactataa

SEQ ID NO: 1631 - DNA, 18 bp, Artificial Sequence
  Synthetic DNA
taatatgcctcactatat

SEQ ID NO: 1632 - DNA, 18 bp, Artificial Sequence
  Synthetic DNA
taatccaactcactatac

SEQ ID NO: 1633 - DNA, 18 bp, Artificial Sequence
  Synthetic DNA
taatccgacacactataa

SEQ ID NO: 1634 - DNA, 18 bp, Artificial Sequence
  Synthetic DNA
taatccgactcacaatac

SEQ ID NO: 1635 - DNA, 18 bp, Artificial Sequence
  Synthetic DNA
taatccgactcactacat

SEQ ID NO: 1636 - DNA, 18 bp, Artificial Sequence
  Synthetic DNA
taatccgactcactagaa

SEQ ID NO: 1637 - DNA, 18 bp, Artificial Sequence
  Synthetic DNA
taatccgactcactatca

SEQ ID NO: 1638 - DNA, 18 bp, Artificial Sequence
  Synthetic DNA
taatccgactctctataa

SEQ ID NO: 1639 - DNA, 18 bp, Artificial Sequence
  Synthetic DNA
taatcggacttactatag

SEQ ID NO: 1640 - DNA, 18 bp, Artificial Sequence
  Synthetic DNA
taatgcgactcactctaa

SEQ ID NO: 1641 - DNA, 18 bp, Artificial Sequence
  Synthetic DNA
taatgcgactgactgtag

SEQ ID NO: 1642 - DNA, 18 bp, Artificial Sequence
  Synthetic DNA
taatgcgtctcactatac

SEQ ID NO: 1643 - DNA, 18 bp, Artificial Sequence
  Synthetic DNA
taatgctactcacgatag

SEQ ID NO: 1644 - DNA, 18 bp, Artificial Sequence
  Synthetic DNA
taattcgacccactataa

SEQ ID NO: 1645 - DNA, 18 bp, Artificial Sequence
  Synthetic DNA
taattcgactcactattt

SEQ ID NO: 1646 - DNA, 18 bp, Artificial Sequence
  Synthetic DNA
taattcgactcgctatac

SEQ ID NO: 1647 - DNA, 18 bp, Artificial Sequence
  Synthetic DNA
tactacgcctcgctatag

SEQ ID NO: 1648 - DNA, 18 bp, Artificial Sequence
  Synthetic DNA
tactactactcactataa

SEQ ID NO: 1649 - DNA, 18 bp, Artificial Sequence
  Synthetic DNA
tagtacgactcactgtac

SEQ ID NO: 1650 - DNA, 18 bp, Artificial Sequence
  Synthetic DNA
tagtacgactccccatag

SEQ ID NO: 1651 - DNA, 18 bp, Artificial Sequence
  Synthetic DNA
tagtaggactcactagag

SEQ ID NO: 1652 - DNA, 18 bp, Artificial Sequence
  Synthetic DNA
tagtgcgacccactatag

SEQ ID NO: 1653 - DNA, 18 bp, Artificial Sequence
  Synthetic DNA
tattacgactaactataa

SEQ ID NO: 1654 - DNA, 18 bp, Artificial Sequence
  Synthetic DNA
tattgcgactcactatac

SEQ ID NO: 1655 - DNA, 18 bp, Artificial Sequence
  Synthetic DNA
tatttcgactcactatac

SEQ ID NO: 1656 - DNA, 18 bp, Artificial Sequence
  Synthetic DNA
tcatacgacacactataa

SEQ ID NO: 1657 - DNA, 18 bp, Artificial Sequence
  Synthetic DNA
tcatacgacacactatac

SEQ ID NO: 1658 - DNA, 18 bp, Artificial Sequence
  Synthetic DNA
tcatacgactcactaaac

SEQ ID NO: 1659 - DNA, 18 bp, Artificial Sequence
  Synthetic DNA
tgatacgactcacaataa

SEQ ID NO: 1660 - DNA, 18 bp, Artificial Sequence
  Synthetic DNA
tgatacgactcatgatag

SEQ ID NO: 1661 - DNA, 18 bp, Artificial Sequence
  Synthetic DNA
tgttacgactcactatat

SEQ ID NO: 1662 - DNA, 18 bp, Artificial Sequence
  Synthetic DNA
ttatacgactccctataa

SEQ ID NO: 1663 - DNA, 18 bp, Artificial Sequence
  Synthetic DNA
ttatacgactcgctatat

SEQ ID NO: 1664 - DNA, 18 bp, Artificial Sequence
  Synthetic DNA
ttatacgactctctatac

SEQ ID NO: 1665 - DNA, 18 bp, Artificial Sequence
  Synthetic DNA
ttatacgcctcactataa

SEQ ID NO: 1666 - DNA, 18 bp, Artificial Sequence
  Synthetic DNA
ttatacggctcactatat

SEQ ID NO: 1667 - DNA, 18 bp, Artificial Sequence
  Synthetic DNA
ttatatgactcactatac

SEQ ID NO: 1668 - DNA, 18 bp, Artificial Sequence
  Synthetic DNA
ttattcgactcactatac

SEQ ID NO: 1669 - DNA, 18 bp, Artificial Sequence
  Synthetic DNA
taatgcgactcacttaag

SEQ ID NO: 1670 - DNA, 18 bp, Artificial Sequence
  Synthetic DNA
aaatacgactcgctattg

SEQ ID NO: 1671 - DNA, 18 bp, Artificial Sequence
  Synthetic DNA
taatagaactcactttag

SEQ ID NO: 1672 - DNA, 18 bp, Artificial Sequence
  Synthetic DNA
tattgcgactccctatag

SEQ ID NO: 1673 - DNA, 18 bp, Artificial Sequence
  Synthetic DNA
ttatgcgtctcactatag

SEQ ID NO: 1674 - DNA, 18 bp, Artificial Sequence
  Synthetic DNA
tcatacgactcgctattg

SEQ ID NO: 1675 - DNA, 18 bp, Artificial Sequence
  Synthetic DNA
taatacgactcgctttcg

SEQ ID NO: 1676 - DNA, 18 bp, Artificial Sequence
  Synthetic DNA
taatacgcatcactattg

SEQ ID NO: 1677 - DNA, 18 bp, Artificial Sequence
  Synthetic DNA
taatacggctcactactg

SEQ ID NO: 1678 - DNA, 18 bp, Artificial Sequence
  Synthetic DNA
taaagcgactcactctag

SEQ ID NO: 1679 - DNA, 18 bp, Artificial Sequence
  Synthetic DNA
taataagactcgccatag

SEQ ID NO: 1680 - DNA, 18 bp, Artificial Sequence
  Synthetic DNA
taatgcgactcacactag

SEQ ID NO: 1681 - DNA, 18 bp, Artificial Sequence
  Synthetic DNA
taataggactcagtctag

SEQ ID NO: 1682 - DNA, 18 bp, Artificial Sequence
  Synthetic DNA
taataggactcactcttg

SEQ ID NO: 1683 - DNA, 18 bp, Artificial Sequence
  Synthetic DNA
taaaacgcctcactatcg

SEQ ID NO: 1684 - DNA, 18 bp, Artificial Sequence
  Synthetic DNA
ctctacgactcactatag

SEQ ID NO: 1685 - DNA, 18 bp, Artificial Sequence
  Synthetic DNA
tattacgactcgctctag

SEQ ID NO: 1686 - DNA, 18 bp, Artificial Sequence
  Synthetic DNA
taatgcaactcactttag

SEQ ID NO: 1687 - DNA, 18 bp, Artificial Sequence
  Synthetic DNA
taatacgcgtcactctag

SEQ ID NO: 1688 - DNA, 18 bp, Artificial Sequence
  Synthetic DNA
taatacgtgtcactattg

SEQ ID NO: 1689 - DNA, 18 bp, Artificial Sequence
  Synthetic DNA
taatagaactcgctatag

SEQ ID NO: 1690 - DNA, 18 bp, Artificial Sequence
  Synthetic DNA
taatacgactcactggtg

SEQ ID NO: 1691 - DNA, 18 bp, Artificial Sequence
  Synthetic DNA
taatccgcctcactctag

SEQ ID NO: 1692 - DNA, 18 bp, Artificial Sequence
  Synthetic DNA
tgatgcgactcactacag

SEQ ID NO: 1693 - DNA, 18 bp, Artificial Sequence
  Synthetic DNA
taatgcaactcactaaag

SEQ ID NO: 1694 - DNA, 18 bp, Artificial Sequence
  Synthetic DNA
tgatgcgactcactattg

SEQ ID NO: 1695 - DNA, 18 bp, Artificial Sequence
  Synthetic DNA
taaaccgactcactaaag

SEQ ID NO: 1696 - DNA, 18 bp, Artificial Sequence
  Synthetic DNA
ttatacggctcactatcg

SEQ ID NO: 1697 - DNA, 18 bp, Artificial Sequence
  Synthetic DNA
taatacgtcccactctag

SEQ ID NO: 1698 - DNA, 18 bp, Artificial Sequence
  Synthetic DNA
taattggactcactgtag

SEQ ID NO: 1699 - DNA, 18 bp, Artificial Sequence
  Synthetic DNA
tgatgcgcctcactatag

SEQ ID NO: 1700 - DNA, 18 bp, Artificial Sequence
  Synthetic DNA
taaagcgactcactattg

SEQ ID NO: 1701 - DNA, 18 bp, Artificial Sequence
  Synthetic DNA
aaatagaactcactatag

SEQ ID NO: 1702 - DNA, 18 bp, Artificial Sequence
  Synthetic DNA
ttatacgactcaccatcg

SEQ ID NO: 1703 - DNA, 18 bp, Artificial Sequence
  Synthetic DNA
taatccgactcattatgg

SEQ ID NO: 1704 - DNA, 18 bp, Artificial Sequence
  Synthetic DNA
tgataagactcactatgg

SEQ ID NO: 1705 - DNA, 18 bp, Artificial Sequence
  Synthetic DNA
tattaagactcactagag

SEQ ID NO: 1706 - DNA, 18 bp, Artificial Sequence
  Synthetic DNA
taatgcaactccctatag

SEQ ID NO: 1707 - DNA, 18 bp, Artificial Sequence
  Synthetic DNA
gaatacgactctctacag

SEQ ID NO: 1708 - DNA, 18 bp, Artificial Sequence
  Synthetic DNA
taatgcaactcactctag

SEQ ID NO: 1709 - DNA, 18 bp, Artificial Sequence
  Synthetic DNA
taatatgacgcactacag

SEQ ID NO: 1710 - DNA, 18 bp, Artificial Sequence
  Synthetic DNA
taataggactcgctattg

SEQ ID NO: 1711 - DNA, 18 bp, Artificial Sequence
  Synthetic DNA
tatcgcgactcactatag

SEQ ID NO: 1712 - DNA, 18 bp, Artificial Sequence
  Synthetic DNA
taatacgtctcactactg

SEQ ID NO: 1713 - DNA, 18 bp, Artificial Sequence
  Synthetic DNA
taataggactcagaatag

SEQ ID NO: 1714 - DNA, 18 bp, Artificial Sequence
  Synthetic DNA
taatacgactcactcccg

SEQ ID NO: 1715 - DNA, 18 bp, Artificial Sequence
  Synthetic DNA
taaaacgcctcactaaag

SEQ ID NO: 1716 - DNA, 18 bp, Artificial Sequence
  Synthetic DNA
ctatacgactcactgtag

SEQ ID NO: 1717 - DNA, 18 bp, Artificial Sequence
  Synthetic DNA
tactacgtctcactctag

SEQ ID NO: 1718 - DNA, 18 bp, Artificial Sequence
  Synthetic DNA
taattcaactcgctatag

SEQ ID NO: 1719 - DNA, 18 bp, Artificial Sequence
  Synthetic DNA
aaaaacgcctcactatag

SEQ ID NO: 1720 - DNA, 18 bp, Artificial Sequence
  Synthetic DNA
tactacgactcgctacag

SEQ ID NO: 1721 - DNA, 18 bp, Artificial Sequence
  Synthetic DNA
tgatacgactcaatctag

SEQ ID NO: 1722 - DNA, 18 bp, Artificial Sequence
  Synthetic DNA
aaatacaactcactagag

SEQ ID NO: 1723 - DNA, 18 bp, Artificial Sequence
  Synthetic DNA
taatacgacccacttgag

SEQ ID NO: 1724 - DNA, 18 bp, Artificial Sequence
  Synthetic DNA
ttattcggctcactatag

SEQ ID NO: 1725 - DNA, 18 bp, Artificial Sequence
  Synthetic DNA
ttttacgactcactctag

SEQ ID NO: 1726 - DNA, 18 bp, Artificial Sequence
  Synthetic DNA
taatacgcatcactttag

SEQ ID NO: 1727 - DNA, 18 bp, Artificial Sequence
  Synthetic DNA
aaatacgactcacactag

SEQ ID NO: 1728 - DNA, 18 bp, Artificial Sequence
  Synthetic DNA
gtatgcgactcactatag

SEQ ID NO: 1729 - DNA, 18 bp, Artificial Sequence
  Synthetic DNA
taatacaactcactaccg

SEQ ID NO: 1730 - DNA, 18 bp, Artificial Sequence
  Synthetic DNA
ttatacgacgcactatcg

SEQ ID NO: 1731 - DNA, 18 bp, Artificial Sequence
  Synthetic DNA
taatacggctcactctcg

SEQ ID NO: 1732 - DNA, 18 bp, Artificial Sequence
  Synthetic DNA
taatgcgactcggtatag

SEQ ID NO: 1733 - DNA, 18 bp, Artificial Sequence
  Synthetic DNA
taacacgactcgctattg

SEQ ID NO: 1734 - DNA, 18 bp, Artificial Sequence
  Synthetic DNA
taatacgacacaccatcg

SEQ ID NO: 1735 - DNA, 18 bp, Artificial Sequence
  Synthetic DNA
tattgcgcctcactatag

SEQ ID NO: 1736 - DNA, 18 bp, Artificial Sequence
  Synthetic DNA
taatgcgactcgctctag

SEQ ID NO: 1737 - DNA, 18 bp, Artificial Sequence
  Synthetic DNA
taatgcgtctcactagag

SEQ ID NO: 1738 - DNA, 18 bp, Artificial Sequence
  Synthetic DNA
taattcggctcgctatag

SEQ ID NO: 1739 - DNA, 18 bp, Artificial Sequence
  Synthetic DNA
taaaacaactcactctag

SEQ ID NO: 1740 - DNA, 18 bp, Artificial Sequence
  Synthetic DNA
taatacgactcacccaag

SEQ ID NO: 1741 - DNA, 18 bp, Artificial Sequence
  Synthetic DNA
taatgcgactcacttttg

SEQ ID NO: 1742 - DNA, 18 bp, Artificial Sequence
  Synthetic DNA
agctacgactcactatag

SEQ ID NO: 1743 - DNA, 18 bp, Artificial Sequence
  Synthetic DNA
taatgcgcctcactttag

SEQ ID NO: 1744 - DNA, 18 bp, Artificial Sequence
  Synthetic DNA
ttaaacgactcgctatag

SEQ ID NO: 1745 - DNA, 18 bp, Artificial Sequence
  Synthetic DNA
taattagactcagtatag

SEQ ID NO: 1746 - DNA, 18 bp, Artificial Sequence
  Synthetic DNA
cagtacgactcactttag

SEQ ID NO: 1747 - DNA, 18 bp, Artificial Sequence
  Synthetic DNA
taatccgactcactaccg

SEQ ID NO: 1748 - DNA, 18 bp, Artificial Sequence
  Synthetic DNA
gaattcgactcactatcg

SEQ ID NO: 1749 - DNA, 18 bp, Artificial Sequence
  Synthetic DNA
taataggactcactggag

SEQ ID NO: 1750 - DNA, 18 bp, Artificial Sequence
  Synthetic DNA
tagtactactcactgtag

SEQ ID NO: 1751 - DNA, 18 bp, Artificial Sequence
  Synthetic DNA
taatgcgtctcactattg

SEQ ID NO: 1752 - DNA, 18 bp, Artificial Sequence
  Synthetic DNA
taatacaactcgctattg

SEQ ID NO: 1753 - DNA, 18 bp, Artificial Sequence
  Synthetic DNA
taataggactcactactg

SEQ ID NO: 1754 - DNA, 18 bp, Artificial Sequence
  Synthetic DNA
taattcgactcactgtcg

SEQ ID NO: 1755 - DNA, 18 bp, Artificial Sequence
  Synthetic DNA
tcattcgactcactatcg

SEQ ID NO: 1756 - DNA, 18 bp, Artificial Sequence
  Synthetic DNA
caaaaggactcactatag

SEQ ID NO: 1757 - DNA, 18 bp, Artificial Sequence
  Synthetic DNA
taatacaactcactactg

SEQ ID NO: 1758 - DNA, 18 bp, Artificial Sequence
  Synthetic DNA
taatacgtctcgctattg

SEQ ID NO: 1759 - DNA, 18 bp, Artificial Sequence
  Synthetic DNA
taattcgcctcactctag

SEQ ID NO: 1760 - DNA, 18 bp, Artificial Sequence
  Synthetic DNA
taagacgaatcactctag

SEQ ID NO: 1761 - DNA, 18 bp, Artificial Sequence
  Synthetic DNA
taaagcgactcactatcg

SEQ ID NO: 1762 - DNA, 18 bp, Artificial Sequence
  Synthetic DNA
taatacgactagctatcg

SEQ ID NO: 1763 - DNA, 18 bp, Artificial Sequence
  Synthetic DNA
taacacgcctcactaaag

SEQ ID NO: 1764 - DNA, 18 bp, Artificial Sequence
  Synthetic DNA
taataagacgcactatcg

SEQ ID NO: 1765 - DNA, 18 bp, Artificial Sequence
  Synthetic DNA
taatacgcctcactcaag

SEQ ID NO: 1766 - DNA, 18 bp, Artificial Sequence
  Synthetic DNA
taatagaactcaccatag

SEQ ID NO: 1767 - DNA, 18 bp, Artificial Sequence
  Synthetic DNA
taatccaactcactatcg

SEQ ID NO: 1768 - DNA, 18 bp, Artificial Sequence
  Synthetic DNA
aaattcgactcactgtag

SEQ ID NO: 1769 - DNA, 18 bp, Artificial Sequence
  Synthetic DNA
tattacgcgtcactatag

SEQ ID NO: 1770 - DNA, 18 bp, Artificial Sequence
  Synthetic DNA
tattgcgactcactttag

SEQ ID NO: 1771 - DNA, 18 bp, Artificial Sequence
  Synthetic DNA
tattacgcctcactctag

SEQ ID NO: 1772 - DNA, 18 bp, Artificial Sequence
  Synthetic DNA
aaatgcgactcactaaag

SEQ ID NO: 1773 - DNA, 18 bp, Artificial Sequence
  Synthetic DNA
aaatgcgactcactacag

SEQ ID NO: 1774 - DNA, 18 bp, Artificial Sequence
  Synthetic DNA
taatacgactcgctcaag

SEQ ID NO: 1775 - DNA, 18 bp, Artificial Sequence
  Synthetic DNA
ttatacgcatcactatag

SEQ ID NO: 1776 - DNA, 18 bp, Artificial Sequence
  Synthetic DNA
ttataggactcactacag

SEQ ID NO: 1777 - DNA, 18 bp, Artificial Sequence
  Synthetic DNA
taatacgagtcactgttg

SEQ ID NO: 1778 - DNA, 18 bp, Artificial Sequence
  Synthetic DNA
ttaaacgactcactgtag

SEQ ID NO: 1779 - DNA, 18 bp, Artificial Sequence
  Synthetic DNA
taattggactcgctatag

SEQ ID NO: 1780 - DNA, 18 bp, Artificial Sequence
  Synthetic DNA
caatacacctcactatag

SEQ ID NO: 1781 - DNA, 18 bp, Artificial Sequence
  Synthetic DNA
caataggactcactctag

SEQ ID NO: 1782 - DNA, 18 bp, Artificial Sequence
  Synthetic DNA
taataggactcgctacag

SEQ ID NO: 1783 - DNA, 18 bp, Artificial Sequence
  Synthetic DNA
taaaacgtctcactagag

SEQ ID NO: 1784 - DNA, 18 bp, Artificial Sequence
  Synthetic DNA
cattatgactcactatag

SEQ ID NO: 1785 - DNA, 18 bp, Artificial Sequence
  Synthetic DNA
aaataggactcactaaag

SEQ ID NO: 1786 - DNA, 18 bp, Artificial Sequence
  Synthetic DNA
taatacgactcgctaacg

SEQ ID NO: 1787 - DNA, 18 bp, Artificial Sequence
  Synthetic DNA
ttataggactcactttag

SEQ ID NO: 1788 - DNA, 18 bp, Artificial Sequence
  Synthetic DNA
caaaacgactcgctatag

SEQ ID NO: 1789 - DNA, 18 bp, Artificial Sequence
  Synthetic DNA
taatgcgactcactcaag

SEQ ID NO: 1790 - DNA, 18 bp, Artificial Sequence
  Synthetic DNA
caatgcgactcactatcg

SEQ ID NO: 1791 - DNA, 18 bp, Artificial Sequence
  Synthetic DNA
taatacaactcactagtg

SEQ ID NO: 1792 - DNA, 18 bp, Artificial Sequence
  Synthetic DNA
tgatttgactcactatag

SEQ ID NO: 1793 - DNA, 18 bp, Artificial Sequence
  Synthetic DNA
tattatgactcactgtag

SEQ ID NO: 1794 - DNA, 18 bp, Artificial Sequence
  Synthetic DNA
tgaagcgactcactatag

SEQ ID NO: 1795 - DNA, 18 bp, Artificial Sequence
  Synthetic DNA
caatacgactcgctacag

SEQ ID NO: 1796 - DNA, 18 bp, Artificial Sequence
  Synthetic DNA
taaatcgactcactctag

SEQ ID NO: 1797 - DNA, 18 bp, Artificial Sequence
  Synthetic DNA
ttatacgcctcactattg

SEQ ID NO: 1798 - DNA, 18 bp, Artificial Sequence
  Synthetic DNA
taatacgactgcctattg

SEQ ID NO: 1799 - DNA, 18 bp, Artificial Sequence
  Synthetic DNA
taataggactcacttttg

SEQ ID NO: 1800 - DNA, 18 bp, Artificial Sequence
  Synthetic DNA
taatcggactctctatag

SEQ ID NO: 1801 - DNA, 18 bp, Artificial Sequence
  Synthetic DNA
taatacgcttcagtatag

SEQ ID NO: 1802 - DNA, 18 bp, Artificial Sequence
  Synthetic DNA
taatacgaatctctgtag

SEQ ID NO: 1803 - DNA, 18 bp, Artificial Sequence
  Synthetic DNA
tattgcgactcactgtag

SEQ ID NO: 1804 - DNA, 18 bp, Artificial Sequence
  Synthetic DNA
caatacgactcgctatcg

SEQ ID NO: 1805 - DNA, 18 bp, Artificial Sequence
  Synthetic DNA
taacgcgactcactctag

SEQ ID NO: 1806 - DNA, 18 bp, Artificial Sequence
  Synthetic DNA
ttttacgcctcactatag

SEQ ID NO: 1807 - DNA, 18 bp, Artificial Sequence
  Synthetic DNA
tgaatcgactcactatag

SEQ ID NO: 1808 - DNA, 18 bp, Artificial Sequence
  Synthetic DNA
taaaacgcctcactatgg

SEQ ID NO: 1809 - DNA, 18 bp, Artificial Sequence
  Synthetic DNA
caatgcgactcactagag

SEQ ID NO: 1810 - DNA, 18 bp, Artificial Sequence
  Synthetic DNA
taacgcgactcactaaag

SEQ ID NO: 1811 - DNA, 18 bp, Artificial Sequence
  Synthetic DNA
caaaacgactcactctag

SEQ ID NO: 1812 - DNA, 18 bp, Artificial Sequence
  Synthetic DNA
caattcgactcactgtag

SEQ ID NO: 1813 - DNA, 18 bp, Artificial Sequence
  Synthetic DNA
tattccgcctcactatag

SEQ ID NO: 1814 - DNA, 18 bp, Artificial Sequence
  Synthetic DNA
tatttcgcctcactatag

SEQ ID NO: 1815 - DNA, 18 bp, Artificial Sequence
  Synthetic DNA
taattcggctcactatgg

SEQ ID NO: 1816 - DNA, 18 bp, Artificial Sequence
  Synthetic DNA
tgataagactcactaaag

SEQ ID NO: 1817 - DNA, 18 bp, Artificial Sequence
  Synthetic DNA
aaaggcgactcactatag

SEQ ID NO: 1818 - DNA, 18 bp, Artificial Sequence
  Synthetic DNA
ctatacgactcactacag

SEQ ID NO: 1819 - DNA, 18 bp, Artificial Sequence
  Synthetic DNA
taatagaactcactctag

SEQ ID NO: 1820 - DNA, 18 bp, Artificial Sequence
  Synthetic DNA
ttaaacgactcactacag

SEQ ID NO: 1821 - DNA, 18 bp, Artificial Sequence
  Synthetic DNA
taaaacaactcactgtag

SEQ ID NO: 1822 - DNA, 18 bp, Artificial Sequence
  Synthetic DNA
ttataggactcactctag

SEQ ID NO: 1823 - DNA, 18 bp, Artificial Sequence
  Synthetic DNA
tattaggactcactatcg

SEQ ID NO: 1824 - DNA, 18 bp, Artificial Sequence
  Synthetic DNA
taaaacgactcagtctag

SEQ ID NO: 1825 - DNA, 18 bp, Artificial Sequence
  Synthetic DNA
taaaaagactcactagag

SEQ ID NO: 1826 - DNA, 18 bp, Artificial Sequence
  Synthetic DNA
taacacgactcgctatcg

SEQ ID NO: 1827 - DNA, 18 bp, Artificial Sequence
  Synthetic DNA
taataagcctcactatgg

SEQ ID NO: 1828 - DNA, 18 bp, Artificial Sequence
  Synthetic DNA
gaatacaactcactatgg

SEQ ID NO: 1829 - DNA, 18 bp, Artificial Sequence
  Synthetic DNA
gaattcgactcactgtag

SEQ ID NO: 1830 - DNA, 18 bp, Artificial Sequence
  Synthetic DNA
gactaggactcactatag

SEQ ID NO: 1831 - DNA, 18 bp, Artificial Sequence
  Synthetic DNA
taaaacgcctcactatat

SEQ ID NO: 1832 - DNA, 18 bp, Artificial Sequence
  Synthetic DNA
taataagagtgactatag

SEQ ID NO: 1833 - DNA, 18 bp, Artificial Sequence
  Synthetic DNA
taatacgaatcactctcg

SEQ ID NO: 1834 - DNA, 18 bp, Artificial Sequence
  Synthetic DNA
taatacgactatctataa

SEQ ID NO: 1835 - DNA, 18 bp, Artificial Sequence
  Synthetic DNA
taatacgattcattataa

SEQ ID NO: 1836 - DNA, 18 bp, Artificial Sequence
  Synthetic DNA
taatacgtatcactagag

SEQ ID NO: 1837 - DNA, 18 bp, Artificial Sequence
  Synthetic DNA
taatgcgactcacgttag

SEQ ID NO: 1838 - DNA, 18 bp, Artificial Sequence
  Synthetic DNA
tgagacgactcacgatag

SEQ ID NO: 1839 - DNA, 18 bp, Artificial Sequence
  Synthetic DNA
taataggactcacttcag

SEQ ID NO: 1840 - DNA, 18 bp, Artificial Sequence
  Synthetic DNA
taatgcgactcaccaaag

SEQ ID NO: 1841 - DNA, 18 bp, Artificial Sequence
  Synthetic DNA
taatttgactcactctag

SEQ ID NO: 1842 - DNA, 18 bp, Artificial Sequence
  Synthetic DNA
taatgcaactcactgtag

SEQ ID NO: 1843 - DNA, 18 bp, Artificial Sequence
  Synthetic DNA
tgatacgcctcactaaag

SEQ ID NO: 1844 - DNA, 18 bp, Artificial Sequence
  Synthetic DNA
ttgtacgactcactctag

SEQ ID NO: 1845 - DNA, 18 bp, Artificial Sequence
  Synthetic DNA
taataggactctgtatag

SEQ ID NO: 1846 - DNA, 18 bp, Artificial Sequence
  Synthetic DNA
tagtccgtctcactatag

SEQ ID NO: 1847 - DNA, 18 bp, Artificial Sequence
  Synthetic DNA
tgatacgactcgctattg

SEQ ID NO: 1848 - DNA, 18 bp, Artificial Sequence
  Synthetic DNA
tattaggactcagtatag

SEQ ID NO: 1849 - DNA, 18 bp, Artificial Sequence
  Synthetic DNA
tcatgcgactcactatcg

SEQ ID NO: 1850 - DNA, 18 bp, Artificial Sequence
  Synthetic DNA
taaagcgactcactagag

SEQ ID NO: 1851 - DNA, 18 bp, Artificial Sequence
  Synthetic DNA
tattgcgactcactctag

SEQ ID NO: 1852 - DNA, 18 bp, Artificial Sequence
  Synthetic DNA
taatacgactcactcgtg

SEQ ID NO: 1853 - DNA, 18 bp, Artificial Sequence
  Synthetic DNA
taataggactcactaacg

SEQ ID NO: 1854 - DNA, 18 bp, Artificial Sequence
  Synthetic DNA
ttatacggctcgctatag

SEQ ID NO: 1855 - DNA, 18 bp, Artificial Sequence
  Synthetic DNA
taattagactcactctag

SEQ ID NO: 1856 - DNA, 18 bp, Artificial Sequence
  Synthetic DNA
aaatacgactcactccag

SEQ ID NO: 1857 - DNA, 18 bp, Artificial Sequence
  Synthetic DNA
taatacgcctcgctacag

SEQ ID NO: 1858 - DNA, 18 bp, Artificial Sequence
  Synthetic DNA
caatacgactcacgaaag

SEQ ID NO: 1859 - DNA, 18 bp, Artificial Sequence
  Synthetic DNA
taattcgactcaggatag

SEQ ID NO: 1860 - DNA, 18 bp, Artificial Sequence
  Synthetic DNA
tgatgcgactcactatcg

SEQ ID NO: 1861 - DNA, 18 bp, Artificial Sequence
  Synthetic DNA
ttatacgactcgctttag

SEQ ID NO: 1862 - DNA, 18 bp, Artificial Sequence
  Synthetic DNA
taattggactcactctag

SEQ ID NO: 1863 - DNA, 18 bp, Artificial Sequence
  Synthetic DNA
caatacgactcacttcag

SEQ ID NO: 1864 - DNA, 18 bp, Artificial Sequence
  Synthetic DNA
taatacgcctcaccatgg

SEQ ID NO: 1865 - DNA, 18 bp, Artificial Sequence
  Synthetic DNA
taattcgcctcgctatag

SEQ ID NO: 1866 - DNA, 18 bp, Artificial Sequence
  Synthetic DNA
cagtacgacacactatag

SEQ ID NO: 1867 - DNA, 18 bp, Artificial Sequence
  Synthetic DNA
taatacgcctcactaagg

SEQ ID NO: 1868 - DNA, 18 bp, Artificial Sequence
  Synthetic DNA
taacacgactcgctctag

SEQ ID NO: 1869 - DNA, 18 bp, Artificial Sequence
  Synthetic DNA
taataagactcagtacag

SEQ ID NO: 1870 - DNA, 18 bp, Artificial Sequence
  Synthetic DNA
taatcggactcactttag

SEQ ID NO: 1871 - DNA, 18 bp, Artificial Sequence
  Synthetic DNA
taaaaggactcactacag

SEQ ID NO: 1872 - DNA, 18 bp, Artificial Sequence
  Synthetic DNA
taataggtctcactctag

SEQ ID NO: 1873 - DNA, 18 bp, Artificial Sequence
  Synthetic DNA
tattaggactcactttag

SEQ ID NO: 1874 - DNA, 18 bp, Artificial Sequence
  Synthetic DNA
tgaaacgactcactacag

SEQ ID NO: 1875 - DNA, 18 bp, Artificial Sequence
  Synthetic DNA
tattaggactcactaaag

SEQ ID NO: 1876 - DNA, 18 bp, Artificial Sequence
  Synthetic DNA
taatacgactcaccactg

SEQ ID NO: 1877 - DNA, 18 bp, Artificial Sequence
  Synthetic DNA
taatacgcatcactaaag

SEQ ID NO: 1878 - DNA, 18 bp, Artificial Sequence
  Synthetic DNA
tattgcgactcactacag

SEQ ID NO: 1879 - DNA, 18 bp, Artificial Sequence
  Synthetic DNA
taatacaactcactccag

SEQ ID NO: 1880 - DNA, 18 bp, Artificial Sequence
  Synthetic DNA
gtatacgactcactctag

SEQ ID NO: 1881 - DNA, 18 bp, Artificial Sequence
  Synthetic DNA
gaataggactcactctag

SEQ ID NO: 1882 - DNA, 18 bp, Artificial Sequence
  Synthetic DNA
taataggcctcactacag

SEQ ID NO: 1883 - DNA, 18 bp, Artificial Sequence
  Synthetic DNA
taatccgactcactccag

SEQ ID NO: 1884 - DNA, 18 bp, Artificial Sequence
  Synthetic DNA
taatgcgactcacattag

SEQ ID NO: 1885 - DNA, 18 bp, Artificial Sequence
  Synthetic DNA
tattacgactcaccatcg

SEQ ID NO: 1886 - DNA, 18 bp, Artificial Sequence
  Synthetic DNA
taatccgactcactcaag

SEQ ID NO: 1887 - DNA, 18 bp, Artificial Sequence
  Synthetic DNA
ccaaacgactcactatag

SEQ ID NO: 1888 - DNA, 18 bp, Artificial Sequence
  Synthetic DNA
ttattcgcctcactatag

SEQ ID NO: 1889 - DNA, 18 bp, Artificial Sequence
  Synthetic DNA
ttttacgactcactatcg

SEQ ID NO: 1890 - DNA, 18 bp, Artificial Sequence
  Synthetic DNA
ttatgcgactcactagag

SEQ ID NO: 1891 - DNA, 18 bp, Artificial Sequence
  Synthetic DNA
taattcaactcactctag

SEQ ID NO: 1892 - DNA, 18 bp, Artificial Sequence
  Synthetic DNA
aaattcgactcactatcg

SEQ ID NO: 1893 - DNA, 18 bp, Artificial Sequence
  Synthetic DNA
taaaacgactcaggatag

SEQ ID NO: 1894 - DNA, 18 bp, Artificial Sequence
  Synthetic DNA
taattcggctcactaaag

SEQ ID NO: 1895 - DNA, 18 bp, Artificial Sequence
  Synthetic DNA
taatccgactcgctacag

SEQ ID NO: 1896 - DNA, 18 bp, Artificial Sequence
  Synthetic DNA
taatccgcctcactaaag

SEQ ID NO: 1897 - DNA, 18 bp, Artificial Sequence
  Synthetic DNA
taatgcgactcactcttg

SEQ ID NO: 1898 - DNA, 18 bp, Artificial Sequence
  Synthetic DNA
taatacgcctcacttaag

SEQ ID NO: 1899 - DNA, 18 bp, Artificial Sequence
  Synthetic DNA
ttatacggctcactattg

SEQ ID NO: 1900 - DNA, 18 bp, Artificial Sequence
  Synthetic DNA
tattgcgactcagtatag

SEQ ID NO: 1901 - DNA, 18 bp, Artificial Sequence
  Synthetic DNA
taatacgactcgcaatcg

SEQ ID NO: 1902 - DNA, 18 bp, Artificial Sequence
  Synthetic DNA
taatacgactcgctagtg

SEQ ID NO: 1903 - DNA, 18 bp, Artificial Sequence
  Synthetic DNA
taatctgactcactatgg

SEQ ID NO: 1904 - DNA, 18 bp, Artificial Sequence
  Synthetic DNA
taatgcgacgcgctatag

SEQ ID NO: 1905 - DNA, 18 bp, Artificial Sequence
  Synthetic DNA
gaatctgactcactatag

SEQ ID NO: 1906 - DNA, 18 bp, Artificial Sequence
  Synthetic DNA
taataagactcactcttg

SEQ ID NO: 1907 - DNA, 18 bp, Artificial Sequence
  Synthetic DNA
aaattcgactcactattg

SEQ ID NO: 1908 - DNA, 18 bp, Artificial Sequence
  Synthetic DNA
taatacaactcagtaaag

SEQ ID NO: 1909 - DNA, 18 bp, Artificial Sequence
  Synthetic DNA
taaaaagactcactctag

SEQ ID NO: 1910 - DNA, 18 bp, Artificial Sequence
  Synthetic DNA
taatacgcctcactaatg

SEQ ID NO: 1911 - DNA, 18 bp, Artificial Sequence
  Synthetic DNA
caatgtgactcactatag

SEQ ID NO: 1912 - DNA, 18 bp, Artificial Sequence
  Synthetic DNA
taaaaggactcactctag

SEQ ID NO: 1913 - DNA, 18 bp, Artificial Sequence
  Synthetic DNA
taatacgacgctccatag

SEQ ID NO: 1914 - DNA, 18 bp, Artificial Sequence
  Synthetic DNA
taattagactcgctatag

SEQ ID NO: 1915 - DNA, 18 bp, Artificial Sequence
  Synthetic DNA
caatacgactcactctcg

SEQ ID NO: 1916 - DNA, 18 bp, Artificial Sequence
  Synthetic DNA
taacgcgactcactttag

SEQ ID NO: 1917 - DNA, 18 bp, Artificial Sequence
  Synthetic DNA
taatcggactcactatcg

SEQ ID NO: 1918 - DNA, 18 bp, Artificial Sequence
  Synthetic DNA
tataacgcctcactatag

SEQ ID NO: 1919 - DNA, 18 bp, Artificial Sequence
  Synthetic DNA
taattcgcctcactaaag

SEQ ID NO: 1920 - DNA, 18 bp, Artificial Sequence
  Synthetic DNA
ttatagaactcactatag

SEQ ID NO: 1921 - DNA, 18 bp, Artificial Sequence
  Synthetic DNA
taaaaggactcagtatag

SEQ ID NO: 1922 - DNA, 18 bp, Artificial Sequence
  Synthetic DNA
gaatgcgattcactatag

SEQ ID NO: 1923 - DNA, 18 bp, Artificial Sequence
  Synthetic DNA
taattcgcctcactagag

SEQ ID NO: 1924 - DNA, 18 bp, Artificial Sequence
  Synthetic DNA
taatacgactcagtgaag

SEQ ID NO: 1925 - DNA, 18 bp, Artificial Sequence
  Synthetic DNA
aaatgcgactcactatgg

SEQ ID NO: 1926 - DNA, 18 bp, Artificial Sequence
  Synthetic DNA
taatgcgactcgctgtag

SEQ ID NO: 1927 - DNA, 18 bp, Artificial Sequence
  Synthetic DNA
aaaaaggactcactatag

SEQ ID NO: 1928 - DNA, 18 bp, Artificial Sequence
  Synthetic DNA
caatacgactcaccatgg

SEQ ID NO: 1929 - DNA, 18 bp, Artificial Sequence
  Synthetic DNA
aaatacgactcgctatcg

SEQ ID NO: 1930 - DNA, 18 bp, Artificial Sequence
  Synthetic DNA
gaattcgactcactattg

SEQ ID NO: 1931 - DNA, 18 bp, Artificial Sequence
  Synthetic DNA
taacagaactcactatag

SEQ ID NO: 1932 - DNA, 18 bp, Artificial Sequence
  Synthetic DNA
tagtacgacccactaaag

SEQ ID NO: 1933 - DNA, 18 bp, Artificial Sequence
  Synthetic DNA
taatacgactcgctcttg

SEQ ID NO: 1934 - DNA, 18 bp, Artificial Sequence
  Synthetic DNA
taaagcgtctcactatag

SEQ ID NO: 1935 - DNA, 18 bp, Artificial Sequence
  Synthetic DNA
ttatgcgactcactattg

SEQ ID NO: 1936 - DNA, 18 bp, Artificial Sequence
  Synthetic DNA
tattacgactcactcttg

SEQ ID NO: 1937 - DNA, 18 bp, Artificial Sequence
  Synthetic DNA
aaatacgcatcactatag

SEQ ID NO: 1938 - DNA, 18 bp, Artificial Sequence
  Synthetic DNA
aaatatgactcactgtag

SEQ ID NO: 1939 - DNA, 18 bp, Artificial Sequence
  Synthetic DNA
taatgcgactcgctttag

SEQ ID NO: 1940 - DNA, 18 bp, Artificial Sequence
  Synthetic DNA
taatccaactcactgtag

SEQ ID NO: 1941 - DNA, 18 bp, Artificial Sequence
  Synthetic DNA
tattaagactcactctag

SEQ ID NO: 1942 - DNA, 18 bp, Artificial Sequence
  Synthetic DNA
taataggactcagtttag

SEQ ID NO: 1943 - DNA, 18 bp, Artificial Sequence
  Synthetic DNA
taatacgacacgctatcg

SEQ ID NO: 1944 - DNA, 18 bp, Artificial Sequence
  Synthetic DNA
taatccgactcacactag

SEQ ID NO: 1945 - DNA, 18 bp, Artificial Sequence
  Synthetic DNA
taatgcaacccactatag

SEQ ID NO: 1946 - DNA, 18 bp, Artificial Sequence
  Synthetic DNA
taaaacgactcgctacag

SEQ ID NO: 1947 - DNA, 18 bp, Artificial Sequence
  Synthetic DNA
taatataactcactattg

SEQ ID NO: 1948 - DNA, 18 bp, Artificial Sequence
  Synthetic DNA
taattcgcctcactttag

SEQ ID NO: 1949 - DNA, 18 bp, Artificial Sequence
  Synthetic DNA
tatttcgactcactgtag

SEQ ID NO: 1950 - DNA, 18 bp, Artificial Sequence
  Synthetic DNA
taattcgactcacggtag

SEQ ID NO: 1951 - DNA, 18 bp, Artificial Sequence
  Synthetic DNA
taaaaggactcactatcg

SEQ ID NO: 1952 - DNA, 18 bp, Artificial Sequence
  Synthetic DNA
caattcgactcactacag

SEQ ID NO: 1953 - DNA, 18 bp, Artificial Sequence
  Synthetic DNA
taattcgagtcactaaag

SEQ ID NO: 1954 - DNA, 18 bp, Artificial Sequence
  Synthetic DNA
ttttccgactcactatag

SEQ ID NO: 1955 - DNA, 18 bp, Artificial Sequence
  Synthetic DNA
tcatacgactcactactg

SEQ ID NO: 1956 - DNA, 18 bp, Artificial Sequence
  Synthetic DNA
taattcgtctcactagag

SEQ ID NO: 1957 - DNA, 18 bp, Artificial Sequence
  Synthetic DNA
taattggactcactacag

SEQ ID NO: 1958 - DNA, 18 bp, Artificial Sequence
  Synthetic DNA
ctatgcgactcactatag

SEQ ID NO: 1959 - DNA, 18 bp, Artificial Sequence
  Synthetic DNA
taataggactcactttcg

SEQ ID NO: 1960 - DNA, 18 bp, Artificial Sequence
  Synthetic DNA
ttatacgactcaccattg

SEQ ID NO: 1961 - DNA, 18 bp, Artificial Sequence
  Synthetic DNA
taatccgcctcactttag

SEQ ID NO: 1962 - DNA, 18 bp, Artificial Sequence
  Synthetic DNA
cattacgactcactgtag

SEQ ID NO: 1963 - DNA, 18 bp, Artificial Sequence
  Synthetic DNA
taaaacgactcactttgg

SEQ ID NO: 1964 - DNA, 18 bp, Artificial Sequence
  Synthetic DNA
ttttacgactcactacag

SEQ ID NO: 1965 - DNA, 18 bp, Artificial Sequence
  Synthetic DNA
taattggactcactaaag

SEQ ID NO: 1966 - DNA, 18 bp, Artificial Sequence
  Synthetic DNA
taatacgactcagtcttg

SEQ ID NO: 1967 - DNA, 18 bp, Artificial Sequence
  Synthetic DNA
taattcggctcactagag

SEQ ID NO: 1968 - DNA, 18 bp, Artificial Sequence
  Synthetic DNA
tattaggactcactataa

SEQ ID NO: 1969 - DNA, 18 bp, Artificial Sequence
  Synthetic DNA
caattagactcactatag

SEQ ID NO: 1970 - DNA, 18 bp, Artificial Sequence
  Synthetic DNA
gaatacgcctcacaatag

SEQ ID NO: 1971 - DNA, 18 bp, Artificial Sequence
  Synthetic DNA
taatacgactcggtaaag

SEQ ID NO: 1972 - DNA, 18 bp, Artificial Sequence
  Synthetic DNA
aaatacgactcactagtg

SEQ ID NO: 1973 - DNA, 18 bp, Artificial Sequence
  Synthetic DNA
tcataggacacactatag

SEQ ID NO: 1974 - DNA, 18 bp, Artificial Sequence
  Synthetic DNA
tcataagactcactatgg

SEQ ID NO: 1975 - DNA, 18 bp, Artificial Sequence
  Synthetic DNA
caatacgactcagtacag

SEQ ID NO: 1976 - DNA, 18 bp, Artificial Sequence
  Synthetic DNA
gaatacgcctcactagag

SEQ ID NO: 1977 - DNA, 18 bp, Artificial Sequence
  Synthetic DNA
taattcgagtcgctatag

SEQ ID NO: 1978 - DNA, 18 bp, Artificial Sequence
  Synthetic DNA
taataggactcagtacag

SEQ ID NO: 1979 - DNA, 18 bp, Artificial Sequence
  Synthetic DNA
cgatacgactcactagag

SEQ ID NO: 1980 - DNA, 18 bp, Artificial Sequence
  Synthetic DNA
taatgagactcactatcg

SEQ ID NO: 1981 - DNA, 18 bp, Artificial Sequence
  Synthetic DNA
aaatacgactcgctctag

SEQ ID NO: 1982 - DNA, 18 bp, Artificial Sequence
  Synthetic DNA
caatacgactcaccaaag

SEQ ID NO: 1983 - DNA, 18 bp, Artificial Sequence
  Synthetic DNA
caatacgactcagtgtag

SEQ ID NO: 1984 - DNA, 18 bp, Artificial Sequence
  Synthetic DNA
taacacgcctcactatcg

SEQ ID NO: 1985 - DNA, 18 bp, Artificial Sequence
  Synthetic DNA
taatacgactaactccag

SEQ ID NO: 1986 - DNA, 18 bp, Artificial Sequence
  Synthetic DNA
taatacgactcaatttaa

SEQ ID NO: 1987 - DNA, 18 bp, Artificial Sequence
  Synthetic DNA
taatacgactcacaaaat

SEQ ID NO: 1988 - DNA, 18 bp, Artificial Sequence
  Synthetic DNA
taatacgactcacgagtg

SEQ ID NO: 1989 - DNA, 18 bp, Artificial Sequence
  Synthetic DNA
taatacgactcacttaat

SEQ ID NO: 1990 - DNA, 18 bp, Artificial Sequence
  Synthetic DNA
taatacgactccctgtcg

SEQ ID NO: 1991 - DNA, 18 bp, Artificial Sequence
  Synthetic DNA
taatacgactcgcgatcg

SEQ ID NO: 1992 - DNA, 18 bp, Artificial Sequence
  Synthetic DNA
taatacgactctctatga

SEQ ID NO: 1993 - DNA, 18 bp, Artificial Sequence
  Synthetic DNA
taatacgagtccctctag

SEQ ID NO: 1994 - DNA, 18 bp, Artificial Sequence
  Synthetic DNA
taatacggctgagtatag

SEQ ID NO: 1995 - DNA, 18 bp, Artificial Sequence
  Synthetic DNA
taatacggtgcactatag

SEQ ID NO: 1996 - DNA, 18 bp, Artificial Sequence
  Synthetic DNA
taatagggctcactttag

SEQ ID NO: 1997 - DNA, 18 bp, Artificial Sequence
  Synthetic DNA
taatgagactcgctatag

SEQ ID NO: 1998 - DNA, 18 bp, Artificial Sequence
  Synthetic DNA
taatgcgactcactggag

SEQ ID NO: 1999 - DNA, 18 bp, Artificial Sequence
  Synthetic DNA
taatgcgtctcactataa

SEQ ID NO: 2000 - DNA, 18 bp, Artificial Sequence
  Synthetic DNA
taattcgagtcactatgg

SEQ ID NO: 2001 - DNA, 18 bp, Artificial Sequence
  Synthetic DNA
tattacgactcactctaa

SEQ ID NO: 2002 - DNA, 18 bp, Artificial Sequence
  Synthetic DNA
tattaggactcacgatag

SEQ ID NO: 2003 - DNA, 18 bp, Artificial Sequence
  Synthetic DNA
tgttacgactcactataa

SEQ ID NO: 2004 - DNA, 18 bp, Artificial Sequence
  Synthetic DNA
ttatccgactcactataa

SEQ ID NO: 2005 - DNA, 18 bp, Artificial Sequence
  Synthetic DNA
aaatatgactcactatat

SEQ ID NO: 2006 - DNA, 18 bp, Artificial Sequence
  Synthetic DNA
caatacgactcaccgtag

SEQ ID NO: 2007 - DNA, 18 bp, Artificial Sequence
  Synthetic DNA
caatacgactctctatac

SEQ ID NO: 2008 - DNA, 18 bp, Artificial Sequence
  Synthetic DNA
ctatacgactcactataa

SEQ ID NO: 2009 - DNA, 18 bp, Artificial Sequence
  Synthetic DNA
gaatagcactcactatag

SEQ ID NO: 2010 - DNA, 18 bp, Artificial Sequence
  Synthetic DNA
gaataggactcactatcg

SEQ ID NO: 2011 - DNA, 18 bp, Artificial Sequence
  Synthetic DNA
taaaacgactcacaatat

SEQ ID NO: 2012 - DNA, 18 bp, Artificial Sequence
  Synthetic DNA
taaaacgactcactatga

SEQ ID NO: 2013 - DNA, 18 bp, Artificial Sequence
  Synthetic DNA
taacacaactcactagag

SEQ ID NO: 2014 - DNA, 18 bp, Artificial Sequence
  Synthetic DNA
taacacgactcactatca

SEQ ID NO: 2015 - DNA, 18 bp, Artificial Sequence
  Synthetic DNA
taataagactcactacat

SEQ ID NO: 2016 - DNA, 18 bp, Artificial Sequence
  Synthetic DNA
taataagcttcactatag

SEQ ID NO: 2017 - DNA, 18 bp, Artificial Sequence
  Synthetic DNA
taatacaactcaggatag

SEQ ID NO: 2018 - DNA, 18 bp, Artificial Sequence
  Synthetic DNA
taatacaattcactataa

SEQ ID NO: 2019 - DNA, 18 bp, Artificial Sequence
  Synthetic DNA
taataccacccactatgg

SEQ ID NO: 2020 - DNA, 18 bp, Artificial Sequence
  Synthetic DNA
taataccactcaagatag

SEQ ID NO: 2021 - DNA, 18 bp, Artificial Sequence
  Synthetic DNA
taataccactccctagag

SEQ ID NO: 2022 - DNA, 18 bp, Artificial Sequence
  Synthetic DNA
taatacgaaccactatac

SEQ ID NO: 2023 - DNA, 18 bp, Artificial Sequence
  Synthetic DNA
taatacgaattactataa

SEQ ID NO: 2024 - DNA, 18 bp, Artificial Sequence
  Synthetic DNA
taatacgacccacgagag

SEQ ID NO: 2025 - DNA, 18 bp, Artificial Sequence
  Synthetic DNA
taatacgacgcactgtgg

SEQ ID NO: 2026 - DNA, 18 bp, Artificial Sequence
  Synthetic DNA
taatacgacgccctagag

SEQ ID NO: 2027 - DNA, 18 bp, Artificial Sequence
  Synthetic DNA
taatacgactcacaatca

SEQ ID NO: 2028 - DNA, 18 bp, Artificial Sequence
  Synthetic DNA
taatacgactcactcaat

SEQ ID NO: 2029 - DNA, 18 bp, Artificial Sequence
  Synthetic DNA
taatacgactcactccac

SEQ ID NO: 2030 - DNA, 18 bp, Artificial Sequence
  Synthetic DNA
taatacgactcattctat

SEQ ID NO: 2031 - DNA, 18 bp, Artificial Sequence
  Synthetic DNA
taatacgactcgatataa

SEQ ID NO: 2032 - DNA, 18 bp, Artificial Sequence
  Synthetic DNA
taatacgactggctacag

SEQ ID NO: 2033 - DNA, 18 bp, Artificial Sequence
  Synthetic DNA
taatacgacttacgagag

SEQ ID NO: 2034 - DNA, 18 bp, Artificial Sequence
  Synthetic DNA
taatacgacttactacat

SEQ ID NO: 2035 - DNA, 18 bp, Artificial Sequence
  Synthetic DNA
taatacgacttactatca

SEQ ID NO: 2036 - DNA, 18 bp, Artificial Sequence
  Synthetic DNA
taatacgagacactagag

SEQ ID NO: 2037 - DNA, 18 bp, Artificial Sequence
  Synthetic DNA
taatacgccgccctatag

SEQ ID NO: 2038 - DNA, 18 bp, Artificial Sequence
  Synthetic DNA
taatacgcctcactaaaa

SEQ ID NO: 2039 - DNA, 18 bp, Artificial Sequence
  Synthetic DNA
taatacgcctcagtgtag

SEQ ID NO: 2040 - DNA, 18 bp, Artificial Sequence
  Synthetic DNA
taatacgcgtcactatat

SEQ ID NO: 2041 - DNA, 18 bp, Artificial Sequence
  Synthetic DNA
taatacggctcactattc

SEQ ID NO: 2042 - DNA, 18 bp, Artificial Sequence
  Synthetic DNA
taatacgtctcaccatat

SEQ ID NO: 2043 - DNA, 18 bp, Artificial Sequence
  Synthetic DNA
taatacgtctcactaaat

SEQ ID NO: 2044 - DNA, 18 bp, Artificial Sequence
  Synthetic DNA
taatacgtctcgctatat

SEQ ID NO: 2045 - DNA, 18 bp, Artificial Sequence
  Synthetic DNA
taatacgtctctctatac

SEQ ID NO: 2046 - DNA, 18 bp, Artificial Sequence
  Synthetic DNA
taatagaactcactatat

SEQ ID NO: 2047 - DNA, 18 bp, Artificial Sequence
  Synthetic DNA
taataggacccactataa

SEQ ID NO: 2048 - DNA, 18 bp, Artificial Sequence
  Synthetic DNA
taataggactcacgatgg

SEQ ID NO: 2049 - DNA, 18 bp, Artificial Sequence
  Synthetic DNA
taataggactgacgatag

SEQ ID NO: 2050 - DNA, 18 bp, Artificial Sequence
  Synthetic DNA
taatatgactcactatga

SEQ ID NO: 2051 - DNA, 18 bp, Artificial Sequence
  Synthetic DNA
taatatgactcactctat

SEQ ID NO: 2052 - DNA, 18 bp, Artificial Sequence
  Synthetic DNA
taatcagactcactatat

SEQ ID NO: 2053 - DNA, 18 bp, Artificial Sequence
  Synthetic DNA
taatccgactcaccatgg

SEQ ID NO: 2054 - DNA, 18 bp, Artificial Sequence
  Synthetic DNA
taatccgtctcactatat

SEQ ID NO: 2055 - DNA, 18 bp, Artificial Sequence
  Synthetic DNA
taatgcgactcactattt

SEQ ID NO: 2056 - DNA, 18 bp, Artificial Sequence
  Synthetic DNA
taatgcgactcagtataa

SEQ ID NO: 2057 - DNA, 18 bp, Artificial Sequence
  Synthetic DNA
taatgcgcctcactatat

SEQ ID NO: 2058 - DNA, 18 bp, Artificial Sequence
  Synthetic DNA
taatgggactcactagag

SEQ ID NO: 2059 - DNA, 18 bp, Artificial Sequence
  Synthetic DNA
tactacgactcactttaa

SEQ ID NO: 2060 - DNA, 18 bp, Artificial Sequence
  Synthetic DNA
tactacgactctctataa

SEQ ID NO: 2061 - DNA, 18 bp, Artificial Sequence
  Synthetic DNA
tagtacgaatcactgtag

SEQ ID NO: 2062 - DNA, 18 bp, Artificial Sequence
  Synthetic DNA
tagtacgactcaccgtag

SEQ ID NO: 2063 - DNA, 18 bp, Artificial Sequence
  Synthetic DNA
tagtacgactcactatga

SEQ ID NO: 2064 - DNA, 18 bp, Artificial Sequence
  Synthetic DNA
tattacgactcactgtaa

SEQ ID NO: 2065 - DNA, 18 bp, Artificial Sequence
  Synthetic DNA
tattacgattcactatat

SEQ ID NO: 2066 - DNA, 18 bp, Artificial Sequence
  Synthetic DNA
tattactactcactatac

SEQ ID NO: 2067 - DNA, 18 bp, Artificial Sequence
  Synthetic DNA
tcagacgcctcactatag

SEQ ID NO: 2068 - DNA, 18 bp, Artificial Sequence
  Synthetic DNA
tcatacgacgcactaaag

SEQ ID NO: 2069 - DNA, 18 bp, Artificial Sequence
  Synthetic DNA
tcatacgtctcactataa

SEQ ID NO: 2070 - DNA, 18 bp, Artificial Sequence
  Synthetic DNA
tcatgcgactccctatag

SEQ ID NO: 2071 - DNA, 18 bp, Artificial Sequence
  Synthetic DNA
tgataagactgactatag

SEQ ID NO: 2072 - DNA, 18 bp, Artificial Sequence
  Synthetic DNA
tgatacgtctcactataa

SEQ ID NO: 2073 - DNA, 18 bp, Artificial Sequence
  Synthetic DNA
tgataggactcactataa

SEQ ID NO: 2074 - DNA, 18 bp, Artificial Sequence
  Synthetic DNA
tgatctgactcactatag

SEQ ID NO: 2075 - DNA, 18 bp, Artificial Sequence
  Synthetic DNA
tgattcgactcactatat

SEQ ID NO: 2076 - DNA, 18 bp, Artificial Sequence
  Synthetic DNA
ttatacgacacactatac

SEQ ID NO: 2077 - DNA, 18 bp, Artificial Sequence
  Synthetic DNA
ttatacgactcaatataa

SEQ ID NO: 2078 - DNA, 18 bp, Artificial Sequence
  Synthetic DNA
ttatacgactcactaaac

SEQ ID NO: 2079 - DNA, 18 bp, Artificial Sequence
  Synthetic DNA
ttatacgactcactacat

SEQ ID NO: 2080 - DNA, 18 bp, Artificial Sequence
  Synthetic DNA
ttatacgcctcactatac

SEQ ID NO: 2081 - DNA, 18 bp, Artificial Sequence
  Synthetic DNA
ttatgcgactcactatat

SEQ ID NO: 2082 - DNA, 18 bp, Artificial Sequence
  Synthetic DNA
taataggtctcactaaag

SEQ ID NO: 2083 - DNA, 18 bp, Artificial Sequence
  Synthetic DNA
tattacaactcactctag

SEQ ID NO: 2084 - DNA, 18 bp, Artificial Sequence
  Synthetic DNA
caataggactcactattg

SEQ ID NO: 2085 - DNA, 18 bp, Artificial Sequence
  Synthetic DNA
ttataagactcgctatag

SEQ ID NO: 2086 - DNA, 18 bp, Artificial Sequence
  Synthetic DNA
taataggactcacttaag

SEQ ID NO: 2087 - DNA, 18 bp, Artificial Sequence
  Synthetic DNA
ttatccgactcactgtag

SEQ ID NO: 2088 - DNA, 18 bp, Artificial Sequence
  Synthetic DNA
taatgcaactcgctatag

SEQ ID NO: 2089 - DNA, 18 bp, Artificial Sequence
  Synthetic DNA
taatgcgactcactaagg

SEQ ID NO: 2090 - DNA, 18 bp, Artificial Sequence
  Synthetic DNA
caatacggctcgctatag

SEQ ID NO: 2091 - DNA, 18 bp, Artificial Sequence
  Synthetic DNA
caccacgactcactatag

SEQ ID NO: 2092 - DNA, 18 bp, Artificial Sequence
  Synthetic DNA
gaatacgactcaccaaag

SEQ ID NO: 2093 - DNA, 18 bp, Artificial Sequence
  Synthetic DNA
taattcgactcagtctag

SEQ ID NO: 2094 - DNA, 18 bp, Artificial Sequence
  Synthetic DNA
tattacgcatcactatag

SEQ ID NO: 2095 - DNA, 18 bp, Artificial Sequence
  Synthetic DNA
taaagcgactcactttag

SEQ ID NO: 2096 - DNA, 18 bp, Artificial Sequence
  Synthetic DNA
tagtacgactctctctag

SEQ ID NO: 2097 - DNA, 18 bp, Artificial Sequence
  Synthetic DNA
taataagcctcactattg

SEQ ID NO: 2098 - DNA, 18 bp, Artificial Sequence
  Synthetic DNA
taatttgactcactagag

SEQ ID NO: 2099 - DNA, 18 bp, Artificial Sequence
  Synthetic DNA
taaaacgactcgctaaag

SEQ ID NO: 2100 - DNA, 18 bp, Artificial Sequence
  Synthetic DNA
taattcgactcgctatgg

SEQ ID NO: 2101 - DNA, 18 bp, Artificial Sequence
  Synthetic DNA
taataaaactcactaaag

SEQ ID NO: 2102 - DNA, 18 bp, Artificial Sequence
  Synthetic DNA
ctatacgtctcactatag

SEQ ID NO: 2103 - DNA, 18 bp, Artificial Sequence
  Synthetic DNA
tgttacgcctcactatag

SEQ ID NO: 2104 - DNA, 18 bp, Artificial Sequence
  Synthetic DNA
taatacgtctcactaccg

SEQ ID NO: 2105 - DNA, 18 bp, Artificial Sequence
  Synthetic DNA
taaaaccgctcactatag

SEQ ID NO: 2106 - DNA, 18 bp, Artificial Sequence
  Synthetic DNA
taatcccgctcactatag

SEQ ID NO: 2107 - DNA, 18 bp, Artificial Sequence
  Synthetic DNA
taatgcgcatcactatag

SEQ ID NO: 2108 - DNA, 18 bp, Artificial Sequence
  Synthetic DNA
caataggactcactttag

SEQ ID NO: 2109 - DNA, 18 bp, Artificial Sequence
  Synthetic DNA
taatctgactcactaaag

SEQ ID NO: 2110 - DNA, 18 bp, Artificial Sequence
  Synthetic DNA
tattaggtctcactatag

SEQ ID NO: 2111 - DNA, 18 bp, Artificial Sequence
  Synthetic DNA
taatccaactcactacag

SEQ ID NO: 2112 - DNA, 18 bp, Artificial Sequence
  Synthetic DNA
taatacaactcgctctag

SEQ ID NO: 2113 - DNA, 18 bp, Artificial Sequence
  Synthetic DNA
taatccgccttactatag

SEQ ID NO: 2114 - DNA, 18 bp, Artificial Sequence
  Synthetic DNA
taatagaactcactaaag

SEQ ID NO: 2115 - DNA, 18 bp, Artificial Sequence
  Synthetic DNA
taattcgacgcactaaag

SEQ ID NO: 2116 - DNA, 18 bp, Artificial Sequence
  Synthetic DNA
tatttcgactcactagag

SEQ ID NO: 2117 - DNA, 18 bp, Artificial Sequence
  Synthetic DNA
taataagacccaccatag

SEQ ID NO: 2118 - DNA, 18 bp, Artificial Sequence
  Synthetic DNA
taatacgactcgctccag

SEQ ID NO: 2119 - DNA, 18 bp, Artificial Sequence
  Synthetic DNA
tgatacgagtcactattg

SEQ ID NO: 2120 - DNA, 18 bp, Artificial Sequence
  Synthetic DNA
taaatcgactcactgtag

SEQ ID NO: 2121 - DNA, 18 bp, Artificial Sequence
  Synthetic DNA
ttatacgactcagtacag

SEQ ID NO: 2122 - DNA, 18 bp, Artificial Sequence
  Synthetic DNA
aaattcgactcactctag

SEQ ID NO: 2123 - DNA, 18 bp, Artificial Sequence
  Synthetic DNA
taatgcgactcacgaaag

SEQ ID NO: 2124 - DNA, 18 bp, Artificial Sequence
  Synthetic DNA
taaaacggctcaccatag

SEQ ID NO: 2125 - DNA, 18 bp, Artificial Sequence
  Synthetic DNA
gaaaacgtctcactatag

SEQ ID NO: 2126 - DNA, 18 bp, Artificial Sequence
  Synthetic DNA
gtaaacgactcactatag

SEQ ID NO: 2127 - DNA, 18 bp, Artificial Sequence
  Synthetic DNA
taatgcgactcactaacg

SEQ ID NO: 2128 - DNA, 18 bp, Artificial Sequence
  Synthetic DNA
tgttacgtctcactatag

SEQ ID NO: 2129 - DNA, 18 bp, Artificial Sequence
  Synthetic DNA
aaaaacgactcactctag

SEQ ID NO: 2130 - DNA, 18 bp, Artificial Sequence
  Synthetic DNA
taataaggctcactattg

SEQ ID NO: 2131 - DNA, 18 bp, Artificial Sequence
  Synthetic DNA
tagtacgactcgctattg

SEQ ID NO: 2132 - DNA, 18 bp, Artificial Sequence
  Synthetic DNA
taattggtctcactatag

SEQ ID NO: 2133 - DNA, 18 bp, Artificial Sequence
  Synthetic DNA
caatacaactcgctatag

SEQ ID NO: 2134 - DNA, 18 bp, Artificial Sequence
  Synthetic DNA
tgttacgactcgctatag

SEQ ID NO: 2135 - DNA, 18 bp, Artificial Sequence
  Synthetic DNA
tgttgcgactcactatag

SEQ ID NO: 2136 - DNA, 18 bp, Artificial Sequence
  Synthetic DNA
ttattcgtctcactatag

SEQ ID NO: 2137 - DNA, 18 bp, Artificial Sequence
  Synthetic DNA
taattcgactcactaacg

SEQ ID NO: 2138 - DNA, 18 bp, Artificial Sequence
  Synthetic DNA
taatccgactcgctatgg

SEQ ID NO: 2139 - DNA, 18 bp, Artificial Sequence
  Synthetic DNA
taaaacgactcagtgtag

SEQ ID NO: 2140 - DNA, 18 bp, Artificial Sequence
  Synthetic DNA
taatgcgtctcactatcg

SEQ ID NO: 2141 - DNA, 18 bp, Artificial Sequence
  Synthetic DNA
taatgcaactcaccatag

SEQ ID NO: 2142 - DNA, 18 bp, Artificial Sequence
  Synthetic DNA
ttataggactcactatcg

SEQ ID NO: 2143 - DNA, 18 bp, Artificial Sequence
  Synthetic DNA
taataggactcagtaaag

SEQ ID NO: 2144 - DNA, 18 bp, Artificial Sequence
  Synthetic DNA
taattcgactcactcttg

SEQ ID NO: 2145 - DNA, 18 bp, Artificial Sequence
  Synthetic DNA
ttatacgactcgctaaag

SEQ ID NO: 2146 - DNA, 18 bp, Artificial Sequence
  Synthetic DNA
tatttcgactcactatcg

SEQ ID NO: 2147 - DNA, 18 bp, Artificial Sequence
  Synthetic DNA
aagtacgactcactgtag

SEQ ID NO: 2148 - DNA, 18 bp, Artificial Sequence
  Synthetic DNA
taatacgcctcacggtag

SEQ ID NO: 2149 - DNA, 18 bp, Artificial Sequence
  Synthetic DNA
aaataggactcgctatag

SEQ ID NO: 2150 - DNA, 18 bp, Artificial Sequence
  Synthetic DNA
taatgggactcactacag

SEQ ID NO: 2151 - DNA, 18 bp, Artificial Sequence
  Synthetic DNA
aaatacgcttcactatag

SEQ ID NO: 2152 - DNA, 18 bp, Artificial Sequence
  Synthetic DNA
aaatgcgactcgctatag

SEQ ID NO: 2153 - DNA, 18 bp, Artificial Sequence
  Synthetic DNA
taataagactcactactg

SEQ ID NO: 2154 - DNA, 18 bp, Artificial Sequence
  Synthetic DNA
taatgggactcactctag

SEQ ID NO: 2155 - DNA, 18 bp, Artificial Sequence
  Synthetic DNA
taattcgtctcactacag

SEQ ID NO: 2156 - DNA, 18 bp, Artificial Sequence
  Synthetic DNA
aaatgcgactcactagag

SEQ ID NO: 2157 - DNA, 18 bp, Artificial Sequence
  Synthetic DNA
taatacgtcccactatcg

SEQ ID NO: 2158 - DNA, 18 bp, Artificial Sequence
  Synthetic DNA
taaagcgactcgctatag

SEQ ID NO: 2159 - DNA, 18 bp, Artificial Sequence
  Synthetic DNA
ttatacaactcactacag

SEQ ID NO: 2160 - DNA, 18 bp, Artificial Sequence
  Synthetic DNA
aaatgcgactcactattg

SEQ ID NO: 2161 - DNA, 18 bp, Artificial Sequence
  Synthetic DNA
tattgcgactcgctatag

SEQ ID NO: 2162 - DNA, 18 bp, Artificial Sequence
  Synthetic DNA
taaaaggactcactaaag

SEQ ID NO: 2163 - DNA, 18 bp, Artificial Sequence
  Synthetic DNA
tactacgtctcactacag

SEQ ID NO: 2164 - DNA, 18 bp, Artificial Sequence
  Synthetic DNA
taatacgactcggtattg

SEQ ID NO: 2165 - DNA, 18 bp, Artificial Sequence
  Synthetic DNA
taattcgactcactgaag

SEQ ID NO: 2166 - DNA, 18 bp, Artificial Sequence
  Synthetic DNA
taatacggctctctattg

SEQ ID NO: 2167 - DNA, 18 bp, Artificial Sequence
  Synthetic DNA
taattcgactcgctgtag

SEQ ID NO: 2168 - DNA, 18 bp, Artificial Sequence
  Synthetic DNA
taattcggctcactctag

SEQ ID NO: 2169 - DNA, 18 bp, Artificial Sequence
  Synthetic DNA
ttaaacgactcactatcg

SEQ ID NO: 2170 - DNA, 18 bp, Artificial Sequence
  Synthetic DNA
taataagcgtcactatag

SEQ ID NO: 2171 - DNA, 18 bp, Artificial Sequence
  Synthetic DNA
taatatgactcgctattg

SEQ ID NO: 2172 - DNA, 18 bp, Artificial Sequence
  Synthetic DNA
taatacgtcccactacag

SEQ ID NO: 2173 - DNA, 18 bp, Artificial Sequence
  Synthetic DNA
ttatacgactcgctctag

SEQ ID NO: 2174 - DNA, 18 bp, Artificial Sequence
  Synthetic DNA
caataggactcactagag

SEQ ID NO: 2175 - DNA, 18 bp, Artificial Sequence
  Synthetic DNA
tagtacgactcgctatcg

SEQ ID NO: 2176 - DNA, 18 bp, Artificial Sequence
  Synthetic DNA
caataggactcactatcg

SEQ ID NO: 2177 - DNA, 18 bp, Artificial Sequence
  Synthetic DNA
taaaacgtctcactatat

SEQ ID NO: 2178 - DNA, 18 bp, Artificial Sequence
  Synthetic DNA
taatacaactcactggag

SEQ ID NO: 2179 - DNA, 18 bp, Artificial Sequence
  Synthetic DNA
taatacgaaccaccatag

SEQ ID NO: 2180 - DNA, 18 bp, Artificial Sequence
  Synthetic DNA
taatacgacacactaggg

SEQ ID NO: 2181 - DNA, 18 bp, Artificial Sequence
  Synthetic DNA
taatactactcaatataa

SEQ ID NO: 2182 - DNA, 18 bp, Artificial Sequence
  Synthetic DNA
taatccgactcgcgatag

SEQ ID NO: 2183 - DNA, 18 bp, Artificial Sequence
  Synthetic DNA
taatcgcactcactatag

SEQ ID NO: 2184 - DNA, 18 bp, Artificial Sequence
  Synthetic DNA
taatgcaactcactatcg

SEQ ID NO: 2185 - DNA, 18 bp, Artificial Sequence
  Synthetic DNA
tactacgactcactcgag

SEQ ID NO: 2186 - DNA, 18 bp, Artificial Sequence
  Synthetic DNA
tattacgagtcactagag

SEQ ID NO: 2187 - DNA, 18 bp, Artificial Sequence
  Synthetic DNA
tattgcgactcactatat

SEQ ID NO: 2188 - DNA, 18 bp, Artificial Sequence
  Synthetic DNA
tcctacgactcactatgg

SEQ ID NO: 2189 - DNA, 18 bp, Artificial Sequence
  Synthetic DNA
tgatacgagtcgctatag

SEQ ID NO: 2190 - DNA, 18 bp, Artificial Sequence
  Synthetic DNA
taatacgactcacttctg

SEQ ID NO: 2191 - DNA, 18 bp, Artificial Sequence
  Synthetic DNA
taattggactcactttag

SEQ ID NO: 2192 - DNA, 18 bp, Artificial Sequence
  Synthetic DNA
tgttacaactcactatag

SEQ ID NO: 2193 - DNA, 18 bp, Artificial Sequence
  Synthetic DNA
taatacgacacactactg

SEQ ID NO: 2194 - DNA, 18 bp, Artificial Sequence
  Synthetic DNA
tattacgactcgctacag

SEQ ID NO: 2195 - DNA, 18 bp, Artificial Sequence
  Synthetic DNA
taataagactcgctaaag

SEQ ID NO: 2196 - DNA, 18 bp, Artificial Sequence
  Synthetic DNA
taaaacgactcaccgtag

SEQ ID NO: 2197 - DNA, 18 bp, Artificial Sequence
  Synthetic DNA
tagtgcgactcactacag

SEQ ID NO: 2198 - DNA, 18 bp, Artificial Sequence
  Synthetic DNA
ttttacgactcagtatag

SEQ ID NO: 2199 - DNA, 18 bp, Artificial Sequence
  Synthetic DNA
tcattcgactcactgtag

SEQ ID NO: 2200 - DNA, 18 bp, Artificial Sequence
  Synthetic DNA
taatagaactcactatcg

SEQ ID NO: 2201 - DNA, 18 bp, Artificial Sequence
  Synthetic DNA
taatcagcctcactatag

SEQ ID NO: 2202 - DNA, 18 bp, Artificial Sequence
  Synthetic DNA
taatctgcctcactatag

SEQ ID NO: 2203 - DNA, 18 bp, Artificial Sequence
  Synthetic DNA
tattacgcctcactatgg

SEQ ID NO: 2204 - DNA, 18 bp, Artificial Sequence
  Synthetic DNA
ttatacgcctcactctag

SEQ ID NO: 2205 - DNA, 18 bp, Artificial Sequence
  Synthetic DNA
taatttgactcactacag

SEQ ID NO: 2206 - DNA, 18 bp, Artificial Sequence
  Synthetic DNA
taacacgactcacgattg

SEQ ID NO: 2207 - DNA, 18 bp, Artificial Sequence
  Synthetic DNA
taaagcgactcacgatag

SEQ ID NO: 2208 - DNA, 18 bp, Artificial Sequence
  Synthetic DNA
taatccgactcacggtag

SEQ ID NO: 2209 - DNA, 18 bp, Artificial Sequence
  Synthetic DNA
tataacgactcactacag

SEQ ID NO: 2210 - DNA, 18 bp, Artificial Sequence
  Synthetic DNA
taatacaactcactctcg

SEQ ID NO: 2211 - DNA, 18 bp, Artificial Sequence
  Synthetic DNA
taacacgactcactactg

SEQ ID NO: 2212 - DNA, 18 bp, Artificial Sequence
  Synthetic DNA
taatcagactcactattg

SEQ ID NO: 2213 - DNA, 18 bp, Artificial Sequence
  Synthetic DNA
ttatacaactcactttag

SEQ ID NO: 2214 - DNA, 18 bp, Artificial Sequence
  Synthetic DNA
ttatacaactcactctag

SEQ ID NO: 2215 - DNA, 18 bp, Artificial Sequence
  Synthetic DNA
aaataggactcactatcg

SEQ ID NO: 2216 - DNA, 18 bp, Artificial Sequence
  Synthetic DNA
caacacgtctcactatag

SEQ ID NO: 2217 - DNA, 18 bp, Artificial Sequence
  Synthetic DNA
gaatacgactcgctaaag

SEQ ID NO: 2218 - DNA, 18 bp, Artificial Sequence
  Synthetic DNA
aaatacgactcaccacag

SEQ ID NO: 2219 - DNA, 18 bp, Artificial Sequence
  Synthetic DNA
taaagggactcactatag

SEQ ID NO: 2220 - DNA, 18 bp, Artificial Sequence
  Synthetic DNA
taatacaactcacgttag

SEQ ID NO: 2221 - DNA, 18 bp, Artificial Sequence
  Synthetic DNA
tcatagaactcactatag

SEQ ID NO: 2222 - DNA, 18 bp, Artificial Sequence
  Synthetic DNA
caatacgactcactgtcg

SEQ ID NO: 2223 - DNA, 18 bp, Artificial Sequence
  Synthetic DNA
ttattggactcactatag

SEQ ID NO: 2224 - DNA, 18 bp, Artificial Sequence
  Synthetic DNA
taattcgactcgatatag

SEQ ID NO: 2225 - DNA, 18 bp, Artificial Sequence
  Synthetic DNA
ttatacgtctcactagag

SEQ ID NO: 2226 - DNA, 18 bp, Artificial Sequence
  Synthetic DNA
taatgggactcactttag

SEQ ID NO: 2227 - DNA, 18 bp, Artificial Sequence
  Synthetic DNA
ttatacgactcagtattg

SEQ ID NO: 2228 - DNA, 18 bp, Artificial Sequence
  Synthetic DNA
taataaagctcactatag

SEQ ID NO: 2229 - DNA, 18 bp, Artificial Sequence
  Synthetic DNA
ttatccgactcactctag

SEQ ID NO: 2230 - DNA, 18 bp, Artificial Sequence
  Synthetic DNA
taatacgcctcagaatag

SEQ ID NO: 2231 - DNA, 18 bp, Artificial Sequence
  Synthetic DNA
taatataactcacgatag

SEQ ID NO: 2232 - DNA, 18 bp, Artificial Sequence
  Synthetic DNA
tgaaccgactcactatag

SEQ ID NO: 2233 - DNA, 18 bp, Artificial Sequence
  Synthetic DNA
taatagcactcactatcg

SEQ ID NO: 2234 - DNA, 18 bp, Artificial Sequence
  Synthetic DNA
taatacaactcactaacg

SEQ ID NO: 2235 - DNA, 18 bp, Artificial Sequence
  Synthetic DNA
taataagcctcactaaag

SEQ ID NO: 2236 - DNA, 18 bp, Artificial Sequence
  Synthetic DNA
taacaagactcagtatag

SEQ ID NO: 2237 - DNA, 18 bp, Artificial Sequence
  Synthetic DNA
taacgcgactcagtatag

SEQ ID NO: 2238 - DNA, 18 bp, Artificial Sequence
  Synthetic DNA
tcgtacgactcactacag

SEQ ID NO: 2239 - DNA, 18 bp, Artificial Sequence
  Synthetic DNA
caatacgactcactgttg

SEQ ID NO: 2240 - DNA, 18 bp, Artificial Sequence
  Synthetic DNA
taattcgcctcaccatag

SEQ ID NO: 2241 - DNA, 18 bp, Artificial Sequence
  Synthetic DNA
taataaaactcactacag

SEQ ID NO: 2242 - DNA, 18 bp, Artificial Sequence
  Synthetic DNA
taatgcgactcactgtcg

SEQ ID NO: 2243 - DNA, 18 bp, Artificial Sequence
  Synthetic DNA
taaaaagactcactacag

SEQ ID NO: 2244 - DNA, 18 bp, Artificial Sequence
  Synthetic DNA
taataggactcacgaaag

SEQ ID NO: 2245 - DNA, 18 bp, Artificial Sequence
  Synthetic DNA
taataggactcaatctag

SEQ ID NO: 2246 - DNA, 18 bp, Artificial Sequence
  Synthetic DNA
taatgcgaatcaccatag

SEQ ID NO: 2247 - DNA, 18 bp, Artificial Sequence
  Synthetic DNA
taatgcgattcactatcg

SEQ ID NO: 2248 - DNA, 18 bp, Artificial Sequence
  Synthetic DNA
taatgggactcactattg

SEQ ID NO: 2249 - DNA, 18 bp, Artificial Sequence
  Synthetic DNA
tattacgactctctataa

SEQ ID NO: 2250 - DNA, 18 bp, Artificial Sequence
  Synthetic DNA
tgatacgacacactatgg

SEQ ID NO: 2251 - DNA, 18 bp, Artificial Sequence
  Synthetic DNA
gattacgactcactaaag

SEQ ID NO: 2252 - DNA, 18 bp, Artificial Sequence
  Synthetic DNA
ttataggactcaccatag

SEQ ID NO: 2253 - DNA, 18 bp, Artificial Sequence
  Synthetic DNA
caatccgactcactattg

SEQ ID NO: 2254 - DNA, 18 bp, Artificial Sequence
  Synthetic DNA
taacacgcctcactattg

SEQ ID NO: 2255 - DNA, 18 bp, Artificial Sequence
  Synthetic DNA
caatacgactcacttaag

SEQ ID NO: 2256 - DNA, 18 bp, Artificial Sequence
  Synthetic DNA
ttttgcgactcactatag

SEQ ID NO: 2257 - DNA, 18 bp, Artificial Sequence
  Synthetic DNA
ttatacgactcactctcg

SEQ ID NO: 2258 - DNA, 18 bp, Artificial Sequence
  Synthetic DNA
taatacgactcgctgttg

SEQ ID NO: 2259 - DNA, 18 bp, Artificial Sequence
  Synthetic DNA
taaaacgactcagtatcg

SEQ ID NO: 2260 - DNA, 18 bp, Artificial Sequence
  Synthetic DNA
taatccaacgcactatag

SEQ ID NO: 2261 - DNA, 18 bp, Artificial Sequence
  Synthetic DNA
taaaacgacgcactatcg

SEQ ID NO: 2262 - DNA, 18 bp, Artificial Sequence
  Synthetic DNA
taattggactcactattg

SEQ ID NO: 2263 - DNA, 18 bp, Artificial Sequence
  Synthetic DNA
taatgcgactcactttgg

SEQ ID NO: 2264 - DNA, 18 bp, Artificial Sequence
  Synthetic DNA
ttaaacgactcacgatag

SEQ ID NO: 2265 - DNA, 18 bp, Artificial Sequence
  Synthetic DNA
tttcacgactcactatag

SEQ ID NO: 2266 - DNA, 18 bp, Artificial Sequence
  Synthetic DNA
caatgcgactcactaaag

SEQ ID NO: 2267 - DNA, 18 bp, Artificial Sequence
  Synthetic DNA
taaaacgcatcactatag

SEQ ID NO: 2268 - DNA, 18 bp, Artificial Sequence
  Synthetic DNA
tagtacgactcaccattg

SEQ ID NO: 2269 - DNA, 18 bp, Artificial Sequence
  Synthetic DNA
ttatcagactcactatag

SEQ ID NO: 2270 - DNA, 18 bp, Artificial Sequence
  Synthetic DNA
caatgcgtctcactatag

SEQ ID NO: 2271 - DNA, 18 bp, Artificial Sequence
  Synthetic DNA
aaattcgactcacgatag

SEQ ID NO: 2272 - DNA, 18 bp, Artificial Sequence
  Synthetic DNA
taattcgactcactcaag

SEQ ID NO: 2273 - DNA, 18 bp, Artificial Sequence
  Synthetic DNA
ttatacgtctcactatcg

SEQ ID NO: 2274 - DNA, 18 bp, Artificial Sequence
  Synthetic DNA
taatacgactctgtaaag

SEQ ID NO: 2275 - DNA, 18 bp, Artificial Sequence
  Synthetic DNA
taatccgactcgctaaag

SEQ ID NO: 2276 - DNA, 18 bp, Artificial Sequence
  Synthetic DNA
tataacgactcactctag

SEQ ID NO: 2277 - DNA, 18 bp, Artificial Sequence
  Synthetic DNA
ctatacgactcactctag

SEQ ID NO: 2278 - DNA, 18 bp, Artificial Sequence
  Synthetic DNA
ttttacgactcactgtag

SEQ ID NO: 2279 - DNA, 18 bp, Artificial Sequence
  Synthetic DNA
taatactactcgctatcg

SEQ ID NO: 2280 - DNA, 18 bp, Artificial Sequence
  Synthetic DNA
taattcgactcactaggg

SEQ ID NO: 2281 - DNA, 18 bp, Artificial Sequence
  Synthetic DNA
tattacgactgactatcg

SEQ ID NO: 2282 - DNA, 18 bp, Artificial Sequence
  Synthetic DNA
ttataagactcacgatag

SEQ ID NO: 2283 - DNA, 18 bp, Artificial Sequence
  Synthetic DNA
aaatacgcctcactaaag

SEQ ID NO: 2284 - DNA, 18 bp, Artificial Sequence
  Synthetic DNA
taattcgactcacgattg

SEQ ID NO: 2285 - DNA, 18 bp, Artificial Sequence
  Synthetic DNA
taatacgactcactgacg

SEQ ID NO: 2286 - DNA, 18 bp, Artificial Sequence
  Synthetic DNA
tatagcgactcactatag

SEQ ID NO: 2287 - DNA, 18 bp, Artificial Sequence
  Synthetic DNA
aaacaggactcactatag

SEQ ID NO: 2288 - DNA, 18 bp, Artificial Sequence
  Synthetic DNA
taattcgcctcactatgg

SEQ ID NO: 2289 - DNA, 18 bp, Artificial Sequence
  Synthetic DNA
taatacgcctcacttttg

SEQ ID NO: 2290 - DNA, 18 bp, Artificial Sequence
  Synthetic DNA
taaaatgactcactatgg

SEQ ID NO: 2291 - DNA, 18 bp, Artificial Sequence
  Synthetic DNA
taataggactcactcaag

SEQ ID NO: 2292 - DNA, 18 bp, Artificial Sequence
  Synthetic DNA
taaatcgcctcactatag

SEQ ID NO: 2293 - DNA, 18 bp, Artificial Sequence
  Synthetic DNA
taattagactcactttag

SEQ ID NO: 2294 - DNA, 18 bp, Artificial Sequence
  Synthetic DNA
taattcgatgcactatag

SEQ ID NO: 2295 - DNA, 18 bp, Artificial Sequence
  Synthetic DNA
tgttacgactcactctag

SEQ ID NO: 2296 - DNA, 18 bp, Artificial Sequence
  Synthetic DNA
ctatacgactcacgatag

SEQ ID NO: 2297 - DNA, 18 bp, Artificial Sequence
  Synthetic DNA
taatacgcctcgctatcg

SEQ ID NO: 2298 - DNA, 18 bp, Artificial Sequence
  Synthetic DNA
tcatacgactcacgaaag

SEQ ID NO: 2299 - DNA, 18 bp, Artificial Sequence
  Synthetic DNA
taataccactcacgattg

SEQ ID NO: 2300 - DNA, 18 bp, Artificial Sequence
  Synthetic DNA
taatacgacgcacactag

SEQ ID NO: 2301 - DNA, 18 bp, Artificial Sequence
  Synthetic DNA
taatacgactcacgtgag

SEQ ID NO: 2302 - DNA, 18 bp, Artificial Sequence
  Synthetic DNA
taatacgcctcactacgg

SEQ ID NO: 2303 - DNA, 18 bp, Artificial Sequence
  Synthetic DNA
taattcgacgcaatatag

SEQ ID NO: 2304 - DNA, 18 bp, Artificial Sequence
  Synthetic DNA
taaaaagactcgctatag

SEQ ID NO: 2305 - DNA, 18 bp, Artificial Sequence
  Synthetic DNA
ttatgcgactcactatgg

SEQ ID NO: 2306 - DNA, 18 bp, Artificial Sequence
  Synthetic DNA
taacgcaactcactatag

SEQ ID NO: 2307 - DNA, 18 bp, Artificial Sequence
  Synthetic DNA
taattcggctcagtatag

SEQ ID NO: 2308 - DNA, 18 bp, Artificial Sequence
  Synthetic DNA
taatgcgacgcaccatag

SEQ ID NO: 2309 - DNA, 18 bp, Artificial Sequence
  Synthetic DNA
taatgctgctcactatag

SEQ ID NO: 2310 - DNA, 18 bp, Artificial Sequence
  Synthetic DNA
gaagatgactcactatag

SEQ ID NO: 2311 - DNA, 18 bp, Artificial Sequence
  Synthetic DNA
taaaacgactcacaataa

SEQ ID NO: 2312 - DNA, 18 bp, Artificial Sequence
  Synthetic DNA
taagacgactcaccctag

SEQ ID NO: 2313 - DNA, 18 bp, Artificial Sequence
  Synthetic DNA
taatacgactcacaattc

SEQ ID NO: 2314 - DNA, 18 bp, Artificial Sequence
  Synthetic DNA
taatacgactcactcaaa

SEQ ID NO: 2315 - DNA, 18 bp, Artificial Sequence
  Synthetic DNA
taatacgactcactttca

SEQ ID NO: 2316 - DNA, 18 bp, Artificial Sequence
  Synthetic DNA
taatacgactctcgctag

SEQ ID NO: 2317 - DNA, 18 bp, Artificial Sequence
  Synthetic DNA
taatacgactctctatca

SEQ ID NO: 2318 - DNA, 18 bp, Artificial Sequence
  Synthetic DNA
taatacgcctgactattg

SEQ ID NO: 2319 - DNA, 18 bp, Artificial Sequence
  Synthetic DNA
taatacggctcgctatgg

SEQ ID NO: 2320 - DNA, 18 bp, Artificial Sequence
  Synthetic DNA
taatgcgactcactacgg

SEQ ID NO: 2321 - DNA, 18 bp, Artificial Sequence
  Synthetic DNA
tagtacgactccctacag

SEQ ID NO: 2322 - DNA, 18 bp, Artificial Sequence
  Synthetic DNA
tattacgacacactataa

SEQ ID NO: 2323 - DNA, 18 bp, Artificial Sequence
  Synthetic DNA
aaatacgactcacaatat

SEQ ID NO: 2324 - DNA, 18 bp, Artificial Sequence
  Synthetic DNA
aaatacgactcactacat

SEQ ID NO: 2325 - DNA, 18 bp, Artificial Sequence
  Synthetic DNA
aaatacgactcactttaa

SEQ ID NO: 2326 - DNA, 18 bp, Artificial Sequence
  Synthetic DNA
aaatacgactcactttac

SEQ ID NO: 2327 - DNA, 18 bp, Artificial Sequence
  Synthetic DNA
caagacgcctcactatag

SEQ ID NO: 2328 - DNA, 18 bp, Artificial Sequence
  Synthetic DNA
caataagactcactagag

SEQ ID NO: 2329 - DNA, 18 bp, Artificial Sequence
  Synthetic DNA
cagtacgactcactatcg

SEQ ID NO: 2330 - DNA, 18 bp, Artificial Sequence
  Synthetic DNA
gaatacgactcactgttg

SEQ ID NO: 2331 - DNA, 18 bp, Artificial Sequence
  Synthetic DNA
gaatacgactcagtacag

SEQ ID NO: 2332 - DNA, 18 bp, Artificial Sequence
  Synthetic DNA
gactacgactcactatgg

SEQ ID NO: 2333 - DNA, 18 bp, Artificial Sequence
  Synthetic DNA
gcatacgactccctatag

SEQ ID NO: 2334 - DNA, 18 bp, Artificial Sequence
  Synthetic DNA
taaaacgtctcactataa

SEQ ID NO: 2335 - DNA, 18 bp, Artificial Sequence
  Synthetic DNA
taacacgactggctatag

SEQ ID NO: 2336 - DNA, 18 bp, Artificial Sequence
  Synthetic DNA
taagcccactcactatag

SEQ ID NO: 2337 - DNA, 18 bp, Artificial Sequence
  Synthetic DNA
taataagacacactagag

SEQ ID NO: 2338 - DNA, 18 bp, Artificial Sequence
  Synthetic DNA
taataagactcactctaa

SEQ ID NO: 2339 - DNA, 18 bp, Artificial Sequence
  Synthetic DNA
taatacaactcattatac

SEQ ID NO: 2340 - DNA, 18 bp, Artificial Sequence
  Synthetic DNA
taatacaactctctataa

SEQ ID NO: 2341 - DNA, 18 bp, Artificial Sequence
  Synthetic DNA
taataccaatcactataa

SEQ ID NO: 2342 - DNA, 18 bp, Artificial Sequence
  Synthetic DNA
taatacgaatcactaaaa

SEQ ID NO: 2343 - DNA, 18 bp, Artificial Sequence
  Synthetic DNA
taatacgaatcactattt

SEQ ID NO: 2344 - DNA, 18 bp, Artificial Sequence
  Synthetic DNA
taatacgacgcaccatgg

SEQ ID NO: 2345 - DNA, 18 bp, Artificial Sequence
  Synthetic DNA
taatacgactcaatgtaa

SEQ ID NO: 2346 - DNA, 18 bp, Artificial Sequence
  Synthetic DNA
taatacgactcaccatcc

SEQ ID NO: 2347 - DNA, 18 bp, Artificial Sequence
  Synthetic DNA
taatacgactcaccctgg

SEQ ID NO: 2348 - DNA, 18 bp, Artificial Sequence
  Synthetic DNA
taatacgactcactaatt

SEQ ID NO: 2349 - DNA, 18 bp, Artificial Sequence
  Synthetic DNA
taatacgactcactcttc

SEQ ID NO: 2350 - DNA, 18 bp, Artificial Sequence
  Synthetic DNA
taatacgactcactttgc

SEQ ID NO: 2351 - DNA, 18 bp, Artificial Sequence
  Synthetic DNA
taatacgactccctgcag

SEQ ID NO: 2352 - DNA, 18 bp, Artificial Sequence
  Synthetic DNA
taatacgactccctgtac

SEQ ID NO: 2353 - DNA, 18 bp, Artificial Sequence
  Synthetic DNA
taatacgaggcactaaag

SEQ ID NO: 2354 - DNA, 18 bp, Artificial Sequence
  Synthetic DNA
taatacgagtcaccatcg

SEQ ID NO: 2355 - DNA, 18 bp, Artificial Sequence
  Synthetic DNA
taatacgagtcacgatgg

SEQ ID NO: 2356 - DNA, 18 bp, Artificial Sequence
  Synthetic DNA
taatacgagtcgctatcg

SEQ ID NO: 2357 - DNA, 18 bp, Artificial Sequence
  Synthetic DNA
taatacgattcactaaac

SEQ ID NO: 2358 - DNA, 18 bp, Artificial Sequence
  Synthetic DNA
taatacgcctcactttaa

SEQ ID NO: 2359 - DNA, 18 bp, Artificial Sequence
  Synthetic DNA
taatacgcctcactttac

SEQ ID NO: 2360 - DNA, 18 bp, Artificial Sequence
  Synthetic DNA
taatacgcctcagtatcg

SEQ ID NO: 2361 - DNA, 18 bp, Artificial Sequence
  Synthetic DNA
taatacgtatcactatat

SEQ ID NO: 2362 - DNA, 18 bp, Artificial Sequence
  Synthetic DNA
taatacgtctcactacat

SEQ ID NO: 2363 - DNA, 18 bp, Artificial Sequence
  Synthetic DNA
taatactactcaatatac

SEQ ID NO: 2364 - DNA, 18 bp, Artificial Sequence
  Synthetic DNA
taatactattcactataa

SEQ ID NO: 2365 - DNA, 18 bp, Artificial Sequence
  Synthetic DNA
taataggactcactcgag

SEQ ID NO: 2366 - DNA, 18 bp, Artificial Sequence
  Synthetic DNA
taataggactcactttat

SEQ ID NO: 2367 - DNA, 18 bp, Artificial Sequence
  Synthetic DNA
taataggacttactacag

SEQ ID NO: 2368 - DNA, 18 bp, Artificial Sequence
  Synthetic DNA
taatagtagtcactatag

SEQ ID NO: 2369 - DNA, 18 bp, Artificial Sequence
  Synthetic DNA
taatatgacgcaccatag

SEQ ID NO: 2370 - DNA, 18 bp, Artificial Sequence
  Synthetic DNA
taatatgacgcagtatag

SEQ ID NO: 2371 - DNA, 18 bp, Artificial Sequence
  Synthetic DNA
taatccgactcactctgg

SEQ ID NO: 2372 - DNA, 18 bp, Artificial Sequence
  Synthetic DNA
taatccgactcactgtaa

SEQ ID NO: 2373 - DNA, 18 bp, Artificial Sequence
  Synthetic DNA
taatccgagtcagtatag

SEQ ID NO: 2374 - DNA, 18 bp, Artificial Sequence
  Synthetic DNA
taatgcgactcactatca

SEQ ID NO: 2375 - DNA, 18 bp, Artificial Sequence
  Synthetic DNA
taatgcgactcactcgag

SEQ ID NO: 2376 - DNA, 18 bp, Artificial Sequence
  Synthetic DNA
taatgcgactcactgtat

SEQ ID NO: 2377 - DNA, 18 bp, Artificial Sequence
  Synthetic DNA
taatgcgactcagtatgg

SEQ ID NO: 2378 - DNA, 18 bp, Artificial Sequence
  Synthetic DNA
taatgcgactccctgtag

SEQ ID NO: 2379 - DNA, 18 bp, Artificial Sequence
  Synthetic DNA
taatgcgcctcactatac

SEQ ID NO: 2380 - DNA, 18 bp, Artificial Sequence
  Synthetic DNA
taatgggactcactatcg

SEQ ID NO: 2381 - DNA, 18 bp, Artificial Sequence
  Synthetic DNA
taattcgactcacaatac

SEQ ID NO: 2382 - DNA, 18 bp, Artificial Sequence
  Synthetic DNA
taattcgactcactattc

SEQ ID NO: 2383 - DNA, 18 bp, Artificial Sequence
  Synthetic DNA
taatttgactcactataa

SEQ ID NO: 2384 - DNA, 18 bp, Artificial Sequence
  Synthetic DNA
tactacgagtcaccatag

SEQ ID NO: 2385 - DNA, 18 bp, Artificial Sequence
  Synthetic DNA
tagaacgactcactagag

SEQ ID NO: 2386 - DNA, 18 bp, Artificial Sequence
  Synthetic DNA
tagtaagactcactagag

SEQ ID NO: 2387 - DNA, 18 bp, Artificial Sequence
  Synthetic DNA
tatcacgactcactatat

SEQ ID NO: 2388 - DNA, 18 bp, Artificial Sequence
  Synthetic DNA
tattaagactcactatac

SEQ ID NO: 2389 - DNA, 18 bp, Artificial Sequence
  Synthetic DNA
tattacgactcaatatat

SEQ ID NO: 2390 - DNA, 18 bp, Artificial Sequence
  Synthetic DNA
tattacgactcattataa

SEQ ID NO: 2391 - DNA, 18 bp, Artificial Sequence
  Synthetic DNA
tcatacgattcactacag

SEQ ID NO: 2392 - DNA, 18 bp, Artificial Sequence
  Synthetic DNA
tcatgcgagtcactatag

SEQ ID NO: 2393 - DNA, 18 bp, Artificial Sequence
  Synthetic DNA
tcgtacgactcattatag

SEQ ID NO: 2394 - DNA, 18 bp, Artificial Sequence
  Synthetic DNA
tgatgcgactcgctatag

SEQ ID NO: 2395 - DNA, 18 bp, Artificial Sequence
  Synthetic DNA
tgattcgactcactataa

SEQ ID NO: 2396 - DNA, 18 bp, Artificial Sequence
  Synthetic DNA
ttatacgactcactctaa

SEQ ID NO: 2397 - DNA, 18 bp, Artificial Sequence
  Synthetic DNA
ttatatgactcactatat

SEQ ID NO: 2398 - DNA, 18 bp, Artificial Sequence
  Synthetic DNA
ttatccgactcacgatag

SEQ ID NO: 2399 - DNA, 18 bp, Artificial Sequence
  Synthetic DNA
ttattcgactcactatat

SEQ ID NO: 2400 - DNA, 18 bp, Artificial Sequence
  Synthetic DNA
ttctacgactcactataa

SEQ ID NO: 2401 - DNA, 18 bp, Artificial Sequence
  Synthetic DNA
ttattcgactcactacag

SEQ ID NO: 2402 - DNA, 18 bp, Artificial Sequence
  Synthetic DNA
taataagactcacttttg

SEQ ID NO: 2403 - DNA, 18 bp, Artificial Sequence
  Synthetic DNA
caataagactcactttag

SEQ ID NO: 2404 - DNA, 18 bp, Artificial Sequence
  Synthetic DNA
taatacgtcttgctatag

SEQ ID NO: 2405 - DNA, 18 bp, Artificial Sequence
  Synthetic DNA
ttatacgactcacagtag

SEQ ID NO: 2406 - DNA, 18 bp, Artificial Sequence
  Synthetic DNA
caatacgactcactcaag

SEQ ID NO: 2407 - DNA, 18 bp, Artificial Sequence
  Synthetic DNA
taaaacaactcactacag

SEQ ID NO: 2408 - DNA, 18 bp, Artificial Sequence
  Synthetic DNA
taatagcactcactaaag

SEQ ID NO: 2409 - DNA, 18 bp, Artificial Sequence
  Synthetic DNA
caatacgactcgctaaag

SEQ ID NO: 2410 - DNA, 18 bp, Artificial Sequence
  Synthetic DNA
gaatacgactcacttaag

SEQ ID NO: 2411 - DNA, 18 bp, Artificial Sequence
  Synthetic DNA
ttatacgcctcactgtag

SEQ ID NO: 2412 - DNA, 18 bp, Artificial Sequence
  Synthetic DNA
tattacgcctcactaaag

SEQ ID NO: 2413 - DNA, 18 bp, Artificial Sequence
  Synthetic DNA
tattacgactcgctaaag

SEQ ID NO: 2414 - DNA, 18 bp, Artificial Sequence
  Synthetic DNA
taataggactcgctaaag

SEQ ID NO: 2415 - DNA, 18 bp, Artificial Sequence
  Synthetic DNA
taattcgcctcactattg

SEQ ID NO: 2416 - DNA, 18 bp, Artificial Sequence
  Synthetic DNA
ttaaaggactcactatag

SEQ ID NO: 2417 - DNA, 18 bp, Artificial Sequence
  Synthetic DNA
ttatgggactcactatag

SEQ ID NO: 2418 - DNA, 18 bp, Artificial Sequence
  Synthetic DNA
taataagactcaccatcg

SEQ ID NO: 2419 - DNA, 18 bp, Artificial Sequence
  Synthetic DNA
taatatgactcactgtcg

SEQ ID NO: 2420 - DNA, 18 bp, Artificial Sequence
  Synthetic DNA
taatataactcagtatag

SEQ ID NO: 2421 - DNA, 18 bp, Artificial Sequence
  Synthetic DNA
ttataggactcagtatag

SEQ ID NO: 2422 - DNA, 18 bp, Artificial Sequence
  Synthetic DNA
taattgaactcactatag

SEQ ID NO: 2423 - DNA, 18 bp, Artificial Sequence
  Synthetic DNA
aaatacgactcgctaaag

SEQ ID NO: 2424 - DNA, 18 bp, Artificial Sequence
  Synthetic DNA
tagtacgactcgctatgg

SEQ ID NO: 2425 - DNA, 18 bp, Artificial Sequence
  Synthetic DNA
ttatacgactcagtagag

SEQ ID NO: 2426 - DNA, 18 bp, Artificial Sequence
  Synthetic DNA
aaataagactcactacag

SEQ ID NO: 2427 - DNA, 18 bp, Artificial Sequence
  Synthetic DNA
taattggactcaccatag

SEQ ID NO: 2428 - DNA, 18 bp, Artificial Sequence
  Synthetic DNA
gaattcgactcacaatag

SEQ ID NO: 2429 - DNA, 18 bp, Artificial Sequence
  Synthetic DNA
taatataactcactacag

SEQ ID NO: 2430 - DNA, 18 bp, Artificial Sequence
  Synthetic DNA
taatacgcctcactactg

SEQ ID NO: 2431 - DNA, 18 bp, Artificial Sequence
  Synthetic DNA
tcattcgactcactagag

SEQ ID NO: 2432 - DNA, 18 bp, Artificial Sequence
  Synthetic DNA
taaaacgtctcactaaag

SEQ ID NO: 2433 - DNA, 18 bp, Artificial Sequence
  Synthetic DNA
tcatgcgactcactttag

SEQ ID NO: 2434 - DNA, 18 bp, Artificial Sequence
  Synthetic DNA
taatacgtgtctctatag

SEQ ID NO: 2435 - DNA, 18 bp, Artificial Sequence
  Synthetic DNA
aaatgcgactcactgtag

SEQ ID NO: 2436 - DNA, 18 bp, Artificial Sequence
  Synthetic DNA
taatacgcatcactctag

SEQ ID NO: 2437 - DNA, 18 bp, Artificial Sequence
  Synthetic DNA
taatacgactcagttttg

SEQ ID NO: 2438 - DNA, 18 bp, Artificial Sequence
  Synthetic DNA
caatacgactcacttttg

SEQ ID NO: 2439 - DNA, 18 bp, Artificial Sequence
  Synthetic DNA
ttataggactcactaaag

SEQ ID NO: 2440 - DNA, 18 bp, Artificial Sequence
  Synthetic DNA
tattgcgactcactatcg

SEQ ID NO: 2441 - DNA, 18 bp, Artificial Sequence
  Synthetic DNA
ctatacgactcagtatag

SEQ ID NO: 2442 - DNA, 18 bp, Artificial Sequence
  Synthetic DNA
taatatcgctcactatag

SEQ ID NO: 2443 - DNA, 18 bp, Artificial Sequence
  Synthetic DNA
taatacgactcacctgag

SEQ ID NO: 2444 - DNA, 18 bp, Artificial Sequence
  Synthetic DNA
taatcggactcacgatag

SEQ ID NO: 2445 - DNA, 18 bp, Artificial Sequence
  Synthetic DNA
taatgcaactcagtatag

SEQ ID NO: 2446 - DNA, 18 bp, Artificial Sequence
  Synthetic DNA
taatgcggctcactattg

SEQ ID NO: 2447 - DNA, 18 bp, Artificial Sequence
  Synthetic DNA
gattacgactcactattg

SEQ ID NO: 2448 - DNA, 18 bp, Artificial Sequence
  Synthetic DNA
taaaacgcctcactttag

SEQ ID NO: 2449 - DNA, 18 bp, Artificial Sequence
  Synthetic DNA
taatactgctcactatcg

SEQ ID NO: 2450 - DNA, 18 bp, Artificial Sequence
  Synthetic DNA
taattcgcctcactacag

SEQ ID NO: 2451 - DNA, 18 bp, Artificial Sequence
  Synthetic DNA
taataagactctcgatag

SEQ ID NO: 2452 - DNA, 18 bp, Artificial Sequence
  Synthetic DNA
taattcgactagctatag

SEQ ID NO: 2453 - DNA, 18 bp, Artificial Sequence
  Synthetic DNA
taatacgactcactgccg

SEQ ID NO: 2454 - DNA, 18 bp, Artificial Sequence
  Synthetic DNA
taatgagcctcactatag

SEQ ID NO: 2455 - DNA, 18 bp, Artificial Sequence
  Synthetic DNA
taaaacgactcaccatcg

SEQ ID NO: 2456 - DNA, 18 bp, Artificial Sequence
  Synthetic DNA
tgatacgactcactagtg

SEQ ID NO: 2457 - DNA, 18 bp, Artificial Sequence
  Synthetic DNA
caagaggactcactatag

SEQ ID NO: 2458 - DNA, 18 bp, Artificial Sequence
  Synthetic DNA
gaatacgacacaatatag

SEQ ID NO: 2459 - DNA, 18 bp, Artificial Sequence
  Synthetic DNA
taagccgacttactatag

SEQ ID NO: 2460 - DNA, 18 bp, Artificial Sequence
  Synthetic DNA
taatacggctcgccatag

SEQ ID NO: 2461 - DNA, 18 bp, Artificial Sequence
  Synthetic DNA
ttatacgtctcactaaag

SEQ ID NO: 2462 - DNA, 18 bp, Artificial Sequence
  Synthetic DNA
tattacggctcactatcg

SEQ ID NO: 2463 - DNA, 18 bp, Artificial Sequence
  Synthetic DNA
taatacgactcacggttg

SEQ ID NO: 2464 - DNA, 18 bp, Artificial Sequence
  Synthetic DNA
caaaacgactcagtatag

SEQ ID NO: 2465 - DNA, 18 bp, Artificial Sequence
  Synthetic DNA
tcatacgactcacagtag

SEQ ID NO: 2466 - DNA, 18 bp, Artificial Sequence
  Synthetic DNA
ttatacgaatcactctag

SEQ ID NO: 2467 - DNA, 18 bp, Artificial Sequence
  Synthetic DNA
taatacaactcactgcag

SEQ ID NO: 2468 - DNA, 18 bp, Artificial Sequence
  Synthetic DNA
gaattcgcctcactatag

SEQ ID NO: 2469 - DNA, 18 bp, Artificial Sequence
  Synthetic DNA
tattacgactcactctcg

SEQ ID NO: 2470 - DNA, 18 bp, Artificial Sequence
  Synthetic DNA
taatacgcttcactattg

SEQ ID NO: 2471 - DNA, 18 bp, Artificial Sequence
  Synthetic DNA
taatcggactcactattg

SEQ ID NO: 2472 - DNA, 18 bp, Artificial Sequence
  Synthetic DNA
taaaccgactcactatcg

SEQ ID NO: 2473 - DNA, 18 bp, Artificial Sequence
  Synthetic DNA
taattcgactctgtatag

SEQ ID NO: 2474 - DNA, 18 bp, Artificial Sequence
  Synthetic DNA
taatacgtcccactaaag

SEQ ID NO: 2475 - DNA, 18 bp, Artificial Sequence
  Synthetic DNA
tataacgactcactatcg

SEQ ID NO: 2476 - DNA, 18 bp, Artificial Sequence
  Synthetic DNA
ctatacgcctcactatag

SEQ ID NO: 2477 - DNA, 18 bp, Artificial Sequence
  Synthetic DNA
taataggactcacagtag

SEQ ID NO: 2478 - DNA, 18 bp, Artificial Sequence
  Synthetic DNA
gtatacgactcgctatag

SEQ ID NO: 2479 - DNA, 18 bp, Artificial Sequence
  Synthetic DNA
taatgcgactcacaatcg

SEQ ID NO: 2480 - DNA, 18 bp, Artificial Sequence
  Synthetic DNA
ttatacgtctcactattg

SEQ ID NO: 2481 - DNA, 18 bp, Artificial Sequence
  Synthetic DNA
taatgcgattcactaaag

SEQ ID NO: 2482 - DNA, 18 bp, Artificial Sequence
  Synthetic DNA
taattcgacttactgtag

SEQ ID NO: 2483 - DNA, 18 bp, Artificial Sequence
  Synthetic DNA
taatgtgactcactaaag

SEQ ID NO: 2484 - DNA, 18 bp, Artificial Sequence
  Synthetic DNA
caatttgactcactatag

SEQ ID NO: 2485 - DNA, 18 bp, Artificial Sequence
  Synthetic DNA
caataagactcactacag

SEQ ID NO: 2486 - DNA, 18 bp, Artificial Sequence
  Synthetic DNA
taaaaggactcactgtag

SEQ ID NO: 2487 - DNA, 18 bp, Artificial Sequence
  Synthetic DNA
tattaagacgcactatag

SEQ ID NO: 2488 - DNA, 18 bp, Artificial Sequence
  Synthetic DNA
taattggactcacgatag

SEQ ID NO: 2489 - DNA, 18 bp, Artificial Sequence
  Synthetic DNA
aaatacgacgcactagag

SEQ ID NO: 2490 - DNA, 18 bp, Artificial Sequence
  Synthetic DNA
gaatacgtctcactctag

SEQ ID NO: 2491 - DNA, 18 bp, Artificial Sequence
  Synthetic DNA
taataggactcagcatag

SEQ ID NO: 2492 - DNA, 18 bp, Artificial Sequence
  Synthetic DNA
taataggtcgcactatag

SEQ ID NO: 2493 - DNA, 18 bp, Artificial Sequence
  Synthetic DNA
taatcggactcgctatag

SEQ ID NO: 2494 - DNA, 18 bp, Artificial Sequence
  Synthetic DNA
taattggactcactatcg

SEQ ID NO: 2495 - DNA, 18 bp, Artificial Sequence
  Synthetic DNA
tagtacgcctcactaaag

SEQ ID NO: 2496 - DNA, 18 bp, Artificial Sequence
  Synthetic DNA
tcctgcgactcactatag

SEQ ID NO: 2497 - DNA, 18 bp, Artificial Sequence
  Synthetic DNA
taacacgactcgctgtag

SEQ ID NO: 2498 - DNA, 18 bp, Artificial Sequence
  Synthetic DNA
taagacgactcacaatcg

SEQ ID NO: 2499 - DNA, 18 bp, Artificial Sequence
  Synthetic DNA
taagacgattaactatag

SEQ ID NO: 2500 - DNA, 18 bp, Artificial Sequence
  Synthetic DNA
taatacgaatcactgtac

SEQ ID NO: 2501 - DNA, 18 bp, Artificial Sequence
  Synthetic DNA
taatacgactaacggtag

SEQ ID NO: 2502 - DNA, 18 bp, Artificial Sequence
  Synthetic DNA
taatacgactcaccaaac

SEQ ID NO: 2503 - DNA, 18 bp, Artificial Sequence
  Synthetic DNA
taatacgccccactatcg

SEQ ID NO: 2504 - DNA, 18 bp, Artificial Sequence
  Synthetic DNA
taatacggcgcactaaag

SEQ ID NO: 2505 - DNA, 18 bp, Artificial Sequence
  Synthetic DNA
taataggcctcactgtag

SEQ ID NO: 2506 - DNA, 18 bp, Artificial Sequence
  Synthetic DNA
taatccgcctcactatcg

SEQ ID NO: 2507 - DNA, 18 bp, Artificial Sequence
  Synthetic DNA
taatgcgactccctacag

SEQ ID NO: 2508 - DNA, 18 bp, Artificial Sequence
  Synthetic DNA
taatgcggctaactatag

SEQ ID NO: 2509 - DNA, 18 bp, Artificial Sequence
  Synthetic DNA
taattcgactctctataa

SEQ ID NO: 2510 - DNA, 18 bp, Artificial Sequence
  Synthetic DNA
tactacgacttactgtag

SEQ ID NO: 2511 - DNA, 18 bp, Artificial Sequence
  Synthetic DNA
tattacgactcacgatgg

SEQ ID NO: 2512 - DNA, 18 bp, Artificial Sequence
  Synthetic DNA
tgatgcgactcactgtag

SEQ ID NO: 2513 - DNA, 18 bp, Artificial Sequence
  Synthetic DNA
aaataggactcactattg

SEQ ID NO: 2514 - DNA, 18 bp, Artificial Sequence
  Synthetic DNA
taatccgcctcactacag

SEQ ID NO: 2515 - DNA, 18 bp, Artificial Sequence
  Synthetic DNA
tattaggactcactagag

SEQ ID NO: 2516 - DNA, 18 bp, Artificial Sequence
  Synthetic DNA
taataagaatcactatcg

SEQ ID NO: 2517 - DNA, 18 bp, Artificial Sequence
  Synthetic DNA
taatacgactcactcctg

SEQ ID NO: 2518 - DNA, 18 bp, Artificial Sequence
  Synthetic DNA
taatgcgactctctagag

SEQ ID NO: 2519 - DNA, 18 bp, Artificial Sequence
  Synthetic DNA
ttaaaagactcactatag

SEQ ID NO: 2520 - DNA, 18 bp, Artificial Sequence
  Synthetic DNA
taacacgactgactttag

SEQ ID NO: 2521 - DNA, 18 bp, Artificial Sequence
  Synthetic DNA
taacgcgtctcactatag

SEQ ID NO: 2522 - DNA, 18 bp, Artificial Sequence
  Synthetic DNA
taataagactcactacgg

SEQ ID NO: 2523 - DNA, 18 bp, Artificial Sequence
  Synthetic DNA
taataaggctcgctatag

SEQ ID NO: 2524 - DNA, 18 bp, Artificial Sequence
  Synthetic DNA
taatacgtctcactggag

SEQ ID NO: 2525 - DNA, 18 bp, Artificial Sequence
  Synthetic DNA
taactcgactcgctatag

SEQ ID NO: 2526 - DNA, 18 bp, Artificial Sequence
  Synthetic DNA
taatataactcgctatag

SEQ ID NO: 2527 - DNA, 18 bp, Artificial Sequence
  Synthetic DNA
ttatacgcctcactacag

SEQ ID NO: 2528 - DNA, 18 bp, Artificial Sequence
  Synthetic DNA
ttataggactcgctatag

SEQ ID NO: 2529 - DNA, 18 bp, Artificial Sequence
  Synthetic DNA
caaaacgactcactacag

SEQ ID NO: 2530 - DNA, 18 bp, Artificial Sequence
  Synthetic DNA
taaaacgcctcaccatag

SEQ ID NO: 2531 - DNA, 18 bp, Artificial Sequence
  Synthetic DNA
taacacgattcactatgg

SEQ ID NO: 2532 - DNA, 18 bp, Artificial Sequence
  Synthetic DNA
taatacgagtgactacag

SEQ ID NO: 2533 - DNA, 18 bp, Artificial Sequence
  Synthetic DNA
taatacggcgcactattg

SEQ ID NO: 2534 - DNA, 18 bp, Artificial Sequence
  Synthetic DNA
taatagggctcagtatag

SEQ ID NO: 2535 - DNA, 18 bp, Artificial Sequence
  Synthetic DNA
taatatgactcgctacag

SEQ ID NO: 2536 - DNA, 18 bp, Artificial Sequence
  Synthetic DNA
taatacgtctcactaatg

SEQ ID NO: 2537 - DNA, 18 bp, Artificial Sequence
  Synthetic DNA
aaatacaactcactctag

SEQ ID NO: 2538 - DNA, 18 bp, Artificial Sequence
  Synthetic DNA
tgatacgcctcactattg

SEQ ID NO: 2539 - DNA, 18 bp, Artificial Sequence
  Synthetic DNA
taaatcgactcactacag

SEQ ID NO: 2540 - DNA, 18 bp, Artificial Sequence
  Synthetic DNA
taattcgaatcgctatag

SEQ ID NO: 2541 - DNA, 18 bp, Artificial Sequence
  Synthetic DNA
taatacgactcgctaatg

SEQ ID NO: 2542 - DNA, 18 bp, Artificial Sequence
  Synthetic DNA
taatagaactcacaatag

SEQ ID NO: 2543 - DNA, 18 bp, Artificial Sequence
  Synthetic DNA
tgatacggctcactattg

SEQ ID NO: 2544 - DNA, 18 bp, Artificial Sequence
  Synthetic DNA
ttatatgcctcactatag

SEQ ID NO: 2545 - DNA, 18 bp, Artificial Sequence
  Synthetic DNA
taaaacgactcactaccg

SEQ ID NO: 2546 - DNA, 18 bp, Artificial Sequence
  Synthetic DNA
taatccgtctcgctatag

SEQ ID NO: 2547 - DNA, 18 bp, Artificial Sequence
  Synthetic DNA
taagacgaatcactattg

SEQ ID NO: 2548 - DNA, 18 bp, Artificial Sequence
  Synthetic DNA
taatacgacgcactccag

SEQ ID NO: 2549 - DNA, 18 bp, Artificial Sequence
  Synthetic DNA
gtatacgactcactacag

SEQ ID NO: 2550 - DNA, 18 bp, Artificial Sequence
  Synthetic DNA
taatacgactcaccctcg

SEQ ID NO: 2551 - DNA, 18 bp, Artificial Sequence
  Synthetic DNA
taatacgactcattgtcg

SEQ ID NO: 2552 - DNA, 18 bp, Artificial Sequence
  Synthetic DNA
taatacgactcggcatag

SEQ ID NO: 2553 - DNA, 18 bp, Artificial Sequence
  Synthetic DNA
taatagtactcactctag

SEQ ID NO: 2554 - DNA, 18 bp, Artificial Sequence
  Synthetic DNA
taatccgcctcactgtag

SEQ ID NO: 2555 - DNA, 18 bp, Artificial Sequence
  Synthetic DNA
taatgcgactcactctgg

SEQ ID NO: 2556 - DNA, 18 bp, Artificial Sequence
  Synthetic DNA
ttatacgactcactactg

SEQ ID NO: 2557 - DNA, 18 bp, Artificial Sequence
  Synthetic DNA
atatgcgactcactatag

SEQ ID NO: 2558 - DNA, 18 bp, Artificial Sequence
  Synthetic DNA
taatacaactcgctaaag

SEQ ID NO: 2559 - DNA, 18 bp, Artificial Sequence
  Synthetic DNA
tactacgactctctacag

SEQ ID NO: 2560 - DNA, 18 bp, Artificial Sequence
  Synthetic DNA
taaatggactcactatag

SEQ ID NO: 2561 - DNA, 18 bp, Artificial Sequence
  Synthetic DNA
taatgcgaatcactttag

SEQ ID NO: 2562 - DNA, 18 bp, Artificial Sequence
  Synthetic DNA
taaaacgactcaccattg

SEQ ID NO: 2563 - DNA, 18 bp, Artificial Sequence
  Synthetic DNA
caaaacgcctcactatag

SEQ ID NO: 2564 - DNA, 18 bp, Artificial Sequence
  Synthetic DNA
caatacgactcactaccg

SEQ ID NO: 2565 - DNA, 18 bp, Artificial Sequence
  Synthetic DNA
taatacgacgcgctattg

SEQ ID NO: 2566 - DNA, 18 bp, Artificial Sequence
  Synthetic DNA
taatgcgacttactacag

SEQ ID NO: 2567 - DNA, 18 bp, Artificial Sequence
  Synthetic DNA
tattaggactcactgtag

SEQ ID NO: 2568 - DNA, 18 bp, Artificial Sequence
  Synthetic DNA
aaatatgactcactagag

SEQ ID NO: 2569 - DNA, 18 bp, Artificial Sequence
  Synthetic DNA
taattcgactcacgaaag

SEQ ID NO: 2570 - DNA, 18 bp, Artificial Sequence
  Synthetic DNA
ttatatgactcactgtag

SEQ ID NO: 2571 - DNA, 18 bp, Artificial Sequence
  Synthetic DNA
taatccgactcgctctag

SEQ ID NO: 2572 - DNA, 18 bp, Artificial Sequence
  Synthetic DNA
tcatccgactcacaatag

SEQ ID NO: 2573 - DNA, 18 bp, Artificial Sequence
  Synthetic DNA
tgatacgactcactactg

SEQ ID NO: 2574 - DNA, 18 bp, Artificial Sequence
  Synthetic DNA
ttatacgactcactagtg

SEQ ID NO: 2575 - DNA, 18 bp, Artificial Sequence
  Synthetic DNA
tactgcgtctcactatag

SEQ ID NO: 2576 - DNA, 18 bp, Artificial Sequence
  Synthetic DNA
ttatacaactcgctatag

SEQ ID NO: 2577 - DNA, 18 bp, Artificial Sequence
  Synthetic DNA
taattcgactcactgttg

SEQ ID NO: 2578 - DNA, 18 bp, Artificial Sequence
  Synthetic DNA
taatacgactcacttatg

SEQ ID NO: 2579 - DNA, 18 bp, Artificial Sequence
  Synthetic DNA
taattcgtctcactaaag

SEQ ID NO: 2580 - DNA, 18 bp, Artificial Sequence
  Synthetic DNA
taatacgaatgactattg

SEQ ID NO: 2581 - DNA, 18 bp, Artificial Sequence
  Synthetic DNA
taatacgactggctatgg

SEQ ID NO: 2582 - DNA, 18 bp, Artificial Sequence
  Synthetic DNA
taatccgactcaatatcg

SEQ ID NO: 2583 - DNA, 18 bp, Artificial Sequence
  Synthetic DNA
taatacgactcagttcag

SEQ ID NO: 2584 - DNA, 18 bp, Artificial Sequence
  Synthetic DNA
caattcgactcactaaag

SEQ ID NO: 2585 - DNA, 18 bp, Artificial Sequence
  Synthetic DNA
tattttgactcactatag

SEQ ID NO: 2586 - DNA, 18 bp, Artificial Sequence
  Synthetic DNA
ttaaacgacgcactatag

SEQ ID NO: 2587 - DNA, 18 bp, Artificial Sequence
  Synthetic DNA
tataacgactcactagag

SEQ ID NO: 2588 - DNA, 18 bp, Artificial Sequence
  Synthetic DNA
taataagactcactctcg

SEQ ID NO: 2589 - DNA, 18 bp, Artificial Sequence
  Synthetic DNA
taatgcgactcgccatag

SEQ ID NO: 2590 - DNA, 18 bp, Artificial Sequence
  Synthetic DNA
taattagactcactacag

SEQ ID NO: 2591 - DNA, 18 bp, Artificial Sequence
  Synthetic DNA
taaaaagtctcactatag

SEQ ID NO: 2592 - DNA, 18 bp, Artificial Sequence
  Synthetic DNA
taaaacgcctcactattg

SEQ ID NO: 2593 - DNA, 18 bp, Artificial Sequence
  Synthetic DNA
taatactgcccactatag

SEQ ID NO: 2594 - DNA, 18 bp, Artificial Sequence
  Synthetic DNA
tactacgactcacttaag

SEQ ID NO: 2595 - DNA, 18 bp, Artificial Sequence
  Synthetic DNA
taattagactcactattg

SEQ ID NO: 2596 - DNA, 18 bp, Artificial Sequence
  Synthetic DNA
taaaatgactcactctag

SEQ ID NO: 2597 - DNA, 18 bp, Artificial Sequence
  Synthetic DNA
tagttcgactcactacag

SEQ ID NO: 2598 - DNA, 18 bp, Artificial Sequence
  Synthetic DNA
taatacgtcacactatcg

SEQ ID NO: 2599 - DNA, 18 bp, Artificial Sequence
  Synthetic DNA
tagaacgtctcactatag

SEQ ID NO: 2600 - DNA, 18 bp, Artificial Sequence
  Synthetic DNA
tattacgactcactttgg

SEQ ID NO: 2601 - DNA, 18 bp, Artificial Sequence
  Synthetic DNA
tgattcgactcactacag

SEQ ID NO: 2602 - DNA, 18 bp, Artificial Sequence
  Synthetic DNA
aaataagactcactctag

SEQ ID NO: 2603 - DNA, 18 bp, Artificial Sequence
  Synthetic DNA
taaaacgagtcactttag

SEQ ID NO: 2604 - DNA, 18 bp, Artificial Sequence
  Synthetic DNA
taaaacgcctcactacag

SEQ ID NO: 2605 - DNA, 18 bp, Artificial Sequence
  Synthetic DNA
taatatgactcacgaaag

SEQ ID NO: 2606 - DNA, 18 bp, Artificial Sequence
  Synthetic DNA
caatgcgactcaccatag

SEQ ID NO: 2607 - DNA, 18 bp, Artificial Sequence
  Synthetic DNA
taatacgacacgctattg

SEQ ID NO: 2608 - DNA, 18 bp, Artificial Sequence
  Synthetic DNA
taataaaactcactatcg

SEQ ID NO: 2609 - DNA, 18 bp, Artificial Sequence
  Synthetic DNA
ttatagcactcactatag

SEQ ID NO: 2610 - DNA, 18 bp, Artificial Sequence
  Synthetic DNA
tgattcgactcactctag

SEQ ID NO: 2611 - DNA, 18 bp, Artificial Sequence
  Synthetic DNA
ttaaacgactcactagag

SEQ ID NO: 2612 - DNA, 18 bp, Artificial Sequence
  Synthetic DNA
taatacggctcactttcg

SEQ ID NO: 2613 - DNA, 18 bp, Artificial Sequence
  Synthetic DNA
taatacgactctctaccg

SEQ ID NO: 2614 - DNA, 18 bp, Artificial Sequence
  Synthetic DNA
taatccgacgcactacag

SEQ ID NO: 2615 - DNA, 18 bp, Artificial Sequence
  Synthetic DNA
tgttacgacgcactatag

SEQ ID NO: 2616 - DNA, 18 bp, Artificial Sequence
  Synthetic DNA
caataggactcagtatag

SEQ ID NO: 2617 - DNA, 18 bp, Artificial Sequence
  Synthetic DNA
gaatatgactcactgtag

SEQ ID NO: 2618 - DNA, 18 bp, Artificial Sequence
  Synthetic DNA
taatacgactcaccccag

SEQ ID NO: 2619 - DNA, 18 bp, Artificial Sequence
  Synthetic DNA
tgatatgactcactctag

SEQ ID NO: 2620 - DNA, 18 bp, Artificial Sequence
  Synthetic DNA
taatacgactcgctaaaa

SEQ ID NO: 2621 - DNA, 18 bp, Artificial Sequence
  Synthetic DNA
taatatgactcactagtg

SEQ ID NO: 2622 - DNA, 18 bp, Artificial Sequence
  Synthetic DNA
gaataccactcacgatag

SEQ ID NO: 2623 - DNA, 18 bp, Artificial Sequence
  Synthetic DNA
taataccactcactccag

SEQ ID NO: 2624 - DNA, 18 bp, Artificial Sequence
  Synthetic DNA
taatacgacccgctaaag

SEQ ID NO: 2625 - DNA, 18 bp, Artificial Sequence
  Synthetic DNA
taatacgactcaaaataa

SEQ ID NO: 2626 - DNA, 18 bp, Artificial Sequence
  Synthetic DNA
taatacgattgactatgg

SEQ ID NO: 2627 - DNA, 18 bp, Artificial Sequence
  Synthetic DNA
taatcggactcagtatag

SEQ ID NO: 2628 - DNA, 18 bp, Artificial Sequence
  Synthetic DNA
tactgcaactcactatag

SEQ ID NO: 2629 - DNA, 18 bp, Artificial Sequence
  Synthetic DNA
tattacgactcactatca

SEQ ID NO: 2630 - DNA, 18 bp, Artificial Sequence
  Synthetic DNA
tgttccgactcactatag

SEQ ID NO: 2631 - DNA, 18 bp, Artificial Sequence
  Synthetic DNA
ttatacgcctcgctatag

SEQ ID NO: 2632 - DNA, 18 bp, Artificial Sequence
  Synthetic DNA
aaatacgactcacaataa

SEQ ID NO: 2633 - DNA, 18 bp, Artificial Sequence
  Synthetic DNA
caacacgactcactatcg

SEQ ID NO: 2634 - DNA, 18 bp, Artificial Sequence
  Synthetic DNA
caacaggactcactatag

SEQ ID NO: 2635 - DNA, 18 bp, Artificial Sequence
  Synthetic DNA
caatacgactcactgcag

SEQ ID NO: 2636 - DNA, 18 bp, Artificial Sequence
  Synthetic DNA
cagtacgactcactgtag

SEQ ID NO: 2637 - DNA, 18 bp, Artificial Sequence
  Synthetic DNA
gaacacgacccactatag

SEQ ID NO: 2638 - DNA, 18 bp, Artificial Sequence
  Synthetic DNA
gaaggcgactcactatag

SEQ ID NO: 2639 - DNA, 18 bp, Artificial Sequence
  Synthetic DNA
gaatacgactcactctgg

SEQ ID NO: 2640 - DNA, 18 bp, Artificial Sequence
  Synthetic DNA
gaatacgactcatcatag

SEQ ID NO: 2641 - DNA, 18 bp, Artificial Sequence
  Synthetic DNA
gaatacgactcattatgg

SEQ ID NO: 2642 - DNA, 18 bp, Artificial Sequence
  Synthetic DNA
gaatacgtctcactagag

SEQ ID NO: 2643 - DNA, 18 bp, Artificial Sequence
  Synthetic DNA
gaatactgctcactatag

SEQ ID NO: 2644 - DNA, 18 bp, Artificial Sequence
  Synthetic DNA
gaatgcgactcagtatag

SEQ ID NO: 2645 - DNA, 18 bp, Artificial Sequence
  Synthetic DNA
taaaacggctcgctatag

SEQ ID NO: 2646 - DNA, 18 bp, Artificial Sequence
  Synthetic DNA
taaagcgactcactgtag

SEQ ID NO: 2647 - DNA, 18 bp, Artificial Sequence
  Synthetic DNA
taacacaactccctatag

SEQ ID NO: 2648 - DNA, 18 bp, Artificial Sequence
  Synthetic DNA
taagaccacccactatag

SEQ ID NO: 2649 - DNA, 18 bp, Artificial Sequence
  Synthetic DNA
taagaccgctcactatag

SEQ ID NO: 2650 - DNA, 18 bp, Artificial Sequence
  Synthetic DNA
taagacgactgacaatag

SEQ ID NO: 2651 - DNA, 18 bp, Artificial Sequence
  Synthetic DNA
taagccgactcaatatag

SEQ ID NO: 2652 - DNA, 18 bp, Artificial Sequence
  Synthetic DNA
taataagacggactatag

SEQ ID NO: 2653 - DNA, 18 bp, Artificial Sequence
  Synthetic DNA
taatacaacgcactatcg

SEQ ID NO: 2654 - DNA, 18 bp, Artificial Sequence
  Synthetic DNA
taatacaactgactatat

SEQ ID NO: 2655 - DNA, 18 bp, Artificial Sequence
  Synthetic DNA
taatacatctcactatat

SEQ ID NO: 2656 - DNA, 18 bp, Artificial Sequence
  Synthetic DNA
taataccacgcagtatag

SEQ ID NO: 2657 - DNA, 18 bp, Artificial Sequence
  Synthetic DNA
taataccactcgctatcg

SEQ ID NO: 2658 - DNA, 18 bp, Artificial Sequence
  Synthetic DNA
taataccatgcactatag

SEQ ID NO: 2659 - DNA, 18 bp, Artificial Sequence
  Synthetic DNA
taatacgacccacgatcg

SEQ ID NO: 2660 - DNA, 18 bp, Artificial Sequence
  Synthetic DNA
taatacgacccactccag

SEQ ID NO: 2661 - DNA, 18 bp, Artificial Sequence
  Synthetic DNA
taatacgacccagcatag

SEQ ID NO: 2662 - DNA, 18 bp, Artificial Sequence
  Synthetic DNA
taatacgactcaccaaaa

SEQ ID NO: 2663 - DNA, 18 bp, Artificial Sequence
  Synthetic DNA
taatacgactcacggtaa

SEQ ID NO: 2664 - DNA, 18 bp, Artificial Sequence
  Synthetic DNA
taatacgactcactaaga

SEQ ID NO: 2665 - DNA, 18 bp, Artificial Sequence
  Synthetic DNA
taatacgactcactaagc

SEQ ID NO: 2666 - DNA, 18 bp, Artificial Sequence
  Synthetic DNA
taatacgactcactggcg

SEQ ID NO: 2667 - DNA, 18 bp, Artificial Sequence
  Synthetic DNA
taatacgactcagggtag

SEQ ID NO: 2668 - DNA, 18 bp, Artificial Sequence
  Synthetic DNA
taatacgactccctttaa

SEQ ID NO: 2669 - DNA, 18 bp, Artificial Sequence
  Synthetic DNA
taatacgactcggtagag

SEQ ID NO: 2670 - DNA, 18 bp, Artificial Sequence
  Synthetic DNA
taatacgactctctttat

SEQ ID NO: 2671 - DNA, 18 bp, Artificial Sequence
  Synthetic DNA
taatacgactctgtataa

SEQ ID NO: 2672 - DNA, 18 bp, Artificial Sequence
  Synthetic DNA
taatacgactggctgtag

SEQ ID NO: 2673 - DNA, 18 bp, Artificial Sequence
  Synthetic DNA
taatacgactttctatat

SEQ ID NO: 2674 - DNA, 18 bp, Artificial Sequence
  Synthetic DNA
taatacgagtcaatatcg

SEQ ID NO: 2675 - DNA, 18 bp, Artificial Sequence
  Synthetic DNA
taatacgagtcactgtgg

SEQ ID NO: 2676 - DNA, 18 bp, Artificial Sequence
  Synthetic DNA
taatacgatgcactatcg

SEQ ID NO: 2677 - DNA, 18 bp, Artificial Sequence
  Synthetic DNA
taatacggctcgatatag

SEQ ID NO: 2678 - DNA, 18 bp, Artificial Sequence
  Synthetic DNA
taatacgtcacactataa

SEQ ID NO: 2679 - DNA, 18 bp, Artificial Sequence
  Synthetic DNA
taatacgtctcactattc

SEQ ID NO: 2680 - DNA, 18 bp, Artificial Sequence
  Synthetic DNA
taatacgtctcactttat

SEQ ID NO: 2681 - DNA, 18 bp, Artificial Sequence
  Synthetic DNA
taatactactcacgacag

SEQ ID NO: 2682 - DNA, 18 bp, Artificial Sequence
  Synthetic DNA
taatactactcactatga

SEQ ID NO: 2683 - DNA, 18 bp, Artificial Sequence
  Synthetic DNA
taatactactcactttac

SEQ ID NO: 2684 - DNA, 18 bp, Artificial Sequence
  Synthetic DNA
taataggacccactatcg

SEQ ID NO: 2685 - DNA, 18 bp, Artificial Sequence
  Synthetic DNA
taatatgactcactatca

SEQ ID NO: 2686 - DNA, 18 bp, Artificial Sequence
  Synthetic DNA
taatatgactcactgtac

SEQ ID NO: 2687 - DNA, 18 bp, Artificial Sequence
  Synthetic DNA
taatatgcctcactgtag

SEQ ID NO: 2688 - DNA, 18 bp, Artificial Sequence
  Synthetic DNA
taatccgactcactacgg

SEQ ID NO: 2689 - DNA, 18 bp, Artificial Sequence
  Synthetic DNA
taatgcgacccactagag

SEQ ID NO: 2690 - DNA, 18 bp, Artificial Sequence
  Synthetic DNA
taatgcgactcacgatcg

SEQ ID NO: 2691 - DNA, 18 bp, Artificial Sequence
  Synthetic DNA
taattcgactcaccataa

SEQ ID NO: 2692 - DNA, 18 bp, Artificial Sequence
  Synthetic DNA
taattcgactcactttat

SEQ ID NO: 2693 - DNA, 18 bp, Artificial Sequence
  Synthetic DNA
taattcgactcagtataa

SEQ ID NO: 2694 - DNA, 18 bp, Artificial Sequence
  Synthetic DNA
tacgacgagtcactatag

SEQ ID NO: 2695 - DNA, 18 bp, Artificial Sequence
  Synthetic DNA
tactacgactcacgattg

SEQ ID NO: 2696 - DNA, 18 bp, Artificial Sequence
  Synthetic DNA
tactacgagtcgctatag

SEQ ID NO: 2697 - DNA, 18 bp, Artificial Sequence
  Synthetic DNA
tagcaagactcactatag

SEQ ID NO: 2698 - DNA, 18 bp, Artificial Sequence
  Synthetic DNA
tattacgacgcagtatag

SEQ ID NO: 2699 - DNA, 18 bp, Artificial Sequence
  Synthetic DNA
tcacacgacccactatag

SEQ ID NO: 2700 - DNA, 18 bp, Artificial Sequence
  Synthetic DNA
tcatacgactcactagtg

SEQ ID NO: 2701 - DNA, 18 bp, Artificial Sequence
  Synthetic DNA
tcatacgactcactctgg

SEQ ID NO: 2702 - DNA, 18 bp, Artificial Sequence
  Synthetic DNA
tcatacgactcagtgtag

SEQ ID NO: 2703 - DNA, 18 bp, Artificial Sequence
  Synthetic DNA
tgagacgactcactttag

SEQ ID NO: 2704 - DNA, 18 bp, Artificial Sequence
  Synthetic DNA
tgatacaactcaccatag

SEQ ID NO: 2705 - DNA, 18 bp, Artificial Sequence
  Synthetic DNA
tgatacgactcactgtaa

SEQ ID NO: 2706 - DNA, 18 bp, Artificial Sequence
  Synthetic DNA
tgatgcgactcactagag

SEQ ID NO: 2707 - DNA, 18 bp, Artificial Sequence
  Synthetic DNA
ttagacgactcactgtag

SEQ ID NO: 2708 - DNA, 18 bp, Artificial Sequence
  Synthetic DNA
ttatacgactcactatct

SEQ ID NO: 2709 - DNA, 18 bp, Artificial Sequence
  Synthetic DNA
tgttacgactcactttag

SEQ ID NO: 2710 - DNA, 18 bp, Artificial Sequence
  Synthetic DNA
taattcgactcacaatgg

SEQ ID NO: 2711 - DNA, 18 bp, Artificial Sequence
  Synthetic DNA
taattcaactcactttag

SEQ ID NO: 2712 - DNA, 18 bp, Artificial Sequence
  Synthetic DNA
ttataagactcactctag

SEQ ID NO: 2713 - DNA, 18 bp, Artificial Sequence
  Synthetic DNA
taatcagactcactaaag

SEQ ID NO: 2714 - DNA, 18 bp, Artificial Sequence
  Synthetic DNA
acttacgactcactatag

SEQ ID NO: 2715 - DNA, 18 bp, Artificial Sequence
  Synthetic DNA
aaataagactcactgtag

SEQ ID NO: 2716 - DNA, 18 bp, Artificial Sequence
  Synthetic DNA
taataagtctcactatcg

SEQ ID NO: 2717 - DNA, 18 bp, Artificial Sequence
  Synthetic DNA
ttattcgactcactctag

SEQ ID NO: 2718 - DNA, 18 bp, Artificial Sequence
  Synthetic DNA
taatacgactcagtttgg

SEQ ID NO: 2719 - DNA, 18 bp, Artificial Sequence
  Synthetic DNA
taataagactcactccag

SEQ ID NO: 2720 - DNA, 18 bp, Artificial Sequence
  Synthetic DNA
taattcgacgctctatag

SEQ ID NO: 2721 - DNA, 18 bp, Artificial Sequence
  Synthetic DNA
ttatacgactcactcttg

SEQ ID NO: 2722 - DNA, 18 bp, Artificial Sequence
  Synthetic DNA
aattaggactcactatag

SEQ ID NO: 2723 - DNA, 18 bp, Artificial Sequence
  Synthetic DNA
tgaaacgactcgctatag

SEQ ID NO: 2724 - DNA, 18 bp, Artificial Sequence
  Synthetic DNA
caatacgtctcactgtag

SEQ ID NO: 2725 - DNA, 18 bp, Artificial Sequence
  Synthetic DNA
taatacgactcacttacg

SEQ ID NO: 2726 - DNA, 18 bp, Artificial Sequence
  Synthetic DNA
taatacaactcacactag

SEQ ID NO: 2727 - DNA, 18 bp, Artificial Sequence
  Synthetic DNA
taataagactcactgttg

SEQ ID NO: 2728 - DNA, 18 bp, Artificial Sequence
  Synthetic DNA
tattacgactcactactg

SEQ ID NO: 2729 - DNA, 18 bp, Artificial Sequence
  Synthetic DNA
taataaaactcgctatag

SEQ ID NO: 2730 - DNA, 18 bp, Artificial Sequence
  Synthetic DNA
ttatacgcctcactatgg

SEQ ID NO: 2731 - DNA, 18 bp, Artificial Sequence
  Synthetic DNA
taataagactcactttgg

SEQ ID NO: 2732 - DNA, 18 bp, Artificial Sequence
  Synthetic DNA
caatacgactcactttcg

SEQ ID NO: 2733 - DNA, 18 bp, Artificial Sequence
  Synthetic DNA
taatactacgcagtatag

SEQ ID NO: 2734 - DNA, 18 bp, Artificial Sequence
  Synthetic DNA
tgatcctactcactatag

SEQ ID NO: 2735 - DNA, 18 bp, Artificial Sequence
  Synthetic DNA
tattacgactcgccatag

SEQ ID NO: 2736 - DNA, 18 bp, Artificial Sequence
  Synthetic DNA
ttaaacgtctcactatag

SEQ ID NO: 2737 - DNA, 18 bp, Artificial Sequence
  Synthetic DNA
taatacgactcgctatta

SEQ ID NO: 2738 - DNA, 18 bp, Artificial Sequence
  Synthetic DNA
taattggacgcactatag

SEQ ID NO: 2739 - DNA, 18 bp, Artificial Sequence
  Synthetic DNA
ttatacgcctcactttag

SEQ ID NO: 2740 - DNA, 18 bp, Artificial Sequence
  Synthetic DNA
taatatgagacactatag

SEQ ID NO: 2741 - DNA, 18 bp, Artificial Sequence
  Synthetic DNA
ttatacgactcagtctag

SEQ ID NO: 2742 - DNA, 18 bp, Artificial Sequence
  Synthetic DNA
tattacgactcaccttag

SEQ ID NO: 2743 - DNA, 18 bp, Artificial Sequence
  Synthetic DNA
taataagactcactgtcg

SEQ ID NO: 2744 - DNA, 18 bp, Artificial Sequence
  Synthetic DNA
caatgagactcactatag

SEQ ID NO: 2745 - DNA, 18 bp, Artificial Sequence
  Synthetic DNA
taatcccactcactatcg

SEQ ID NO: 2746 - DNA, 18 bp, Artificial Sequence
  Synthetic DNA
taatctgactcactagag

SEQ ID NO: 2747 - DNA, 18 bp, Artificial Sequence
  Synthetic DNA
tgatacgactcactcgag

SEQ ID NO: 2748 - DNA, 18 bp, Artificial Sequence
  Synthetic DNA
tatttggactcactatag

SEQ ID NO: 2749 - DNA, 18 bp, Artificial Sequence
  Synthetic DNA
tattacgacttgctatag

SEQ ID NO: 2750 - DNA, 18 bp, Artificial Sequence
  Synthetic DNA
ttatacgtctcactacag

SEQ ID NO: 2751 - DNA, 18 bp, Artificial Sequence
  Synthetic DNA
agataagactcactatag

SEQ ID NO: 2752 - DNA, 18 bp, Artificial Sequence
  Synthetic DNA
taatacgactcactgagg

SEQ ID NO: 2753 - DNA, 18 bp, Artificial Sequence
  Synthetic DNA
taattcaactcactacag

SEQ ID NO: 2754 - DNA, 18 bp, Artificial Sequence
  Synthetic DNA
taatgagactcactttag

SEQ ID NO: 2755 - DNA, 18 bp, Artificial Sequence
  Synthetic DNA
taatacgactcgccaaag

SEQ ID NO: 2756 - DNA, 18 bp, Artificial Sequence
  Synthetic DNA
taatccgactcactactg

SEQ ID NO: 2757 - DNA, 18 bp, Artificial Sequence
  Synthetic DNA
ttataagactcactacag

SEQ ID NO: 2758 - DNA, 18 bp, Artificial Sequence
  Synthetic DNA
taatgctcctcactatag

SEQ ID NO: 2759 - DNA, 18 bp, Artificial Sequence
  Synthetic DNA
taatatgactcactaccg

SEQ ID NO: 2760 - DNA, 18 bp, Artificial Sequence
  Synthetic DNA
tagttcgactcgctatag

SEQ ID NO: 2761 - DNA, 18 bp, Artificial Sequence
  Synthetic DNA
tgatgcgactcactatgg

SEQ ID NO: 2762 - DNA, 18 bp, Artificial Sequence
  Synthetic DNA
taattaaactcactatag

SEQ ID NO: 2763 - DNA, 18 bp, Artificial Sequence
  Synthetic DNA
taacacgtctcactaaag

SEQ ID NO: 2764 - DNA, 18 bp, Artificial Sequence
  Synthetic DNA
taatacgactcagaattg

SEQ ID NO: 2765 - DNA, 18 bp, Artificial Sequence
  Synthetic DNA
cattacgactcgctatag

SEQ ID NO: 2766 - DNA, 18 bp, Artificial Sequence
  Synthetic DNA
taataggactcactaatg

SEQ ID NO: 2767 - DNA, 18 bp, Artificial Sequence
  Synthetic DNA
aaatgcgactcactttag

SEQ ID NO: 2768 - DNA, 18 bp, Artificial Sequence
  Synthetic DNA
tatcatgactcactatag

SEQ ID NO: 2769 - DNA, 18 bp, Artificial Sequence
  Synthetic DNA
taatacggctcaatattg

SEQ ID NO: 2770 - DNA, 18 bp, Artificial Sequence
  Synthetic DNA
ttttaggactcactatag

SEQ ID NO: 2771 - DNA, 18 bp, Artificial Sequence
  Synthetic DNA
taaaacgtctcactgtag

SEQ ID NO: 2772 - DNA, 18 bp, Artificial Sequence
  Synthetic DNA
tattacggctcaccatag

SEQ ID NO: 2773 - DNA, 18 bp, Artificial Sequence
  Synthetic DNA
ttattagactcactatag

SEQ ID NO: 2774 - DNA, 18 bp, Artificial Sequence
  Synthetic DNA
tatcacgtctcactatag

SEQ ID NO: 2775 - DNA, 18 bp, Artificial Sequence
  Synthetic DNA
tattacgcctcactattg

SEQ ID NO: 2776 - DNA, 18 bp, Artificial Sequence
  Synthetic DNA
aaaaacgactcactttag

SEQ ID NO: 2777 - DNA, 18 bp, Artificial Sequence
  Synthetic DNA
ttgaacgactcactatag

SEQ ID NO: 2778 - DNA, 18 bp, Artificial Sequence
  Synthetic DNA
taatacgactcgcttttg

SEQ ID NO: 2779 - DNA, 18 bp, Artificial Sequence
  Synthetic DNA
tatttcgtctcactatag

SEQ ID NO: 2780 - DNA, 18 bp, Artificial Sequence
  Synthetic DNA
taatgtaactcactatag

SEQ ID NO: 2781 - DNA, 18 bp, Artificial Sequence
  Synthetic DNA
ctataagactcactatag

SEQ ID NO: 2782 - DNA, 18 bp, Artificial Sequence
  Synthetic DNA
taaaacgaatcactatgg

SEQ ID NO: 2783 - DNA, 18 bp, Artificial Sequence
  Synthetic DNA
taatatgactcacttcag

SEQ ID NO: 2784 - DNA, 18 bp, Artificial Sequence
  Synthetic DNA
taaaacgagtcactaaag

SEQ ID NO: 2785 - DNA, 18 bp, Artificial Sequence
  Synthetic DNA
tattgagactcactatag

SEQ ID NO: 2786 - DNA, 18 bp, Artificial Sequence
  Synthetic DNA
gaatatgactcactaaag

SEQ ID NO: 2787 - DNA, 18 bp, Artificial Sequence
  Synthetic DNA
taatgcgactcacagtag

SEQ ID NO: 2788 - DNA, 18 bp, Artificial Sequence
  Synthetic DNA
tagtaggactcactaaag

SEQ ID NO: 2789 - DNA, 18 bp, Artificial Sequence
  Synthetic DNA
caatacgactcactgaag

SEQ ID NO: 2790 - DNA, 18 bp, Artificial Sequence
  Synthetic DNA
taatacgcctcaccgtag

SEQ ID NO: 2791 - DNA, 18 bp, Artificial Sequence
  Synthetic DNA
aaatacgacgcaccatag

SEQ ID NO: 2792 - DNA, 18 bp, Artificial Sequence
  Synthetic DNA
caataagactcactgtag

SEQ ID NO: 2793 - DNA, 18 bp, Artificial Sequence
  Synthetic DNA
gaatacgacccaccatag

SEQ ID NO: 2794 - DNA, 18 bp, Artificial Sequence
  Synthetic DNA
taaaacgactcactttat

SEQ ID NO: 2795 - DNA, 18 bp, Artificial Sequence
  Synthetic DNA
taataagaaccactatag

SEQ ID NO: 2796 - DNA, 18 bp, Artificial Sequence
  Synthetic DNA
taatacgactcgatatgg

SEQ ID NO: 2797 - DNA, 18 bp, Artificial Sequence
  Synthetic DNA
taatacgactctggatag

SEQ ID NO: 2798 - DNA, 18 bp, Artificial Sequence
  Synthetic DNA
taatacgagtccctacag

SEQ ID NO: 2799 - DNA, 18 bp, Artificial Sequence
  Synthetic DNA
taatacgattcgctctag

SEQ ID NO: 2800 - DNA, 18 bp, Artificial Sequence
  Synthetic DNA
taatactactgactacag

SEQ ID NO: 2801 - DNA, 18 bp, Artificial Sequence
  Synthetic DNA
taataggactcaatagag

SEQ ID NO: 2802 - DNA, 18 bp, Artificial Sequence
  Synthetic DNA
taatgcgactcaccagag

SEQ ID NO: 2803 - DNA, 18 bp, Artificial Sequence
  Synthetic DNA
taatgcgactcactgtgg

SEQ ID NO: 2804 - DNA, 18 bp, Artificial Sequence
  Synthetic DNA
taattcgcctcactgtag

SEQ ID NO: 2805 - DNA, 18 bp, Artificial Sequence
  Synthetic DNA
tactacgactcactccag

SEQ ID NO: 2806 - DNA, 18 bp, Artificial Sequence
  Synthetic DNA
tactacggctcactatcg

SEQ ID NO: 2807 - DNA, 18 bp, Artificial Sequence
  Synthetic DNA
tagaacgcctcactatag

SEQ ID NO: 2808 - DNA, 18 bp, Artificial Sequence
  Synthetic DNA
tagtacgactaactagag

SEQ ID NO: 2809 - DNA, 18 bp, Artificial Sequence
  Synthetic DNA
tattacgactcactgtac

SEQ ID NO: 2810 - DNA, 18 bp, Artificial Sequence
  Synthetic DNA
tgatacgagtcacaatag

SEQ ID NO: 2811 - DNA, 18 bp, Artificial Sequence
  Synthetic DNA
aaactcgactcactatag

SEQ ID NO: 2812 - DNA, 18 bp, Artificial Sequence
  Synthetic DNA
ttatacgactcactgttg

SEQ ID NO: 2813 - DNA, 18 bp, Artificial Sequence
  Synthetic DNA
ttatacgcctcaccatag

SEQ ID NO: 2814 - DNA, 18 bp, Artificial Sequence
  Synthetic DNA
tcttacgactaactatag

SEQ ID NO: 2815 - DNA, 18 bp, Artificial Sequence
  Synthetic DNA
ttattcgactcactaaag

SEQ ID NO: 2816 - DNA, 18 bp, Artificial Sequence
  Synthetic DNA
tattatgactcactagag

SEQ ID NO: 2817 - DNA, 18 bp, Artificial Sequence
  Synthetic DNA
tgatacaactcactttag

SEQ ID NO: 2818 - DNA, 18 bp, Artificial Sequence
  Synthetic DNA
ttatatgactcactttag

SEQ ID NO: 2819 - DNA, 18 bp, Artificial Sequence
  Synthetic DNA
tatcacgactcactttag

SEQ ID NO: 2820 - DNA, 18 bp, Artificial Sequence
  Synthetic DNA
tataatgactcactatag

SEQ ID NO: 2821 - DNA, 18 bp, Artificial Sequence
  Synthetic DNA
taacacgactcactctgg

SEQ ID NO: 2822 - DNA, 18 bp, Artificial Sequence
  Synthetic DNA
taatacaactcactgtcg

SEQ ID NO: 2823 - DNA, 18 bp, Artificial Sequence
  Synthetic DNA
taatacgacgccctattg

SEQ ID NO: 2824 - DNA, 18 bp, Artificial Sequence
  Synthetic DNA
taatacggctcgctattg

SEQ ID NO: 2825 - DNA, 18 bp, Artificial Sequence
  Synthetic DNA
taatataactcactaaag

SEQ ID NO: 2826 - DNA, 18 bp, Artificial Sequence
  Synthetic DNA
taatacgtctcgctaaag

SEQ ID NO: 2827 - DNA, 18 bp, Artificial Sequence
  Synthetic DNA
tataacgactcactaaag

SEQ ID NO: 2828 - DNA, 18 bp, Artificial Sequence
  Synthetic DNA
aattacgactcgctatag

SEQ ID NO: 2829 - DNA, 18 bp, Artificial Sequence
  Synthetic DNA
caaaccgactcactatag

SEQ ID NO: 2830 - DNA, 18 bp, Artificial Sequence
  Synthetic DNA
caataggactcactacag

SEQ ID NO: 2831 - DNA, 18 bp, Artificial Sequence
  Synthetic DNA
gattaagactcactatag

SEQ ID NO: 2832 - DNA, 18 bp, Artificial Sequence
  Synthetic DNA
taacacggctcaatatag

SEQ ID NO: 2833 - DNA, 18 bp, Artificial Sequence
  Synthetic DNA
taataagactgactctag

SEQ ID NO: 2834 - DNA, 18 bp, Artificial Sequence
  Synthetic DNA
taatacgacgcaccttag

SEQ ID NO: 2835 - DNA, 18 bp, Artificial Sequence
  Synthetic DNA
taatacgactcgcaacag

SEQ ID NO: 2836 - DNA, 18 bp, Artificial Sequence
  Synthetic DNA
taatcctactcactgtag

SEQ ID NO: 2837 - DNA, 18 bp, Artificial Sequence
  Synthetic DNA
taatgcgactcacgctag

SEQ ID NO: 2838 - DNA, 18 bp, Artificial Sequence
  Synthetic DNA
tactataactcactatag

SEQ ID NO: 2839 - DNA, 18 bp, Artificial Sequence
  Synthetic DNA
tgctgcgactcactatag

SEQ ID NO: 2840 - DNA, 18 bp, Artificial Sequence
  Synthetic DNA
aaaaacgactcgctatag

SEQ ID NO: 2841 - DNA, 18 bp, Artificial Sequence
  Synthetic DNA
aaatacgactcactactg

SEQ ID NO: 2842 - DNA, 18 bp, Artificial Sequence
  Synthetic DNA
ttttacgactcgctatag

SEQ ID NO: 2843 - DNA, 18 bp, Artificial Sequence
  Synthetic DNA
taataggactctctacag

SEQ ID NO: 2844 - DNA, 18 bp, Artificial Sequence
  Synthetic DNA
taattcgactcaatatcg

SEQ ID NO: 2845 - DNA, 18 bp, Artificial Sequence
  Synthetic DNA
tattacaactcacgatag

SEQ ID NO: 2846 - DNA, 18 bp, Artificial Sequence
  Synthetic DNA
taatgcgactcacaaaag

SEQ ID NO: 2847 - DNA, 18 bp, Artificial Sequence
  Synthetic DNA
aaataggactcacaatag

SEQ ID NO: 2848 - DNA, 18 bp, Artificial Sequence
  Synthetic DNA
taattcgcctcactatcg

SEQ ID NO: 2849 - DNA, 18 bp, Artificial Sequence
  Synthetic DNA
taatacgacacactcgag

SEQ ID NO: 2850 - DNA, 18 bp, Artificial Sequence
  Synthetic DNA
taatatgacagactatag

SEQ ID NO: 2851 - DNA, 18 bp, Artificial Sequence
  Synthetic DNA
tttttcgactcactatag

SEQ ID NO: 2852 - DNA, 18 bp, Artificial Sequence
  Synthetic DNA
taatccgtctcactttag

SEQ ID NO: 2853 - DNA, 18 bp, Artificial Sequence
  Synthetic DNA
caaagcgactcactatag

SEQ ID NO: 2854 - DNA, 18 bp, Artificial Sequence
  Synthetic DNA
caatacgactcagtctag

SEQ ID NO: 2855 - DNA, 18 bp, Artificial Sequence
  Synthetic DNA
taatacgagtcgctattg

SEQ ID NO: 2856 - DNA, 18 bp, Artificial Sequence
  Synthetic DNA
taataggactcaccattg

SEQ ID NO: 2857 - DNA, 18 bp, Artificial Sequence
  Synthetic DNA
ttaaacgactcactttag

SEQ ID NO: 2858 - DNA, 18 bp, Artificial Sequence
  Synthetic DNA
aattacgactcagtatag

SEQ ID NO: 2859 - DNA, 18 bp, Artificial Sequence
  Synthetic DNA
tcattcgactcgctatag

SEQ ID NO: 2860 - DNA, 18 bp, Artificial Sequence
  Synthetic DNA
ttataagactcactatgg

SEQ ID NO: 2861 - DNA, 18 bp, Artificial Sequence
  Synthetic DNA
gatttcgactcactatag

SEQ ID NO: 2862 - DNA, 18 bp, Artificial Sequence
  Synthetic DNA
taataagactcactagtg

SEQ ID NO: 2863 - DNA, 18 bp, Artificial Sequence
  Synthetic DNA
taatacgtctcacaatcg

SEQ ID NO: 2864 - DNA, 18 bp, Artificial Sequence
  Synthetic DNA
taattcgactcacttcag

SEQ ID NO: 2865 - DNA, 18 bp, Artificial Sequence
  Synthetic DNA
aaatacgactcaccatcg

SEQ ID NO: 2866 - DNA, 18 bp, Artificial Sequence
  Synthetic DNA
ttattcgactcactgtag

SEQ ID NO: 2867 - DNA, 18 bp, Artificial Sequence
  Synthetic DNA
taatatgactcactctcg

SEQ ID NO: 2868 - DNA, 18 bp, Artificial Sequence
  Synthetic DNA
taatgcgactctctctag

SEQ ID NO: 2869 - DNA, 18 bp, Artificial Sequence
  Synthetic DNA
taatatgtctcgctatag

SEQ ID NO: 2870 - DNA, 18 bp, Artificial Sequence
  Synthetic DNA
taatatgactcacttttg

SEQ ID NO: 2871 - DNA, 18 bp, Artificial Sequence
  Synthetic DNA
ttatacgtctcgctatag

SEQ ID NO: 2872 - DNA, 18 bp, Artificial Sequence
  Synthetic DNA
caaatcgactcactatag

SEQ ID NO: 2873 - DNA, 18 bp, Artificial Sequence
  Synthetic DNA
ttttacgactcactttag

SEQ ID NO: 2874 - DNA, 18 bp, Artificial Sequence
  Synthetic DNA
tagtacgaatcactttag

SEQ ID NO: 2875 - DNA, 18 bp, Artificial Sequence
  Synthetic DNA
caatacaactcactacag

SEQ ID NO: 2876 - DNA, 18 bp, Artificial Sequence
  Synthetic DNA
ttttacgactcactagag

SEQ ID NO: 2877 - DNA, 18 bp, Artificial Sequence
  Synthetic DNA
taatacgactaactgcag

SEQ ID NO: 2878 - DNA, 18 bp, Artificial Sequence
  Synthetic DNA
taatacggctcacaatcg

SEQ ID NO: 2879 - DNA, 18 bp, Artificial Sequence
  Synthetic DNA
ttatacaactcacgatag

SEQ ID NO: 2880 - DNA, 18 bp, Artificial Sequence
  Synthetic DNA
caatacgactcacaatcg

SEQ ID NO: 2881 - DNA, 18 bp, Artificial Sequence
  Synthetic DNA
taaaaagactcactgtag

SEQ ID NO: 2882 - DNA, 18 bp, Artificial Sequence
  Synthetic DNA
taatacgactcgccagag

SEQ ID NO: 2883 - DNA, 18 bp, Artificial Sequence
  Synthetic DNA
taatcggaatcactatag

SEQ ID NO: 2884 - DNA, 18 bp, Artificial Sequence
  Synthetic DNA
taatgcgactaactacag

SEQ ID NO: 2885 - DNA, 18 bp, Artificial Sequence
  Synthetic DNA
taatgcgcctcaccatag

SEQ ID NO: 2886 - DNA, 18 bp, Artificial Sequence
  Synthetic DNA
taattcgactcattgtag

SEQ ID NO: 2887 - DNA, 18 bp, Artificial Sequence
  Synthetic DNA
taggacgactctctatag

SEQ ID NO: 2888 - DNA, 18 bp, Artificial Sequence
  Synthetic DNA
tgatacgacacactctag

SEQ ID NO: 2889 - DNA, 18 bp, Artificial Sequence
  Synthetic DNA
ttatacgacacactgtag

SEQ ID NO: 2890 - DNA, 18 bp, Artificial Sequence
  Synthetic DNA
taatacgactcactgatg

SEQ ID NO: 2891 - DNA, 18 bp, Artificial Sequence
  Synthetic DNA
taatatgactcactactg

SEQ ID NO: 2892 - DNA, 18 bp, Artificial Sequence
  Synthetic DNA
taatacgtgtcattatag

SEQ ID NO: 2893 - DNA, 18 bp, Artificial Sequence
  Synthetic DNA
taaaacgactcactccag

SEQ ID NO: 2894 - DNA, 18 bp, Artificial Sequence
  Synthetic DNA
taagacaactcacgatag

SEQ ID NO: 2895 - DNA, 18 bp, Artificial Sequence
  Synthetic DNA
taatacgcatcaccatag

SEQ ID NO: 2896 - DNA, 18 bp, Artificial Sequence
  Synthetic DNA
taatcagactcgctatag

SEQ ID NO: 2897 - DNA, 18 bp, Artificial Sequence
  Synthetic DNA
cagtacgactcactattg

SEQ ID NO: 2898 - DNA, 18 bp, Artificial Sequence
  Synthetic DNA
gacttcgactcactatag

SEQ ID NO: 2899 - DNA, 18 bp, Artificial Sequence
  Synthetic DNA
taaaacgacgcgctatag

SEQ ID NO: 2900 - DNA, 18 bp, Artificial Sequence
  Synthetic DNA
taacacggctcagtatag

SEQ ID NO: 2901 - DNA, 18 bp, Artificial Sequence
  Synthetic DNA
taataccactcactgtcg

SEQ ID NO: 2902 - DNA, 18 bp, Artificial Sequence
  Synthetic DNA
taatacgactaactaggg

SEQ ID NO: 2903 - DNA, 18 bp, Artificial Sequence
  Synthetic DNA
taatacgactaactatta

SEQ ID NO: 2904 - DNA, 18 bp, Artificial Sequence
  Synthetic DNA
taatacgactcgatctag

SEQ ID NO: 2905 - DNA, 18 bp, Artificial Sequence
  Synthetic DNA
taataggactcactaccg

SEQ ID NO: 2906 - DNA, 18 bp, Artificial Sequence
  Synthetic DNA
taatccgactcaagatag

SEQ ID NO: 2907 - DNA, 18 bp, Artificial Sequence
  Synthetic DNA
taatccgactgagtatag

SEQ ID NO: 2908 - DNA, 18 bp, Artificial Sequence
  Synthetic DNA
taatccgtctcactataa

SEQ ID NO: 2909 - DNA, 18 bp, Artificial Sequence
  Synthetic DNA
taatgcggctcactatcg

SEQ ID NO: 2910 - DNA, 18 bp, Artificial Sequence
  Synthetic DNA
taattctacgcactatag

SEQ ID NO: 2911 - DNA, 18 bp, Artificial Sequence
  Synthetic DNA
tactaggactcactacag

SEQ ID NO: 2912 - DNA, 18 bp, Artificial Sequence
  Synthetic DNA
tatttcgactcactataa

SEQ ID NO: 2913 - DNA, 18 bp, Artificial Sequence
  Synthetic DNA
tcacacgactcactatcg

SEQ ID NO: 2914 - DNA, 18 bp, Artificial Sequence
  Synthetic DNA
tcataccactcgctatag

SEQ ID NO: 2915 - DNA, 18 bp, Artificial Sequence
  Synthetic DNA
tcatacgactcgctatcg

SEQ ID NO: 2916 - DNA, 18 bp, Artificial Sequence
  Synthetic DNA
ttacacgactcactctag

SEQ ID NO: 2917 - DNA, 18 bp, Artificial Sequence
  Synthetic DNA
aaatacgactcactattc

SEQ ID NO: 2918 - DNA, 18 bp, Artificial Sequence
  Synthetic DNA
caatacgacccactatcg

SEQ ID NO: 2919 - DNA, 18 bp, Artificial Sequence
  Synthetic DNA
caatacgactcactctgg

SEQ ID NO: 2920 - DNA, 18 bp, Artificial Sequence
  Synthetic DNA
caatacgactcattataa

SEQ ID NO: 2921 - DNA, 18 bp, Artificial Sequence
  Synthetic DNA
gaacacgacttactatag

SEQ ID NO: 2922 - DNA, 18 bp, Artificial Sequence
  Synthetic DNA
gaagacgactcagtatag

SEQ ID NO: 2923 - DNA, 18 bp, Artificial Sequence
  Synthetic DNA
gaatacgacttgctatag

SEQ ID NO: 2924 - DNA, 18 bp, Artificial Sequence
  Synthetic DNA
gaatacgattcaatatag

SEQ ID NO: 2925 - DNA, 18 bp, Artificial Sequence
  Synthetic DNA
gaataggactcaatatag

SEQ ID NO: 2926 - DNA, 18 bp, Artificial Sequence
  Synthetic DNA
gactacgacacactatag

SEQ ID NO: 2927 - DNA, 18 bp, Artificial Sequence
  Synthetic DNA
ggatacgactcaccatag

SEQ ID NO: 2928 - DNA, 18 bp, Artificial Sequence
  Synthetic DNA
gtatacgactcagtatag

SEQ ID NO: 2929 - DNA, 18 bp, Artificial Sequence
  Synthetic DNA
taacaccactcactctag

SEQ ID NO: 2930 - DNA, 18 bp, Artificial Sequence
  Synthetic DNA
taacatgactcactagag

SEQ ID NO: 2931 - DNA, 18 bp, Artificial Sequence
  Synthetic DNA
taacccgactcacgatag

SEQ ID NO: 2932 - DNA, 18 bp, Artificial Sequence
  Synthetic DNA
taagacgactcagtatgg

SEQ ID NO: 2933 - DNA, 18 bp, Artificial Sequence
  Synthetic DNA
taagactactcactctag

SEQ ID NO: 2934 - DNA, 18 bp, Artificial Sequence
  Synthetic DNA
taataagactcacgctag

SEQ ID NO: 2935 - DNA, 18 bp, Artificial Sequence
  Synthetic DNA
taatacagctcagtatag

SEQ ID NO: 2936 - DNA, 18 bp, Artificial Sequence
  Synthetic DNA
taataccactcaccagag

SEQ ID NO: 2937 - DNA, 18 bp, Artificial Sequence
  Synthetic DNA
taatacgacacactatca

SEQ ID NO: 2938 - DNA, 18 bp, Artificial Sequence
  Synthetic DNA
taatacgacgcagcatag

SEQ ID NO: 2939 - DNA, 18 bp, Artificial Sequence
  Synthetic DNA
taatacgactaactaaaa

SEQ ID NO: 2940 - DNA, 18 bp, Artificial Sequence
  Synthetic DNA
taatacgactcacaggag

SEQ ID NO: 2941 - DNA, 18 bp, Artificial Sequence
  Synthetic DNA
taatacgactcactgaaa

SEQ ID NO: 2942 - DNA, 18 bp, Artificial Sequence
  Synthetic DNA
taatacgactcgcgttag

SEQ ID NO: 2943 - DNA, 18 bp, Artificial Sequence
  Synthetic DNA
taatacgactcgctacgg

SEQ ID NO: 2944 - DNA, 18 bp, Artificial Sequence
  Synthetic DNA
taatacgactcgctcgag

SEQ ID NO: 2945 - DNA, 18 bp, Artificial Sequence
  Synthetic DNA
taatacgactctctagaa

SEQ ID NO: 2946 - DNA, 18 bp, Artificial Sequence
  Synthetic DNA
taatacgagtcaggatag

SEQ ID NO: 2947 - DNA, 18 bp, Artificial Sequence
  Synthetic DNA
taatacgagtcgctctag

SEQ ID NO: 2948 - DNA, 18 bp, Artificial Sequence
  Synthetic DNA
taatacgagtgacgatag

SEQ ID NO: 2949 - DNA, 18 bp, Artificial Sequence
  Synthetic DNA
taatacgattgactataa

SEQ ID NO: 2950 - DNA, 18 bp, Artificial Sequence
  Synthetic DNA
taatacgccgcaatatag

SEQ ID NO: 2951 - DNA, 18 bp, Artificial Sequence
  Synthetic DNA
taatacgcctccgtatag

SEQ ID NO: 2952 - DNA, 18 bp, Artificial Sequence
  Synthetic DNA
taatacgcctgaatatag

SEQ ID NO: 2953 - DNA, 18 bp, Artificial Sequence
  Synthetic DNA
taatacggcccactctag

SEQ ID NO: 2954 - DNA, 18 bp, Artificial Sequence
  Synthetic DNA
taatacggctcgctacag

SEQ ID NO: 2955 - DNA, 18 bp, Artificial Sequence
  Synthetic DNA
taatacgtatcactataa

SEQ ID NO: 2956 - DNA, 18 bp, Artificial Sequence
  Synthetic DNA
taatacgtctcactatca

SEQ ID NO: 2957 - DNA, 18 bp, Artificial Sequence
  Synthetic DNA
taatacgtctcactttac

SEQ ID NO: 2958 - DNA, 18 bp, Artificial Sequence
  Synthetic DNA
taatacgtctcgctataa

SEQ ID NO: 2959 - DNA, 18 bp, Artificial Sequence
  Synthetic DNA
taataggacccactacag

SEQ ID NO: 2960 - DNA, 18 bp, Artificial Sequence
  Synthetic DNA
taataggattcactgtag

SEQ ID NO: 2961 - DNA, 18 bp, Artificial Sequence
  Synthetic DNA
taatatgaatcacgatag

SEQ ID NO: 2962 - DNA, 18 bp, Artificial Sequence
  Synthetic DNA
taatatgactcacaataa

SEQ ID NO: 2963 - DNA, 18 bp, Artificial Sequence
  Synthetic DNA
taatccgacgcagtatag

SEQ ID NO: 2964 - DNA, 18 bp, Artificial Sequence
  Synthetic DNA
taatctgactgactatag

SEQ ID NO: 2965 - DNA, 18 bp, Artificial Sequence
  Synthetic DNA
taatgcgactcaccacag

SEQ ID NO: 2966 - DNA, 18 bp, Artificial Sequence
  Synthetic DNA
taatgcgactcgttatag

SEQ ID NO: 2967 - DNA, 18 bp, Artificial Sequence
  Synthetic DNA
taatgcgactgaccatag

SEQ ID NO: 2968 - DNA, 18 bp, Artificial Sequence
  Synthetic DNA
taatgcgcctcagtatag

SEQ ID NO: 2969 - DNA, 18 bp, Artificial Sequence
  Synthetic DNA
taattcgactctctatat

SEQ ID NO: 2970 - DNA, 18 bp, Artificial Sequence
  Synthetic DNA
tactacgacgcactctag

SEQ ID NO: 2971 - DNA, 18 bp, Artificial Sequence
  Synthetic DNA
tactacgactgagtatag

SEQ ID NO: 2972 - DNA, 18 bp, Artificial Sequence
  Synthetic DNA
tactacgcctgactatag

SEQ ID NO: 2973 - DNA, 18 bp, Artificial Sequence
  Synthetic DNA
tactacggcccactatag

SEQ ID NO: 2974 - DNA, 18 bp, Artificial Sequence
  Synthetic DNA
tactatgactaactatag

SEQ ID NO: 2975 - DNA, 18 bp, Artificial Sequence
  Synthetic DNA
tagtacgactcactaggg

SEQ ID NO: 2976 - DNA, 18 bp, Artificial Sequence
  Synthetic DNA
tagtacgactcgccatag

SEQ ID NO: 2977 - DNA, 18 bp, Artificial Sequence
  Synthetic DNA
tcataggactcactatgg

SEQ ID NO: 2978 - DNA, 18 bp, Artificial Sequence
  Synthetic DNA
tcatagggctcactatag

SEQ ID NO: 2979 - DNA, 18 bp, Artificial Sequence
  Synthetic DNA
tgataagactcactgtag

SEQ ID NO: 2980 - DNA, 18 bp, Artificial Sequence
  Synthetic DNA
tgatacgaatcactagag

SEQ ID NO: 2981 - DNA, 18 bp, Artificial Sequence
  Synthetic DNA
tgattcgactcactagag

SEQ ID NO: 2982 - DNA, 18 bp, Artificial Sequence
  Synthetic DNA
ttatacgacccactctag

SEQ ID NO: 2983 - DNA, 18 bp, Artificial Sequence
  Synthetic DNA
ttatacgtctcactatat

SEQ ID NO: 2984 - DNA, 18 bp, Artificial Sequence
  Synthetic DNA
ttatgcgactcagtatag

SEQ ID NO: 2985 - DNA, 18 bp, Artificial Sequence
  Synthetic DNA
ttatacgtctcactgtag

SEQ ID NO: 2986 - DNA, 18 bp, Artificial Sequence
  Synthetic DNA
taattcgactcacttttg

SEQ ID NO: 2987 - DNA, 18 bp, Artificial Sequence
  Synthetic DNA
tattacaactcagtatag

SEQ ID NO: 2988 - DNA, 18 bp, Artificial Sequence
  Synthetic DNA
tattcagactcactatag

SEQ ID NO: 2989 - DNA, 18 bp, Artificial Sequence
  Synthetic DNA
taaaacaactcaccatag

SEQ ID NO: 2990 - DNA, 18 bp, Artificial Sequence
  Synthetic DNA
taattcgactctctatgg

SEQ ID NO: 2991 - DNA, 18 bp, Artificial Sequence
  Synthetic DNA
taattcgcttcactatag

SEQ ID NO: 2992 - DNA, 18 bp, Artificial Sequence
  Synthetic DNA
taattcgactcactgcag

SEQ ID NO: 2993 - DNA, 18 bp, Artificial Sequence
  Synthetic DNA
tattgcgactcaccatag

SEQ ID NO: 2994 - DNA, 18 bp, Artificial Sequence
  Synthetic DNA
taattcgactctctattg

SEQ ID NO: 2995 - DNA, 18 bp, Artificial Sequence
  Synthetic DNA
tgatacgtctcactaaag

SEQ ID NO: 2996 - DNA, 18 bp, Artificial Sequence
  Synthetic DNA
taatacgcttcactatcg

SEQ ID NO: 2997 - DNA, 18 bp, Artificial Sequence
  Synthetic DNA
aaatacgactcacgctag

SEQ ID NO: 2998 - DNA, 18 bp, Artificial Sequence
  Synthetic DNA
taatacgactcaccaacg

SEQ ID NO: 2999 - DNA, 18 bp, Artificial Sequence
  Synthetic DNA
ttataggactcactgtag

SEQ ID NO: 3000 - DNA, 18 bp, Artificial Sequence
  Synthetic DNA
caaaacgactcactttag

SEQ ID NO: 3001 - DNA, 18 bp, Artificial Sequence
  Synthetic DNA
tacaccgactcactatag

SEQ ID NO: 3002 - DNA, 18 bp, Artificial Sequence
  Synthetic DNA
aaattcgactcaccatag

SEQ ID NO: 3003 - DNA, 18 bp, Artificial Sequence
  Synthetic DNA
taatttgactcactaaag

SEQ ID NO: 3004 - DNA, 18 bp, Artificial Sequence
  Synthetic DNA
taaaataactcactatag

SEQ ID NO: 3005 - DNA, 18 bp, Artificial Sequence
  Synthetic DNA
ttatttgactcactatag

SEQ ID NO: 3006 - DNA, 18 bp, Artificial Sequence
  Synthetic DNA
taatccgactcactagtg

SEQ ID NO: 3007 - DNA, 18 bp, Artificial Sequence
  Synthetic DNA
taatgagactcactaaag

SEQ ID NO: 3008 - DNA, 18 bp, Artificial Sequence
  Synthetic DNA
caagacgacttactatag

SEQ ID NO: 3009 - DNA, 18 bp, Artificial Sequence
  Synthetic DNA
taagacgacttgctatag

SEQ ID NO: 3010 - DNA, 18 bp, Artificial Sequence
  Synthetic DNA
taataggactcagtattg

SEQ ID NO: 3011 - DNA, 18 bp, Artificial Sequence
  Synthetic DNA
taattcgactcgcgatag

SEQ ID NO: 3012 - DNA, 18 bp, Artificial Sequence
  Synthetic DNA
taatacgactcacagttg

SEQ ID NO: 3013 - DNA, 18 bp, Artificial Sequence
  Synthetic DNA
taatacgcctctctacag

SEQ ID NO: 3014 - DNA, 18 bp, Artificial Sequence
  Synthetic DNA
taattagactcactgtag

SEQ ID NO: 3015 - DNA, 18 bp, Artificial Sequence
  Synthetic DNA
tattacaactcactgtag

SEQ ID NO: 3016 - DNA, 18 bp, Artificial Sequence
  Synthetic DNA
taatacgcctcactcttg

SEQ ID NO: 3017 - DNA, 18 bp, Artificial Sequence
  Synthetic DNA
taaaacaactcgctatag

SEQ ID NO: 3018 - DNA, 18 bp, Artificial Sequence
  Synthetic DNA
taatacgtctcgctatgg

SEQ ID NO: 3019 - DNA, 18 bp, Artificial Sequence
  Synthetic DNA
ttattcgactcactagag

SEQ ID NO: 3020 - DNA, 18 bp, Artificial Sequence
  Synthetic DNA
ttatacaactcactatcg

SEQ ID NO: 3021 - DNA, 18 bp, Artificial Sequence
  Synthetic DNA
ttatacgactctctgtag

SEQ ID NO: 3022 - DNA, 18 bp, Artificial Sequence
  Synthetic DNA
taatacgcatcactatcg

SEQ ID NO: 3023 - DNA, 18 bp, Artificial Sequence
  Synthetic DNA
taataggactcactaagg

SEQ ID NO: 3024 - DNA, 18 bp, Artificial Sequence
  Synthetic DNA
taatatgactcactgttg

SEQ ID NO: 3025 - DNA, 18 bp, Artificial Sequence
  Synthetic DNA
ttatacgactcagtatcg

SEQ ID NO: 3026 - DNA, 18 bp, Artificial Sequence
  Synthetic DNA
caatacgcatcactatag

SEQ ID NO: 3027 - DNA, 18 bp, Artificial Sequence
  Synthetic DNA
taaaacgactcactacgg

SEQ ID NO: 3028 - DNA, 18 bp, Artificial Sequence
  Synthetic DNA
taacacgcctcgctatag

SEQ ID NO: 3029 - DNA, 18 bp, Artificial Sequence
  Synthetic DNA
taataagactcagtgtag

SEQ ID NO: 3030 - DNA, 18 bp, Artificial Sequence
  Synthetic DNA
taatgggactcagtatag

SEQ ID NO: 3031 - DNA, 18 bp, Artificial Sequence
  Synthetic DNA
tgatacaacccactatag

SEQ ID NO: 3032 - DNA, 18 bp, Artificial Sequence
  Synthetic DNA
tattaagactcactacag

SEQ ID NO: 3033 - DNA, 18 bp, Artificial Sequence
  Synthetic DNA
tgatacgtctcactacag

SEQ ID NO: 3034 - DNA, 18 bp, Artificial Sequence
  Synthetic DNA
taattcgactcacgttag

SEQ ID NO: 3035 - DNA, 18 bp, Artificial Sequence
  Synthetic DNA
ttatacgactctctatgg

SEQ ID NO: 3036 - DNA, 18 bp, Artificial Sequence
  Synthetic DNA
aaatacgactcactgtcg

SEQ ID NO: 3037 - DNA, 18 bp, Artificial Sequence
  Synthetic DNA
taatcggactcactctag

SEQ ID NO: 3038 - DNA, 18 bp, Artificial Sequence
  Synthetic DNA
tatcacgactcactgtag

SEQ ID NO: 3039 - DNA, 18 bp, Artificial Sequence
  Synthetic DNA
taatacgtctcacttcag

SEQ ID NO: 3040 - DNA, 18 bp, Artificial Sequence
  Synthetic DNA
taatacgactcaccttgg

SEQ ID NO: 3041 - DNA, 18 bp, Artificial Sequence
  Synthetic DNA
taatacgactctatagag

SEQ ID NO: 3042 - DNA, 18 bp, Artificial Sequence
  Synthetic DNA
tagtacacctcactatag

SEQ ID NO: 3043 - DNA, 18 bp, Artificial Sequence
  Synthetic DNA
ttttacgtctcactatag

SEQ ID NO: 3044 - DNA, 18 bp, Artificial Sequence
  Synthetic DNA
taatagctctcactatag

SEQ ID NO: 3045 - DNA, 18 bp, Artificial Sequence
  Synthetic DNA
tattacgactcaccctag

SEQ ID NO: 3046 - DNA, 18 bp, Artificial Sequence
  Synthetic DNA
tattacgtctcactctag

SEQ ID NO: 3047 - DNA, 18 bp, Artificial Sequence
  Synthetic DNA
taaaacgactcacactag

SEQ ID NO: 3048 - DNA, 18 bp, Artificial Sequence
  Synthetic DNA
taattcgtctcactctag

SEQ ID NO: 3049 - DNA, 18 bp, Artificial Sequence
  Synthetic DNA
ttatgcaactcactatag

SEQ ID NO: 3050 - DNA, 18 bp, Artificial Sequence
  Synthetic DNA
ttataggactcactattg

SEQ ID NO: 3051 - DNA, 18 bp, Artificial Sequence
  Synthetic DNA
ttataagactcactagag

SEQ ID NO: 3052 - DNA, 18 bp, Artificial Sequence
  Synthetic DNA
aaatgcgactcaccatag

SEQ ID NO: 3053 - DNA, 18 bp, Artificial Sequence
  Synthetic DNA
tattacgactcactacgg

SEQ ID NO: 3054 - DNA, 18 bp, Artificial Sequence
  Synthetic DNA
caatacgactaactctag

SEQ ID NO: 3055 - DNA, 18 bp, Artificial Sequence
  Synthetic DNA
gaaatcgactcactatag

SEQ ID NO: 3056 - DNA, 18 bp, Artificial Sequence
  Synthetic DNA
gtatatgactcactatag

SEQ ID NO: 3057 - DNA, 18 bp, Artificial Sequence
  Synthetic DNA
taataagactcactaggg

SEQ ID NO: 3058 - DNA, 18 bp, Artificial Sequence
  Synthetic DNA
taatacgactcaataccg

SEQ ID NO: 3059 - DNA, 18 bp, Artificial Sequence
  Synthetic DNA
taatacgagtgacaatag

SEQ ID NO: 3060 - DNA, 18 bp, Artificial Sequence
  Synthetic DNA
taatccgactcaccatcg

SEQ ID NO: 3061 - DNA, 18 bp, Artificial Sequence
  Synthetic DNA
tattacgacgcactatcg

SEQ ID NO: 3062 - DNA, 18 bp, Artificial Sequence
  Synthetic DNA
tgatacgtctcagtatag

SEQ ID NO: 3063 - DNA, 18 bp, Artificial Sequence
  Synthetic DNA
cgatacgacttactatag

SEQ ID NO: 3064 - DNA, 18 bp, Artificial Sequence
  Synthetic DNA
gaatacgactccttatag

SEQ ID NO: 3065 - DNA, 18 bp, Artificial Sequence
  Synthetic DNA
gattacgactcactgtag

SEQ ID NO: 3066 - DNA, 18 bp, Artificial Sequence
  Synthetic DNA
taaaacgactcactatcc

SEQ ID NO: 3067 - DNA, 18 bp, Artificial Sequence
  Synthetic DNA
taaaaggactcactagag

SEQ ID NO: 3068 - DNA, 18 bp, Artificial Sequence
  Synthetic DNA
taagaccactcagtatag

SEQ ID NO: 3069 - DNA, 18 bp, Artificial Sequence
  Synthetic DNA
taagacgccacactatag

SEQ ID NO: 3070 - DNA, 18 bp, Artificial Sequence
  Synthetic DNA
taataaaacgcactatag

SEQ ID NO: 3071 - DNA, 18 bp, Artificial Sequence
  Synthetic DNA
taataacactcaccatag

SEQ ID NO: 3072 - DNA, 18 bp, Artificial Sequence
  Synthetic DNA
taataagacccactatgg

SEQ ID NO: 3073 - DNA, 18 bp, Artificial Sequence
  Synthetic DNA
taatacgactaactctcg

SEQ ID NO: 3074 - DNA, 18 bp, Artificial Sequence
  Synthetic DNA
taatacgactcaatagcg

SEQ ID NO: 3075 - DNA, 18 bp, Artificial Sequence
  Synthetic DNA
taatacgcatcactgtag

SEQ ID NO: 3076 - DNA, 18 bp, Artificial Sequence
  Synthetic DNA
taatagcactcaccatag

SEQ ID NO: 3077 - DNA, 18 bp, Artificial Sequence
  Synthetic DNA
taatccgactaactctag

SEQ ID NO: 3078 - DNA, 18 bp, Artificial Sequence
  Synthetic DNA
taatgcgactccccatag

SEQ ID NO: 3079 - DNA, 18 bp, Artificial Sequence
  Synthetic DNA
taatgtgactccctatag

SEQ ID NO: 3080 - DNA, 18 bp, Artificial Sequence
  Synthetic DNA
tactacgcatcactatag

SEQ ID NO: 3081 - DNA, 18 bp, Artificial Sequence
  Synthetic DNA
tatgacgactcactacag

SEQ ID NO: 3082 - DNA, 18 bp, Artificial Sequence
  Synthetic DNA
tattacgactcactttac

SEQ ID NO: 3083 - DNA, 18 bp, Artificial Sequence
  Synthetic DNA
ttggacgactcactatag

SEQ ID NO: 3084 - DNA, 18 bp, Artificial Sequence
  Synthetic DNA
ttaaacgactcactctag

SEQ ID NO: 3085 - DNA, 18 bp, Artificial Sequence
  Synthetic DNA
ttatctgactcactatag

SEQ ID NO: 3086 - DNA, 18 bp, Artificial Sequence
  Synthetic DNA
taatacaactcacttaag

SEQ ID NO: 3087 - DNA, 18 bp, Artificial Sequence
  Synthetic DNA
aaattcgcctcactatag

SEQ ID NO: 3088 - DNA, 18 bp, Artificial Sequence
  Synthetic DNA
tattaagactcactaaag

SEQ ID NO: 3089 - DNA, 18 bp, Artificial Sequence
  Synthetic DNA
tgataagactcactttag

SEQ ID NO: 3090 - DNA, 18 bp, Artificial Sequence
  Synthetic DNA
taatgagactcactattg

SEQ ID NO: 3091 - DNA, 18 bp, Artificial Sequence
  Synthetic DNA
taatacgactcgatattg

SEQ ID NO: 3092 - DNA, 18 bp, Artificial Sequence
  Synthetic DNA
tatttcgactcactctag

SEQ ID NO: 3093 - DNA, 18 bp, Artificial Sequence
  Synthetic DNA
tgatacgtctcactctag

SEQ ID NO: 3094 - DNA, 18 bp, Artificial Sequence
  Synthetic DNA
taatacgccccactttag

SEQ ID NO: 3095 - DNA, 18 bp, Artificial Sequence
  Synthetic DNA
taatactactaactatcg

SEQ ID NO: 3096 - DNA, 18 bp, Artificial Sequence
  Synthetic DNA
tattacaactcactatcg

SEQ ID NO: 3097 - DNA, 18 bp, Artificial Sequence
  Synthetic DNA
taaagtgactcactatag

SEQ ID NO: 3098 - DNA, 18 bp, Artificial Sequence
  Synthetic DNA
ttataggcctcactatag

SEQ ID NO: 3099 - DNA, 18 bp, Artificial Sequence
  Synthetic DNA
cattacgactcactttag

SEQ ID NO: 3100 - DNA, 18 bp, Artificial Sequence
  Synthetic DNA
aattacgactcaccatag

SEQ ID NO: 3101 - DNA, 18 bp, Artificial Sequence
  Synthetic DNA
taatacaactcaccacag

SEQ ID NO: 3102 - DNA, 18 bp, Artificial Sequence
  Synthetic DNA
gaataagacccactatag

SEQ ID NO: 3103 - DNA, 18 bp, Artificial Sequence
  Synthetic DNA
taaggcgactcactattg

SEQ ID NO: 3104 - DNA, 18 bp, Artificial Sequence
  Synthetic DNA
taataagcctcactatcg

SEQ ID NO: 3105 - DNA, 18 bp, Artificial Sequence
  Synthetic DNA
tattacgactaactagag

SEQ ID NO: 3106 - DNA, 18 bp, Artificial Sequence
  Synthetic DNA
tgattcgactcactattg

SEQ ID NO: 3107 - DNA, 18 bp, Artificial Sequence
  Synthetic DNA
taattcgactcactctcg

SEQ ID NO: 3108 - DNA, 18 bp, Artificial Sequence
  Synthetic DNA
taatacaactcactttgg

SEQ ID NO: 3109 - DNA, 18 bp, Artificial Sequence
  Synthetic DNA
taatacgactcagtaatg

SEQ ID NO: 3110 - DNA, 18 bp, Artificial Sequence
  Synthetic DNA
taatacgcctcacagtag

SEQ ID NO: 3111 - DNA, 18 bp, Artificial Sequence
  Synthetic DNA
tagtacggctcactatcg

SEQ ID NO: 3112 - DNA, 18 bp, Artificial Sequence
  Synthetic DNA
tgatacgcctcactttag

SEQ ID NO: 3113 - DNA, 18 bp, Artificial Sequence
  Synthetic DNA
taaaacgtctcactttag

SEQ ID NO: 3114 - DNA, 18 bp, Artificial Sequence
  Synthetic DNA
taatacaactcactcttg

SEQ ID NO: 3115 - DNA, 18 bp, Artificial Sequence
  Synthetic DNA
taaaacgactcaccctag

SEQ ID NO: 3116 - DNA, 18 bp, Artificial Sequence
  Synthetic DNA
taatagaactcagtatag

SEQ ID NO: 3117 - DNA, 18 bp, Artificial Sequence
  Synthetic DNA
taccacgactcattatag

SEQ ID NO: 3118 - DNA, 18 bp, Artificial Sequence
  Synthetic DNA
tgatacgacagactatag

SEQ ID NO: 3119 - DNA, 18 bp, Artificial Sequence
  Synthetic DNA
tattacgactcactgttg

SEQ ID NO: 3120 - DNA, 18 bp, Artificial Sequence
  Synthetic DNA
taatttgactcgctatag

SEQ ID NO: 3121 - DNA, 18 bp, Artificial Sequence
  Synthetic DNA
tataaggactcactatag

SEQ ID NO: 3122 - DNA, 18 bp, Artificial Sequence
  Synthetic DNA
ttttacaactcactatag

SEQ ID NO: 3123 - DNA, 18 bp, Artificial Sequence
  Synthetic DNA
taaaacgactcaatctag

SEQ ID NO: 3124 - DNA, 18 bp, Artificial Sequence
  Synthetic DNA
taatacgactcactaata

SEQ ID NO: 3125 - DNA, 18 bp, Artificial Sequence
  Synthetic DNA
taatacgactcgctgtcg

SEQ ID NO: 3126 - DNA, 18 bp, Artificial Sequence
  Synthetic DNA
ttacacgactcactattg

SEQ ID NO: 3127 - DNA, 18 bp, Artificial Sequence
  Synthetic DNA
taataagactcactgaag

SEQ ID NO: 3128 - DNA, 18 bp, Artificial Sequence
  Synthetic DNA
ttacacgactcactgtag

SEQ ID NO: 3129 - DNA, 18 bp, Artificial Sequence
  Synthetic DNA
ttatacgactcattctag

SEQ ID NO: 3130 - DNA, 18 bp, Artificial Sequence
  Synthetic DNA
ttaatcgactcactatag

SEQ ID NO: 3131 - DNA, 18 bp, Artificial Sequence
  Synthetic DNA
taatcggactcactaaag

SEQ ID NO: 3132 - DNA, 18 bp, Artificial Sequence
  Synthetic DNA
tactacgactcgctattg

SEQ ID NO: 3133 - DNA, 18 bp, Artificial Sequence
  Synthetic DNA
tattacaactcactttag

SEQ ID NO: 3134 - DNA, 18 bp, Artificial Sequence
  Synthetic DNA
cattacgtctcactatag

SEQ ID NO: 3135 - DNA, 18 bp, Artificial Sequence
  Synthetic DNA
ttatacgactcacttttg

SEQ ID NO: 3136 - DNA, 18 bp, Artificial Sequence
  Synthetic DNA
taataagtctcgctatag

SEQ ID NO: 3137 - DNA, 18 bp, Artificial Sequence
  Synthetic DNA
taattagtctcactatag

SEQ ID NO: 3138 - DNA, 18 bp, Artificial Sequence
  Synthetic DNA
ttatacgactcacttcag

SEQ ID NO: 3139 - DNA, 18 bp, Artificial Sequence
  Synthetic DNA
ttatacgactctctacag

SEQ ID NO: 3140 - DNA, 18 bp, Artificial Sequence
  Synthetic DNA
taatacgactcgcttaag

SEQ ID NO: 3141 - DNA, 18 bp, Artificial Sequence
  Synthetic DNA
tattacgtctcactaaag

SEQ ID NO: 3142 - DNA, 18 bp, Artificial Sequence
  Synthetic DNA
tatttcgactcactttag

SEQ ID NO: 3143 - DNA, 18 bp, Artificial Sequence
  Synthetic DNA
taaaaagactcactaaag

SEQ ID NO: 3144 - DNA, 18 bp, Artificial Sequence
  Synthetic DNA
taatacagctcactattg

SEQ ID NO: 3145 - DNA, 18 bp, Artificial Sequence
  Synthetic DNA
taatacgacttgctattg

SEQ ID NO: 3146 - DNA, 18 bp, Artificial Sequence
  Synthetic DNA
caattcgactcactatcg

SEQ ID NO: 3147 - DNA, 18 bp, Artificial Sequence
  Synthetic DNA
taatccgacgcactttag

SEQ ID NO: 3148 - DNA, 18 bp, Artificial Sequence
  Synthetic DNA
taataatactcagtatag

SEQ ID NO: 3149 - DNA, 18 bp, Artificial Sequence
  Synthetic DNA
taataggtctcactacag

SEQ ID NO: 3150 - DNA, 18 bp, Artificial Sequence
  Synthetic DNA
taatatgacccactgtag

SEQ ID NO: 3151 - DNA, 18 bp, Artificial Sequence
  Synthetic DNA
taatgtgactcactctag

SEQ ID NO: 3152 - DNA, 18 bp, Artificial Sequence
  Synthetic DNA
tcatacgagtcactacag

SEQ ID NO: 3153 - DNA, 18 bp, Artificial Sequence
  Synthetic DNA
ttctccgactcactatag

SEQ ID NO: 3154 - DNA, 18 bp, Artificial Sequence
  Synthetic DNA
taatacgagtcactaatg

SEQ ID NO: 3155 - DNA, 18 bp, Artificial Sequence
  Synthetic DNA
tattacgactctcgatag

SEQ ID NO: 3156 - DNA, 18 bp, Artificial Sequence
  Synthetic DNA
taaaacgtctcactatcg

SEQ ID NO: 3157 - DNA, 18 bp, Artificial Sequence
  Synthetic DNA
taattggactcacaatag

SEQ ID NO: 3158 - DNA, 18 bp, Artificial Sequence
  Synthetic DNA
ctataggactcactatag

SEQ ID NO: 3159 - DNA, 18 bp, Artificial Sequence
  Synthetic DNA
taatacgactaactactg

SEQ ID NO: 3160 - DNA, 18 bp, Artificial Sequence
  Synthetic DNA
taatagaattcactatag

SEQ ID NO: 3161 - DNA, 18 bp, Artificial Sequence
  Synthetic DNA
taatatgacgcactaaag

SEQ ID NO: 3162 - DNA, 18 bp, Artificial Sequence
  Synthetic DNA
taatatgcgtcactatag

SEQ ID NO: 3163 - DNA, 18 bp, Artificial Sequence
  Synthetic DNA
taataatgctcactatag

SEQ ID NO: 3164 - DNA, 18 bp, Artificial Sequence
  Synthetic DNA
taatacgactcacgcaag

SEQ ID NO: 3165 - DNA, 18 bp, Artificial Sequence
  Synthetic DNA
taatacgactggctattg

SEQ ID NO: 3166 - DNA, 18 bp, Artificial Sequence
  Synthetic DNA
taatacgcatcagtatag

SEQ ID NO: 3167 - DNA, 18 bp, Artificial Sequence
  Synthetic DNA
taataggactcaaaatag

SEQ ID NO: 3168 - DNA, 18 bp, Artificial Sequence
  Synthetic DNA
tagtacgactcactcgag

SEQ ID NO: 3169 - DNA, 18 bp, Artificial Sequence
  Synthetic DNA
gtatacgactcaccatag

SEQ ID NO: 3170 - DNA, 18 bp, Artificial Sequence
  Synthetic DNA
taaatcgactcactataa

SEQ ID NO: 3171 - DNA, 18 bp, Artificial Sequence
  Synthetic DNA
taacaaaactcactatag

SEQ ID NO: 3172 - DNA, 18 bp, Artificial Sequence
  Synthetic DNA
taagacgacacactacag

SEQ ID NO: 3173 - DNA, 18 bp, Artificial Sequence
  Synthetic DNA
taagacgactaactacag

SEQ ID NO: 3174 - DNA, 18 bp, Artificial Sequence
  Synthetic DNA
taataagactaactacag

SEQ ID NO: 3175 - DNA, 18 bp, Artificial Sequence
  Synthetic DNA
taatacgactcacttaaa

SEQ ID NO: 3176 - DNA, 18 bp, Artificial Sequence
  Synthetic DNA
taatacgactcacttgaa

SEQ ID NO: 3177 - DNA, 18 bp, Artificial Sequence
  Synthetic DNA
taatacgagcaactatag

SEQ ID NO: 3178 - DNA, 18 bp, Artificial Sequence
  Synthetic DNA
taatacgcctcactaccg

SEQ ID NO: 3179 - DNA, 18 bp, Artificial Sequence
  Synthetic DNA
taatacgcctcagtctag

SEQ ID NO: 3180 - DNA, 18 bp, Artificial Sequence
  Synthetic DNA
taatacgcctccctctag

SEQ ID NO: 3181 - DNA, 18 bp, Artificial Sequence
  Synthetic DNA
taatacgtctccctataa

SEQ ID NO: 3182 - DNA, 18 bp, Artificial Sequence
  Synthetic DNA
taatgcgactcattacag

SEQ ID NO: 3183 - DNA, 18 bp, Artificial Sequence
  Synthetic DNA
tactacgacttgctatag

SEQ ID NO: 3184 - DNA, 18 bp, Artificial Sequence
  Synthetic DNA
tcatccgactcattatag

SEQ ID NO: 3185 - DNA, 18 bp, Artificial Sequence
  Synthetic DNA
tgctacgacttactatag

SEQ ID NO: 3186 - DNA, 18 bp, Artificial Sequence
  Synthetic DNA
aaagacgactcaccatag

SEQ ID NO: 3187 - DNA, 18 bp, Artificial Sequence
  Synthetic DNA
aaatacaactcacgatag

SEQ ID NO: 3188 - DNA, 18 bp, Artificial Sequence
  Synthetic DNA
aaatacgacccactgtag

SEQ ID NO: 3189 - DNA, 18 bp, Artificial Sequence
  Synthetic DNA
caatacgacgaactatag

SEQ ID NO: 3190 - DNA, 18 bp, Artificial Sequence
  Synthetic DNA
caatacgactcggtatag

SEQ ID NO: 3191 - DNA, 18 bp, Artificial Sequence
  Synthetic DNA
caatacgattcagtatag

SEQ ID NO: 3192 - DNA, 18 bp, Artificial Sequence
  Synthetic DNA
caataggacccactatag

SEQ ID NO: 3193 - DNA, 18 bp, Artificial Sequence
  Synthetic DNA
caatgcgactcactacag

SEQ ID NO: 3194 - DNA, 18 bp, Artificial Sequence
  Synthetic DNA
cactacgactcaatatag

SEQ ID NO: 3195 - DNA, 18 bp, Artificial Sequence
  Synthetic DNA
cagtacaactcactatag

SEQ ID NO: 3196 - DNA, 18 bp, Artificial Sequence
  Synthetic DNA
gaataagactcgctatag

SEQ ID NO: 3197 - DNA, 18 bp, Artificial Sequence
  Synthetic DNA
gaataagacttactatag

SEQ ID NO: 3198 - DNA, 18 bp, Artificial Sequence
  Synthetic DNA
gaatacgtctccctatag

SEQ ID NO: 3199 - DNA, 18 bp, Artificial Sequence
  Synthetic DNA
gaataggacacactatag

SEQ ID NO: 3200 - DNA, 18 bp, Artificial Sequence
  Synthetic DNA
gaattcgactcactagag

SEQ ID NO: 3201 - DNA, 18 bp, Artificial Sequence
  Synthetic DNA
gattacgactcactagag

SEQ ID NO: 3202 - DNA, 18 bp, Artificial Sequence
  Synthetic DNA
taacacgcgtcactatag

SEQ ID NO: 3203 - DNA, 18 bp, Artificial Sequence
  Synthetic DNA
taacaggacccactatag

SEQ ID NO: 3204 - DNA, 18 bp, Artificial Sequence
  Synthetic DNA
taacccgactcactctag

SEQ ID NO: 3205 - DNA, 18 bp, Artificial Sequence
  Synthetic DNA
taagaccactcactatcg

SEQ ID NO: 3206 - DNA, 18 bp, Artificial Sequence
  Synthetic DNA
taagacgacacgctatag

SEQ ID NO: 3207 - DNA, 18 bp, Artificial Sequence
  Synthetic DNA
taagacgccttactatag

SEQ ID NO: 3208 - DNA, 18 bp, Artificial Sequence
  Synthetic DNA
taagtcggctcactatag

SEQ ID NO: 3209 - DNA, 18 bp, Artificial Sequence
  Synthetic DNA
taataagactctctatat

SEQ ID NO: 3210 - DNA, 18 bp, Artificial Sequence
  Synthetic DNA
taataccacgcactgtag

SEQ ID NO: 3211 - DNA, 18 bp, Artificial Sequence
  Synthetic DNA
taatacgacacactaaaa

SEQ ID NO: 3212 - DNA, 18 bp, Artificial Sequence
  Synthetic DNA
taatacgacacactattc

SEQ ID NO: 3213 - DNA, 18 bp, Artificial Sequence
  Synthetic DNA
taatacgacccaatgtag

SEQ ID NO: 3214 - DNA, 18 bp, Artificial Sequence
  Synthetic DNA
taatacgacccgctatgg

SEQ ID NO: 3215 - DNA, 18 bp, Artificial Sequence
  Synthetic DNA
taatacgacgccctaaag

SEQ ID NO: 3216 - DNA, 18 bp, Artificial Sequence
  Synthetic DNA
taatacgacgctatatag

SEQ ID NO: 3217 - DNA, 18 bp, Artificial Sequence
  Synthetic DNA
taatacgactcaagatcg

SEQ ID NO: 3218 - DNA, 18 bp, Artificial Sequence
  Synthetic DNA
taatacgactcacttcac

SEQ ID NO: 3219 - DNA, 18 bp, Artificial Sequence
  Synthetic DNA
taatacgactggccatag

SEQ ID NO: 3220 - DNA, 18 bp, Artificial Sequence
  Synthetic DNA
taatacgacttactacgg

SEQ ID NO: 3221 - DNA, 18 bp, Artificial Sequence
  Synthetic DNA
taatacgagtcaatgtag

SEQ ID NO: 3222 - DNA, 18 bp, Artificial Sequence
  Synthetic DNA
taatacgattcactaaaa

SEQ ID NO: 3223 - DNA, 18 bp, Artificial Sequence
  Synthetic DNA
taatacgcccccctatag

SEQ ID NO: 3224 - DNA, 18 bp, Artificial Sequence
  Synthetic DNA
taatacgcctcagtatgg

SEQ ID NO: 3225 - DNA, 18 bp, Artificial Sequence
  Synthetic DNA
taatacgcctccccatag

SEQ ID NO: 3226 - DNA, 18 bp, Artificial Sequence
  Synthetic DNA
taatacgcttcactagag

SEQ ID NO: 3227 - DNA, 18 bp, Artificial Sequence
  Synthetic DNA
taatacggctcattctag

SEQ ID NO: 3228 - DNA, 18 bp, Artificial Sequence
  Synthetic DNA
taatacgtctcacaataa

SEQ ID NO: 3229 - DNA, 18 bp, Artificial Sequence
  Synthetic DNA
taataggagtcactatgg

SEQ ID NO: 3230 - DNA, 18 bp, Artificial Sequence
  Synthetic DNA
taatatgactcacgctag

SEQ ID NO: 3231 - DNA, 18 bp, Artificial Sequence
  Synthetic DNA
taatccgactcgcaatag

SEQ ID NO: 3232 - DNA, 18 bp, Artificial Sequence
  Synthetic DNA
taatccgagtcactatcg

SEQ ID NO: 3233 - DNA, 18 bp, Artificial Sequence
  Synthetic DNA
taatccgcatcactatag

SEQ ID NO: 3234 - DNA, 18 bp, Artificial Sequence
  Synthetic DNA
taatgcgactcactctcg

SEQ ID NO: 3235 - DNA, 18 bp, Artificial Sequence
  Synthetic DNA
taatgcgactcatgatag

SEQ ID NO: 3236 - DNA, 18 bp, Artificial Sequence
  Synthetic DNA
taatgggacacactatag

SEQ ID NO: 3237 - DNA, 18 bp, Artificial Sequence
  Synthetic DNA
taattcgacgcagtatag

SEQ ID NO: 3238 - DNA, 18 bp, Artificial Sequence
  Synthetic DNA
tacgacggctcactatag

SEQ ID NO: 3239 - DNA, 18 bp, Artificial Sequence
  Synthetic DNA
tactacgcctccctatag

SEQ ID NO: 3240 - DNA, 18 bp, Artificial Sequence
  Synthetic DNA
tactaggactcactatcg

SEQ ID NO: 3241 - DNA, 18 bp, Artificial Sequence
  Synthetic DNA
tactgcgactcactagag

SEQ ID NO: 3242 - DNA, 18 bp, Artificial Sequence
  Synthetic DNA
tacttcgactcactagag

SEQ ID NO: 3243 - DNA, 18 bp, Artificial Sequence
  Synthetic DNA
tagtacgactcagtctag

SEQ ID NO: 3244 - DNA, 18 bp, Artificial Sequence
  Synthetic DNA
tagtacgactcgctacag

SEQ ID NO: 3245 - DNA, 18 bp, Artificial Sequence
  Synthetic DNA
tagtaggacttactatag

SEQ ID NO: 3246 - DNA, 18 bp, Artificial Sequence
  Synthetic DNA
tattacgactcacaatac

SEQ ID NO: 3247 - DNA, 18 bp, Artificial Sequence
  Synthetic DNA
tattacgactcactgtgg

SEQ ID NO: 3248 - DNA, 18 bp, Artificial Sequence
  Synthetic DNA
tattacgactcactttat

SEQ ID NO: 3249 - DNA, 18 bp, Artificial Sequence
  Synthetic DNA
tattatgactcactatat

SEQ ID NO: 3250 - DNA, 18 bp, Artificial Sequence
  Synthetic DNA
tcatacgacgcactacag

SEQ ID NO: 3251 - DNA, 18 bp, Artificial Sequence
  Synthetic DNA
tcatacgactcagtagag

SEQ ID NO: 3252 - DNA, 18 bp, Artificial Sequence
  Synthetic DNA
tcccacgactcactatag

SEQ ID NO: 3253 - DNA, 18 bp, Artificial Sequence
  Synthetic DNA
tgatacgactcactctaa

SEQ ID NO: 3254 - DNA, 18 bp, Artificial Sequence
  Synthetic DNA
tgatatgactcactagag

SEQ ID NO: 3255 - DNA, 18 bp, Artificial Sequence
  Synthetic DNA
ttatacgactcacaataa

SEQ ID NO: 3256 - DNA, 18 bp, Artificial Sequence
  Synthetic DNA
ttatacgactgacgatag

SEQ ID NO: 3257 - DNA, 18 bp, Artificial Sequence
  Synthetic DNA
ttatacgacttactataa

SEQ ID NO: 3258 - DNA, 18 bp, Artificial Sequence
  Synthetic DNA
ttatacgtctcactatac

SEQ ID NO: 3259 - DNA, 18 bp, Artificial Sequence
  Synthetic DNA
ttttacgactcactataa

SEQ ID NO: 3260 - DNA, 18 bp, Artificial Sequence
  Synthetic DNA
taattcgactctctaaag

SEQ ID NO: 3261 - DNA, 18 bp, Artificial Sequence
  Synthetic DNA
taatacgactcacttagg

SEQ ID NO: 3262 - DNA, 18 bp, Artificial Sequence
  Synthetic DNA
tatttagactcactatag

SEQ ID NO: 3263 - DNA, 18 bp, Artificial Sequence
  Synthetic DNA
tattgcgattcactatag

SEQ ID NO: 3264 - DNA, 18 bp, Artificial Sequence
  Synthetic DNA
aattacgactcactgtag

SEQ ID NO: 3265 - DNA, 18 bp, Artificial Sequence
  Synthetic DNA
taattcgtctcaccatag

SEQ ID NO: 3266 - DNA, 18 bp, Artificial Sequence
  Synthetic DNA
taataaaactcactctag

SEQ ID NO: 3267 - DNA, 18 bp, Artificial Sequence
  Synthetic DNA
taataagagtcactaaag

SEQ ID NO: 3268 - DNA, 18 bp, Artificial Sequence
  Synthetic DNA
ttataagcctcactatag

SEQ ID NO: 3269 - DNA, 18 bp, Artificial Sequence
  Synthetic DNA
tattacaactcactattg

SEQ ID NO: 3270 - DNA, 18 bp, Artificial Sequence
  Synthetic DNA
taaatcgactcactttag

SEQ ID NO: 3271 - DNA, 18 bp, Artificial Sequence
  Synthetic DNA
ttataccgctcactatag

SEQ ID NO: 3272 - DNA, 18 bp, Artificial Sequence
  Synthetic DNA
tagtacaactcactacag

SEQ ID NO: 3273 - DNA, 18 bp, Artificial Sequence
  Synthetic DNA
ctatacgactcactttag

SEQ ID NO: 3274 - DNA, 18 bp, Artificial Sequence
  Synthetic DNA
tattacgtgtcactatag

SEQ ID NO: 3275 - DNA, 18 bp, Artificial Sequence
  Synthetic DNA
taataagtgtcactatag

SEQ ID NO: 3276 - DNA, 18 bp, Artificial Sequence
  Synthetic DNA
taataggactcgccatag

SEQ ID NO: 3277 - DNA, 18 bp, Artificial Sequence
  Synthetic DNA
taatatgactcactaagg

SEQ ID NO: 3278 - DNA, 18 bp, Artificial Sequence
  Synthetic DNA
taatatgactcactgtgg

SEQ ID NO: 3279 - DNA, 18 bp, Artificial Sequence
  Synthetic DNA
caaaacgactcacaatag

SEQ ID NO: 3280 - DNA, 18 bp, Artificial Sequence
  Synthetic DNA
taatacgtctcaccatcg

SEQ ID NO: 3281 - DNA, 18 bp, Artificial Sequence
  Synthetic DNA
caattcaactcactatag

SEQ ID NO: 3282 - DNA, 18 bp, Artificial Sequence
  Synthetic DNA
ttatacgactcactaagg

SEQ ID NO: 3283 - DNA, 18 bp, Artificial Sequence
  Synthetic DNA
ttttacgactcaccatag

SEQ ID NO: 3284 - DNA, 18 bp, Artificial Sequence
  Synthetic DNA
taataagactcaccttag

SEQ ID NO: 3285 - DNA, 18 bp, Artificial Sequence
  Synthetic DNA
ttattcgactcactttag

SEQ ID NO: 3286 - DNA, 18 bp, Artificial Sequence
  Synthetic DNA
aaatacgtctcactctag

SEQ ID NO: 3287 - DNA, 18 bp, Artificial Sequence
  Synthetic DNA
taaaccgactcaccatag

SEQ ID NO: 3288 - DNA, 18 bp, Artificial Sequence
  Synthetic DNA
taattcgactcacgatcg

SEQ ID NO: 3289 - DNA, 18 bp, Artificial Sequence
  Synthetic DNA
tcataccactcactacag

SEQ ID NO: 3290 - DNA, 18 bp, Artificial Sequence
  Synthetic DNA
taatacgcctcacttcag

SEQ ID NO: 3291 - DNA, 18 bp, Artificial Sequence
  Synthetic DNA
taacacgactctctattg

SEQ ID NO: 3292 - DNA, 18 bp, Artificial Sequence
  Synthetic DNA
aattacgcctcactatag

SEQ ID NO: 3293 - DNA, 18 bp, Artificial Sequence
  Synthetic DNA
tgattcgcctcactatag

SEQ ID NO: 3294 - DNA, 18 bp, Artificial Sequence
  Synthetic DNA
aaacgcgactcactatag

SEQ ID NO: 3295 - DNA, 18 bp, Artificial Sequence
  Synthetic DNA
tatcacgcctcactatag

SEQ ID NO: 3296 - DNA, 18 bp, Artificial Sequence
  Synthetic DNA
taatacgagtcactactg

SEQ ID NO: 3297 - DNA, 18 bp, Artificial Sequence
  Synthetic DNA
taatacggatcaccatag

SEQ ID NO: 3298 - DNA, 18 bp, Artificial Sequence
  Synthetic DNA
taatacggctagctatag

SEQ ID NO: 3299 - DNA, 18 bp, Artificial Sequence
  Synthetic DNA
taatccgaatcactctag

SEQ ID NO: 3300 - DNA, 18 bp, Artificial Sequence
  Synthetic DNA
taatgagactcactacag

SEQ ID NO: 3301 - DNA, 18 bp, Artificial Sequence
  Synthetic DNA
taatgcgaatcgctatag

SEQ ID NO: 3302 - DNA, 18 bp, Artificial Sequence
  Synthetic DNA
tgatacgacgcactattg

SEQ ID NO: 3303 - DNA, 18 bp, Artificial Sequence
  Synthetic DNA
tgataggactcactaaag

SEQ ID NO: 3304 - DNA, 18 bp, Artificial Sequence
  Synthetic DNA
ttataggactcactatgg

SEQ ID NO: 3305 - DNA, 18 bp, Artificial Sequence
  Synthetic DNA
tctttcgactcactatag

SEQ ID NO: 3306 - DNA, 18 bp, Artificial Sequence
  Synthetic DNA
ctatccgactcactatag

SEQ ID NO: 3307 - DNA, 18 bp, Artificial Sequence
  Synthetic DNA
taatacgactctctgaag

SEQ ID NO: 3308 - DNA, 18 bp, Artificial Sequence
  Synthetic DNA
taatacgtctcgctacag

SEQ ID NO: 3309 - DNA, 18 bp, Artificial Sequence
  Synthetic DNA
taatatgactcacttgag

SEQ ID NO: 3310 - DNA, 18 bp, Artificial Sequence
  Synthetic DNA
tgatacaactcacaatag

SEQ ID NO: 3311 - DNA, 18 bp, Artificial Sequence
  Synthetic DNA
taatacgactagctattg

SEQ ID NO: 3312 - DNA, 18 bp, Artificial Sequence
  Synthetic DNA
tattacgactcactcaag

SEQ ID NO: 3313 - DNA, 18 bp, Artificial Sequence
  Synthetic DNA
ttatacaactcagtatag

SEQ ID NO: 3314 - DNA, 18 bp, Artificial Sequence
  Synthetic DNA
taaaacgactcaccatgg

SEQ ID NO: 3315 - DNA, 18 bp, Artificial Sequence
  Synthetic DNA
caatacgactcacggtag

SEQ ID NO: 3316 - DNA, 18 bp, Artificial Sequence
  Synthetic DNA
caattcgactcactagag

SEQ ID NO: 3317 - DNA, 18 bp, Artificial Sequence
  Synthetic DNA
tattacgagtcagtatag

SEQ ID NO: 3318 - DNA, 18 bp, Artificial Sequence
  Synthetic DNA
tcatatgactcactatgg

SEQ ID NO: 3319 - DNA, 18 bp, Artificial Sequence
  Synthetic DNA
ttatacgactcactgcag

SEQ ID NO: 3320 - DNA, 18 bp, Artificial Sequence
  Synthetic DNA
ttatacgactcaggatag

SEQ ID NO: 3321 - DNA, 18 bp, Artificial Sequence
  Synthetic DNA
aaatacgactcactgcag

SEQ ID NO: 3322 - DNA, 18 bp, Artificial Sequence
  Synthetic DNA
caatatgactgactatag

SEQ ID NO: 3323 - DNA, 18 bp, Artificial Sequence
  Synthetic DNA
gaatgcgcctcactatag

SEQ ID NO: 3324 - DNA, 18 bp, Artificial Sequence
  Synthetic DNA
taaaccgactcactagag

SEQ ID NO: 3325 - DNA, 18 bp, Artificial Sequence
  Synthetic DNA
taacacgacttactatcg

SEQ ID NO: 3326 - DNA, 18 bp, Artificial Sequence
  Synthetic DNA
taaggcgactctctatag

SEQ ID NO: 3327 - DNA, 18 bp, Artificial Sequence
  Synthetic DNA
taatacgacgttctatag

SEQ ID NO: 3328 - DNA, 18 bp, Artificial Sequence
  Synthetic DNA
taatacgactcacttttt

SEQ ID NO: 3329 - DNA, 18 bp, Artificial Sequence
  Synthetic DNA
taatacgcctcaggatag

SEQ ID NO: 3330 - DNA, 18 bp, Artificial Sequence
  Synthetic DNA
taataggactcaccagag

SEQ ID NO: 3331 - DNA, 18 bp, Artificial Sequence
  Synthetic DNA
taatccgactctgtatag

SEQ ID NO: 3332 - DNA, 18 bp, Artificial Sequence
  Synthetic DNA
taatcggactcacaatag

SEQ ID NO: 3333 - DNA, 18 bp, Artificial Sequence
  Synthetic DNA
taatgcgaatcactctag

SEQ ID NO: 3334 - DNA, 18 bp, Artificial Sequence
  Synthetic DNA
taatgcgacccaatatag

SEQ ID NO: 3335 - DNA, 18 bp, Artificial Sequence
  Synthetic DNA
taattcgacgaactatag

SEQ ID NO: 3336 - DNA, 18 bp, Artificial Sequence
  Synthetic DNA
tattacgaagcactatag

SEQ ID NO: 3337 - DNA, 18 bp, Artificial Sequence
  Synthetic DNA
tcataagactcactatcg

SEQ ID NO: 3338 - DNA, 18 bp, Artificial Sequence
  Synthetic DNA
tcatacgactcaccacag

SEQ ID NO: 3339 - DNA, 18 bp, Artificial Sequence
  Synthetic DNA
tcatatgactcactatcg

SEQ ID NO: 3340 - DNA, 18 bp, Artificial Sequence
  Synthetic DNA
tcatgcgactcactacag

SEQ ID NO: 3341 - DNA, 18 bp, Artificial Sequence
  Synthetic DNA
taatacgtatcactctag

SEQ ID NO: 3342 - DNA, 18 bp, Artificial Sequence
  Synthetic DNA
taattcgactctctacag

SEQ ID NO: 3343 - DNA, 18 bp, Artificial Sequence
  Synthetic DNA
tagtacaactcactctag

SEQ ID NO: 3344 - DNA, 18 bp, Artificial Sequence
  Synthetic DNA
taatacgcctcaccttag

SEQ ID NO: 3345 - DNA, 18 bp, Artificial Sequence
  Synthetic DNA
taatacgactcacctttg

SEQ ID NO: 3346 - DNA, 18 bp, Artificial Sequence
  Synthetic DNA
caattcgactcactctag

SEQ ID NO: 3347 - DNA, 18 bp, Artificial Sequence
  Synthetic DNA
aaatttgactcactatag

SEQ ID NO: 3348 - DNA, 18 bp, Artificial Sequence
  Synthetic DNA
ttatacgactcacgaaag

SEQ ID NO: 3349 - DNA, 18 bp, Artificial Sequence
  Synthetic DNA
taataagactgacaatag

SEQ ID NO: 3350 - DNA, 18 bp, Artificial Sequence
  Synthetic DNA
taatacgactccctgttg

SEQ ID NO: 3351 - DNA, 18 bp, Artificial Sequence
  Synthetic DNA
taaaacaactcactattg

SEQ ID NO: 3352 - DNA, 18 bp, Artificial Sequence
  Synthetic DNA
ttatacgactcaccctag

SEQ ID NO: 3353 - DNA, 18 bp, Artificial Sequence
  Synthetic DNA
taaatcgtctcactatag

SEQ ID NO: 3354 - DNA, 18 bp, Artificial Sequence
  Synthetic DNA
taatacaactcacttcag

SEQ ID NO: 3355 - DNA, 18 bp, Artificial Sequence
  Synthetic DNA
tattagaactcactatag

SEQ ID NO: 3356 - DNA, 18 bp, Artificial Sequence
  Synthetic DNA
tcatacgagtgactatag

SEQ ID NO: 3357 - DNA, 18 bp, Artificial Sequence
  Synthetic DNA
taaagagactcactatag

SEQ ID NO: 3358 - DNA, 18 bp, Artificial Sequence
  Synthetic DNA
taataacactccctatag

SEQ ID NO: 3359 - DNA, 18 bp, Artificial Sequence
  Synthetic DNA
taatgcgactaaccatag

SEQ ID NO: 3360 - DNA, 18 bp, Artificial Sequence
  Synthetic DNA
tacaacgactcaccatag

SEQ ID NO: 3361 - DNA, 18 bp, Artificial Sequence
  Synthetic DNA
tcatacgactcagtatgg

SEQ ID NO: 3362 - DNA, 18 bp, Artificial Sequence
  Synthetic DNA
tattaagactcacaatag

SEQ ID NO: 3363 - DNA, 18 bp, Artificial Sequence
  Synthetic DNA
taaaacgactcactactg

SEQ ID NO: 3364 - DNA, 18 bp, Artificial Sequence
  Synthetic DNA
taatccgtctcactatcg

SEQ ID NO: 3365 - DNA, 18 bp, Artificial Sequence
  Synthetic DNA
tattaagactcgctatag

SEQ ID NO: 3366 - DNA, 18 bp, Artificial Sequence
  Synthetic DNA
taattcgtctcactttag

SEQ ID NO: 3367 - DNA, 18 bp, Artificial Sequence
  Synthetic DNA
taataagactcacttcag

SEQ ID NO: 3368 - DNA, 18 bp, Artificial Sequence
  Synthetic DNA
taatacaactcactcaag

SEQ ID NO: 3369 - DNA, 18 bp, Artificial Sequence
  Synthetic DNA
gaatacgactcacttttg

SEQ ID NO: 3370 - DNA, 18 bp, Artificial Sequence
  Synthetic DNA
gaatacgacccactttag

SEQ ID NO: 3371 - DNA, 18 bp, Artificial Sequence
  Synthetic DNA
taataagactcacgaaag

SEQ ID NO: 3372 - DNA, 18 bp, Artificial Sequence
  Synthetic DNA
taataagactcactaccg

SEQ ID NO: 3373 - DNA, 18 bp, Artificial Sequence
  Synthetic DNA
taatacgaatcatgatag

SEQ ID NO: 3374 - DNA, 18 bp, Artificial Sequence
  Synthetic DNA
taatacgacgcactcaag

SEQ ID NO: 3375 - DNA, 18 bp, Artificial Sequence
  Synthetic DNA
taatccgatccactatag

SEQ ID NO: 3376 - DNA, 18 bp, Artificial Sequence
  Synthetic DNA
tactaggactcactctag

SEQ ID NO: 3377 - DNA, 18 bp, Artificial Sequence
  Synthetic DNA
tgatatgactaactatag

SEQ ID NO: 3378 - DNA, 18 bp, Artificial Sequence
  Synthetic DNA
taatacgactcacatcag

SEQ ID NO: 3379 - DNA, 18 bp, Artificial Sequence
  Synthetic DNA
caatctgactcactatag

SEQ ID NO: 3380 - DNA, 18 bp, Artificial Sequence
  Synthetic DNA
taataagactcaccagag

SEQ ID NO: 3381 - DNA, 18 bp, Artificial Sequence
  Synthetic DNA
taatacgactcactgctg

SEQ ID NO: 3382 - DNA, 18 bp, Artificial Sequence
  Synthetic DNA
taatacgactcgacatag

SEQ ID NO: 3383 - DNA, 18 bp, Artificial Sequence
  Synthetic DNA
taattcgccccactatag

SEQ ID NO: 3384 - DNA, 18 bp, Artificial Sequence
  Synthetic DNA
ttatccgactcaccatag

SEQ ID NO: 3385 - DNA, 18 bp, Artificial Sequence
  Synthetic DNA
ttttatgactcactatag

SEQ ID NO: 3386 - DNA, 18 bp, Artificial Sequence
  Synthetic DNA
ttatacgactcactcaag

SEQ ID NO: 3387 - DNA, 18 bp, Artificial Sequence
  Synthetic DNA
aattgcgactcactatag

SEQ ID NO: 3388 - DNA, 18 bp, Artificial Sequence
  Synthetic DNA
taaaatgactcagtatag

SEQ ID NO: 3389 - DNA, 18 bp, Artificial Sequence
  Synthetic DNA
taaaccgactcactctag

SEQ ID NO: 3390 - DNA, 18 bp, Artificial Sequence
  Synthetic DNA
taaaaagactcactatcg

SEQ ID NO: 3391 - DNA, 18 bp, Artificial Sequence
  Synthetic DNA
taattcgactcactttgg

SEQ ID NO: 3392 - DNA, 18 bp, Artificial Sequence
  Synthetic DNA
caataggactcactgtag

SEQ ID NO: 3393 - DNA, 18 bp, Artificial Sequence
  Synthetic DNA
taatacgactcgttattg

SEQ ID NO: 3394 - DNA, 18 bp, Artificial Sequence
  Synthetic DNA
tcttgcgactcactatag

SEQ ID NO: 3395 - DNA, 18 bp, Artificial Sequence
  Synthetic DNA
tattccgactcactattg

SEQ ID NO: 3396 - DNA, 18 bp, Artificial Sequence
  Synthetic DNA
ttattcgactcagtatag

SEQ ID NO: 3397 - DNA, 18 bp, Artificial Sequence
  Synthetic DNA
taatccgactcacttaag

SEQ ID NO: 3398 - DNA, 18 bp, Artificial Sequence
  Synthetic DNA
tataacgactcacgatag

SEQ ID NO: 3399 - DNA, 18 bp, Artificial Sequence
  Synthetic DNA
aactacgactcagtatag

SEQ ID NO: 3400 - DNA, 18 bp, Artificial Sequence
  Synthetic DNA
taataccaatcactgtag

SEQ ID NO: 3401 - DNA, 18 bp, Artificial Sequence
  Synthetic DNA
taatacgactcagtccag

SEQ ID NO: 3402 - DNA, 18 bp, Artificial Sequence
  Synthetic DNA
taatacgccgcactattg

SEQ ID NO: 3403 - DNA, 18 bp, Artificial Sequence
  Synthetic DNA
taatatgaatcactatcg

SEQ ID NO: 3404 - DNA, 18 bp, Artificial Sequence
  Synthetic DNA
taatccgactccctttag

SEQ ID NO: 3405 - DNA, 18 bp, Artificial Sequence
  Synthetic DNA
taatgcgaatcactatcg

SEQ ID NO: 3406 - DNA, 18 bp, Artificial Sequence
  Synthetic DNA
tactgcgactcactattg

SEQ ID NO: 3407 - DNA, 18 bp, Artificial Sequence
  Synthetic DNA
tcatacgcctcactattg

SEQ ID NO: 3408 - DNA, 18 bp, Artificial Sequence
  Synthetic DNA
caatccgactcactatgg

SEQ ID NO: 3409 - DNA, 18 bp, Artificial Sequence
  Synthetic DNA
gaatacgactcagtattg

SEQ ID NO: 3410 - DNA, 18 bp, Artificial Sequence
  Synthetic DNA
gattacaactcactatag

SEQ ID NO: 3411 - DNA, 18 bp, Artificial Sequence
  Synthetic DNA
taaaacgactcacggtag

SEQ ID NO: 3412 - DNA, 18 bp, Artificial Sequence
  Synthetic DNA
taagacgactagctatag

SEQ ID NO: 3413 - DNA, 18 bp, Artificial Sequence
  Synthetic DNA
taatacgacgtactctag

SEQ ID NO: 3414 - DNA, 18 bp, Artificial Sequence
  Synthetic DNA
taatacgactggctctag

SEQ ID NO: 3415 - DNA, 18 bp, Artificial Sequence
  Synthetic DNA
taatacgatgcacaatag

SEQ ID NO: 3416 - DNA, 18 bp, Artificial Sequence
  Synthetic DNA
taatacggctcacgattg

SEQ ID NO: 3417 - DNA, 18 bp, Artificial Sequence
  Synthetic DNA
taatcctactcgctatag

SEQ ID NO: 3418 - DNA, 18 bp, Artificial Sequence
  Synthetic DNA
taatgcgactaactatcg

SEQ ID NO: 3419 - DNA, 18 bp, Artificial Sequence
  Synthetic DNA
tactacgcgtcactatag

SEQ ID NO: 3420 - DNA, 18 bp, Artificial Sequence
  Synthetic DNA
taggacgactcaatatag

SEQ ID NO: 3421 - DNA, 18 bp, Artificial Sequence
  Synthetic DNA
tagtacgtgtcactatag

SEQ ID NO: 3422 - DNA, 18 bp, Artificial Sequence
  Synthetic DNA
tagtccgactcactgtag

SEQ ID NO: 3423 - DNA, 18 bp, Artificial Sequence
  Synthetic DNA
tgagacgtctcactatag

SEQ ID NO: 3424 - DNA, 18 bp, Artificial Sequence
  Synthetic DNA
tgataggacgcactatag

SEQ ID NO: 3425 - DNA, 18 bp, Artificial Sequence
  Synthetic DNA
tgatgcgactcactctag

SEQ ID NO: 3426 - DNA, 18 bp, Artificial Sequence
  Synthetic DNA
aaagacgactcattatag

SEQ ID NO: 3427 - DNA, 18 bp, Artificial Sequence
  Synthetic DNA
aaatacgactcgccatag

SEQ ID NO: 3428 - DNA, 18 bp, Artificial Sequence
  Synthetic DNA
aaatacgagtcacgatag

SEQ ID NO: 3429 - DNA, 18 bp, Artificial Sequence
  Synthetic DNA
aaatacgagtcactataa

SEQ ID NO: 3430 - DNA, 18 bp, Artificial Sequence
  Synthetic DNA
atatacgactcactataa

SEQ ID NO: 3431 - DNA, 18 bp, Artificial Sequence
  Synthetic DNA
caagacgactcaccatag

SEQ ID NO: 3432 - DNA, 18 bp, Artificial Sequence
  Synthetic DNA
ccatacgactcactataa

SEQ ID NO: 3433 - DNA, 18 bp, Artificial Sequence
  Synthetic DNA
gaaaacgactcacgatag

SEQ ID NO: 3434 - DNA, 18 bp, Artificial Sequence
  Synthetic DNA
gaataagactcactgtag

SEQ ID NO: 3435 - DNA, 18 bp, Artificial Sequence
  Synthetic DNA
gaatacgactcaccatcg

SEQ ID NO: 3436 - DNA, 18 bp, Artificial Sequence
  Synthetic DNA
gaatacgactcgcaatag

SEQ ID NO: 3437 - DNA, 18 bp, Artificial Sequence
  Synthetic DNA
gaatacgacttattatag

SEQ ID NO: 3438 - DNA, 18 bp, Artificial Sequence
  Synthetic DNA
gaatacgatgcactatag

SEQ ID NO: 3439 - DNA, 18 bp, Artificial Sequence
  Synthetic DNA
gaatccgactcactctag

SEQ ID NO: 3440 - DNA, 18 bp, Artificial Sequence
  Synthetic DNA
gaatgcgacttactatag

SEQ ID NO: 3441 - DNA, 18 bp, Artificial Sequence
  Synthetic DNA
taacaggactgactatag

SEQ ID NO: 3442 - DNA, 18 bp, Artificial Sequence
  Synthetic DNA
taagacgaatcactgtag

SEQ ID NO: 3443 - DNA, 18 bp, Artificial Sequence
  Synthetic DNA
taagacgaccaactatag

SEQ ID NO: 3444 - DNA, 18 bp, Artificial Sequence
  Synthetic DNA
taagacgactaacgatag

SEQ ID NO: 3445 - DNA, 18 bp, Artificial Sequence
  Synthetic DNA
taagacgactgactaaag

SEQ ID NO: 3446 - DNA, 18 bp, Artificial Sequence
  Synthetic DNA
taagacgagtcactttag

SEQ ID NO: 3447 - DNA, 18 bp, Artificial Sequence
  Synthetic DNA
taataacactcacgatag

SEQ ID NO: 3448 - DNA, 18 bp, Artificial Sequence
  Synthetic DNA
taataaggctcaatatag

SEQ ID NO: 3449 - DNA, 18 bp, Artificial Sequence
  Synthetic DNA
taatacaactcacaataa

SEQ ID NO: 3450 - DNA, 18 bp, Artificial Sequence
  Synthetic DNA
taataccactagctatag

SEQ ID NO: 3451 - DNA, 18 bp, Artificial Sequence
  Synthetic DNA
taataccactcaccctag

SEQ ID NO: 3452 - DNA, 18 bp, Artificial Sequence
  Synthetic DNA
taataccactcacgagag

SEQ ID NO: 3453 - DNA, 18 bp, Artificial Sequence
  Synthetic DNA
taatacgaatcacaatac

SEQ ID NO: 3454 - DNA, 18 bp, Artificial Sequence
  Synthetic DNA
taatacgacacgcgatag

SEQ ID NO: 3455 - DNA, 18 bp, Artificial Sequence
  Synthetic DNA
taatacgacccaccctag

SEQ ID NO: 3456 - DNA, 18 bp, Artificial Sequence
  Synthetic DNA
taatacgacccattgtag

SEQ ID NO: 3457 - DNA, 18 bp, Artificial Sequence
  Synthetic DNA
taatacgacgcagtgtag

SEQ ID NO: 3458 - DNA, 18 bp, Artificial Sequence
  Synthetic DNA
taatacgactaactaccg

SEQ ID NO: 3459 - DNA, 18 bp, Artificial Sequence
  Synthetic DNA
taatacgactcacgactg

SEQ ID NO: 3460 - DNA, 18 bp, Artificial Sequence
  Synthetic DNA
taatacgactccctagcg

SEQ ID NO: 3461 - DNA, 18 bp, Artificial Sequence
  Synthetic DNA
taatacgagtcacgatcg

SEQ ID NO: 3462 - DNA, 18 bp, Artificial Sequence
  Synthetic DNA
taatacggctcgctataa

SEQ ID NO: 3463 - DNA, 18 bp, Artificial Sequence
  Synthetic DNA
taatacgtctcactatct

SEQ ID NO: 3464 - DNA, 18 bp, Artificial Sequence
  Synthetic DNA
taatagaacccactatag

SEQ ID NO: 3465 - DNA, 18 bp, Artificial Sequence
  Synthetic DNA
taatagggcttactatag

SEQ ID NO: 3466 - DNA, 18 bp, Artificial Sequence
  Synthetic DNA
taatcagacgcactatag

SEQ ID NO: 3467 - DNA, 18 bp, Artificial Sequence
  Synthetic DNA
taatcccactcgctatag

SEQ ID NO: 3468 - DNA, 18 bp, Artificial Sequence
  Synthetic DNA
taatccgactagctatag

SEQ ID NO: 3469 - DNA, 18 bp, Artificial Sequence
  Synthetic DNA
taatccgactcattagag

SEQ ID NO: 3470 - DNA, 18 bp, Artificial Sequence
  Synthetic DNA
taatccgactcggtatag

SEQ ID NO: 3471 - DNA, 18 bp, Artificial Sequence
  Synthetic DNA
taatgccactcactatcg

SEQ ID NO: 3472 - DNA, 18 bp, Artificial Sequence
  Synthetic DNA
taatgcgaatcacgatag

SEQ ID NO: 3473 - DNA, 18 bp, Artificial Sequence
  Synthetic DNA
taatgcgactcagtagag

SEQ ID NO: 3474 - DNA, 18 bp, Artificial Sequence
  Synthetic DNA
taatgcgacttactgtag

SEQ ID NO: 3475 - DNA, 18 bp, Artificial Sequence
  Synthetic DNA
taatgcgacttagtatag

SEQ ID NO: 3476 - DNA, 18 bp, Artificial Sequence
  Synthetic DNA
taatgcgcctcactatcg

SEQ ID NO: 3477 - DNA, 18 bp, Artificial Sequence
  Synthetic DNA
taatgcgcctcactatgg

SEQ ID NO: 3478 - DNA, 18 bp, Artificial Sequence
  Synthetic DNA
taatgggacgcactatag

SEQ ID NO: 3479 - DNA, 18 bp, Artificial Sequence
  Synthetic DNA
taattcgactcactttac

SEQ ID NO: 3480 - DNA, 18 bp, Artificial Sequence
  Synthetic DNA
tactacgactcagtatcg

SEQ ID NO: 3481 - DNA, 18 bp, Artificial Sequence
  Synthetic DNA
tactacgagtcactctag

SEQ ID NO: 3482 - DNA, 18 bp, Artificial Sequence
  Synthetic DNA
tactcccactcactatag

SEQ ID NO: 3483 - DNA, 18 bp, Artificial Sequence
  Synthetic DNA
tactgcgactcactatgg

SEQ ID NO: 3484 - DNA, 18 bp, Artificial Sequence
  Synthetic DNA
tactgcgactcagtatag

SEQ ID NO: 3485 - DNA, 18 bp, Artificial Sequence
  Synthetic DNA
tagaacgactcacgatag

SEQ ID NO: 3486 - DNA, 18 bp, Artificial Sequence
  Synthetic DNA
tagtacgtctccctatag

SEQ ID NO: 3487 - DNA, 18 bp, Artificial Sequence
  Synthetic DNA
tagtccgacccactatag

SEQ ID NO: 3488 - DNA, 18 bp, Artificial Sequence
  Synthetic DNA
tattacgacgcaccatag

SEQ ID NO: 3489 - DNA, 18 bp, Artificial Sequence
  Synthetic DNA
tcatacgattcaccatag

SEQ ID NO: 3490 - DNA, 18 bp, Artificial Sequence
  Synthetic DNA
tcatacggcgcactatag

SEQ ID NO: 3491 - DNA, 18 bp, Artificial Sequence
  Synthetic DNA
tcgtacgactcaccatag

SEQ ID NO: 3492 - DNA, 18 bp, Artificial Sequence
  Synthetic DNA
tgaaaggactcactatag

SEQ ID NO: 3493 - DNA, 18 bp, Artificial Sequence
  Synthetic DNA
tgatacgactcactttaa

SEQ ID NO: 3494 - DNA, 18 bp, Artificial Sequence
  Synthetic DNA
tgatacgactccctatgg

SEQ ID NO: 3495 - DNA, 18 bp, Artificial Sequence
  Synthetic DNA
tgattcgactcactatgg

SEQ ID NO: 3496 - DNA, 18 bp, Artificial Sequence
  Synthetic DNA
ttagacgactcactctag

SEQ ID NO: 3497 - DNA, 18 bp, Artificial Sequence
  Synthetic DNA
taatccgactctctctag

SEQ ID NO: 3498 - DNA, 18 bp, Artificial Sequence
  Synthetic DNA
taacacgactcactacgg

SEQ ID NO: 3499 - DNA, 18 bp, Artificial Sequence
  Synthetic DNA
taatacaaagcactatag

SEQ ID NO: 3500 - DNA, 18 bp, Artificial Sequence
  Synthetic DNA
taatacaactgactatgg

SEQ ID NO: 3501 - DNA, 18 bp, Artificial Sequence
  Synthetic DNA
taatacgaccaactatcg

SEQ ID NO: 3502 - DNA, 18 bp, Artificial Sequence
  Synthetic DNA
taatacgactcagtagtg

SEQ ID NO: 3503 - DNA, 18 bp, Artificial Sequence
  Synthetic DNA
taatacgactcgcgacag

SEQ ID NO: 3504 - DNA, 18 bp, Artificial Sequence
  Synthetic DNA
taatacgtctcgctctag

SEQ ID NO: 3505 - DNA, 18 bp, Artificial Sequence
  Synthetic DNA
taatatgactctctagag

SEQ ID NO: 3506 - DNA, 18 bp, Artificial Sequence
  Synthetic DNA
taatgcgactaactctag

SEQ ID NO: 3507 - DNA, 18 bp, Artificial Sequence
  Synthetic DNA
taatgcgcctcgctatag

SEQ ID NO: 3508 - DNA, 18 bp, Artificial Sequence
  Synthetic DNA
taatgctactcactctag

SEQ ID NO: 3509 - DNA, 18 bp, Artificial Sequence
  Synthetic DNA
tactccgactcactctag

SEQ ID NO: 3510 - DNA, 18 bp, Artificial Sequence
  Synthetic DNA
tatcacgactcaccatag

SEQ ID NO: 3511 - DNA, 18 bp, Artificial Sequence
  Synthetic DNA
tcaaaccactcactatag

SEQ ID NO: 3512 - DNA, 18 bp, Artificial Sequence
  Synthetic DNA
tcatacgactcacaagag

SEQ ID NO: 3513 - DNA, 18 bp, Artificial Sequence
  Synthetic DNA
tgatacgactcactaacg

SEQ ID NO: 3514 - DNA, 18 bp, Artificial Sequence
  Synthetic DNA
tgctacgactcactgtag

SEQ ID NO: 3515 - DNA, 18 bp, Artificial Sequence
  Synthetic DNA
ctttacgactcactatag

SEQ ID NO: 3516 - DNA, 18 bp, Artificial Sequence
  Synthetic DNA
ttataagactcactttag

SEQ ID NO: 3517 - DNA, 18 bp, Artificial Sequence
  Synthetic DNA
taatatgtctcactgtag

SEQ ID NO: 3518 - DNA, 18 bp, Artificial Sequence
  Synthetic DNA
ttatacgactcacaatgg

SEQ ID NO: 3519 - DNA, 18 bp, Artificial Sequence
  Synthetic DNA
gtatacgactcactaaag

SEQ ID NO: 3520 - DNA, 18 bp, Artificial Sequence
  Synthetic DNA
cattacgactcactctag

SEQ ID NO: 3521 - DNA, 18 bp, Artificial Sequence
  Synthetic DNA
taaaacgactcaccaaag

SEQ ID NO: 3522 - DNA, 18 bp, Artificial Sequence
  Synthetic DNA
taatacgtctcacactag

SEQ ID NO: 3523 - DNA, 18 bp, Artificial Sequence
  Synthetic DNA
tttaacgactcactatag

SEQ ID NO: 3524 - DNA, 18 bp, Artificial Sequence
  Synthetic DNA
tgatacgaaacactatag

SEQ ID NO: 3525 - DNA, 18 bp, Artificial Sequence
  Synthetic DNA
ttatacggctcactacag

SEQ ID NO: 3526 - DNA, 18 bp, Artificial Sequence
  Synthetic DNA
taaaacgactcactcttg

SEQ ID NO: 3527 - DNA, 18 bp, Artificial Sequence
  Synthetic DNA
taatgcgtctcacaatag

SEQ ID NO: 3528 - DNA, 18 bp, Artificial Sequence
  Synthetic DNA
taatagcacacactatag

SEQ ID NO: 3529 - DNA, 18 bp, Artificial Sequence
  Synthetic DNA
aaatacgcctcactagag

SEQ ID NO: 3530 - DNA, 18 bp, Artificial Sequence
  Synthetic DNA
caatacgcctcactattg

SEQ ID NO: 3531 - DNA, 18 bp, Artificial Sequence
  Synthetic DNA
taaaacggctcactatcg

SEQ ID NO: 3532 - DNA, 18 bp, Artificial Sequence
  Synthetic DNA
taatacgactcccactag

SEQ ID NO: 3533 - DNA, 18 bp, Artificial Sequence
  Synthetic DNA
tcctacaactcactatag

SEQ ID NO: 3534 - DNA, 18 bp, Artificial Sequence
  Synthetic DNA
taatatgtctcactatcg

SEQ ID NO: 3535 - DNA, 18 bp, Artificial Sequence
  Synthetic DNA
ttatccgactcactacag

SEQ ID NO: 3536 - DNA, 18 bp, Artificial Sequence
  Synthetic DNA
taatatcactctctatag

SEQ ID NO: 3537 - DNA, 18 bp, Artificial Sequence
  Synthetic DNA
taatacgactcaccaagg

SEQ ID NO: 3538 - DNA, 18 bp, Artificial Sequence
  Synthetic DNA
tcattggactcactatag

SEQ ID NO: 3539 - DNA, 18 bp, Artificial Sequence
  Synthetic DNA
tcgtacgactcactttag

SEQ ID NO: 3540 - DNA, 18 bp, Artificial Sequence
  Synthetic DNA
tattacaactcgctatag

SEQ ID NO: 3541 - DNA, 18 bp, Artificial Sequence
  Synthetic DNA
tattacgactcactgaag

SEQ ID NO: 3542 - DNA, 18 bp, Artificial Sequence
  Synthetic DNA
ttatacgactcacttaag

SEQ ID NO: 3543 - DNA, 18 bp, Artificial Sequence
  Synthetic DNA
taagaagtctcactatag

SEQ ID NO: 3544 - DNA, 18 bp, Artificial Sequence
  Synthetic DNA
taagacgtctcactatcg

SEQ ID NO: 3545 - DNA, 18 bp, Artificial Sequence
  Synthetic DNA
taataagaatcactacag

SEQ ID NO: 3546 - DNA, 18 bp, Artificial Sequence
  Synthetic DNA
taataccattcagtatag

SEQ ID NO: 3547 - DNA, 18 bp, Artificial Sequence
  Synthetic DNA
taatacgactctgtacag

SEQ ID NO: 3548 - DNA, 18 bp, Artificial Sequence
  Synthetic DNA
taatacgtctcaccagag

SEQ ID NO: 3549 - DNA, 18 bp, Artificial Sequence
  Synthetic DNA
tactacgactaactgtag

SEQ ID NO: 3550 - DNA, 18 bp, Artificial Sequence
  Synthetic DNA
tgaaacgactcacgatag

SEQ ID NO: 3551 - DNA, 18 bp, Artificial Sequence
  Synthetic DNA
tgatacgactgactttag

SEQ ID NO: 3552 - DNA, 18 bp, Artificial Sequence
  Synthetic DNA
ttataggtctcactatag

SEQ ID NO: 3553 - DNA, 18 bp, Artificial Sequence
  Synthetic DNA
taatactactcactaatg

SEQ ID NO: 3554 - DNA, 18 bp, Artificial Sequence
  Synthetic DNA
taaaacgtctcactctag

SEQ ID NO: 3555 - DNA, 18 bp, Artificial Sequence
  Synthetic DNA
aaatacgactcacttcag

SEQ ID NO: 3556 - DNA, 18 bp, Artificial Sequence
  Synthetic DNA
taataggtctcactatgg

SEQ ID NO: 3557 - DNA, 18 bp, Artificial Sequence
  Synthetic DNA
taatacgactcactcatg

SEQ ID NO: 3558 - DNA, 18 bp, Artificial Sequence
  Synthetic DNA
taatacgtctcactcaag

SEQ ID NO: 3559 - DNA, 18 bp, Artificial Sequence
  Synthetic DNA
taattcggctcactttag

SEQ ID NO: 3560 - DNA, 18 bp, Artificial Sequence
  Synthetic DNA
tcatacgactcactcttg

SEQ ID NO: 3561 - DNA, 18 bp, Artificial Sequence
  Synthetic DNA
ttgtgcgactcactatag

SEQ ID NO: 3562 - DNA, 18 bp, Artificial Sequence
  Synthetic DNA
taattagactcacaatag

SEQ ID NO: 3563 - DNA, 18 bp, Artificial Sequence
  Synthetic DNA
taatacggctcacaattg

SEQ ID NO: 3564 - DNA, 18 bp, Artificial Sequence
  Synthetic DNA
tatatcgactcactatag

SEQ ID NO: 3565 - DNA, 18 bp, Artificial Sequence
  Synthetic DNA
tataacgactcactttag

SEQ ID NO: 3566 - DNA, 18 bp, Artificial Sequence
  Synthetic DNA
taatacgaatcgctattg

SEQ ID NO: 3567 - DNA, 18 bp, Artificial Sequence
  Synthetic DNA
taatccgtctcagtatag

SEQ ID NO: 3568 - DNA, 18 bp, Artificial Sequence
  Synthetic DNA
taatgagtctcactatag

SEQ ID NO: 3569 - DNA, 18 bp, Artificial Sequence
  Synthetic DNA
taaaaagactcagtatag

SEQ ID NO: 3570 - DNA, 18 bp, Artificial Sequence
  Synthetic DNA
taatacgactcacaaccg

SEQ ID NO: 3571 - DNA, 18 bp, Artificial Sequence
  Synthetic DNA
taatacgcataactatag

SEQ ID NO: 3572 - DNA, 18 bp, Artificial Sequence
  Synthetic DNA
tattgcgactcaatatag

SEQ ID NO: 3573 - DNA, 18 bp, Artificial Sequence
  Synthetic DNA
taatacgacttagcatag

SEQ ID NO: 3574 - DNA, 18 bp, Artificial Sequence
  Synthetic DNA
taattcgcctcagtatag

SEQ ID NO: 3575 - DNA, 18 bp, Artificial Sequence
  Synthetic DNA
tcacactactcactatag

SEQ ID NO: 3576 - DNA, 18 bp, Artificial Sequence
  Synthetic DNA
tgatacggcacactatag

SEQ ID NO: 3577 - DNA, 18 bp, Artificial Sequence
  Synthetic DNA
caatccgactcactaaag

SEQ ID NO: 3578 - DNA, 18 bp, Artificial Sequence
  Synthetic DNA
gattacgactcactatcg

SEQ ID NO: 3579 - DNA, 18 bp, Artificial Sequence
  Synthetic DNA
taagaagagtcactatag

SEQ ID NO: 3580 - DNA, 18 bp, Artificial Sequence
  Synthetic DNA
taataacactcactatcg

SEQ ID NO: 3581 - DNA, 18 bp, Artificial Sequence
  Synthetic DNA
taatacagctaactatag

SEQ ID NO: 3582 - DNA, 18 bp, Artificial Sequence
  Synthetic DNA
taatacccctcactctag

SEQ ID NO: 3583 - DNA, 18 bp, Artificial Sequence
  Synthetic DNA
taatacgaaccactacag

SEQ ID NO: 3584 - DNA, 18 bp, Artificial Sequence
  Synthetic DNA
taatacgacgcactttcg

SEQ ID NO: 3585 - DNA, 18 bp, Artificial Sequence
  Synthetic DNA
taatacgacgctgtatag

SEQ ID NO: 3586 - DNA, 18 bp, Artificial Sequence
  Synthetic DNA
taatacgactcactctcc

SEQ ID NO: 3587 - DNA, 18 bp, Artificial Sequence
  Synthetic DNA
taatacgactcgttatcg

SEQ ID NO: 3588 - DNA, 18 bp, Artificial Sequence
  Synthetic DNA
taatacgattggctatag

SEQ ID NO: 3589 - DNA, 18 bp, Artificial Sequence
  Synthetic DNA
taatacgccttactagag

SEQ ID NO: 3590 - DNA, 18 bp, Artificial Sequence
  Synthetic DNA
taatacgcgtcactaaag

SEQ ID NO: 3591 - DNA, 18 bp, Artificial Sequence
  Synthetic DNA
taatacggctcatcatag

SEQ ID NO: 3592 - DNA, 18 bp, Artificial Sequence
  Synthetic DNA
taatacgtctctctataa

SEQ ID NO: 3593 - DNA, 18 bp, Artificial Sequence
  Synthetic DNA
taataggcctcactatcg

SEQ ID NO: 3594 - DNA, 18 bp, Artificial Sequence
  Synthetic DNA
taatccgactcactgtcg

SEQ ID NO: 3595 - DNA, 18 bp, Artificial Sequence
  Synthetic DNA
taatccgactctctgtag

SEQ ID NO: 3596 - DNA, 18 bp, Artificial Sequence
  Synthetic DNA
tactacgattgactatag

SEQ ID NO: 3597 - DNA, 18 bp, Artificial Sequence
  Synthetic DNA
tagtacgagtcactgtag

SEQ ID NO: 3598 - DNA, 18 bp, Artificial Sequence
  Synthetic DNA
tatcccgactcactatag

SEQ ID NO: 3599 - DNA, 18 bp, Artificial Sequence
  Synthetic DNA
ttatacgtctcactataa

SEQ ID NO: 3600 - DNA, 18 bp, Artificial Sequence
  Synthetic DNA
aaaaacgactcactgtag

SEQ ID NO: 3601 - DNA, 18 bp, Artificial Sequence
  Synthetic DNA
taatacaactcactttcg

SEQ ID NO: 3602 - DNA, 18 bp, Artificial Sequence
  Synthetic DNA
taatacgagtcattattg

SEQ ID NO: 3603 - DNA, 18 bp, Artificial Sequence
  Synthetic DNA
taatgcgaatcactaaag

SEQ ID NO: 3604 - DNA, 18 bp, Artificial Sequence
  Synthetic DNA
taaaacgactcacgttag

SEQ ID NO: 3605 - DNA, 18 bp, Artificial Sequence
  Synthetic DNA
ttataagactcactattg

SEQ ID NO: 3606 - DNA, 18 bp, Artificial Sequence
  Synthetic DNA
taatacaactcactaatg

SEQ ID NO: 3607 - DNA, 18 bp, Artificial Sequence
  Synthetic DNA
taatactactcgctattg

SEQ ID NO: 3608 - DNA, 18 bp, Artificial Sequence
  Synthetic DNA
taattcgactcactacgg

SEQ ID NO: 3609 - DNA, 18 bp, Artificial Sequence
  Synthetic DNA
tattacgacacactagag

SEQ ID NO: 3610 - DNA, 18 bp, Artificial Sequence
  Synthetic DNA
caatacgactcgctgtag

SEQ ID NO: 3611 - DNA, 18 bp, Artificial Sequence
  Synthetic DNA
taaaaccactcgctatag

SEQ ID NO: 3612 - DNA, 18 bp, Artificial Sequence
  Synthetic DNA
taataaggctcactatcg

SEQ ID NO: 3613 - DNA, 18 bp, Artificial Sequence
  Synthetic DNA
taataccactcacactag

SEQ ID NO: 3614 - DNA, 18 bp, Artificial Sequence
  Synthetic DNA
taatacgacaaactagag

SEQ ID NO: 3615 - DNA, 18 bp, Artificial Sequence
  Synthetic DNA
taatatcactcagtatag

SEQ ID NO: 3616 - DNA, 18 bp, Artificial Sequence
  Synthetic DNA
taatccgactctcgatag

SEQ ID NO: 3617 - DNA, 18 bp, Artificial Sequence
  Synthetic DNA
taatgcgcctcaatatag

SEQ ID NO: 3618 - DNA, 18 bp, Artificial Sequence
  Synthetic DNA
tactgcgactcactaaag

SEQ ID NO: 3619 - DNA, 18 bp, Artificial Sequence
  Synthetic DNA
ttattcaactcactatag

SEQ ID NO: 3620 - DNA, 18 bp, Artificial Sequence
  Synthetic DNA
ttatacgactcactgtcg

SEQ ID NO: 3621 - DNA, 18 bp, Artificial Sequence
  Synthetic DNA
taataaaactcactattg

SEQ ID NO: 3622 - DNA, 18 bp, Artificial Sequence
  Synthetic DNA
taattcgactcaccctag

SEQ ID NO: 3623 - DNA, 18 bp, Artificial Sequence
  Synthetic DNA
ttatacgactcacttgag

SEQ ID NO: 3624 - DNA, 18 bp, Artificial Sequence
  Synthetic DNA
aaacacgcctcactatag

SEQ ID NO: 3625 - DNA, 18 bp, Artificial Sequence
  Synthetic DNA
caatacgactctctatgg

SEQ ID NO: 3626 - DNA, 18 bp, Artificial Sequence
  Synthetic DNA
gaatacgactcaccattg

SEQ ID NO: 3627 - DNA, 18 bp, Artificial Sequence
  Synthetic DNA
taatacaactcactctgg

SEQ ID NO: 3628 - DNA, 18 bp, Artificial Sequence
  Synthetic DNA
taatacgactaactaacg

SEQ ID NO: 3629 - DNA, 18 bp, Artificial Sequence
  Synthetic DNA
taatacgactagccatag

SEQ ID NO: 3630 - DNA, 18 bp, Artificial Sequence
  Synthetic DNA
taatacgactcgataaag

SEQ ID NO: 3631 - DNA, 18 bp, Artificial Sequence
  Synthetic DNA
taatacgactctgtatcg

SEQ ID NO: 3632 - DNA, 18 bp, Artificial Sequence
  Synthetic DNA
taatacgagtcgctgtag

SEQ ID NO: 3633 - DNA, 18 bp, Artificial Sequence
  Synthetic DNA
taatacaactcacttttg

SEQ ID NO: 3634 - DNA, 18 bp, Artificial Sequence
  Synthetic DNA
taatgcaactcactattg

SEQ ID NO: 3635 - DNA, 18 bp, Artificial Sequence
  Synthetic DNA
tgattcgactcacaatag

SEQ ID NO: 3636 - DNA, 18 bp, Artificial Sequence
  Synthetic DNA
taaaacaactcactttag

SEQ ID NO: 3637 - DNA, 18 bp, Artificial Sequence
  Synthetic DNA
taattcgactcacaatcg

SEQ ID NO: 3638 - DNA, 18 bp, Artificial Sequence
  Synthetic DNA
aaatacgcctcattatag

SEQ ID NO: 3639 - DNA, 18 bp, Artificial Sequence
  Synthetic DNA
taatgcgtctcacgatag

SEQ ID NO: 3640 - DNA, 18 bp, Artificial Sequence
  Synthetic DNA
tgaaaagactcactatag

SEQ ID NO: 3641 - DNA, 18 bp, Artificial Sequence
  Synthetic DNA
tattccgaatcactatag

SEQ ID NO: 3642 - DNA, 18 bp, Artificial Sequence
  Synthetic DNA
taacaagactcactctag

SEQ ID NO: 3643 - DNA, 18 bp, Artificial Sequence
  Synthetic DNA
taatgaaactcactatag

SEQ ID NO: 3644 - DNA, 18 bp, Artificial Sequence
  Synthetic DNA
aaattcgtctcactatag

SEQ ID NO: 3645 - DNA, 18 bp, Artificial Sequence
  Synthetic DNA
taataagactcactttcg

SEQ ID NO: 3646 - DNA, 18 bp, Artificial Sequence
  Synthetic DNA
taatacgtctcaccaaag

SEQ ID NO: 3647 - DNA, 18 bp, Artificial Sequence
  Synthetic DNA
tgtttcgactcactatag

SEQ ID NO: 3648 - DNA, 18 bp, Artificial Sequence
  Synthetic DNA
tataacgactcgctatag

SEQ ID NO: 3649 - DNA, 18 bp, Artificial Sequence
  Synthetic DNA
aaatacgacttactaaag

SEQ ID NO: 3650 - DNA, 18 bp, Artificial Sequence
  Synthetic DNA
taatacaactctctctag

SEQ ID NO: 3651 - DNA, 18 bp, Artificial Sequence
  Synthetic DNA
tattacgactcacttcag

SEQ ID NO: 3652 - DNA, 18 bp, Artificial Sequence
  Synthetic DNA
ttatatgactcactaaag

SEQ ID NO: 3653 - DNA, 18 bp, Artificial Sequence
  Synthetic DNA
ttatgagactcactatag

SEQ ID NO: 3654 - DNA, 18 bp, Artificial Sequence
  Synthetic DNA
ctatacgactcacaatag

SEQ ID NO: 3655 - DNA, 18 bp, Artificial Sequence
  Synthetic DNA
taatacgaatcattacag

SEQ ID NO: 3656 - DNA, 18 bp, Artificial Sequence
  Synthetic DNA
taaaacgtctcgctatag

SEQ ID NO: 3657 - DNA, 18 bp, Artificial Sequence
  Synthetic DNA
aaatacgactagctatag

SEQ ID NO: 3658 - DNA, 18 bp, Artificial Sequence
  Synthetic DNA
taataacactcactacag

SEQ ID NO: 3659 - DNA, 18 bp, Artificial Sequence
  Synthetic DNA
aaatgcgactaactatag

SEQ ID NO: 3660 - DNA, 18 bp, Artificial Sequence
  Synthetic DNA
taatccgagtcattatag

SEQ ID NO: 3661 - DNA, 18 bp, Artificial Sequence
  Synthetic DNA
taatccgattcactacag

SEQ ID NO: 3662 - DNA, 18 bp, Artificial Sequence
  Synthetic DNA
taatgcgacttactttag

SEQ ID NO: 3663 - DNA, 18 bp, Artificial Sequence
  Synthetic DNA
taatgcgtctcactctag

SEQ ID NO: 3664 - DNA, 18 bp, Artificial Sequence
  Synthetic DNA
tactcctactcactatag

SEQ ID NO: 3665 - DNA, 18 bp, Artificial Sequence
  Synthetic DNA
tgttaggactcactatag

SEQ ID NO: 3666 - DNA, 18 bp, Artificial Sequence
  Synthetic DNA
caattcgacgcactatag

SEQ ID NO: 3667 - DNA, 18 bp, Artificial Sequence
  Synthetic DNA
taaaacgactcgctatgg

SEQ ID NO: 3668 - DNA, 18 bp, Artificial Sequence
  Synthetic DNA
taacaggactcaccatag

SEQ ID NO: 3669 - DNA, 18 bp, Artificial Sequence
  Synthetic DNA
taataagactcatgatag

SEQ ID NO: 3670 - DNA, 18 bp, Artificial Sequence
  Synthetic DNA
taataagcctcactgtag

SEQ ID NO: 3671 - DNA, 18 bp, Artificial Sequence
  Synthetic DNA
taataaggctcaccatag

SEQ ID NO: 3672 - DNA, 18 bp, Artificial Sequence
  Synthetic DNA
taatacgacgcactttgg

SEQ ID NO: 3673 - DNA, 18 bp, Artificial Sequence
  Synthetic DNA
taatacgactcggtatcg

SEQ ID NO: 3674 - DNA, 18 bp, Artificial Sequence
  Synthetic DNA
taatacgcctgacgatag

SEQ ID NO: 3675 - DNA, 18 bp, Artificial Sequence
  Synthetic DNA
taatacggatcagtatag

SEQ ID NO: 3676 - DNA, 18 bp, Artificial Sequence
  Synthetic DNA
taatacggcacactatcg

SEQ ID NO: 3677 - DNA, 18 bp, Artificial Sequence
  Synthetic DNA
taatagaactcaatatag

SEQ ID NO: 3678 - DNA, 18 bp, Artificial Sequence
  Synthetic DNA
taataggactcaatatgg

SEQ ID NO: 3679 - DNA, 18 bp, Artificial Sequence
  Synthetic DNA
taataggcctcacgatag

SEQ ID NO: 3680 - DNA, 18 bp, Artificial Sequence
  Synthetic DNA
taatatgactcacgattg

SEQ ID NO: 3681 - DNA, 18 bp, Artificial Sequence
  Synthetic DNA
taatccgcctcaatatag

SEQ ID NO: 3682 - DNA, 18 bp, Artificial Sequence
  Synthetic DNA
taatgcgactgcctatag

SEQ ID NO: 3683 - DNA, 18 bp, Artificial Sequence
  Synthetic DNA
taatgcgtctcagtatag

SEQ ID NO: 3684 - DNA, 18 bp, Artificial Sequence
  Synthetic DNA
taatgggactcactgtag

SEQ ID NO: 3685 - DNA, 18 bp, Artificial Sequence
  Synthetic DNA
taattgggctcactatag

SEQ ID NO: 3686 - DNA, 18 bp, Artificial Sequence
  Synthetic DNA
tagtacgactcactgtcg

SEQ ID NO: 3687 - DNA, 18 bp, Artificial Sequence
  Synthetic DNA
tattacgacccactatcg

SEQ ID NO: 3688 - DNA, 18 bp, Artificial Sequence
  Synthetic DNA
tcatacgactcaacatag

SEQ ID NO: 3689 - DNA, 18 bp, Artificial Sequence
  Synthetic DNA
tgctacgactcaatatag

SEQ ID NO: 3690 - DNA, 18 bp, Artificial Sequence
  Synthetic DNA
aaataggacgcactatag

SEQ ID NO: 3691 - DNA, 18 bp, Artificial Sequence
  Synthetic DNA
aactacggctcactatag

SEQ ID NO: 3692 - DNA, 18 bp, Artificial Sequence
  Synthetic DNA
caatacgactcgcgatag

SEQ ID NO: 3693 - DNA, 18 bp, Artificial Sequence
  Synthetic DNA
caatacgatccactatag

SEQ ID NO: 3694 - DNA, 18 bp, Artificial Sequence
  Synthetic DNA
caatagcactcactatag

SEQ ID NO: 3695 - DNA, 18 bp, Artificial Sequence
  Synthetic DNA
gaatacgactcacactag

SEQ ID NO: 3696 - DNA, 18 bp, Artificial Sequence
  Synthetic DNA
gaatacgtgtcactatag

SEQ ID NO: 3697 - DNA, 18 bp, Artificial Sequence
  Synthetic DNA
gaatgccactcactatag

SEQ ID NO: 3698 - DNA, 18 bp, Artificial Sequence
  Synthetic DNA
taacacgacgcactatcg

SEQ ID NO: 3699 - DNA, 18 bp, Artificial Sequence
  Synthetic DNA
taacacgactcgccatag

SEQ ID NO: 3700 - DNA, 18 bp, Artificial Sequence
  Synthetic DNA
taacacgactcgcgatag

SEQ ID NO: 3701 - DNA, 18 bp, Artificial Sequence
  Synthetic DNA
taacgcgactcaccatag

SEQ ID NO: 3702 - DNA, 18 bp, Artificial Sequence
  Synthetic DNA
taacgcgactctctatag

SEQ ID NO: 3703 - DNA, 18 bp, Artificial Sequence
  Synthetic DNA
taaggcgactcactgtag

SEQ ID NO: 3704 - DNA, 18 bp, Artificial Sequence
  Synthetic DNA
taataagactctctataa

SEQ ID NO: 3705 - DNA, 18 bp, Artificial Sequence
  Synthetic DNA
taataaggctcactacag

SEQ ID NO: 3706 - DNA, 18 bp, Artificial Sequence
  Synthetic DNA
taatacaactgactagag

SEQ ID NO: 3707 - DNA, 18 bp, Artificial Sequence
  Synthetic DNA
taatacgaatgcctatag

SEQ ID NO: 3708 - DNA, 18 bp, Artificial Sequence
  Synthetic DNA
taatacgaccaactgtag

SEQ ID NO: 3709 - DNA, 18 bp, Artificial Sequence
  Synthetic DNA
taatacgacccagtagag

SEQ ID NO: 3710 - DNA, 18 bp, Artificial Sequence
  Synthetic DNA
taatacgactcacaaaac

SEQ ID NO: 3711 - DNA, 18 bp, Artificial Sequence
  Synthetic DNA
taatacgactcactaaca

SEQ ID NO: 3712 - DNA, 18 bp, Artificial Sequence
  Synthetic DNA
taatacgactcactgggg

SEQ ID NO: 3713 - DNA, 18 bp, Artificial Sequence
  Synthetic DNA
taatacgactcacttaac

SEQ ID NO: 3714 - DNA, 18 bp, Artificial Sequence
  Synthetic DNA
taatacgactcagagtag

SEQ ID NO: 3715 - DNA, 18 bp, Artificial Sequence
  Synthetic DNA
taatacgactcatgatcg

SEQ ID NO: 3716 - DNA, 18 bp, Artificial Sequence
  Synthetic DNA
taatacgactccttgtag

SEQ ID NO: 3717 - DNA, 18 bp, Artificial Sequence
  Synthetic DNA
taatacgactcgttctag

SEQ ID NO: 3718 - DNA, 18 bp, Artificial Sequence
  Synthetic DNA
taatacgactgagtattg

SEQ ID NO: 3719 - DNA, 18 bp, Artificial Sequence
  Synthetic DNA
taatacgagtccctatcg

SEQ ID NO: 3720 - DNA, 18 bp, Artificial Sequence
  Synthetic DNA
taatacgagtccctgtag

SEQ ID NO: 3721 - DNA, 18 bp, Artificial Sequence
  Synthetic DNA
taatacgagtgaatatag

SEQ ID NO: 3722 - DNA, 18 bp, Artificial Sequence
  Synthetic DNA
taatacgattcacgagag

SEQ ID NO: 3723 - DNA, 18 bp, Artificial Sequence
  Synthetic DNA
taatacgattctcgatag

SEQ ID NO: 3724 - DNA, 18 bp, Artificial Sequence
  Synthetic DNA
taatacgcctaaccatag

SEQ ID NO: 3725 - DNA, 18 bp, Artificial Sequence
  Synthetic DNA
taatacgcctcgctctag

SEQ ID NO: 3726 - DNA, 18 bp, Artificial Sequence
  Synthetic DNA
taatacgcgtcactttag

SEQ ID NO: 3727 - DNA, 18 bp, Artificial Sequence
  Synthetic DNA
taatacggatcactacag

SEQ ID NO: 3728 - DNA, 18 bp, Artificial Sequence
  Synthetic DNA
taatacggctcactaccg

SEQ ID NO: 3729 - DNA, 18 bp, Artificial Sequence
  Synthetic DNA
taatacgtctcactttaa

SEQ ID NO: 3730 - DNA, 18 bp, Artificial Sequence
  Synthetic DNA
taatagggctcaccatag

SEQ ID NO: 3731 - DNA, 18 bp, Artificial Sequence
  Synthetic DNA
taatatggctcactatcg

SEQ ID NO: 3732 - DNA, 18 bp, Artificial Sequence
  Synthetic DNA
taatcggactcaccatag

SEQ ID NO: 3733 - DNA, 18 bp, Artificial Sequence
  Synthetic DNA
taatgcgcctccctatag

SEQ ID NO: 3734 - DNA, 18 bp, Artificial Sequence
  Synthetic DNA
taatgggactcaccatag

SEQ ID NO: 3735 - DNA, 18 bp, Artificial Sequence
  Synthetic DNA
taattagactcactataa

SEQ ID NO: 3736 - DNA, 18 bp, Artificial Sequence
  Synthetic DNA
taattcgactcactgtac

SEQ ID NO: 3737 - DNA, 18 bp, Artificial Sequence
  Synthetic DNA
taatttgacgcactatag

SEQ ID NO: 3738 - DNA, 18 bp, Artificial Sequence
  Synthetic DNA
tactacgacacactatcg

SEQ ID NO: 3739 - DNA, 18 bp, Artificial Sequence
  Synthetic DNA
tagcacgactcactacag

SEQ ID NO: 3740 - DNA, 18 bp, Artificial Sequence
  Synthetic DNA
tagtacgactcatgatag

SEQ ID NO: 3741 - DNA, 18 bp, Artificial Sequence
  Synthetic DNA
tagtacgagtcaccatag

SEQ ID NO: 3742 - DNA, 18 bp, Artificial Sequence
  Synthetic DNA
tattacaacgcactatag

SEQ ID NO: 3743 - DNA, 18 bp, Artificial Sequence
  Synthetic DNA
tattacgacttactataa

SEQ ID NO: 3744 - DNA, 18 bp, Artificial Sequence
  Synthetic DNA
tattacgaggcactatag

SEQ ID NO: 3745 - DNA, 18 bp, Artificial Sequence
  Synthetic DNA
tcagaccactcactatag

SEQ ID NO: 3746 - DNA, 18 bp, Artificial Sequence
  Synthetic DNA
tcatacgactcgccatag

SEQ ID NO: 3747 - DNA, 18 bp, Artificial Sequence
  Synthetic DNA
tcatacggcacactatag

SEQ ID NO: 3748 - DNA, 18 bp, Artificial Sequence
  Synthetic DNA
tcatacggctcactagag

SEQ ID NO: 3749 - DNA, 18 bp, Artificial Sequence
  Synthetic DNA
tcatacggctcactatcg

SEQ ID NO: 3750 - DNA, 18 bp, Artificial Sequence
  Synthetic DNA
tcatatgactcactagag

SEQ ID NO: 3751 - DNA, 18 bp, Artificial Sequence
  Synthetic DNA
tgataagcctcactatag

SEQ ID NO: 3752 - DNA, 18 bp, Artificial Sequence
  Synthetic DNA
tgatacgactcaccatgg

SEQ ID NO: 3753 - DNA, 18 bp, Artificial Sequence
  Synthetic DNA
tgatacgcctaactatag

SEQ ID NO: 3754 - DNA, 18 bp, Artificial Sequence
  Synthetic DNA
tgattcgactccctatag

SEQ ID NO: 3755 - DNA, 18 bp, Artificial Sequence
  Synthetic DNA
ttatacgactcactaaaa

SEQ ID NO: 3756 - DNA, 18 bp, Artificial Sequence
  Synthetic DNA
ttatacgactcactttat

SEQ ID NO: 3757 - DNA, 18 bp, Artificial Sequence
  Synthetic DNA
taatacgactcacattgg

SEQ ID NO: 3758 - DNA, 18 bp, Artificial Sequence
  Synthetic DNA
taataagactctctaaag

SEQ ID NO: 3759 - DNA, 18 bp, Artificial Sequence
  Synthetic DNA
taatagcactcactttag

SEQ ID NO: 3760 - DNA, 18 bp, Artificial Sequence
  Synthetic DNA
taatacgtctccctatgg

SEQ ID NO: 3761 - DNA, 18 bp, Artificial Sequence
  Synthetic DNA
taatacgtctcgatatag

SEQ ID NO: 3762 - DNA, 18 bp, Artificial Sequence
  Synthetic DNA
taattccactcaccatag

SEQ ID NO: 3763 - DNA, 18 bp, Artificial Sequence
  Synthetic DNA
gtatacgactcactttag

SEQ ID NO: 3764 - DNA, 18 bp, Artificial Sequence
  Synthetic DNA
aaataagacccactatag

SEQ ID NO: 3765 - DNA, 18 bp, Artificial Sequence
  Synthetic DNA
aaatacgactcactaacg

SEQ ID NO: 3766 - DNA, 18 bp, Artificial Sequence
  Synthetic DNA
gtatacgcctcactatag

SEQ ID NO: 3767 - DNA, 18 bp, Artificial Sequence
  Synthetic DNA
taatccgccacactatag

SEQ ID NO: 3768 - DNA, 18 bp, Artificial Sequence
  Synthetic DNA
taataagtctcactacag

SEQ ID NO: 3769 - DNA, 18 bp, Artificial Sequence
  Synthetic DNA
atatacaactcactatag

SEQ ID NO: 3770 - DNA, 18 bp, Artificial Sequence
  Synthetic DNA
taatacgtctcaccattg

SEQ ID NO: 3771 - DNA, 18 bp, Artificial Sequence
  Synthetic DNA
taatataactcacaatag

SEQ ID NO: 3772 - DNA, 18 bp, Artificial Sequence
  Synthetic DNA
tattacaactcactagag

SEQ ID NO: 3773 - DNA, 18 bp, Artificial Sequence
  Synthetic DNA
ttttaagactcactatag

SEQ ID NO: 3774 - DNA, 18 bp, Artificial Sequence
  Synthetic DNA
taaaacgactcactagtg

SEQ ID NO: 3775 - DNA, 18 bp, Artificial Sequence
  Synthetic DNA
taatacgtctcgccatag

SEQ ID NO: 3776 - DNA, 18 bp, Artificial Sequence
  Synthetic DNA
taaaccggctcactatag

SEQ ID NO: 3777 - DNA, 18 bp, Artificial Sequence
  Synthetic DNA
taacaggattcactatag

SEQ ID NO: 3778 - DNA, 18 bp, Artificial Sequence
  Synthetic DNA
taagccgactcactttag

SEQ ID NO: 3779 - DNA, 18 bp, Artificial Sequence
  Synthetic DNA
taatacaacgcaatatag

SEQ ID NO: 3780 - DNA, 18 bp, Artificial Sequence
  Synthetic DNA
taatacgaattactgtag

SEQ ID NO: 3781 - DNA, 18 bp, Artificial Sequence
  Synthetic DNA
taatacgagtcactttcg

SEQ ID NO: 3782 - DNA, 18 bp, Artificial Sequence
  Synthetic DNA
taatactactaagtatag

SEQ ID NO: 3783 - DNA, 18 bp, Artificial Sequence
  Synthetic DNA
taatctgactcactacag

SEQ ID NO: 3784 - DNA, 18 bp, Artificial Sequence
  Synthetic DNA
taatgcgactaattatag

SEQ ID NO: 3785 - DNA, 18 bp, Artificial Sequence
  Synthetic DNA
tagtgcgactcactttag

SEQ ID NO: 3786 - DNA, 18 bp, Artificial Sequence
  Synthetic DNA
tcattcgacccactatag

SEQ ID NO: 3787 - DNA, 18 bp, Artificial Sequence
  Synthetic DNA
tgatccgattcactatag

SEQ ID NO: 3788 - DNA, 18 bp, Artificial Sequence
  Synthetic DNA
tgattcgactcactgtag

SEQ ID NO: 3789 - DNA, 18 bp, Artificial Sequence
  Synthetic DNA
tagtacgtctcactattg

SEQ ID NO: 3790 - DNA, 18 bp, Artificial Sequence
  Synthetic DNA
taatatatctcactatag

SEQ ID NO: 3791 - DNA, 18 bp, Artificial Sequence
  Synthetic DNA
taatacgattcgctattg

SEQ ID NO: 3792 - DNA, 18 bp, Artificial Sequence
  Synthetic DNA
tattatgactcactacag

SEQ ID NO: 3793 - DNA, 18 bp, Artificial Sequence
  Synthetic DNA
tgattcgtctcactatag

SEQ ID NO: 3794 - DNA, 18 bp, Artificial Sequence
  Synthetic DNA
taaaacgaatccctatag

SEQ ID NO: 3795 - DNA, 18 bp, Artificial Sequence
  Synthetic DNA
ttatacgcctcactatcg

SEQ ID NO: 3796 - DNA, 18 bp, Artificial Sequence
  Synthetic DNA
taaaccgactcactacag

SEQ ID NO: 3797 - DNA, 18 bp, Artificial Sequence
  Synthetic DNA
taaagcgactcacaatag

SEQ ID NO: 3798 - DNA, 18 bp, Artificial Sequence
  Synthetic DNA
tactacaactcactattg

SEQ ID NO: 3799 - DNA, 18 bp, Artificial Sequence
  Synthetic DNA
ttatacgactcactttcg

SEQ ID NO: 3800 - DNA, 18 bp, Artificial Sequence
  Synthetic DNA
taaatcggctcactatag

SEQ ID NO: 3801 - DNA, 18 bp, Artificial Sequence
  Synthetic DNA
taatacgccacattatag

SEQ ID NO: 3802 - DNA, 18 bp, Artificial Sequence
  Synthetic DNA
aaatccgactcactctag

SEQ ID NO: 3803 - DNA, 18 bp, Artificial Sequence
  Synthetic DNA
ttatacgactcacactag

SEQ ID NO: 3804 - DNA, 18 bp, Artificial Sequence
  Synthetic DNA
gtatacgactcactattg

SEQ ID NO: 3805 - DNA, 18 bp, Artificial Sequence
  Synthetic DNA
taacacgactcgctaaag

SEQ ID NO: 3806 - DNA, 18 bp, Artificial Sequence
  Synthetic DNA
taattcgactcggtatag

SEQ ID NO: 3807 - DNA, 18 bp, Artificial Sequence
  Synthetic DNA
ttataggactcactagag

SEQ ID NO: 3808 - DNA, 18 bp, Artificial Sequence
  Synthetic DNA
aaagtcgactcactatag

SEQ ID NO: 3809 - DNA, 18 bp, Artificial Sequence
  Synthetic DNA
caataacactcactatag

SEQ ID NO: 3810 - DNA, 18 bp, Artificial Sequence
  Synthetic DNA
caatgcgactcgctatag

SEQ ID NO: 3811 - DNA, 18 bp, Artificial Sequence
  Synthetic DNA
gaatacgacacactaaag

SEQ ID NO: 3812 - DNA, 18 bp, Artificial Sequence
  Synthetic DNA
taacacgactccctaaag

SEQ ID NO: 3813 - DNA, 18 bp, Artificial Sequence
  Synthetic DNA
taacccggctcactatag

SEQ ID NO: 3814 - DNA, 18 bp, Artificial Sequence
  Synthetic DNA
taagacgactcactaagg

SEQ ID NO: 3815 - DNA, 18 bp, Artificial Sequence
  Synthetic DNA
taataagagccactatag

SEQ ID NO: 3816 - DNA, 18 bp, Artificial Sequence
  Synthetic DNA
taataccactaactgtag

SEQ ID NO: 3817 - DNA, 18 bp, Artificial Sequence
  Synthetic DNA
taataccactcaccgtag

SEQ ID NO: 3818 - DNA, 18 bp, Artificial Sequence
  Synthetic DNA
taatacgactcaacgtag

SEQ ID NO: 3819 - DNA, 18 bp, Artificial Sequence
  Synthetic DNA
taatacgactcaccaggg

SEQ ID NO: 3820 - DNA, 18 bp, Artificial Sequence
  Synthetic DNA
taataggaataactatag

SEQ ID NO: 3821 - DNA, 18 bp, Artificial Sequence
  Synthetic DNA
taataggactcaccatcg

SEQ ID NO: 3822 - DNA, 18 bp, Artificial Sequence
  Synthetic DNA
taatccgcctcaccatag

SEQ ID NO: 3823 - DNA, 18 bp, Artificial Sequence
  Synthetic DNA
taattcgactcacgctag

SEQ ID NO: 3824 - DNA, 18 bp, Artificial Sequence
  Synthetic DNA
tactacgcctcactatgg

SEQ ID NO: 3825 - DNA, 18 bp, Artificial Sequence
  Synthetic DNA
tagtaagactcactacag

SEQ ID NO: 3826 - DNA, 18 bp, Artificial Sequence
  Synthetic DNA
tgatacgactcacgaaag

SEQ ID NO: 3827 - DNA, 18 bp, Artificial Sequence
  Synthetic DNA
tgatacgtctcacgatag

SEQ ID NO: 3828 - DNA, 18 bp, Artificial Sequence
  Synthetic DNA
tgatgctactcactatag

SEQ ID NO: 3829 - DNA, 18 bp, Artificial Sequence
  Synthetic DNA
ttatacgagtcactagag

SEQ ID NO: 3830 - DNA, 18 bp, Artificial Sequence
  Synthetic DNA
aaaaacgactcactaaag

SEQ ID NO: 3831 - DNA, 18 bp, Artificial Sequence
  Synthetic DNA
aaatacaactcactttag

SEQ ID NO: 3832 - DNA, 18 bp, Artificial Sequence
  Synthetic DNA
aaatgcgactcacaatag

SEQ ID NO: 3833 - DNA, 18 bp, Artificial Sequence
  Synthetic DNA
tctaacgactcactatag

SEQ ID NO: 3834 - DNA, 18 bp, Artificial Sequence
  Synthetic DNA
aaatataactcactatag

SEQ ID NO: 3835 - DNA, 18 bp, Artificial Sequence
  Synthetic DNA
caatacaactcacaatag

SEQ ID NO: 3836 - DNA, 18 bp, Artificial Sequence
  Synthetic DNA
taatacgtcttaccatag

SEQ ID NO: 3837 - DNA, 18 bp, Artificial Sequence
  Synthetic DNA
taattcgtctcaatatag

SEQ ID NO: 3838 - DNA, 18 bp, Artificial Sequence
  Synthetic DNA
aaatacgactcactaagg

SEQ ID NO: 3839 - DNA, 18 bp, Artificial Sequence
  Synthetic DNA
taatacgtttcactaaag

SEQ ID NO: 3840 - DNA, 18 bp, Artificial Sequence
  Synthetic DNA
taatccgactcactaacg

SEQ ID NO: 3841 - DNA, 18 bp, Artificial Sequence
  Synthetic DNA
taaaacggatcactatag

SEQ ID NO: 3842 - DNA, 18 bp, Artificial Sequence
  Synthetic DNA
taaaaggacgcactatag

SEQ ID NO: 3843 - DNA, 18 bp, Artificial Sequence
  Synthetic DNA
taatacgacgcactaatg

SEQ ID NO: 3844 - DNA, 18 bp, Artificial Sequence
  Synthetic DNA
taatacgactagctctag

SEQ ID NO: 3845 - DNA, 18 bp, Artificial Sequence
  Synthetic DNA
taatacgactgtctatgg

SEQ ID NO: 3846 - DNA, 18 bp, Artificial Sequence
  Synthetic DNA
taatacgtctcactccag

SEQ ID NO: 3847 - DNA, 18 bp, Artificial Sequence
  Synthetic DNA
taatactactcactcgag

SEQ ID NO: 3848 - DNA, 18 bp, Artificial Sequence
  Synthetic DNA
taatatgactcgttatag

SEQ ID NO: 3849 - DNA, 18 bp, Artificial Sequence
  Synthetic DNA
taatccgactcactcttg

SEQ ID NO: 3850 - DNA, 18 bp, Artificial Sequence
  Synthetic DNA
taatccgactcgccatag

SEQ ID NO: 3851 - DNA, 18 bp, Artificial Sequence
  Synthetic DNA
taatttgactcactatcg

SEQ ID NO: 3852 - DNA, 18 bp, Artificial Sequence
  Synthetic DNA
tagtgcgaatcactatag

SEQ ID NO: 3853 - DNA, 18 bp, Artificial Sequence
  Synthetic DNA
tgatacgactaactctag

SEQ ID NO: 3854 - DNA, 18 bp, Artificial Sequence
  Synthetic DNA
taaaaggactcactattg

SEQ ID NO: 3855 - DNA, 18 bp, Artificial Sequence
  Synthetic DNA
taattagcctcactatag

SEQ ID NO: 3856 - DNA, 18 bp, Artificial Sequence
  Synthetic DNA
caatatgcctcactatag

SEQ ID NO: 3857 - DNA, 18 bp, Artificial Sequence
  Synthetic DNA
taatacgacacgctgtag

SEQ ID NO: 3858 - DNA, 18 bp, Artificial Sequence
  Synthetic DNA
taatccgcctcactattg

SEQ ID NO: 3859 - DNA, 18 bp, Artificial Sequence
  Synthetic DNA
tgatacgacacattatag

SEQ ID NO: 3860 - DNA, 18 bp, Artificial Sequence
  Synthetic DNA
atatacgactcactatcg

SEQ ID NO: 3861 - DNA, 18 bp, Artificial Sequence
  Synthetic DNA
taataaaactcactttag

SEQ ID NO: 3862 - DNA, 18 bp, Artificial Sequence
  Synthetic DNA
aattacgactcactaaag

SEQ ID NO: 3863 - DNA, 18 bp, Artificial Sequence
  Synthetic DNA
taaagcgcctcactatag

SEQ ID NO: 3864 - DNA, 18 bp, Artificial Sequence
  Synthetic DNA
tagtacaactcactaaag

SEQ ID NO: 3865 - DNA, 18 bp, Artificial Sequence
  Synthetic DNA
tgatatgactcactttag

SEQ ID NO: 3866 - DNA, 18 bp, Artificial Sequence
  Synthetic DNA
tattgcgactcacaatag

SEQ ID NO: 3867 - DNA, 18 bp, Artificial Sequence
  Synthetic DNA
caatacgactcactactg

SEQ ID NO: 3868 - DNA, 18 bp, Artificial Sequence
  Synthetic DNA
taatatgtgtcactatag

SEQ ID NO: 3869 - DNA, 18 bp, Artificial Sequence
  Synthetic DNA
taaaacgactctctaaag

SEQ ID NO: 3870 - DNA, 18 bp, Artificial Sequence
  Synthetic DNA
atatacgactcactacag

SEQ ID NO: 3871 - DNA, 18 bp, Artificial Sequence
  Synthetic DNA
tataacaactcactatag

SEQ ID NO: 3872 - DNA, 18 bp, Artificial Sequence
  Synthetic DNA
ttattcgactcaccatag

SEQ ID NO: 3873 - DNA, 18 bp, Artificial Sequence
  Synthetic DNA
ttatacgactcacaattg

SEQ ID NO: 3874 - DNA, 18 bp, Artificial Sequence
  Synthetic DNA
ttatatgactcactattg

SEQ ID NO: 3875 - DNA, 18 bp, Artificial Sequence
  Synthetic DNA
atttacgactcactatag

SEQ ID NO: 3876 - DNA, 18 bp, Artificial Sequence
  Synthetic DNA
taatacgtctctctatcg

SEQ ID NO: 3877 - DNA, 18 bp, Artificial Sequence
  Synthetic DNA
taaaccgactcattatag

SEQ ID NO: 3878 - DNA, 18 bp, Artificial Sequence
  Synthetic DNA
aagtacaactcactatag

SEQ ID NO: 3879 - DNA, 18 bp, Artificial Sequence
  Synthetic DNA
taataagactctctctag

SEQ ID NO: 3880 - DNA, 18 bp, Artificial Sequence
  Synthetic DNA
taatacgacctactaaag

SEQ ID NO: 3881 - DNA, 18 bp, Artificial Sequence
  Synthetic DNA
taatacgactcaatcttg

SEQ ID NO: 3882 - DNA, 18 bp, Artificial Sequence
  Synthetic DNA
taatacgactcgcaatgg

SEQ ID NO: 3883 - DNA, 18 bp, Artificial Sequence
  Synthetic DNA
taatacgcctcactaacg

SEQ ID NO: 3884 - DNA, 18 bp, Artificial Sequence
  Synthetic DNA
aaatccgactcgctatag

SEQ ID NO: 3885 - DNA, 18 bp, Artificial Sequence
  Synthetic DNA
caacactactcactatag

SEQ ID NO: 3886 - DNA, 18 bp, Artificial Sequence
  Synthetic DNA
caatgcgactctctatag

SEQ ID NO: 3887 - DNA, 18 bp, Artificial Sequence
  Synthetic DNA
cattacgacccactatag

SEQ ID NO: 3888 - DNA, 18 bp, Artificial Sequence
  Synthetic DNA
taatacaactcattatcg

SEQ ID NO: 3889 - DNA, 18 bp, Artificial Sequence
  Synthetic DNA
taatacagctcaccatag

SEQ ID NO: 3890 - DNA, 18 bp, Artificial Sequence
  Synthetic DNA
taatacgccacgctatag

SEQ ID NO: 3891 - DNA, 18 bp, Artificial Sequence
  Synthetic DNA
taattcgacccattatag

SEQ ID NO: 3892 - DNA, 18 bp, Artificial Sequence
  Synthetic DNA
tcatacgactcacaacag

SEQ ID NO: 3893 - DNA, 18 bp, Artificial Sequence
  Synthetic DNA
ttatacgcgtcactatag

SEQ ID NO: 3894 - DNA, 18 bp, Artificial Sequence
  Synthetic DNA
caatacgaatcaccatag

SEQ ID NO: 3895 - DNA, 18 bp, Artificial Sequence
  Synthetic DNA
caatacgactcaccatcg

SEQ ID NO: 3896 - DNA, 18 bp, Artificial Sequence
  Synthetic DNA
gattacgactcacaatag

SEQ ID NO: 3897 - DNA, 18 bp, Artificial Sequence
  Synthetic DNA
taagaagattcactatag

SEQ ID NO: 3898 - DNA, 18 bp, Artificial Sequence
  Synthetic DNA
taaggcgactcactatgg

SEQ ID NO: 3899 - DNA, 18 bp, Artificial Sequence
  Synthetic DNA
taatacccatcactatag

SEQ ID NO: 3900 - DNA, 18 bp, Artificial Sequence
  Synthetic DNA
taatacgacccgctattg

SEQ ID NO: 3901 - DNA, 18 bp, Artificial Sequence
  Synthetic DNA
taatacgacggattatag

SEQ ID NO: 3902 - DNA, 18 bp, Artificial Sequence
  Synthetic DNA
taatacgcatcaatatag

SEQ ID NO: 3903 - DNA, 18 bp, Artificial Sequence
  Synthetic DNA
taattccactcgctatag

SEQ ID NO: 3904 - DNA, 18 bp, Artificial Sequence
  Synthetic DNA
tacttcgactcgctatag

SEQ ID NO: 3905 - DNA, 18 bp, Artificial Sequence
  Synthetic DNA
tgataagacacactatag

SEQ ID NO: 3906 - DNA, 18 bp, Artificial Sequence
  Synthetic DNA
tgttacgactcacgatag

SEQ ID NO: 3907 - DNA, 18 bp, Artificial Sequence
  Synthetic DNA
ttctacgactcactacag

SEQ ID NO: 3908 - DNA, 18 bp, Artificial Sequence
  Synthetic DNA
aaatacgactcagtatgg

SEQ ID NO: 3909 - DNA, 18 bp, Artificial Sequence
  Synthetic DNA
aaatacgactcgctacag

SEQ ID NO: 3910 - DNA, 18 bp, Artificial Sequence
  Synthetic DNA
aaatactcctcactatag

SEQ ID NO: 3911 - DNA, 18 bp, Artificial Sequence
  Synthetic DNA
acatacgactcactctag

SEQ ID NO: 3912 - DNA, 18 bp, Artificial Sequence
  Synthetic DNA
caatacgagttactatag

SEQ ID NO: 3913 - DNA, 18 bp, Artificial Sequence
  Synthetic DNA
caatgcgactcacaatag

SEQ ID NO: 3914 - DNA, 18 bp, Artificial Sequence
  Synthetic DNA
taaaacgacgcactagag

SEQ ID NO: 3915 - DNA, 18 bp, Artificial Sequence
  Synthetic DNA
taacacgactgactaaag

SEQ ID NO: 3916 - DNA, 18 bp, Artificial Sequence
  Synthetic DNA
taagacgacgcactattg

SEQ ID NO: 3917 - DNA, 18 bp, Artificial Sequence
  Synthetic DNA
taataagactcgctacag

SEQ ID NO: 3918 - DNA, 18 bp, Artificial Sequence
  Synthetic DNA
taataccactcacttgag

SEQ ID NO: 3919 - DNA, 18 bp, Artificial Sequence
  Synthetic DNA
taatacgaaggactatag

SEQ ID NO: 3920 - DNA, 18 bp, Artificial Sequence
  Synthetic DNA
taatacgacgaagtatag

SEQ ID NO: 3921 - DNA, 18 bp, Artificial Sequence
  Synthetic DNA
taatacgcctcactgttg

SEQ ID NO: 3922 - DNA, 18 bp, Artificial Sequence
  Synthetic DNA
taatacggctcgctaaag

SEQ ID NO: 3923 - DNA, 18 bp, Artificial Sequence
  Synthetic DNA
taatacgtgtcgctatag

SEQ ID NO: 3924 - DNA, 18 bp, Artificial Sequence
  Synthetic DNA
taatagcactcactacag

SEQ ID NO: 3925 - DNA, 18 bp, Artificial Sequence
  Synthetic DNA
taataggtctcgctatag

SEQ ID NO: 3926 - DNA, 18 bp, Artificial Sequence
  Synthetic DNA
taatatgactaactatcg

SEQ ID NO: 3927 - DNA, 18 bp, Artificial Sequence
  Synthetic DNA
taatatggctcgctatag

SEQ ID NO: 3928 - DNA, 18 bp, Artificial Sequence
  Synthetic DNA
taatccgactcagtatgg

SEQ ID NO: 3929 - DNA, 18 bp, Artificial Sequence
  Synthetic DNA
taatccgcctcacgatag

SEQ ID NO: 3930 - DNA, 18 bp, Artificial Sequence
  Synthetic DNA
taattcgactcactggag

SEQ ID NO: 3931 - DNA, 18 bp, Artificial Sequence
  Synthetic DNA
taattcgactgagtatag

SEQ ID NO: 3932 - DNA, 18 bp, Artificial Sequence
  Synthetic DNA
tactaagactcgctatag

SEQ ID NO: 3933 - DNA, 18 bp, Artificial Sequence
  Synthetic DNA
tagaacggctcactatag

SEQ ID NO: 3934 - DNA, 18 bp, Artificial Sequence
  Synthetic DNA
tagtacgactcactgttg

SEQ ID NO: 3935 - DNA, 18 bp, Artificial Sequence
  Synthetic DNA
tagtacgactccctttag

SEQ ID NO: 3936 - DNA, 18 bp, Artificial Sequence
  Synthetic DNA
tagtactactcactacag

SEQ ID NO: 3937 - DNA, 18 bp, Artificial Sequence
  Synthetic DNA
tattacgacgcactaaag

SEQ ID NO: 3938 - DNA, 18 bp, Artificial Sequence
  Synthetic DNA
tgaaacgactcactatcg

SEQ ID NO: 3939 - DNA, 18 bp, Artificial Sequence
  Synthetic DNA
tgatccgactgactatag

SEQ ID NO: 3940 - DNA, 18 bp, Artificial Sequence
  Synthetic DNA
aagtacgactgactatag

SEQ ID NO: 3941 - DNA, 18 bp, Artificial Sequence
  Synthetic DNA
agatacgactcactagag

SEQ ID NO: 3942 - DNA, 18 bp, Artificial Sequence
  Synthetic DNA
caataagactcactatgg

SEQ ID NO: 3943 - DNA, 18 bp, Artificial Sequence
  Synthetic DNA
caatacgactcgccatag

SEQ ID NO: 3944 - DNA, 18 bp, Artificial Sequence
  Synthetic DNA
caatacggctcaatatag

SEQ ID NO: 3945 - DNA, 18 bp, Artificial Sequence
  Synthetic DNA
caatacggctccctatag

SEQ ID NO: 3946 - DNA, 18 bp, Artificial Sequence
  Synthetic DNA
gaatacgacttactttag

SEQ ID NO: 3947 - DNA, 18 bp, Artificial Sequence
  Synthetic DNA
gaataggactcattatag

SEQ ID NO: 3948 - DNA, 18 bp, Artificial Sequence
  Synthetic DNA
gattacgacccactatag

SEQ ID NO: 3949 - DNA, 18 bp, Artificial Sequence
  Synthetic DNA
gcatacggctcactatag

SEQ ID NO: 3950 - DNA, 18 bp, Artificial Sequence
  Synthetic DNA
gtatacgactcactagag

SEQ ID NO: 3951 - DNA, 18 bp, Artificial Sequence
  Synthetic DNA
taaaacgactcactgtac

SEQ ID NO: 3952 - DNA, 18 bp, Artificial Sequence
  Synthetic DNA
taaacggactcactatag

SEQ ID NO: 3953 - DNA, 18 bp, Artificial Sequence
  Synthetic DNA
taacaccacccactatag

SEQ ID NO: 3954 - DNA, 18 bp, Artificial Sequence
  Synthetic DNA
taacagcactcactatag

SEQ ID NO: 3955 - DNA, 18 bp, Artificial Sequence
  Synthetic DNA
taagacgaatcactatcg

SEQ ID NO: 3956 - DNA, 18 bp, Artificial Sequence
  Synthetic DNA
taagacgacttactgtag

SEQ ID NO: 3957 - DNA, 18 bp, Artificial Sequence
  Synthetic DNA
taagacgattcactacag

SEQ ID NO: 3958 - DNA, 18 bp, Artificial Sequence
  Synthetic DNA
taataaaactcactatgg

SEQ ID NO: 3959 - DNA, 18 bp, Artificial Sequence
  Synthetic DNA
taataagactcactttat

SEQ ID NO: 3960 - DNA, 18 bp, Artificial Sequence
  Synthetic DNA
taataagagtaactatag

SEQ ID NO: 3961 - DNA, 18 bp, Artificial Sequence
  Synthetic DNA
taataaggctcactctag

SEQ ID NO: 3962 - DNA, 18 bp, Artificial Sequence
  Synthetic DNA
taatacaagtccctatag

SEQ ID NO: 3963 - DNA, 18 bp, Artificial Sequence
  Synthetic DNA
taataccacgccctatag

SEQ ID NO: 3964 - DNA, 18 bp, Artificial Sequence
  Synthetic DNA
taataccactgactgtag

SEQ ID NO: 3965 - DNA, 18 bp, Artificial Sequence
  Synthetic DNA
taataccgctccctatag

SEQ ID NO: 3966 - DNA, 18 bp, Artificial Sequence
  Synthetic DNA
taatacgaatcgctgtag

SEQ ID NO: 3967 - DNA, 18 bp, Artificial Sequence
  Synthetic DNA
taatacgacacactgtac

SEQ ID NO: 3968 - DNA, 18 bp, Artificial Sequence
  Synthetic DNA
taatacgacccactagcg

SEQ ID NO: 3969 - DNA, 18 bp, Artificial Sequence
  Synthetic DNA
taatacgacccgatatag

SEQ ID NO: 3970 - DNA, 18 bp, Artificial Sequence
  Synthetic DNA
taatacgactcactctta

SEQ ID NO: 3971 - DNA, 18 bp, Artificial Sequence
  Synthetic DNA
taatacgactcactgtta

SEQ ID NO: 3972 - DNA, 18 bp, Artificial Sequence
  Synthetic DNA
taatacgactcattatct

SEQ ID NO: 3973 - DNA, 18 bp, Artificial Sequence
  Synthetic DNA
taatacgactccgtctag

SEQ ID NO: 3974 - DNA, 18 bp, Artificial Sequence
  Synthetic DNA
taatacgagtgtctatag

SEQ ID NO: 3975 - DNA, 18 bp, Artificial Sequence
  Synthetic DNA
taatacgattaagtatag

SEQ ID NO: 3976 - DNA, 18 bp, Artificial Sequence
  Synthetic DNA
taatacgccccactagag

SEQ ID NO: 3977 - DNA, 18 bp, Artificial Sequence
  Synthetic DNA
taatacggccgactatag

SEQ ID NO: 3978 - DNA, 18 bp, Artificial Sequence
  Synthetic DNA
taatacggctcagaatag

SEQ ID NO: 3979 - DNA, 18 bp, Artificial Sequence
  Synthetic DNA
taatacgtctcactatcc

SEQ ID NO: 3980 - DNA, 18 bp, Artificial Sequence
  Synthetic DNA
taatactacccactagag

SEQ ID NO: 3981 - DNA, 18 bp, Artificial Sequence
  Synthetic DNA
taataggactcactgtgg

SEQ ID NO: 3982 - DNA, 18 bp, Artificial Sequence
  Synthetic DNA
taatatgacccactaaag

SEQ ID NO: 3983 - DNA, 18 bp, Artificial Sequence
  Synthetic DNA
taatatgactctctataa

SEQ ID NO: 3984 - DNA, 18 bp, Artificial Sequence
  Synthetic DNA
taatatggctcactagag

SEQ ID NO: 3985 - DNA, 18 bp, Artificial Sequence
  Synthetic DNA
taatcggactgactatag

SEQ ID NO: 3986 - DNA, 18 bp, Artificial Sequence
  Synthetic DNA
taatctgactcactgtag

SEQ ID NO: 3987 - DNA, 18 bp, Artificial Sequence
  Synthetic DNA
taatgagacgcactatag

SEQ ID NO: 3988 - DNA, 18 bp, Artificial Sequence
  Synthetic DNA
taatgcaacgcactatag

SEQ ID NO: 3989 - DNA, 18 bp, Artificial Sequence
  Synthetic DNA
taatgccagtcactatag

SEQ ID NO: 3990 - DNA, 18 bp, Artificial Sequence
  Synthetic DNA
taatgggactccctatag

SEQ ID NO: 3991 - DNA, 18 bp, Artificial Sequence
  Synthetic DNA
taattcaactcactataa

SEQ ID NO: 3992 - DNA, 18 bp, Artificial Sequence
  Synthetic DNA
taattccagtcactatag

SEQ ID NO: 3993 - DNA, 18 bp, Artificial Sequence
  Synthetic DNA
taattcgactcattataa

SEQ ID NO: 3994 - DNA, 18 bp, Artificial Sequence
  Synthetic DNA
tacgacgactcactattg

SEQ ID NO: 3995 - DNA, 18 bp, Artificial Sequence
  Synthetic DNA
tactacgacgcactattg

SEQ ID NO: 3996 - DNA, 18 bp, Artificial Sequence
  Synthetic DNA
tactacgactcaccacag

SEQ ID NO: 3997 - DNA, 18 bp, Artificial Sequence
  Synthetic DNA
tactacgactcaccatcg

SEQ ID NO: 3998 - DNA, 18 bp, Artificial Sequence
  Synthetic DNA
tactacgatgcactatag

SEQ ID NO: 3999 - DNA, 18 bp, Artificial Sequence
  Synthetic DNA
taggacgactgactatag

SEQ ID NO: 4000 - DNA, 18 bp, Artificial Sequence
  Synthetic DNA
tagtacgactcactttaa

SEQ ID NO: 4001 - DNA, 18 bp, Artificial Sequence
  Synthetic DNA
tagtacgactcaggatag

SEQ ID NO: 4002 - DNA, 18 bp, Artificial Sequence
  Synthetic DNA
tagtacgactcgttatag

SEQ ID NO: 4003 - DNA, 18 bp, Artificial Sequence
  Synthetic DNA
tagtacgcctcgctatag

SEQ ID NO: 4004 - DNA, 18 bp, Artificial Sequence
  Synthetic DNA
tagtgcgactcgctatag

SEQ ID NO: 4005 - DNA, 18 bp, Artificial Sequence
  Synthetic DNA
tatgacgactcagtatag

SEQ ID NO: 4006 - DNA, 18 bp, Artificial Sequence
  Synthetic DNA
tattacgactcaagatag

SEQ ID NO: 4007 - DNA, 18 bp, Artificial Sequence
  Synthetic DNA
tattccgactgactatag

SEQ ID NO: 4008 - DNA, 18 bp, Artificial Sequence
  Synthetic DNA
tcataagacccactatag

SEQ ID NO: 4009 - DNA, 18 bp, Artificial Sequence
  Synthetic DNA
tcatacgacgcactctag

SEQ ID NO: 4010 - DNA, 18 bp, Artificial Sequence
  Synthetic DNA
tcatacgactcactgtgg

SEQ ID NO: 4011 - DNA, 18 bp, Artificial Sequence
  Synthetic DNA
tcatacgagtcgctatag

SEQ ID NO: 4012 - DNA, 18 bp, Artificial Sequence
  Synthetic DNA
tcatccgactcactgtag

SEQ ID NO: 4013 - DNA, 18 bp, Artificial Sequence
  Synthetic DNA
tcattcgactcacgatag

SEQ ID NO: 4014 - DNA, 18 bp, Artificial Sequence
  Synthetic DNA
tgagacgactcaccatag

SEQ ID NO: 4015 - DNA, 18 bp, Artificial Sequence
  Synthetic DNA
tgatacgacgcaccatag

SEQ ID NO: 4016 - DNA, 18 bp, Artificial Sequence
  Synthetic DNA
tgatacgactcagaatag

SEQ ID NO: 4017 - DNA, 18 bp, Artificial Sequence
  Synthetic DNA
tgataggacccactatag

SEQ ID NO: 4018 - DNA, 18 bp, Artificial Sequence
  Synthetic DNA
tgatccgagtcactatag

SEQ ID NO: 4019 - DNA, 18 bp, Artificial Sequence
  Synthetic DNA
tgatgcgactcaccatag

SEQ ID NO: 4020 - DNA, 18 bp, Artificial Sequence
  Synthetic DNA
tggtgcgactcactatag

SEQ ID NO: 4021 - DNA, 18 bp, Artificial Sequence
  Synthetic DNA
ttataagactcactataa

SEQ ID NO: 4022 - DNA, 18 bp, Artificial Sequence
  Synthetic DNA
ttaaacgactcactaaag

SEQ ID NO: 4023 - DNA, 18 bp, Artificial Sequence
  Synthetic DNA
taatacggcacactattg

SEQ ID NO: 4024 - DNA, 18 bp, Artificial Sequence
  Synthetic DNA
taattcgactcaccaaag

SEQ ID NO: 4025 - DNA, 18 bp, Artificial Sequence
  Synthetic DNA
tgaaacgactcactattg

SEQ ID NO: 4026 - DNA, 18 bp, Artificial Sequence
  Synthetic DNA
ttaaacgactcactatgg

SEQ ID NO: 4027 - DNA, 18 bp, Artificial Sequence
  Synthetic DNA
ttatatgactcactacag

SEQ ID NO: 4028 - DNA, 18 bp, Artificial Sequence
  Synthetic DNA
taattcaactcactgtag

SEQ ID NO: 4029 - DNA, 18 bp, Artificial Sequence
  Synthetic DNA
tgatgcgactcacaatag

SEQ ID NO: 4030 - DNA, 18 bp, Artificial Sequence
  Synthetic DNA
tattacgactcagtttag

SEQ ID NO: 4031 - DNA, 18 bp, Artificial Sequence
  Synthetic DNA
tcatccgactcactttag

SEQ ID NO: 4032 - DNA, 18 bp, Artificial Sequence
  Synthetic DNA
ttttacgactcaatatag

SEQ ID NO: 4033 - DNA, 18 bp, Artificial Sequence
  Synthetic DNA
taatacgtctcacttaag

SEQ ID NO: 4034 - DNA, 18 bp, Artificial Sequence
  Synthetic DNA
taatccaactcactattg

SEQ ID NO: 4035 - DNA, 18 bp, Artificial Sequence
  Synthetic DNA
taatttgagtcactatag

SEQ ID NO: 4036 - DNA, 18 bp, Artificial Sequence
  Synthetic DNA
tcttacgactcactatcg

SEQ ID NO: 4037 - DNA, 18 bp, Artificial Sequence
  Synthetic DNA
ttatacgactcgctatgg

SEQ ID NO: 4038 - DNA, 18 bp, Artificial Sequence
  Synthetic DNA
tcatacgtctcactattg

SEQ ID NO: 4039 - DNA, 18 bp, Artificial Sequence
  Synthetic DNA
taatcagactcactctag

SEQ ID NO: 4040 - DNA, 18 bp, Artificial Sequence
  Synthetic DNA
tattacgcctgactatag

SEQ ID NO: 4041 - DNA, 18 bp, Artificial Sequence
  Synthetic DNA
taaaacgactcactaatg

SEQ ID NO: 4042 - DNA, 18 bp, Artificial Sequence
  Synthetic DNA
ttattcgactcactattg

SEQ ID NO: 4043 - DNA, 18 bp, Artificial Sequence
  Synthetic DNA
tcatacgactcactaatg

SEQ ID NO: 4044 - DNA, 18 bp, Artificial Sequence
  Synthetic DNA
tatttcgactcactattg

SEQ ID NO: 4045 - DNA, 18 bp, Artificial Sequence
  Synthetic DNA
taatacgactcgatacag

SEQ ID NO: 4046 - DNA, 18 bp, Artificial Sequence
  Synthetic DNA
aaatacgcctcactacag

SEQ ID NO: 4047 - DNA, 18 bp, Artificial Sequence
  Synthetic DNA
taaaacgactccctgtag

SEQ ID NO: 4048 - DNA, 18 bp, Artificial Sequence
  Synthetic DNA
taatacgaccccctaaag

SEQ ID NO: 4049 - DNA, 18 bp, Artificial Sequence
  Synthetic DNA
taatactagtcactctag

SEQ ID NO: 4050 - DNA, 18 bp, Artificial Sequence
  Synthetic DNA
tactacgactcaatatcg

SEQ ID NO: 4051 - DNA, 18 bp, Artificial Sequence
  Synthetic DNA
tagtacaaatcactatag

SEQ ID NO: 4052 - DNA, 18 bp, Artificial Sequence
  Synthetic DNA
tattacgcctcacgatag

SEQ ID NO: 4053 - DNA, 18 bp, Artificial Sequence
  Synthetic DNA
tgatacgacccactattg

SEQ ID NO: 4054 - DNA, 18 bp, Artificial Sequence
  Synthetic DNA
taatacgccttactaaag

SEQ ID NO: 4055 - DNA, 18 bp, Artificial Sequence
  Synthetic DNA
taattagacccactatag

SEQ ID NO: 4056 - DNA, 18 bp, Artificial Sequence
  Synthetic DNA
taatttgcctcactatag

SEQ ID NO: 4057 - DNA, 18 bp, Artificial Sequence
  Synthetic DNA
ttatccgtctcactatag

SEQ ID NO: 4058 - DNA, 18 bp, Artificial Sequence
  Synthetic DNA
taaaacgactcgctttag

SEQ ID NO: 4059 - DNA, 18 bp, Artificial Sequence
  Synthetic DNA
aaatacaactcactacag

SEQ ID NO: 4060 - DNA, 18 bp, Artificial Sequence
  Synthetic DNA
taattcgcctcaatatag

SEQ ID NO: 4061 - DNA, 18 bp, Artificial Sequence
  Synthetic DNA
tcattcgactcactacag

SEQ ID NO: 4062 - DNA, 18 bp, Artificial Sequence
  Synthetic DNA
ttttacgacgcactatag

SEQ ID NO: 4063 - DNA, 18 bp, Artificial Sequence
  Synthetic DNA
taacacgactcacttttg

SEQ ID NO: 4064 - DNA, 18 bp, Artificial Sequence
  Synthetic DNA
aaattcggctcactatag

SEQ ID NO: 4065 - DNA, 18 bp, Artificial Sequence
  Synthetic DNA
ttaaacaactcactatag

SEQ ID NO: 4066 - DNA, 18 bp, Artificial Sequence
  Synthetic DNA
taaaacgactcagtttag

SEQ ID NO: 4067 - DNA, 18 bp, Artificial Sequence
  Synthetic DNA
taatgcgtctcactgtag

SEQ ID NO: 4068 - DNA, 18 bp, Artificial Sequence
  Synthetic DNA
tactacgtctcaccatag

SEQ ID NO: 4069 - DNA, 18 bp, Artificial Sequence
  Synthetic DNA
gaattcgactcactttag

SEQ ID NO: 4070 - DNA, 18 bp, Artificial Sequence
  Synthetic DNA
taaaacgacccattatag

SEQ ID NO: 4071 - DNA, 18 bp, Artificial Sequence
  Synthetic DNA
taatacgacgcaccattg

SEQ ID NO: 4072 - DNA, 18 bp, Artificial Sequence
  Synthetic DNA
taatccaactcagtatag

SEQ ID NO: 4073 - DNA, 18 bp, Artificial Sequence
  Synthetic DNA
taattcgactcagtattg

SEQ ID NO: 4074 - DNA, 18 bp, Artificial Sequence
  Synthetic DNA
aaatacgactcgctagag

SEQ ID NO: 4075 - DNA, 18 bp, Artificial Sequence
  Synthetic DNA
aagtacgactcagtatag

SEQ ID NO: 4076 - DNA, 18 bp, Artificial Sequence
  Synthetic DNA
gaatacaactcactattg

SEQ ID NO: 4077 - DNA, 18 bp, Artificial Sequence
  Synthetic DNA
gaatacgcctcactaaag

SEQ ID NO: 4078 - DNA, 18 bp, Artificial Sequence
  Synthetic DNA
taaaacgactcaccagag

SEQ ID NO: 4079 - DNA, 18 bp, Artificial Sequence
  Synthetic DNA
taacacgactcattacag

SEQ ID NO: 4080 - DNA, 18 bp, Artificial Sequence
  Synthetic DNA
taataaaagtcactatag

SEQ ID NO: 4081 - DNA, 18 bp, Artificial Sequence
  Synthetic DNA
taatacaactcactcgag

SEQ ID NO: 4082 - DNA, 18 bp, Artificial Sequence
  Synthetic DNA
taataccacccactctag

SEQ ID NO: 4083 - DNA, 18 bp, Artificial Sequence
  Synthetic DNA
taatacctctcactctag

SEQ ID NO: 4084 - DNA, 18 bp, Artificial Sequence
  Synthetic DNA
taatacgaatcaggatag

SEQ ID NO: 4085 - DNA, 18 bp, Artificial Sequence
  Synthetic DNA
taatacgaatcgctatgg

SEQ ID NO: 4086 - DNA, 18 bp, Artificial Sequence
  Synthetic DNA
taatacgaatcgctctag

SEQ ID NO: 4087 - DNA, 18 bp, Artificial Sequence
  Synthetic DNA
taatacgaatgagtatag

SEQ ID NO: 4088 - DNA, 18 bp, Artificial Sequence
  Synthetic DNA
taatacgacgcaatattg

SEQ ID NO: 4089 - DNA, 18 bp, Artificial Sequence
  Synthetic DNA
taatacgactatcgatag

SEQ ID NO: 4090 - DNA, 18 bp, Artificial Sequence
  Synthetic DNA
taatacgccgcactaaag

SEQ ID NO: 4091 - DNA, 18 bp, Artificial Sequence
  Synthetic DNA
taatccgagtcaatatag

SEQ ID NO: 4092 - DNA, 18 bp, Artificial Sequence
  Synthetic DNA
taattggactccctatag

SEQ ID NO: 4093 - DNA, 18 bp, Artificial Sequence
  Synthetic DNA
tacgacaactcactatag

SEQ ID NO: 4094 - DNA, 18 bp, Artificial Sequence
  Synthetic DNA
tactacgccacactatag

SEQ ID NO: 4095 - DNA, 18 bp, Artificial Sequence
  Synthetic DNA
tactatgactcactatgg

SEQ ID NO: 4096 - DNA, 18 bp, Artificial Sequence
  Synthetic DNA
tattacgactcacgatcg

SEQ ID NO: 4097 - DNA, 18 bp, Artificial Sequence
  Synthetic DNA
tattccgactcactatcg

SEQ ID NO: 4098 - DNA, 18 bp, Artificial Sequence
  Synthetic DNA
tcataagactcactctag

SEQ ID NO: 4099 - DNA, 18 bp, Artificial Sequence
  Synthetic DNA
tcatatgactgactatag

SEQ ID NO: 4100 - DNA, 18 bp, Artificial Sequence
  Synthetic DNA
tgataggactcactacag

SEQ ID NO: 4101 - DNA, 18 bp, Artificial Sequence
  Synthetic DNA
ttatacgactccctacag

SEQ ID NO: 4102 - DNA, 18 bp, Artificial Sequence
  Synthetic DNA
taaaacgacacaccatag

SEQ ID NO: 4103 - DNA, 18 bp, Artificial Sequence
  Synthetic DNA
tattacgacttactattg

SEQ ID NO: 4104 - DNA, 18 bp, Artificial Sequence
  Synthetic DNA
ttatacgactcactaacg

SEQ ID NO: 4105 - DNA, 18 bp, Artificial Sequence
  Synthetic DNA
taatacgactcactacct

SEQ ID NO: 4106 - DNA, 18 bp, Artificial Sequence
  Synthetic DNA
tattatgcctcactatag

SEQ ID NO: 4107 - DNA, 18 bp, Artificial Sequence
  Synthetic DNA
tgttatgactcactatag

SEQ ID NO: 4108 - DNA, 18 bp, Artificial Sequence
  Synthetic DNA
agatacgactcactattg

SEQ ID NO: 4109 - DNA, 18 bp, Artificial Sequence
  Synthetic DNA
tattccgtctcactatag

SEQ ID NO: 4110 - DNA, 18 bp, Artificial Sequence
  Synthetic DNA
aaatacgactaactatgg

SEQ ID NO: 4111 - DNA, 18 bp, Artificial Sequence
  Synthetic DNA
taatacgactcaatttcg

SEQ ID NO: 4112 - DNA, 18 bp, Artificial Sequence
  Synthetic DNA
taatacgactcattaagg

SEQ ID NO: 4113 - DNA, 18 bp, Artificial Sequence
  Synthetic DNA
taatccgattcattatag

SEQ ID NO: 4114 - DNA, 18 bp, Artificial Sequence
  Synthetic DNA
taatgcgactaactttag

SEQ ID NO: 4115 - DNA, 18 bp, Artificial Sequence
  Synthetic DNA
tacttcgactcactatcg

SEQ ID NO: 4116 - DNA, 18 bp, Artificial Sequence
  Synthetic DNA
taaaacgtctcactattg

SEQ ID NO: 4117 - DNA, 18 bp, Artificial Sequence
  Synthetic DNA
aaatacgcctcactctag

SEQ ID NO: 4118 - DNA, 18 bp, Artificial Sequence
  Synthetic DNA
taaaaagactgactatag

SEQ ID NO: 4119 - DNA, 18 bp, Artificial Sequence
  Synthetic DNA
taatacaactccctgtag

SEQ ID NO: 4120 - DNA, 18 bp, Artificial Sequence
  Synthetic DNA
taatacgattcgccatag

SEQ ID NO: 4121 - DNA, 18 bp, Artificial Sequence
  Synthetic DNA
taatacgattgactattg

SEQ ID NO: 4122 - DNA, 18 bp, Artificial Sequence
  Synthetic DNA
taatacgcctcacactag

SEQ ID NO: 4123 - DNA, 18 bp, Artificial Sequence
  Synthetic DNA
taatacgcctcactttcg

SEQ ID NO: 4124 - DNA, 18 bp, Artificial Sequence
  Synthetic DNA
taatacgccttaccatag

SEQ ID NO: 4125 - DNA, 18 bp, Artificial Sequence
  Synthetic DNA
taatacggctcaccatgg

SEQ ID NO: 4126 - DNA, 18 bp, Artificial Sequence
  Synthetic DNA
taataggactcacttgag

SEQ ID NO: 4127 - DNA, 18 bp, Artificial Sequence
  Synthetic DNA
taatgcgtctgactatag

SEQ ID NO: 4128 - DNA, 18 bp, Artificial Sequence
  Synthetic DNA
taattcgactccccatag

SEQ ID NO: 4129 - DNA, 18 bp, Artificial Sequence
  Synthetic DNA
tattacgaatgactatag

SEQ ID NO: 4130 - DNA, 18 bp, Artificial Sequence
  Synthetic DNA
tattacgactcccgatag

SEQ ID NO: 4131 - DNA, 18 bp, Artificial Sequence
  Synthetic DNA
tcatacgactcattatcg

SEQ ID NO: 4132 - DNA, 18 bp, Artificial Sequence
  Synthetic DNA
tgatacgactagctatag

SEQ ID NO: 4133 - DNA, 18 bp, Artificial Sequence
  Synthetic DNA
ttacacgcctcactatag

SEQ ID NO: 4134 - DNA, 18 bp, Artificial Sequence
  Synthetic DNA
taatccgactcactgttg

SEQ ID NO: 4135 - DNA, 18 bp, Artificial Sequence
  Synthetic DNA
gattacgactcactatgg

SEQ ID NO: 4136 - DNA, 18 bp, Artificial Sequence
  Synthetic DNA
taataagactagctatag

SEQ ID NO: 4137 - DNA, 18 bp, Artificial Sequence
  Synthetic DNA
tgatacgactaaccatag

SEQ ID NO: 4138 - DNA, 18 bp, Artificial Sequence
  Synthetic DNA
ttatccgcctcactatag

SEQ ID NO: 4139 - DNA, 18 bp, Artificial Sequence
  Synthetic DNA
aaatacaactcactaaag

SEQ ID NO: 4140 - DNA, 18 bp, Artificial Sequence
  Synthetic DNA
tattacgacacgctatag

SEQ ID NO: 4141 - DNA, 18 bp, Artificial Sequence
  Synthetic DNA
taataggtctcactattg

SEQ ID NO: 4142 - DNA, 18 bp, Artificial Sequence
  Synthetic DNA
taatacgagttaatatag

SEQ ID NO: 4143 - DNA, 18 bp, Artificial Sequence
  Synthetic DNA
taaagcgactaactatag

SEQ ID NO: 4144 - DNA, 18 bp, Artificial Sequence
  Synthetic DNA
taataagcctcactttag

SEQ ID NO: 4145 - DNA, 18 bp, Artificial Sequence
  Synthetic DNA
tattaggactctctatag

SEQ ID NO: 4146 - DNA, 18 bp, Artificial Sequence
  Synthetic DNA
taaatagactcactatag

SEQ ID NO: 4147 - DNA, 18 bp, Artificial Sequence
  Synthetic DNA
tattacgactcattatgg

SEQ ID NO: 4148 - DNA, 18 bp, Artificial Sequence
  Synthetic DNA
ttataggactcacaatag

SEQ ID NO: 4149 - DNA, 18 bp, Artificial Sequence
  Synthetic DNA
tattacaactcactaaag

SEQ ID NO: 4150 - DNA, 18 bp, Artificial Sequence
  Synthetic DNA
taatacgactcaatcaag

SEQ ID NO: 4151 - DNA, 18 bp, Artificial Sequence
  Synthetic DNA
taattcgaatcactatcg

SEQ ID NO: 4152 - DNA, 18 bp, Artificial Sequence
  Synthetic DNA
aaatacgactcactcaag

SEQ ID NO: 4153 - DNA, 18 bp, Artificial Sequence
  Synthetic DNA
tattccgactcactaaag

SEQ ID NO: 4154 - DNA, 18 bp, Artificial Sequence
  Synthetic DNA
taattcgtgtcactatag

SEQ ID NO: 4155 - DNA, 18 bp, Artificial Sequence
  Synthetic DNA
tatttcgactcacaatag

SEQ ID NO: 4156 - DNA, 18 bp, Artificial Sequence
  Synthetic DNA
tacaacgactcaatatag

SEQ ID NO: 4157 - DNA, 18 bp, Artificial Sequence
  Synthetic DNA
taataagactcaccacag

SEQ ID NO: 4158 - DNA, 18 bp, Artificial Sequence
  Synthetic DNA
taatacggctcaccattg

SEQ ID NO: 4159 - DNA, 18 bp, Artificial Sequence
  Synthetic DNA
tataacgactcactatgg

SEQ ID NO: 4160 - DNA, 18 bp, Artificial Sequence
  Synthetic DNA
caaaacgactcaatatag

SEQ ID NO: 4161 - DNA, 18 bp, Artificial Sequence
  Synthetic DNA
gaatacgactcactactg

SEQ ID NO: 4162 - DNA, 18 bp, Artificial Sequence
  Synthetic DNA
taaaacgactccatatag

SEQ ID NO: 4163 - DNA, 18 bp, Artificial Sequence
  Synthetic DNA
taataccactcgctattg

SEQ ID NO: 4164 - DNA, 18 bp, Artificial Sequence
  Synthetic DNA
taataccgctcactttag

SEQ ID NO: 4165 - DNA, 18 bp, Artificial Sequence
  Synthetic DNA
taatacgactcaatccag

SEQ ID NO: 4166 - DNA, 18 bp, Artificial Sequence
  Synthetic DNA
taatacgactgattgtag

SEQ ID NO: 4167 - DNA, 18 bp, Artificial Sequence
  Synthetic DNA
taatgcgaaacactatag

SEQ ID NO: 4168 - DNA, 18 bp, Artificial Sequence
  Synthetic DNA
taatgcgactcaatatgg

SEQ ID NO: 4169 - DNA, 18 bp, Artificial Sequence
  Synthetic DNA
taatgcgcctaactatag

SEQ ID NO: 4170 - DNA, 18 bp, Artificial Sequence
  Synthetic DNA
tactccgactcactttag

SEQ ID NO: 4171 - DNA, 18 bp, Artificial Sequence
  Synthetic DNA
tggtacgactcaccatag

SEQ ID NO: 4172 - DNA, 18 bp, Artificial Sequence
  Synthetic DNA
taaaacgactcagtaaag

SEQ ID NO: 4173 - DNA, 18 bp, Artificial Sequence
  Synthetic DNA
caatatgactcactacag

SEQ ID NO: 4174 - DNA, 18 bp, Artificial Sequence
  Synthetic DNA
taacacgcctcacaatag

SEQ ID NO: 4175 - DNA, 18 bp, Artificial Sequence
  Synthetic DNA
taatacgaatcattagag

SEQ ID NO: 4176 - DNA, 18 bp, Artificial Sequence
  Synthetic DNA
taatacgactcaataacg

SEQ ID NO: 4177 - DNA, 18 bp, Artificial Sequence
  Synthetic DNA
taattcgacttgctatag

SEQ ID NO: 4178 - DNA, 18 bp, Artificial Sequence
  Synthetic DNA
tagtacaactcactatcg

SEQ ID NO: 4179 - DNA, 18 bp, Artificial Sequence
  Synthetic DNA
tattacgactcattagag

SEQ ID NO: 4180 - DNA, 18 bp, Artificial Sequence
  Synthetic DNA
caatatgactcacgatag

SEQ ID NO: 4181 - DNA, 18 bp, Artificial Sequence
  Synthetic DNA
taaaacgactcacttgag

SEQ ID NO: 4182 - DNA, 18 bp, Artificial Sequence
  Synthetic DNA
taacaagactcacgatag

SEQ ID NO: 4183 - DNA, 18 bp, Artificial Sequence
  Synthetic DNA
taacacaactgactatag

SEQ ID NO: 4184 - DNA, 18 bp, Artificial Sequence
  Synthetic DNA
taacatgacgcactatag

SEQ ID NO: 4185 - DNA, 18 bp, Artificial Sequence
  Synthetic DNA
taagacgacaaactatag

SEQ ID NO: 4186 - DNA, 18 bp, Artificial Sequence
  Synthetic DNA
taagacgacacaatatag

SEQ ID NO: 4187 - DNA, 18 bp, Artificial Sequence
  Synthetic DNA
taagacgattctctatag

SEQ ID NO: 4188 - DNA, 18 bp, Artificial Sequence
  Synthetic DNA
taatacaacgcactacag

SEQ ID NO: 4189 - DNA, 18 bp, Artificial Sequence
  Synthetic DNA
taatacgactcgctgtgg

SEQ ID NO: 4190 - DNA, 18 bp, Artificial Sequence
  Synthetic DNA
taatactactaactacag

SEQ ID NO: 4191 - DNA, 18 bp, Artificial Sequence
  Synthetic DNA
taataggactcaccatgg

SEQ ID NO: 4192 - DNA, 18 bp, Artificial Sequence
  Synthetic DNA
taataggcctaactatag

SEQ ID NO: 4193 - DNA, 18 bp, Artificial Sequence
  Synthetic DNA
taatatggatcactatag

SEQ ID NO: 4194 - DNA, 18 bp, Artificial Sequence
  Synthetic DNA
taatgcaactcactatgg

SEQ ID NO: 4195 - DNA, 18 bp, Artificial Sequence
  Synthetic DNA
taatgccactcactaaag

SEQ ID NO: 4196 - DNA, 18 bp, Artificial Sequence
  Synthetic DNA
taatgcgactcacttgag

SEQ ID NO: 4197 - DNA, 18 bp, Artificial Sequence
  Synthetic DNA
tactccgaatcactatag

SEQ ID NO: 4198 - DNA, 18 bp, Artificial Sequence
  Synthetic DNA
tattacgacccgctatag

SEQ ID NO: 4199 - DNA, 18 bp, Artificial Sequence
  Synthetic DNA
tattccgacccactatag

SEQ ID NO: 4200 - DNA, 18 bp, Artificial Sequence
  Synthetic DNA
tcaaacggctcactatag

SEQ ID NO: 4201 - DNA, 18 bp, Artificial Sequence
  Synthetic DNA
tcatacgcctcactaaag

SEQ ID NO: 4202 - DNA, 18 bp, Artificial Sequence
  Synthetic DNA
tcatacggctcattatag

SEQ ID NO: 4203 - DNA, 18 bp, Artificial Sequence
  Synthetic DNA
tcataggactcgctatag

SEQ ID NO: 4204 - DNA, 18 bp, Artificial Sequence
  Synthetic DNA
tcatccgactcactacag

SEQ ID NO: 4205 - DNA, 18 bp, Artificial Sequence
  Synthetic DNA
tgatacacctcactatag

SEQ ID NO: 4206 - DNA, 18 bp, Artificial Sequence
  Synthetic DNA
tgatacgacacactgtag

SEQ ID NO: 4207 - DNA, 18 bp, Artificial Sequence
  Synthetic DNA
tgatacggctcattatag

SEQ ID NO: 4208 - DNA, 18 bp, Artificial Sequence
  Synthetic DNA
tggtacaactcactatag

SEQ ID NO: 4209 - DNA, 18 bp, Artificial Sequence
  Synthetic DNA
ttatacgcctccctatag

SEQ ID NO: 4210 - DNA, 18 bp, Artificial Sequence
  Synthetic DNA
ttatccggctcactatag

SEQ ID NO: 4211 - DNA, 18 bp, Artificial Sequence
  Synthetic DNA
aaacacgactccctatag

SEQ ID NO: 4212 - DNA, 18 bp, Artificial Sequence
  Synthetic DNA
aaagaagactcactatag

SEQ ID NO: 4213 - DNA, 18 bp, Artificial Sequence
  Synthetic DNA
aaagacgattcactatag

SEQ ID NO: 4214 - DNA, 18 bp, Artificial Sequence
  Synthetic DNA
aaatacaacgcactatag

SEQ ID NO: 4215 - DNA, 18 bp, Artificial Sequence
  Synthetic DNA
aaatatgacgcactatag

SEQ ID NO: 4216 - DNA, 18 bp, Artificial Sequence
  Synthetic DNA
aattacgactcactataa

SEQ ID NO: 4217 - DNA, 18 bp, Artificial Sequence
  Synthetic DNA
caagacggctcactatag

SEQ ID NO: 4218 - DNA, 18 bp, Artificial Sequence
  Synthetic DNA
caataccactcactgtag

SEQ ID NO: 4219 - DNA, 18 bp, Artificial Sequence
  Synthetic DNA
caatacgactcagtattg

SEQ ID NO: 4220 - DNA, 18 bp, Artificial Sequence
  Synthetic DNA
caatacgagtcactatgg

SEQ ID NO: 4221 - DNA, 18 bp, Artificial Sequence
  Synthetic DNA
cagtacgactcactatgg

SEQ ID NO: 4222 - DNA, 18 bp, Artificial Sequence
  Synthetic DNA
ccataggactcactatag

SEQ ID NO: 4223 - DNA, 18 bp, Artificial Sequence
  Synthetic DNA
cgatacgactcactatgg

SEQ ID NO: 4224 - DNA, 18 bp, Artificial Sequence
  Synthetic DNA
gaatacggctcactattg

SEQ ID NO: 4225 - DNA, 18 bp, Artificial Sequence
  Synthetic DNA
gaatgcgactcactattg

SEQ ID NO: 4226 - DNA, 18 bp, Artificial Sequence
  Synthetic DNA
gaattcgattcactatag

SEQ ID NO: 4227 - DNA, 18 bp, Artificial Sequence
  Synthetic DNA
gagtacgactcactaaag

SEQ ID NO: 4228 - DNA, 18 bp, Artificial Sequence
  Synthetic DNA
gcatacgactcaatatag

SEQ ID NO: 4229 - DNA, 18 bp, Artificial Sequence
  Synthetic DNA
taaaacgacgcactacag

SEQ ID NO: 4230 - DNA, 18 bp, Artificial Sequence
  Synthetic DNA
taaaacgactcacgctag

SEQ ID NO: 4231 - DNA, 18 bp, Artificial Sequence
  Synthetic DNA
taacacgactcaatgtag

SEQ ID NO: 4232 - DNA, 18 bp, Artificial Sequence
  Synthetic DNA
taacacgcatcactatag

SEQ ID NO: 4233 - DNA, 18 bp, Artificial Sequence
  Synthetic DNA
taagaggactcaatatag

SEQ ID NO: 4234 - DNA, 18 bp, Artificial Sequence
  Synthetic DNA
taatacaactcactaggg

SEQ ID NO: 4235 - DNA, 18 bp, Artificial Sequence
  Synthetic DNA
taataccactgcctatag

SEQ ID NO: 4236 - DNA, 18 bp, Artificial Sequence
  Synthetic DNA
taatacccctcactgtag

SEQ ID NO: 4237 - DNA, 18 bp, Artificial Sequence
  Synthetic DNA
taatacgaatcaccctag

SEQ ID NO: 4238 - DNA, 18 bp, Artificial Sequence
  Synthetic DNA
taatacgaatgactatcg

SEQ ID NO: 4239 - DNA, 18 bp, Artificial Sequence
  Synthetic DNA
taatacgaatgactctag

SEQ ID NO: 4240 - DNA, 18 bp, Artificial Sequence
  Synthetic DNA
taatacgactaaccagag

SEQ ID NO: 4241 - DNA, 18 bp, Artificial Sequence
  Synthetic DNA
taatacgactcagtacgg

SEQ ID NO: 4242 - DNA, 18 bp, Artificial Sequence
  Synthetic DNA
taatacgactccgtttag

SEQ ID NO: 4243 - DNA, 18 bp, Artificial Sequence
  Synthetic DNA
taatacgagtcactccag

SEQ ID NO: 4244 - DNA, 18 bp, Artificial Sequence
  Synthetic DNA
taatacgattccctgtag

SEQ ID NO: 4245 - DNA, 18 bp, Artificial Sequence
  Synthetic DNA
taatacgcctccttatag

SEQ ID NO: 4246 - DNA, 18 bp, Artificial Sequence
  Synthetic DNA
taatacggctcgttatag

SEQ ID NO: 4247 - DNA, 18 bp, Artificial Sequence
  Synthetic DNA
taatactagtcaccatag

SEQ ID NO: 4248 - DNA, 18 bp, Artificial Sequence
  Synthetic DNA
taatagaactcactatgg

SEQ ID NO: 4249 - DNA, 18 bp, Artificial Sequence
  Synthetic DNA
taataggactcacgttag

SEQ ID NO: 4250 - DNA, 18 bp, Artificial Sequence
  Synthetic DNA
taataggagtcaatatag

SEQ ID NO: 4251 - DNA, 18 bp, Artificial Sequence
  Synthetic DNA
taataggcctgactatag

SEQ ID NO: 4252 - DNA, 18 bp, Artificial Sequence
  Synthetic DNA
taatagggctcacaatag

SEQ ID NO: 4253 - DNA, 18 bp, Artificial Sequence
  Synthetic DNA
taatatgactcactagcg

SEQ ID NO: 4254 - DNA, 18 bp, Artificial Sequence
  Synthetic DNA
taatccgaatcactagag

SEQ ID NO: 4255 - DNA, 18 bp, Artificial Sequence
  Synthetic DNA
taatccgactaactacag

SEQ ID NO: 4256 - DNA, 18 bp, Artificial Sequence
  Synthetic DNA
taatccggctcactatgg

SEQ ID NO: 4257 - DNA, 18 bp, Artificial Sequence
  Synthetic DNA
taatccggctcactctag

SEQ ID NO: 4258 - DNA, 18 bp, Artificial Sequence
  Synthetic DNA
taatcctacgcactatag

SEQ ID NO: 4259 - DNA, 18 bp, Artificial Sequence
  Synthetic DNA
taatgcaaatcactatag

SEQ ID NO: 4260 - DNA, 18 bp, Artificial Sequence
  Synthetic DNA
taatgcgactcaatacag

SEQ ID NO: 4261 - DNA, 18 bp, Artificial Sequence
  Synthetic DNA
tacgacgactcgctatag

SEQ ID NO: 4262 - DNA, 18 bp, Artificial Sequence
  Synthetic DNA
tactaagactcactacag

SEQ ID NO: 4263 - DNA, 18 bp, Artificial Sequence
  Synthetic DNA
tactaagagtcactatag

SEQ ID NO: 4264 - DNA, 18 bp, Artificial Sequence
  Synthetic DNA
tactacggcgcactatag

SEQ ID NO: 4265 - DNA, 18 bp, Artificial Sequence
  Synthetic DNA
tactaggattcactatag

SEQ ID NO: 4266 - DNA, 18 bp, Artificial Sequence
  Synthetic DNA
tactatgactcagtatag

SEQ ID NO: 4267 - DNA, 18 bp, Artificial Sequence
  Synthetic DNA
tagtgccactcactatag

SEQ ID NO: 4268 - DNA, 18 bp, Artificial Sequence
  Synthetic DNA
tagtgcgacttactatag

SEQ ID NO: 4269 - DNA, 18 bp, Artificial Sequence
  Synthetic DNA
tattacgactcactaaaa

SEQ ID NO: 4270 - DNA, 18 bp, Artificial Sequence
  Synthetic DNA
tattacgactcagtagag

SEQ ID NO: 4271 - DNA, 18 bp, Artificial Sequence
  Synthetic DNA
tcataccactccctatag

SEQ ID NO: 4272 - DNA, 18 bp, Artificial Sequence
  Synthetic DNA
tcatacgacccagtatag

SEQ ID NO: 4273 - DNA, 18 bp, Artificial Sequence
  Synthetic DNA
tcatacgacgtactatag

SEQ ID NO: 4274 - DNA, 18 bp, Artificial Sequence
  Synthetic DNA
tcattcggctcactatag

SEQ ID NO: 4275 - DNA, 18 bp, Artificial Sequence
  Synthetic DNA
tcctacgactcgctatag

SEQ ID NO: 4276 - DNA, 18 bp, Artificial Sequence
  Synthetic DNA
taattcgactcactaatg

SEQ ID NO: 4277 - DNA, 18 bp, Artificial Sequence
  Synthetic DNA
taatacgactcacaaagg

SEQ ID NO: 4278 - DNA, 18 bp, Artificial Sequence
  Synthetic DNA
taaaacgactcactaagg

SEQ ID NO: 4279 - DNA, 18 bp, Artificial Sequence
  Synthetic DNA
taatacgtctcactttgg

SEQ ID NO: 4280 - DNA, 18 bp, Artificial Sequence
  Synthetic DNA
taatgcgtctcaatatag

SEQ ID NO: 4281 - DNA, 18 bp, Artificial Sequence
  Synthetic DNA
tagtacgacttaccatag

SEQ ID NO: 4282 - DNA, 18 bp, Artificial Sequence
  Synthetic DNA
taatacgactcacaccag

SEQ ID NO: 4283 - DNA, 18 bp, Artificial Sequence
  Synthetic DNA
taaaatgactcactaaag

SEQ ID NO: 4284 - DNA, 18 bp, Artificial Sequence
  Synthetic DNA
ttaaccgactcactatag

SEQ ID NO: 4285 - DNA, 18 bp, Artificial Sequence
  Synthetic DNA
taataccacacaccatag

SEQ ID NO: 4286 - DNA, 18 bp, Artificial Sequence
  Synthetic DNA
taataggtctcactatcg

SEQ ID NO: 4287 - DNA, 18 bp, Artificial Sequence
  Synthetic DNA
tcatacgactcactaacg

SEQ ID NO: 4288 - DNA, 18 bp, Artificial Sequence
  Synthetic DNA
tgatacgactcactgaag

SEQ ID NO: 4289 - DNA, 18 bp, Artificial Sequence
  Synthetic DNA
ttttacgactcacgatag

SEQ ID NO: 4290 - DNA, 18 bp, Artificial Sequence
  Synthetic DNA
taaaacgactcagaatag

SEQ ID NO: 4291 - DNA, 18 bp, Artificial Sequence
  Synthetic DNA
ttatacgactcactaatg

SEQ ID NO: 4292 - DNA, 18 bp, Artificial Sequence
  Synthetic DNA
taatacgactcacgtttg

SEQ ID NO: 4293 - DNA, 18 bp, Artificial Sequence
  Synthetic DNA
taatacgactcagcaaag

SEQ ID NO: 4294 - DNA, 18 bp, Artificial Sequence
  Synthetic DNA
taatatgacgcactattg

SEQ ID NO: 4295 - DNA, 18 bp, Artificial Sequence
  Synthetic DNA
taattcgaatcacgatag

SEQ ID NO: 4296 - DNA, 18 bp, Artificial Sequence
  Synthetic DNA
tcataggactcaccatag

SEQ ID NO: 4297 - DNA, 18 bp, Artificial Sequence
  Synthetic DNA
ttataccacccactatag

SEQ ID NO: 4298 - DNA, 18 bp, Artificial Sequence
  Synthetic DNA
taatacaacttacaatag

SEQ ID NO: 4299 - DNA, 18 bp, Artificial Sequence
  Synthetic DNA
aaatacgactcactttgg

SEQ ID NO: 4300 - DNA, 18 bp, Artificial Sequence
  Synthetic DNA
taatacgtaccactatag

SEQ ID NO: 4301 - DNA, 18 bp, Artificial Sequence
  Synthetic DNA
taataagactcacttaag

SEQ ID NO: 4302 - DNA, 18 bp, Artificial Sequence
  Synthetic DNA
taatagaactcactattg

SEQ ID NO: 4303 - DNA, 18 bp, Artificial Sequence
  Synthetic DNA
tattgcaactcactatag

SEQ ID NO: 4304 - DNA, 18 bp, Artificial Sequence
  Synthetic DNA
tattgcgactcattatag

SEQ ID NO: 4305 - DNA, 18 bp, Artificial Sequence
  Synthetic DNA
acatccgactcactatag

SEQ ID NO: 4306 - DNA, 18 bp, Artificial Sequence
  Synthetic DNA
cagtacgtctcactatag

SEQ ID NO: 4307 - DNA, 18 bp, Artificial Sequence
  Synthetic DNA
gaatacgactctcgatag

SEQ ID NO: 4308 - DNA, 18 bp, Artificial Sequence
  Synthetic DNA
taatacggctctccatag

SEQ ID NO: 4309 - DNA, 18 bp, Artificial Sequence
  Synthetic DNA
tagtacgactcacttcag

SEQ ID NO: 4310 - DNA, 18 bp, Artificial Sequence
  Synthetic DNA
tattacgactcggtatag

SEQ ID NO: 4311 - DNA, 18 bp, Artificial Sequence
  Synthetic DNA
tcacccgactcactatag

SEQ ID NO: 4312 - DNA, 18 bp, Artificial Sequence
  Synthetic DNA
ttatacgactaagtatag

SEQ ID NO: 4313 - DNA, 18 bp, Artificial Sequence
  Synthetic DNA
tataacgactcactattg

SEQ ID NO: 4314 - DNA, 18 bp, Artificial Sequence
  Synthetic DNA
ttatacgactctctatcg

SEQ ID NO: 4315 - DNA, 18 bp, Artificial Sequence
  Synthetic DNA
taatacaactcaatgtag

SEQ ID NO: 4316 - DNA, 18 bp, Artificial Sequence
  Synthetic DNA
taatacgtctcacgttag

SEQ ID NO: 4317 - DNA, 18 bp, Artificial Sequence
  Synthetic DNA
taaaacgactcactcaag

SEQ ID NO: 4318 - DNA, 18 bp, Artificial Sequence
  Synthetic DNA
taatacgcctcaccattg

SEQ ID NO: 4319 - DNA, 18 bp, Artificial Sequence
  Synthetic DNA
taatatgactcactccag

SEQ ID NO: 4320 - DNA, 18 bp, Artificial Sequence
  Synthetic DNA
ttaaacgactcactattg

SEQ ID NO: 4321 - DNA, 18 bp, Artificial Sequence
  Synthetic DNA
taattcgaatcaatatag

SEQ ID NO: 4322 - DNA, 18 bp, Artificial Sequence
  Synthetic DNA
taaaacgactccctaaag

SEQ ID NO: 4323 - DNA, 18 bp, Artificial Sequence
  Synthetic DNA
tattaggactcactattg

SEQ ID NO: 4324 - DNA, 18 bp, Artificial Sequence
  Synthetic DNA
tcaaacaactcactatag

SEQ ID NO: 4325 - DNA, 18 bp, Artificial Sequence
  Synthetic DNA
aaaagcgactcactatag

SEQ ID NO: 4326 - DNA, 18 bp, Artificial Sequence
  Synthetic DNA
aaatgcgtctcactatag

SEQ ID NO: 4327 - DNA, 18 bp, Artificial Sequence
  Synthetic DNA
taagacgactaactattg

SEQ ID NO: 4328 - DNA, 18 bp, Artificial Sequence
  Synthetic DNA
taatacagcacactatag

SEQ ID NO: 4329 - DNA, 18 bp, Artificial Sequence
  Synthetic DNA
taatacgacccactttcg

SEQ ID NO: 4330 - DNA, 18 bp, Artificial Sequence
  Synthetic DNA
ttgtaagactcactatag

SEQ ID NO: 4331 - DNA, 18 bp, Artificial Sequence
  Synthetic DNA
aaatacgactccttatag

SEQ ID NO: 4332 - DNA, 18 bp, Artificial Sequence
  Synthetic DNA
aaatacggctcactatcg

SEQ ID NO: 4333 - DNA, 18 bp, Artificial Sequence
  Synthetic DNA
aagtccgactcactatag

SEQ ID NO: 4334 - DNA, 18 bp, Artificial Sequence
  Synthetic DNA
caatacggcacactatag

SEQ ID NO: 4335 - DNA, 18 bp, Artificial Sequence
  Synthetic DNA
caatacggctcacgatag

SEQ ID NO: 4336 - DNA, 18 bp, Artificial Sequence
  Synthetic DNA
gactacgtctcactatag

SEQ ID NO: 4337 - DNA, 18 bp, Artificial Sequence
  Synthetic DNA
taaaacgacccactatgg

SEQ ID NO: 4338 - DNA, 18 bp, Artificial Sequence
  Synthetic DNA
taacacgagtcactattg

SEQ ID NO: 4339 - DNA, 18 bp, Artificial Sequence
  Synthetic DNA
taacacgccacactatag

SEQ ID NO: 4340 - DNA, 18 bp, Artificial Sequence
  Synthetic DNA
taacaggactcactctag

SEQ ID NO: 4341 - DNA, 18 bp, Artificial Sequence
  Synthetic DNA
taagacaactcattatag

SEQ ID NO: 4342 - DNA, 18 bp, Artificial Sequence
  Synthetic DNA
taagacgactatctatag

SEQ ID NO: 4343 - DNA, 18 bp, Artificial Sequence
  Synthetic DNA
taagacgactcacactag

SEQ ID NO: 4344 - DNA, 18 bp, Artificial Sequence
  Synthetic DNA
taataacactcagtatag

SEQ ID NO: 4345 - DNA, 18 bp, Artificial Sequence
  Synthetic DNA
taataagaatcagtatag

SEQ ID NO: 4346 - DNA, 18 bp, Artificial Sequence
  Synthetic DNA
taataagactccctctag

SEQ ID NO: 4347 - DNA, 18 bp, Artificial Sequence
  Synthetic DNA
taatacgacacgccatag

SEQ ID NO: 4348 - DNA, 18 bp, Artificial Sequence
  Synthetic DNA
taatacgactaagtatcg

SEQ ID NO: 4349 - DNA, 18 bp, Artificial Sequence
  Synthetic DNA
taatacgactccccatgg

SEQ ID NO: 4350 - DNA, 18 bp, Artificial Sequence
  Synthetic DNA
taatacggatgactatag

SEQ ID NO: 4351 - DNA, 18 bp, Artificial Sequence
  Synthetic DNA
taatactactcactaccg

SEQ ID NO: 4352 - DNA, 18 bp, Artificial Sequence
  Synthetic DNA
taatatgacacagtatag

SEQ ID NO: 4353 - DNA, 18 bp, Artificial Sequence
  Synthetic DNA
taatatgactccctacag

SEQ ID NO: 4354 - DNA, 18 bp, Artificial Sequence
  Synthetic DNA
taatgagactccctatag

SEQ ID NO: 4355 - DNA, 18 bp, Artificial Sequence
  Synthetic DNA
taatgcgactcactgcag

SEQ ID NO: 4356 - DNA, 18 bp, Artificial Sequence
  Synthetic DNA
tactacgactcgctatcg

SEQ ID NO: 4357 - DNA, 18 bp, Artificial Sequence
  Synthetic DNA
tactccgactccctatag

SEQ ID NO: 4358 - DNA, 18 bp, Artificial Sequence
  Synthetic DNA
tagtacggctcactctag

SEQ ID NO: 4359 - DNA, 18 bp, Artificial Sequence
  Synthetic DNA
tcatacaactcactctag

SEQ ID NO: 4360 - DNA, 18 bp, Artificial Sequence
  Synthetic DNA
tcatacgagtcactctag

SEQ ID NO: 4361 - DNA, 18 bp, Artificial Sequence
  Synthetic DNA
tgatccgactcactatgg

SEQ ID NO: 4362 - DNA, 18 bp, Artificial Sequence
  Synthetic DNA
taatacgactcaccaatg

SEQ ID NO: 4363 - DNA, 18 bp, Artificial Sequence
  Synthetic DNA
caatacgaatctctatag

SEQ ID NO: 4364 - DNA, 18 bp, Artificial Sequence
  Synthetic DNA
ttatacgtctcactttag

SEQ ID NO: 4365 - DNA, 18 bp, Artificial Sequence
  Synthetic DNA
tcttacgactcactaaag

SEQ ID NO: 4366 - DNA, 18 bp, Artificial Sequence
  Synthetic DNA
taatacaacttactacag

SEQ ID NO: 4367 - DNA, 18 bp, Artificial Sequence
  Synthetic DNA
taataggactctctctag

SEQ ID NO: 4368 - DNA, 18 bp, Artificial Sequence
  Synthetic DNA
aaatacgactcactgttg

SEQ ID NO: 4369 - DNA, 18 bp, Artificial Sequence
  Synthetic DNA
ttatacgtctcactctag

SEQ ID NO: 4370 - DNA, 18 bp, Artificial Sequence
  Synthetic DNA
taataagactcagtattg

SEQ ID NO: 4371 - DNA, 18 bp, Artificial Sequence
  Synthetic DNA
taatacgactcacttgtg

SEQ ID NO: 4372 - DNA, 18 bp, Artificial Sequence
  Synthetic DNA
taatgtgtctcactatag

SEQ ID NO: 4373 - DNA, 18 bp, Artificial Sequence
  Synthetic DNA
ttataagacccactatag

SEQ ID NO: 4374 - DNA, 18 bp, Artificial Sequence
  Synthetic DNA
ttatccaactcactatag

SEQ ID NO: 4375 - DNA, 18 bp, Artificial Sequence
  Synthetic DNA
caacacgactcacaatag

SEQ ID NO: 4376 - DNA, 18 bp, Artificial Sequence
  Synthetic DNA
gtatacaactcactatag

SEQ ID NO: 4377 - DNA, 18 bp, Artificial Sequence
  Synthetic DNA
taaaacaactcactagag

SEQ ID NO: 4378 - DNA, 18 bp, Artificial Sequence
  Synthetic DNA
taaaacgactcgctctag

SEQ ID NO: 4379 - DNA, 18 bp, Artificial Sequence
  Synthetic DNA
taataagactcacttgag

SEQ ID NO: 4380 - DNA, 18 bp, Artificial Sequence
  Synthetic DNA
taatacaactcagtacag

SEQ ID NO: 4381 - DNA, 18 bp, Artificial Sequence
  Synthetic DNA
taatacaactcgctatgg

SEQ ID NO: 4382 - DNA, 18 bp, Artificial Sequence
  Synthetic DNA
taatacgactcaaagtag

SEQ ID NO: 4383 - DNA, 18 bp, Artificial Sequence
  Synthetic DNA
tcataccacttactatag

SEQ ID NO: 4384 - DNA, 18 bp, Artificial Sequence
  Synthetic DNA
tattacaactcactacag

SEQ ID NO: 4385 - DNA, 18 bp, Artificial Sequence
  Synthetic DNA
taataggactcacaattg

SEQ ID NO: 4386 - DNA, 18 bp, Artificial Sequence
  Synthetic DNA
taatacgactctctccag

SEQ ID NO: 4387 - DNA, 18 bp, Artificial Sequence
  Synthetic DNA
taatatgactctctaaag

SEQ ID NO: 4388 - DNA, 18 bp, Artificial Sequence
  Synthetic DNA
aaatacgacacgctatag

SEQ ID NO: 4389 - DNA, 18 bp, Artificial Sequence
  Synthetic DNA
taatatgactcaatgtag

SEQ ID NO: 4390 - DNA, 18 bp, Artificial Sequence
  Synthetic DNA
taatatgactcactggag

SEQ ID NO: 4391 - DNA, 18 bp, Artificial Sequence
  Synthetic DNA
taatgcgacacactgtag

SEQ ID NO: 4392 - DNA, 18 bp, Artificial Sequence
  Synthetic DNA
tattacgcctcaccatag

SEQ ID NO: 4393 - DNA, 18 bp, Artificial Sequence
  Synthetic DNA
ttatacgactcactttgg

SEQ ID NO: 4394 - DNA, 18 bp, Artificial Sequence
  Synthetic DNA
aaatatgactcacgatag

SEQ ID NO: 4395 - DNA, 18 bp, Artificial Sequence
  Synthetic DNA
gaatacgactctctattg

SEQ ID NO: 4396 - DNA, 18 bp, Artificial Sequence
  Synthetic DNA
taatacaactcaatatcg

SEQ ID NO: 4397 - DNA, 18 bp, Artificial Sequence
  Synthetic DNA
tattagcactcactatag

SEQ ID NO: 4398 - DNA, 18 bp, Artificial Sequence
  Synthetic DNA
tgttacgactcagtatag

SEQ ID NO: 4399 - DNA, 18 bp, Artificial Sequence
  Synthetic DNA
taattcgactcaccttag

SEQ ID NO: 4400 - DNA, 18 bp, Artificial Sequence
  Synthetic DNA
taattcgactaactatcg

SEQ ID NO: 4401 - DNA, 18 bp, Artificial Sequence
  Synthetic DNA
tatttcgactcacgatag

SEQ ID NO: 4402 - DNA, 18 bp, Artificial Sequence
  Synthetic DNA
aaatacgactctcaatag

SEQ ID NO: 4403 - DNA, 18 bp, Artificial Sequence
  Synthetic DNA
agatacgactcactaaag

SEQ ID NO: 4404 - DNA, 18 bp, Artificial Sequence
  Synthetic DNA
taatacgattatctatag

SEQ ID NO: 4405 - DNA, 18 bp, Artificial Sequence
  Synthetic DNA
tactatgactctctatag

SEQ ID NO: 4406 - DNA, 18 bp, Artificial Sequence
  Synthetic DNA
ttatacgactcagtaaag

SEQ ID NO: 4407 - DNA, 18 bp, Artificial Sequence
  Synthetic DNA
tgatacgactcaatattg

SEQ ID NO: 4408 - DNA, 18 bp, Artificial Sequence
  Synthetic DNA
aaatacgactcccaatag

SEQ ID NO: 4409 - DNA, 18 bp, Artificial Sequence
  Synthetic DNA
aaatacgactgactattg

SEQ ID NO: 4410 - DNA, 18 bp, Artificial Sequence
  Synthetic DNA
taacatgtctcactatag

SEQ ID NO: 4411 - DNA, 18 bp, Artificial Sequence
  Synthetic DNA
taatacgacgcacttttg

SEQ ID NO: 4412 - DNA, 18 bp, Artificial Sequence
  Synthetic DNA
taatacgattcaagatag

SEQ ID NO: 4413 - DNA, 18 bp, Artificial Sequence
  Synthetic DNA
aaatacgactcactcgag

SEQ ID NO: 4414 - DNA, 18 bp, Artificial Sequence
  Synthetic DNA
taacgcgactcaatatag

SEQ ID NO: 4415 - DNA, 18 bp, Artificial Sequence
  Synthetic DNA
taatacaactcactgttg

SEQ ID NO: 4416 - DNA, 18 bp, Artificial Sequence
  Synthetic DNA
taatacgactccgtaaag

SEQ ID NO: 4417 - DNA, 18 bp, Artificial Sequence
  Synthetic DNA
taatacgacttaatatgg

SEQ ID NO: 4418 - DNA, 18 bp, Artificial Sequence
  Synthetic DNA
taatacgtgtcactctag

SEQ ID NO: 4419 - DNA, 18 bp, Artificial Sequence
  Synthetic DNA
taatactacccactgtag

SEQ ID NO: 4420 - DNA, 18 bp, Artificial Sequence
  Synthetic DNA
taatataactccctatag

SEQ ID NO: 4421 - DNA, 18 bp, Artificial Sequence
  Synthetic DNA
tgacacgactctctatag

SEQ ID NO: 4422 - DNA, 18 bp, Artificial Sequence
  Synthetic DNA
tgatacgccttactatag

SEQ ID NO: 4423 - DNA, 18 bp, Artificial Sequence
  Synthetic DNA
ttatgcgactcacgatag

SEQ ID NO: 4424 - DNA, 18 bp, Artificial Sequence
  Synthetic DNA
aattacgacgcactatag

SEQ ID NO: 4425 - DNA, 18 bp, Artificial Sequence
  Synthetic DNA
caatacgacaccctatag

SEQ ID NO: 4426 - DNA, 18 bp, Artificial Sequence
  Synthetic DNA
caatatgactcactctag

SEQ ID NO: 4427 - DNA, 18 bp, Artificial Sequence
  Synthetic DNA
caatcccactcactatag

SEQ ID NO: 4428 - DNA, 18 bp, Artificial Sequence
  Synthetic DNA
gaattcgactgactatag

SEQ ID NO: 4429 - DNA, 18 bp, Artificial Sequence
  Synthetic DNA
taacacgactcactgtcg

SEQ ID NO: 4430 - DNA, 18 bp, Artificial Sequence
  Synthetic DNA
taacacgagtcaatatag

SEQ ID NO: 4431 - DNA, 18 bp, Artificial Sequence
  Synthetic DNA
taagaagaatcactatag

SEQ ID NO: 4432 - DNA, 18 bp, Artificial Sequence
  Synthetic DNA
taataagactcacgattg

SEQ ID NO: 4433 - DNA, 18 bp, Artificial Sequence
  Synthetic DNA
taataagactcgttatag

SEQ ID NO: 4434 - DNA, 18 bp, Artificial Sequence
  Synthetic DNA
taataagattcacgatag

SEQ ID NO: 4435 - DNA, 18 bp, Artificial Sequence
  Synthetic DNA
taatacgaatcagtgtag

SEQ ID NO: 4436 - DNA, 18 bp, Artificial Sequence
  Synthetic DNA
taatacgactcagcttag

SEQ ID NO: 4437 - DNA, 18 bp, Artificial Sequence
  Synthetic DNA
taatacgactcgcttcag

SEQ ID NO: 4438 - DNA, 18 bp, Artificial Sequence
  Synthetic DNA
taatacgactctccgtag

SEQ ID NO: 4439 - DNA, 18 bp, Artificial Sequence
  Synthetic DNA
taatacgcgtctctatag

SEQ ID NO: 4440 - DNA, 18 bp, Artificial Sequence
  Synthetic DNA
taatacgtctcaatagag

SEQ ID NO: 4441 - DNA, 18 bp, Artificial Sequence
  Synthetic DNA
taatactacccagtatag

SEQ ID NO: 4442 - DNA, 18 bp, Artificial Sequence
  Synthetic DNA
taatagcactcgctatag

SEQ ID NO: 4443 - DNA, 18 bp, Artificial Sequence
  Synthetic DNA
taatccgactcgctttag

SEQ ID NO: 4444 - DNA, 18 bp, Artificial Sequence
  Synthetic DNA
taatgcgactcatcatag

SEQ ID NO: 4445 - DNA, 18 bp, Artificial Sequence
  Synthetic DNA
taatgcgactccctaaag

SEQ ID NO: 4446 - DNA, 18 bp, Artificial Sequence
  Synthetic DNA
taattccactcactacag

SEQ ID NO: 4447 - DNA, 18 bp, Artificial Sequence
  Synthetic DNA
taccacgactcactatgg

SEQ ID NO: 4448 - DNA, 18 bp, Artificial Sequence
  Synthetic DNA
tactacgacctactatag

SEQ ID NO: 4449 - DNA, 18 bp, Artificial Sequence
  Synthetic DNA
tactccgactctctatag

SEQ ID NO: 4450 - DNA, 18 bp, Artificial Sequence
  Synthetic DNA
tcatacgacccacaatag

SEQ ID NO: 4451 - DNA, 18 bp, Artificial Sequence
  Synthetic DNA
tcataggattcactatag

SEQ ID NO: 4452 - DNA, 18 bp, Artificial Sequence
  Synthetic DNA
tgctacgactcactttag

SEQ ID NO: 4453 - DNA, 18 bp, Artificial Sequence
  Synthetic DNA
caatacgactccccatag

SEQ ID NO: 4454 - DNA, 18 bp, Artificial Sequence
  Synthetic DNA
caatacgccccactatag

SEQ ID NO: 4455 - DNA, 18 bp, Artificial Sequence
  Synthetic DNA
caatacggcccactatag

SEQ ID NO: 4456 - DNA, 18 bp, Artificial Sequence
  Synthetic DNA
gaatacgactcacaatcg

SEQ ID NO: 4457 - DNA, 18 bp, Artificial Sequence
  Synthetic DNA
gaatacgactcattttag

SEQ ID NO: 4458 - DNA, 18 bp, Artificial Sequence
  Synthetic DNA
gaatacgacttcctatag

SEQ ID NO: 4459 - DNA, 18 bp, Artificial Sequence
  Synthetic DNA
gaatacgagtctctatag

SEQ ID NO: 4460 - DNA, 18 bp, Artificial Sequence
  Synthetic DNA
gaatacgtctcgctatag

SEQ ID NO: 4461 - DNA, 18 bp, Artificial Sequence
  Synthetic DNA
gaatactacccactatag

SEQ ID NO: 4462 - DNA, 18 bp, Artificial Sequence
  Synthetic DNA
gaatatgactcagtatag

SEQ ID NO: 4463 - DNA, 18 bp, Artificial Sequence
  Synthetic DNA
gaattcgacccactatag

SEQ ID NO: 4464 - DNA, 18 bp, Artificial Sequence
  Synthetic DNA
gaattcgactccctatag

SEQ ID NO: 4465 - DNA, 18 bp, Artificial Sequence
  Synthetic DNA
ggatacgaatcactatag

SEQ ID NO: 4466 - DNA, 18 bp, Artificial Sequence
  Synthetic DNA
taaaacgactcacgatcg

SEQ ID NO: 4467 - DNA, 18 bp, Artificial Sequence
  Synthetic DNA
taacccgactcgctatag

SEQ ID NO: 4468 - DNA, 18 bp, Artificial Sequence
  Synthetic DNA
taagacgcctcgctatag

SEQ ID NO: 4469 - DNA, 18 bp, Artificial Sequence
  Synthetic DNA
taagccgactcactaaag

SEQ ID NO: 4470 - DNA, 18 bp, Artificial Sequence
  Synthetic DNA
taataagactcattataa

SEQ ID NO: 4471 - DNA, 18 bp, Artificial Sequence
  Synthetic DNA
taataagactccctgtag

SEQ ID NO: 4472 - DNA, 18 bp, Artificial Sequence
  Synthetic DNA
taatacaagtcagtatag

SEQ ID NO: 4473 - DNA, 18 bp, Artificial Sequence
  Synthetic DNA
taataccactcactatta

SEQ ID NO: 4474 - DNA, 18 bp, Artificial Sequence
  Synthetic DNA
taatacgaaacactagag

SEQ ID NO: 4475 - DNA, 18 bp, Artificial Sequence
  Synthetic DNA
taatacgaatctctataa

SEQ ID NO: 4476 - DNA, 18 bp, Artificial Sequence
  Synthetic DNA
taatacgacccaccgtag

SEQ ID NO: 4477 - DNA, 18 bp, Artificial Sequence
  Synthetic DNA
taatacgactaagtgtag

SEQ ID NO: 4478 - DNA, 18 bp, Artificial Sequence
  Synthetic DNA
taatacgactaattacag

SEQ ID NO: 4479 - DNA, 18 bp, Artificial Sequence
  Synthetic DNA
taatacgactcaatggag

SEQ ID NO: 4480 - DNA, 18 bp, Artificial Sequence
  Synthetic DNA
taatacgactccgtacag

SEQ ID NO: 4481 - DNA, 18 bp, Artificial Sequence
  Synthetic DNA
taatacgactcggtctag

SEQ ID NO: 4482 - DNA, 18 bp, Artificial Sequence
  Synthetic DNA
taatacgacttgctatgg

SEQ ID NO: 4483 - DNA, 18 bp, Artificial Sequence
  Synthetic DNA
taatacgagtacctatag

SEQ ID NO: 4484 - DNA, 18 bp, Artificial Sequence
  Synthetic DNA
taatacgagttcctatag

SEQ ID NO: 4485 - DNA, 18 bp, Artificial Sequence
  Synthetic DNA
taatacgattcacggtag

SEQ ID NO: 4486 - DNA, 18 bp, Artificial Sequence
  Synthetic DNA
taatacgattcactatta

SEQ ID NO: 4487 - DNA, 18 bp, Artificial Sequence
  Synthetic DNA
taatacgattccctacag

SEQ ID NO: 4488 - DNA, 18 bp, Artificial Sequence
  Synthetic DNA
taatacgcctaactgtag

SEQ ID NO: 4489 - DNA, 18 bp, Artificial Sequence
  Synthetic DNA
taatacgcctgactacag

SEQ ID NO: 4490 - DNA, 18 bp, Artificial Sequence
  Synthetic DNA
taatacggctctctgtag

SEQ ID NO: 4491 - DNA, 18 bp, Artificial Sequence
  Synthetic DNA
taatacgtctcgcgatag

SEQ ID NO: 4492 - DNA, 18 bp, Artificial Sequence
  Synthetic DNA
taataggactaacgatag

SEQ ID NO: 4493 - DNA, 18 bp, Artificial Sequence
  Synthetic DNA
taataggagtcactatcg

SEQ ID NO: 4494 - DNA, 18 bp, Artificial Sequence
  Synthetic DNA
taatagtactcaatatag

SEQ ID NO: 4495 - DNA, 18 bp, Artificial Sequence
  Synthetic DNA
taatagtacttactatag

SEQ ID NO: 4496 - DNA, 18 bp, Artificial Sequence
  Synthetic DNA
taatatgactcaagatag

SEQ ID NO: 4497 - DNA, 18 bp, Artificial Sequence
  Synthetic DNA
taatatgactcagtgtag

SEQ ID NO: 4498 - DNA, 18 bp, Artificial Sequence
  Synthetic DNA
taatccgactcaatctag

SEQ ID NO: 4499 - DNA, 18 bp, Artificial Sequence
  Synthetic DNA
taatccgactcagtacag

SEQ ID NO: 4500 - DNA, 18 bp, Artificial Sequence
  Synthetic DNA
taatgcgactcgatatag

SEQ ID NO: 4501 - DNA, 18 bp, Artificial Sequence
  Synthetic DNA
taattcgactaacgatag

SEQ ID NO: 4502 - DNA, 18 bp, Artificial Sequence
  Synthetic DNA
taccaggactcactatag

SEQ ID NO: 4503 - DNA, 18 bp, Artificial Sequence
  Synthetic DNA
tacgaggactcactatag

SEQ ID NO: 4504 - DNA, 18 bp, Artificial Sequence
  Synthetic DNA
tactaaaactcactatag

SEQ ID NO: 4505 - DNA, 18 bp, Artificial Sequence
  Synthetic DNA
tactacgaatcactctag

SEQ ID NO: 4506 - DNA, 18 bp, Artificial Sequence
  Synthetic DNA
tactacgactgattatag

SEQ ID NO: 4507 - DNA, 18 bp, Artificial Sequence
  Synthetic DNA
tactactcctcactatag

SEQ ID NO: 4508 - DNA, 18 bp, Artificial Sequence
  Synthetic DNA
tatgaagactcactatag

SEQ ID NO: 4509 - DNA, 18 bp, Artificial Sequence
  Synthetic DNA
tattacggctcactagag

SEQ ID NO: 4510 - DNA, 18 bp, Artificial Sequence
  Synthetic DNA
tcacacgagtcactatag

SEQ ID NO: 4511 - DNA, 18 bp, Artificial Sequence
  Synthetic DNA
tcataccaatcactatag

SEQ ID NO: 4512 - DNA, 18 bp, Artificial Sequence
  Synthetic DNA
tcatacgactcactcgag

SEQ ID NO: 4513 - DNA, 18 bp, Artificial Sequence
  Synthetic DNA
tcatacgactccatatag

SEQ ID NO: 4514 - DNA, 18 bp, Artificial Sequence
  Synthetic DNA
tcatacgactcgatatag

SEQ ID NO: 4515 - DNA, 18 bp, Artificial Sequence
  Synthetic DNA
tcataggacccactatag

SEQ ID NO: 4516 - DNA, 18 bp, Artificial Sequence
  Synthetic DNA
tcatgcgactcaccatag

SEQ ID NO: 4517 - DNA, 18 bp, Artificial Sequence
  Synthetic DNA
tcatgcgactcactgtag

SEQ ID NO: 4518 - DNA, 18 bp, Artificial Sequence
  Synthetic DNA
tcttacgactcacgatag

SEQ ID NO: 4519 - DNA, 18 bp, Artificial Sequence
  Synthetic DNA
tgacacgactgactatag

SEQ ID NO: 4520 - DNA, 18 bp, Artificial Sequence
  Synthetic DNA
tgatacgactaactagag

SEQ ID NO: 4521 - DNA, 18 bp, Artificial Sequence
  Synthetic DNA
tgatacgcctcactctag

SEQ ID NO: 4522 - DNA, 18 bp, Artificial Sequence
  Synthetic DNA
ttataggactcacgatag

SEQ ID NO: 4523 - DNA, 18 bp, Artificial Sequence
  Synthetic DNA
atataagactcactatag

SEQ ID NO: 4524 - DNA, 18 bp, Artificial Sequence
  Synthetic DNA
aaatacgtctccctatag

SEQ ID NO: 4525 - DNA, 18 bp, Artificial Sequence
  Synthetic DNA
agttacgactcactatag

SEQ ID NO: 4526 - DNA, 18 bp, Artificial Sequence
  Synthetic DNA
taatacttctcactatcg

SEQ ID NO: 4527 - DNA, 18 bp, Artificial Sequence
  Synthetic DNA
aaaaacgactcactattg

SEQ ID NO: 4528 - DNA, 18 bp, Artificial Sequence
  Synthetic DNA
taatacgactcacagaag

SEQ ID NO: 4529 - DNA, 18 bp, Artificial Sequence
  Synthetic DNA
taatacgtgtcactttag

SEQ ID NO: 4530 - DNA, 18 bp, Artificial Sequence
  Synthetic DNA
taatgcgactctctaaag

SEQ ID NO: 4531 - DNA, 18 bp, Artificial Sequence
  Synthetic DNA
taatacgactcacaactg

SEQ ID NO: 4532 - DNA, 18 bp, Artificial Sequence
  Synthetic DNA
caaaatgactcactatag

SEQ ID NO: 4533 - DNA, 18 bp, Artificial Sequence
  Synthetic DNA
taatacgtctgactatcg

SEQ ID NO: 4534 - DNA, 18 bp, Artificial Sequence
  Synthetic DNA
taatcagactcactacag

SEQ ID NO: 4535 - DNA, 18 bp, Artificial Sequence
  Synthetic DNA
taatgcgactcaataaag

SEQ ID NO: 4536 - DNA, 18 bp, Artificial Sequence
  Synthetic DNA
ttatataactcactatag

SEQ ID NO: 4537 - DNA, 18 bp, Artificial Sequence
  Synthetic DNA
taattcgactccctattg

SEQ ID NO: 4538 - DNA, 18 bp, Artificial Sequence
  Synthetic DNA
aattacgactcactagag

SEQ ID NO: 4539 - DNA, 18 bp, Artificial Sequence
  Synthetic DNA
caatacgactcaccttag

SEQ ID NO: 4540 - DNA, 18 bp, Artificial Sequence
  Synthetic DNA
taactcgactcactatcg

SEQ ID NO: 4541 - DNA, 18 bp, Artificial Sequence
  Synthetic DNA
taatacgacccaatacag

SEQ ID NO: 4542 - DNA, 18 bp, Artificial Sequence
  Synthetic DNA
taaaaagactcactattg

SEQ ID NO: 4543 - DNA, 18 bp, Artificial Sequence
  Synthetic DNA
taatacgtctcactaacg

SEQ ID NO: 4544 - DNA, 18 bp, Artificial Sequence
  Synthetic DNA
taatatgactcagtttag

SEQ ID NO: 4545 - DNA, 18 bp, Artificial Sequence
  Synthetic DNA
taattccaatcactatag

SEQ ID NO: 4546 - DNA, 18 bp, Artificial Sequence
  Synthetic DNA
tgttacgactcaccatag

SEQ ID NO: 4547 - DNA, 18 bp, Artificial Sequence
  Synthetic DNA
caatacgcgtcactatag

SEQ ID NO: 4548 - DNA, 18 bp, Artificial Sequence
  Synthetic DNA
taacacaattcactatag

SEQ ID NO: 4549 - DNA, 18 bp, Artificial Sequence
  Synthetic DNA
taatactcctcaatatag

SEQ ID NO: 4550 - DNA, 18 bp, Artificial Sequence
  Synthetic DNA
taatgggactctctatag

SEQ ID NO: 4551 - DNA, 18 bp, Artificial Sequence
  Synthetic DNA
taattcgacccaccatag

SEQ ID NO: 4552 - DNA, 18 bp, Artificial Sequence
  Synthetic DNA
taattcgactgactctag

SEQ ID NO: 4553 - DNA, 18 bp, Artificial Sequence
  Synthetic DNA
taattcgagtcaatatag

SEQ ID NO: 4554 - DNA, 18 bp, Artificial Sequence
  Synthetic DNA
tattacgcctcactgtag

SEQ ID NO: 4555 - DNA, 18 bp, Artificial Sequence
  Synthetic DNA
tgatacgactcgctaaag

SEQ ID NO: 4556 - DNA, 18 bp, Artificial Sequence
  Synthetic DNA
ttttacgactcactaaag

SEQ ID NO: 4557 - DNA, 18 bp, Artificial Sequence
  Synthetic DNA
tgaaacgactcactaaag

SEQ ID NO: 4558 - DNA, 18 bp, Artificial Sequence
  Synthetic DNA
ttatgcgacacactatag

SEQ ID NO: 4559 - DNA, 18 bp, Artificial Sequence
  Synthetic DNA
taatacgacacacaagag

SEQ ID NO: 4560 - DNA, 18 bp, Artificial Sequence
  Synthetic DNA
taatacgactcgctttgg

SEQ ID NO: 4561 - DNA, 18 bp, Artificial Sequence
  Synthetic DNA
tagtactactcaatatag

SEQ ID NO: 4562 - DNA, 18 bp, Artificial Sequence
  Synthetic DNA
tgatacgtctcactatcg

SEQ ID NO: 4563 - DNA, 18 bp, Artificial Sequence
  Synthetic DNA
tcatgcgactcactattg

SEQ ID NO: 4564 - DNA, 18 bp, Artificial Sequence
  Synthetic DNA
ttataggactctctatag

SEQ ID NO: 4565 - DNA, 18 bp, Artificial Sequence
  Synthetic DNA
taatccgtctcactctag

SEQ ID NO: 4566 - DNA, 18 bp, Artificial Sequence
  Synthetic DNA
caattcgactcacaatag

SEQ ID NO: 4567 - DNA, 18 bp, Artificial Sequence
  Synthetic DNA
tgttacgactcactaaag

SEQ ID NO: 4568 - DNA, 18 bp, Artificial Sequence
  Synthetic DNA
taactcgactcactaaag

SEQ ID NO: 4569 - DNA, 18 bp, Artificial Sequence
  Synthetic DNA
taatacgattcaacatag

SEQ ID NO: 4570 - DNA, 18 bp, Artificial Sequence
  Synthetic DNA
taatatgactcgctttag

SEQ ID NO: 4571 - DNA, 18 bp, Artificial Sequence
  Synthetic DNA
tagtacgactcacaattg

SEQ ID NO: 4572 - DNA, 18 bp, Artificial Sequence
  Synthetic DNA
taaaacgactgcctatag

SEQ ID NO: 4573 - DNA, 18 bp, Artificial Sequence
  Synthetic DNA
taatacgactcacagtcg

SEQ ID NO: 4574 - DNA, 18 bp, Artificial Sequence
  Synthetic DNA
taataggtctcactttag

SEQ ID NO: 4575 - DNA, 18 bp, Artificial Sequence
  Synthetic DNA
taatccgactctctatcg

SEQ ID NO: 4576 - DNA, 18 bp, Artificial Sequence
  Synthetic DNA
tactacgactcaccattg

SEQ ID NO: 4577 - DNA, 18 bp, Artificial Sequence
  Synthetic DNA
tagaactactcactatag

SEQ ID NO: 4578 - DNA, 18 bp, Artificial Sequence
  Synthetic DNA
tcatacgcctctctatag

SEQ ID NO: 4579 - DNA, 18 bp, Artificial Sequence
  Synthetic DNA
tgatacaactccctatag

SEQ ID NO: 4580 - DNA, 18 bp, Artificial Sequence
  Synthetic DNA
caatacgactcactagtg

SEQ ID NO: 4581 - DNA, 18 bp, Artificial Sequence
  Synthetic DNA
caatacgattcactctag

SEQ ID NO: 4582 - DNA, 18 bp, Artificial Sequence
  Synthetic DNA
taaaacgactcagtacag

SEQ ID NO: 4583 - DNA, 18 bp, Artificial Sequence
  Synthetic DNA
taacacgagtaactatag

SEQ ID NO: 4584 - DNA, 18 bp, Artificial Sequence
  Synthetic DNA
taataagacccaatatag

SEQ ID NO: 4585 - DNA, 18 bp, Artificial Sequence
  Synthetic DNA
taatacgaccaagtatag

SEQ ID NO: 4586 - DNA, 18 bp, Artificial Sequence
  Synthetic DNA
taatacgacgctctatgg

SEQ ID NO: 4587 - DNA, 18 bp, Artificial Sequence
  Synthetic DNA
taatacgactccctgaag

SEQ ID NO: 4588 - DNA, 18 bp, Artificial Sequence
  Synthetic DNA
taatacgactcgttatgg

SEQ ID NO: 4589 - DNA, 18 bp, Artificial Sequence
  Synthetic DNA
taatacgtgtcactatcg

SEQ ID NO: 4590 - DNA, 18 bp, Artificial Sequence
  Synthetic DNA
taatactactcgctacag

SEQ ID NO: 4591 - DNA, 18 bp, Artificial Sequence
  Synthetic DNA
taatagcacgcactatag

SEQ ID NO: 4592 - DNA, 18 bp, Artificial Sequence
  Synthetic DNA
taatagggctcactctag

SEQ ID NO: 4593 - DNA, 18 bp, Artificial Sequence
  Synthetic DNA
taatatagctcactatag

SEQ ID NO: 4594 - DNA, 18 bp, Artificial Sequence
  Synthetic DNA
taatattactcactagag

SEQ ID NO: 4595 - DNA, 18 bp, Artificial Sequence
  Synthetic DNA
taatccgactcaccacag

SEQ ID NO: 4596 - DNA, 18 bp, Artificial Sequence
  Synthetic DNA
taatccgattcagtatag

SEQ ID NO: 4597 - DNA, 18 bp, Artificial Sequence
  Synthetic DNA
taatgtgactcactatcg

SEQ ID NO: 4598 - DNA, 18 bp, Artificial Sequence
  Synthetic DNA
tactacaactcactgtag

SEQ ID NO: 4599 - DNA, 18 bp, Artificial Sequence
  Synthetic DNA
tactactactccctatag

SEQ ID NO: 4600 - DNA, 18 bp, Artificial Sequence
  Synthetic DNA
tagtgcgactcacaatag

SEQ ID NO: 4601 - DNA, 18 bp, Artificial Sequence
  Synthetic DNA
tatgactactcactatag

SEQ ID NO: 4602 - DNA, 18 bp, Artificial Sequence
  Synthetic DNA
tcataccactcactatgg

SEQ ID NO: 4603 - DNA, 18 bp, Artificial Sequence
  Synthetic DNA
tcatacgacttagtatag

SEQ ID NO: 4604 - DNA, 18 bp, Artificial Sequence
  Synthetic DNA
tgataccactcagtatag

SEQ ID NO: 4605 - DNA, 18 bp, Artificial Sequence
  Synthetic DNA
tgataggtctcactatag

SEQ ID NO: 4606 - DNA, 18 bp, Artificial Sequence
  Synthetic DNA
cattacgactcactaaag

SEQ ID NO: 4607 - DNA, 18 bp, Artificial Sequence
  Synthetic DNA
taatacgactctataaag

SEQ ID NO: 4608 - DNA, 18 bp, Artificial Sequence
  Synthetic DNA
taatttgtctcactatag

SEQ ID NO: 4609 - DNA, 18 bp, Artificial Sequence
  Synthetic DNA
taattggactctctatag

SEQ ID NO: 4610 - DNA, 18 bp, Artificial Sequence
  Synthetic DNA
gcatacgactcactattg

SEQ ID NO: 4611 - DNA, 18 bp, Artificial Sequence
  Synthetic DNA
taatccgacacactattg

SEQ ID NO: 4612 - DNA, 18 bp, Artificial Sequence
  Synthetic DNA
caatacaactcactttag

SEQ ID NO: 4613 - DNA, 18 bp, Artificial Sequence
  Synthetic DNA
aaatacgtctcactttag

SEQ ID NO: 4614 - DNA, 18 bp, Artificial Sequence
  Synthetic DNA
ttacaagactcactatag

SEQ ID NO: 4615 - DNA, 18 bp, Artificial Sequence
  Synthetic DNA
ttatccgactcactttag

SEQ ID NO: 4616 - DNA, 18 bp, Artificial Sequence
  Synthetic DNA
aaatacaactcaatatag

SEQ ID NO: 4617 - DNA, 18 bp, Artificial Sequence
  Synthetic DNA
caatacaactcactatcg

SEQ ID NO: 4618 - DNA, 18 bp, Artificial Sequence
  Synthetic DNA
caatacgacctactatag

SEQ ID NO: 4619 - DNA, 18 bp, Artificial Sequence
  Synthetic DNA
taacacgtctcactctag

SEQ ID NO: 4620 - DNA, 18 bp, Artificial Sequence
  Synthetic DNA
taatacgactcagaacag

SEQ ID NO: 4621 - DNA, 18 bp, Artificial Sequence
  Synthetic DNA
taatacgtcgcactattg

SEQ ID NO: 4622 - DNA, 18 bp, Artificial Sequence
  Synthetic DNA
taatactactcaccacag

SEQ ID NO: 4623 - DNA, 18 bp, Artificial Sequence
  Synthetic DNA
taatactagtcactacag

SEQ ID NO: 4624 - DNA, 18 bp, Artificial Sequence
  Synthetic DNA
taatactattccctatag

SEQ ID NO: 4625 - DNA, 18 bp, Artificial Sequence
  Synthetic DNA
taatatgacttcctatag

SEQ ID NO: 4626 - DNA, 18 bp, Artificial Sequence
  Synthetic DNA
taattcgactcactgtgg

SEQ ID NO: 4627 - DNA, 18 bp, Artificial Sequence
  Synthetic DNA
tacaacgactcactacag

SEQ ID NO: 4628 - DNA, 18 bp, Artificial Sequence
  Synthetic DNA
tacttcggctcactatag

SEQ ID NO: 4629 - DNA, 18 bp, Artificial Sequence
  Synthetic DNA
tagtccaactcactatag

SEQ ID NO: 4630 - DNA, 18 bp, Artificial Sequence
  Synthetic DNA
ttacgcgactcactatag

SEQ ID NO: 4631 - DNA, 18 bp, Artificial Sequence
  Synthetic DNA
taaaacgtctcaccatag

SEQ ID NO: 4632 - DNA, 18 bp, Artificial Sequence
  Synthetic DNA
ttatacaactcactgtag

SEQ ID NO: 4633 - DNA, 18 bp, Artificial Sequence
  Synthetic DNA
taattcgactcactttcg

SEQ ID NO: 4634 - DNA, 18 bp, Artificial Sequence
  Synthetic DNA
taatacgactctctaagg

SEQ ID NO: 4635 - DNA, 18 bp, Artificial Sequence
  Synthetic DNA
aaatacgactcactgaag

SEQ ID NO: 4636 - DNA, 18 bp, Artificial Sequence
  Synthetic DNA
taatacgactcacccttg

SEQ ID NO: 4637 - DNA, 18 bp, Artificial Sequence
  Synthetic DNA
taatacggccctctatag

SEQ ID NO: 4638 - DNA, 18 bp, Artificial Sequence
  Synthetic DNA
taatatgcctcaatatag

SEQ ID NO: 4639 - DNA, 18 bp, Artificial Sequence
  Synthetic DNA
taattcgacttactatgg

SEQ ID NO: 4640 - DNA, 18 bp, Artificial Sequence
  Synthetic DNA
tattccgactcacgatag

SEQ ID NO: 4641 - DNA, 18 bp, Artificial Sequence
  Synthetic DNA
ttatacgtctcaccatag

SEQ ID NO: 4642 - DNA, 18 bp, Artificial Sequence
  Synthetic DNA
aaatacaactcactatcg

SEQ ID NO: 4643 - DNA, 18 bp, Artificial Sequence
  Synthetic DNA
caatacgacttcctatag

SEQ ID NO: 4644 - DNA, 18 bp, Artificial Sequence
  Synthetic DNA
taatactactcactctcg

SEQ ID NO: 4645 - DNA, 18 bp, Artificial Sequence
  Synthetic DNA
taataggactatctatag

SEQ ID NO: 4646 - DNA, 18 bp, Artificial Sequence
  Synthetic DNA
taatgcgactctctacag

SEQ ID NO: 4647 - DNA, 18 bp, Artificial Sequence
  Synthetic DNA
taatccgactctctaaag

SEQ ID NO: 4648 - DNA, 18 bp, Artificial Sequence
  Synthetic DNA
tattacgtctcactacag

SEQ ID NO: 4649 - DNA, 18 bp, Artificial Sequence
  Synthetic DNA
tgatacgactcacttttg

SEQ ID NO: 4650 - DNA, 18 bp, Artificial Sequence
  Synthetic DNA
ttataagactcactaaag

SEQ ID NO: 4651 - DNA, 18 bp, Artificial Sequence
  Synthetic DNA
aaatacgtctcgctatag

SEQ ID NO: 4652 - DNA, 18 bp, Artificial Sequence
  Synthetic DNA
tattacgtctcactattg

SEQ ID NO: 4653 - DNA, 18 bp, Artificial Sequence
  Synthetic DNA
taatacgactcacacttg

SEQ ID NO: 4654 - DNA, 18 bp, Artificial Sequence
  Synthetic DNA
ttatacgactcacaacag

SEQ ID NO: 4655 - DNA, 18 bp, Artificial Sequence
  Synthetic DNA
caattcgactcactttag

SEQ ID NO: 4656 - DNA, 18 bp, Artificial Sequence
  Synthetic DNA
ttaaacgactcaccatag

SEQ ID NO: 4657 - DNA, 18 bp, Artificial Sequence
  Synthetic DNA
taatatgattcactatcg

SEQ ID NO: 4658 - DNA, 18 bp, Artificial Sequence
  Synthetic DNA
taatccgactcacaatcg

SEQ ID NO: 4659 - DNA, 18 bp, Artificial Sequence
  Synthetic DNA
aaatgccactcactatag

SEQ ID NO: 4660 - DNA, 18 bp, Artificial Sequence
  Synthetic DNA
caacatgactcactatag

SEQ ID NO: 4661 - DNA, 18 bp, Artificial Sequence
  Synthetic DNA
caatacgactaactatcg

SEQ ID NO: 4662 - DNA, 18 bp, Artificial Sequence
  Synthetic DNA
taaaacgcctcactctag

SEQ ID NO: 4663 - DNA, 18 bp, Artificial Sequence
  Synthetic DNA
taatacgaatcactccag

SEQ ID NO: 4664 - DNA, 18 bp, Artificial Sequence
  Synthetic DNA
taatacgacttactaagg

SEQ ID NO: 4665 - DNA, 18 bp, Artificial Sequence
  Synthetic DNA
taatacgacttactaccg

SEQ ID NO: 4666 - DNA, 18 bp, Artificial Sequence
  Synthetic DNA
taatatgactccccatag

SEQ ID NO: 4667 - DNA, 18 bp, Artificial Sequence
  Synthetic DNA
tactacgtcccactatag

SEQ ID NO: 4668 - DNA, 18 bp, Artificial Sequence
  Synthetic DNA
tagtacgacttactctag

SEQ ID NO: 4669 - DNA, 18 bp, Artificial Sequence
  Synthetic DNA
tcatacgatccactatag

SEQ ID NO: 4670 - DNA, 18 bp, Artificial Sequence
  Synthetic DNA
ttacacgacccactatag

SEQ ID NO: 4671 - DNA, 18 bp, Artificial Sequence
  Synthetic DNA
taaaacgtctcagtatag

SEQ ID NO: 4672 - DNA, 18 bp, Artificial Sequence
  Synthetic DNA
tattaagactcaatatag

SEQ ID NO: 4673 - DNA, 18 bp, Artificial Sequence
  Synthetic DNA
tattaggactcacaatag

SEQ ID NO: 4674 - DNA, 18 bp, Artificial Sequence
  Synthetic DNA
tgaaacgtctcactatag

SEQ ID NO: 4675 - DNA, 18 bp, Artificial Sequence
  Synthetic DNA
tcattagactcactatag

SEQ ID NO: 4676 - DNA, 18 bp, Artificial Sequence
  Synthetic DNA
ttatatgactcgctatag

SEQ ID NO: 4677 - DNA, 18 bp, Artificial Sequence
  Synthetic DNA
taatacaacttactctag

SEQ ID NO: 4678 - DNA, 18 bp, Artificial Sequence
  Synthetic DNA
taatacaagacactatag

SEQ ID NO: 4679 - DNA, 18 bp, Artificial Sequence
  Synthetic DNA
taatacggctcactgttg

SEQ ID NO: 4680 - DNA, 18 bp, Artificial Sequence
  Synthetic DNA
taatgcgtctaactatag

SEQ ID NO: 4681 - DNA, 18 bp, Artificial Sequence
  Synthetic DNA
ttatactactcactagag

SEQ ID NO: 4682 - DNA, 18 bp, Artificial Sequence
  Synthetic DNA
aaataccactcaatatag

SEQ ID NO: 4683 - DNA, 18 bp, Artificial Sequence
  Synthetic DNA
caatacaactcactgtag

SEQ ID NO: 4684 - DNA, 18 bp, Artificial Sequence
  Synthetic DNA
taatactacttaccatag

SEQ ID NO: 4685 - DNA, 18 bp, Artificial Sequence
  Synthetic DNA
taataggactctctagag

SEQ ID NO: 4686 - DNA, 18 bp, Artificial Sequence
  Synthetic DNA
taatcagactcaatatag

SEQ ID NO: 4687 - DNA, 18 bp, Artificial Sequence
  Synthetic DNA
aaatacgaatcactagag

SEQ ID NO: 4688 - DNA, 18 bp, Artificial Sequence
  Synthetic DNA
caaaacgactcaccatag

SEQ ID NO: 4689 - DNA, 18 bp, Artificial Sequence
  Synthetic DNA
gaatacaactcactaaag

SEQ ID NO: 4690 - DNA, 18 bp, Artificial Sequence
  Synthetic DNA
taacccgaatcactatag

SEQ ID NO: 4691 - DNA, 18 bp, Artificial Sequence
  Synthetic DNA
taagaagactcactttag

SEQ ID NO: 4692 - DNA, 18 bp, Artificial Sequence
  Synthetic DNA
taatacgaatcaacatag

SEQ ID NO: 4693 - DNA, 18 bp, Artificial Sequence
  Synthetic DNA
taatacgactcacagtgg

SEQ ID NO: 4694 - DNA, 18 bp, Artificial Sequence
  Synthetic DNA
taatacgactcagtcaag

SEQ ID NO: 4695 - DNA, 18 bp, Artificial Sequence
  Synthetic DNA
taatacgactccttctag

SEQ ID NO: 4696 - DNA, 18 bp, Artificial Sequence
  Synthetic DNA
taatacgccccacaatag

SEQ ID NO: 4697 - DNA, 18 bp, Artificial Sequence
  Synthetic DNA
taatacggctcacaatgg

SEQ ID NO: 4698 - DNA, 18 bp, Artificial Sequence
  Synthetic DNA
taatacggcttagtatag

SEQ ID NO: 4699 - DNA, 18 bp, Artificial Sequence
  Synthetic DNA
taatactaatcacgatag

SEQ ID NO: 4700 - DNA, 18 bp, Artificial Sequence
  Synthetic DNA
taataggtctcactagag

SEQ ID NO: 4701 - DNA, 18 bp, Artificial Sequence
  Synthetic DNA
taatccgacccactgtag

SEQ ID NO: 4702 - DNA, 18 bp, Artificial Sequence
  Synthetic DNA
taatccgactgcctatag

SEQ ID NO: 4703 - DNA, 18 bp, Artificial Sequence
  Synthetic DNA
taatccgatgcactatag

SEQ ID NO: 4704 - DNA, 18 bp, Artificial Sequence
  Synthetic DNA
taatgcgactcagtattg

SEQ ID NO: 4705 - DNA, 18 bp, Artificial Sequence
  Synthetic DNA
tacaacgagtcactatag

SEQ ID NO: 4706 - DNA, 18 bp, Artificial Sequence
  Synthetic DNA
tactacgactcgctctag

SEQ ID NO: 4707 - DNA, 18 bp, Artificial Sequence
  Synthetic DNA
tattactacgcactatag

SEQ ID NO: 4708 - DNA, 18 bp, Artificial Sequence
  Synthetic DNA
tcacatgactcactatag

SEQ ID NO: 4709 - DNA, 18 bp, Artificial Sequence
  Synthetic DNA
tcatacgactccctgtag

SEQ ID NO: 4710 - DNA, 18 bp, Artificial Sequence
  Synthetic DNA
ttacacgacgcactatag

SEQ ID NO: 4711 - DNA, 18 bp, Artificial Sequence
  Synthetic DNA
ttatatgactcacgatag

SEQ ID NO: 4712 - DNA, 18 bp, Artificial Sequence
  Synthetic DNA
aaatgggactcactatag

SEQ ID NO: 4713 - DNA, 18 bp, Artificial Sequence
  Synthetic DNA
aactacgagtcactatag

SEQ ID NO: 4714 - DNA, 18 bp, Artificial Sequence
  Synthetic DNA
aactaggactcactatag

SEQ ID NO: 4715 - DNA, 18 bp, Artificial Sequence
  Synthetic DNA
caatacgactcacgttag

SEQ ID NO: 4716 - DNA, 18 bp, Artificial Sequence
  Synthetic DNA
caatacgactgactgtag

SEQ ID NO: 4717 - DNA, 18 bp, Artificial Sequence
  Synthetic DNA
caatacgacttactatcg

SEQ ID NO: 4718 - DNA, 18 bp, Artificial Sequence
  Synthetic DNA
caatacgcctcactacag

SEQ ID NO: 4719 - DNA, 18 bp, Artificial Sequence
  Synthetic DNA
caatccgcctcactatag

SEQ ID NO: 4720 - DNA, 18 bp, Artificial Sequence
  Synthetic DNA
cagtaagactcactatag

SEQ ID NO: 4721 - DNA, 18 bp, Artificial Sequence
  Synthetic DNA
gaagaagactcactatag

SEQ ID NO: 4722 - DNA, 18 bp, Artificial Sequence
  Synthetic DNA
gaataaaactcactatag

SEQ ID NO: 4723 - DNA, 18 bp, Artificial Sequence
  Synthetic DNA
gaatacgactcacaacag

SEQ ID NO: 4724 - DNA, 18 bp, Artificial Sequence
  Synthetic DNA
gaatacgactcattacag

SEQ ID NO: 4725 - DNA, 18 bp, Artificial Sequence
  Synthetic DNA
gaatatgacttactatag

SEQ ID NO: 4726 - DNA, 18 bp, Artificial Sequence
  Synthetic DNA
gactacgaatcactatag

SEQ ID NO: 4727 - DNA, 18 bp, Artificial Sequence
  Synthetic DNA
gagtacgacgcactatag

SEQ ID NO: 4728 - DNA, 18 bp, Artificial Sequence
  Synthetic DNA
gtatacgactcactatgg

SEQ ID NO: 4729 - DNA, 18 bp, Artificial Sequence
  Synthetic DNA
taaaacgagtcactatcg

SEQ ID NO: 4730 - DNA, 18 bp, Artificial Sequence
  Synthetic DNA
taaatcgactcactagag

SEQ ID NO: 4731 - DNA, 18 bp, Artificial Sequence
  Synthetic DNA
taacacgacgaactatag

SEQ ID NO: 4732 - DNA, 18 bp, Artificial Sequence
  Synthetic DNA
taacacgccgcactatag

SEQ ID NO: 4733 - DNA, 18 bp, Artificial Sequence
  Synthetic DNA
taacaggactcactgtag

SEQ ID NO: 4734 - DNA, 18 bp, Artificial Sequence
  Synthetic DNA
taacaggagtcactatag

SEQ ID NO: 4735 - DNA, 18 bp, Artificial Sequence
  Synthetic DNA
taacatgactcactatcg

SEQ ID NO: 4736 - DNA, 18 bp, Artificial Sequence
  Synthetic DNA
taagacgactctctatcg

SEQ ID NO: 4737 - DNA, 18 bp, Artificial Sequence
  Synthetic DNA
taataagactcactagcg

SEQ ID NO: 4738 - DNA, 18 bp, Artificial Sequence
  Synthetic DNA
taataagactgactagag

SEQ ID NO: 4739 - DNA, 18 bp, Artificial Sequence
  Synthetic DNA
taataagactgagtatag

SEQ ID NO: 4740 - DNA, 18 bp, Artificial Sequence
  Synthetic DNA
taatacaacggactatag

SEQ ID NO: 4741 - DNA, 18 bp, Artificial Sequence
  Synthetic DNA
taatacaactcacgacag

SEQ ID NO: 4742 - DNA, 18 bp, Artificial Sequence
  Synthetic DNA
taatacaactgagtatag

SEQ ID NO: 4743 - DNA, 18 bp, Artificial Sequence
  Synthetic DNA
taataccactcgctacag

SEQ ID NO: 4744 - DNA, 18 bp, Artificial Sequence
  Synthetic DNA
taataccacttagtatag

SEQ ID NO: 4745 - DNA, 18 bp, Artificial Sequence
  Synthetic DNA
taatacgaatcactagcg

SEQ ID NO: 4746 - DNA, 18 bp, Artificial Sequence
  Synthetic DNA
taatacgaatccctgtag

SEQ ID NO: 4747 - DNA, 18 bp, Artificial Sequence
  Synthetic DNA
taatacgacactctataa

SEQ ID NO: 4748 - DNA, 18 bp, Artificial Sequence
  Synthetic DNA
taatacgacgcaacatag

SEQ ID NO: 4749 - DNA, 18 bp, Artificial Sequence
  Synthetic DNA
taatacgacgcacgattg

SEQ ID NO: 4750 - DNA, 18 bp, Artificial Sequence
  Synthetic DNA
taatacgactcagtaggg

SEQ ID NO: 4751 - DNA, 18 bp, Artificial Sequence
  Synthetic DNA
taatacgactcccttcag

SEQ ID NO: 4752 - DNA, 18 bp, Artificial Sequence
  Synthetic DNA
taatacgactctgtgtag

SEQ ID NO: 4753 - DNA, 18 bp, Artificial Sequence
  Synthetic DNA
taatacgactgactcttg

SEQ ID NO: 4754 - DNA, 18 bp, Artificial Sequence
  Synthetic DNA
taatacgactgattagag

SEQ ID NO: 4755 - DNA, 18 bp, Artificial Sequence
  Synthetic DNA
taatacgacttactaggg

SEQ ID NO: 4756 - DNA, 18 bp, Artificial Sequence
  Synthetic DNA
taatacgagccgctatag

SEQ ID NO: 4757 - DNA, 18 bp, Artificial Sequence
  Synthetic DNA
taatacgagtcagtatgg

SEQ ID NO: 4758 - DNA, 18 bp, Artificial Sequence
  Synthetic DNA
taatacgcctccctacag

SEQ ID NO: 4759 - DNA, 18 bp, Artificial Sequence
  Synthetic DNA
taatacggcccactatcg

SEQ ID NO: 4760 - DNA, 18 bp, Artificial Sequence
  Synthetic DNA
taatacggctcacaagag

SEQ ID NO: 4761 - DNA, 18 bp, Artificial Sequence
  Synthetic DNA
taatacggctcagtattg

SEQ ID NO: 4762 - DNA, 18 bp, Artificial Sequence
  Synthetic DNA
taatacggctgactatgg

SEQ ID NO: 4763 - DNA, 18 bp, Artificial Sequence
  Synthetic DNA
taatactactcactgtac

SEQ ID NO: 4764 - DNA, 18 bp, Artificial Sequence
  Synthetic DNA
taatactcctcactagag

SEQ ID NO: 4765 - DNA, 18 bp, Artificial Sequence
  Synthetic DNA
taatagtactcactagag

SEQ ID NO: 4766 - DNA, 18 bp, Artificial Sequence
  Synthetic DNA
taatatgactcacgacag

SEQ ID NO: 4767 - DNA, 18 bp, Artificial Sequence
  Synthetic DNA
taatccgacgcactatcg

SEQ ID NO: 4768 - DNA, 18 bp, Artificial Sequence
  Synthetic DNA
taatccgactcactaggg

SEQ ID NO: 4769 - DNA, 18 bp, Artificial Sequence
  Synthetic DNA
taatccgtctcactagag

SEQ ID NO: 4770 - DNA, 18 bp, Artificial Sequence
  Synthetic DNA
taatgagactcacgatag

SEQ ID NO: 4771 - DNA, 18 bp, Artificial Sequence
  Synthetic DNA
tactacgcctcactgtag

SEQ ID NO: 4772 - DNA, 18 bp, Artificial Sequence
  Synthetic DNA
tactacgccttactatag

SEQ ID NO: 4773 - DNA, 18 bp, Artificial Sequence
  Synthetic DNA
tactacggctccctatag

SEQ ID NO: 4774 - DNA, 18 bp, Artificial Sequence
  Synthetic DNA
tactagtactcactatag

SEQ ID NO: 4775 - DNA, 18 bp, Artificial Sequence
  Synthetic DNA
tagcacgactcaccatag

SEQ ID NO: 4776 - DNA, 18 bp, Artificial Sequence
  Synthetic DNA
tagtacgacacactagag

SEQ ID NO: 4777 - DNA, 18 bp, Artificial Sequence
  Synthetic DNA
tagtacgcctcactatgg

SEQ ID NO: 4778 - DNA, 18 bp, Artificial Sequence
  Synthetic DNA
tagtaggactccctatag

SEQ ID NO: 4779 - DNA, 18 bp, Artificial Sequence
  Synthetic DNA
tagttcgactcactagag

SEQ ID NO: 4780 - DNA, 18 bp, Artificial Sequence
  Synthetic DNA
tattacgactcagtacag

SEQ ID NO: 4781 - DNA, 18 bp, Artificial Sequence
  Synthetic DNA
tattacgactcgctagag

SEQ ID NO: 4782 - DNA, 18 bp, Artificial Sequence
  Synthetic DNA
tcagacgactcactgtag

SEQ ID NO: 4783 - DNA, 18 bp, Artificial Sequence
  Synthetic DNA
tcatacgactcaccatcg

SEQ ID NO: 4784 - DNA, 18 bp, Artificial Sequence
  Synthetic DNA
tcatacgactcacgattg

SEQ ID NO: 4785 - DNA, 18 bp, Artificial Sequence
  Synthetic DNA
tcatacgactgattatag

SEQ ID NO: 4786 - DNA, 18 bp, Artificial Sequence
  Synthetic DNA
tcatccgactcactagag

SEQ ID NO: 4787 - DNA, 18 bp, Artificial Sequence
  Synthetic DNA
tcatccggctcactatag

SEQ ID NO: 4788 - DNA, 18 bp, Artificial Sequence
  Synthetic DNA
tcctacgactcactacag

SEQ ID NO: 4789 - DNA, 18 bp, Artificial Sequence
  Synthetic DNA
tcctacgactcactagag

SEQ ID NO: 4790 - DNA, 18 bp, Artificial Sequence
  Synthetic DNA
tcggacgactcactatag

SEQ ID NO: 4791 - DNA, 18 bp, Artificial Sequence
  Synthetic DNA
tcgtacgactcagtatag

SEQ ID NO: 4792 - DNA, 18 bp, Artificial Sequence
  Synthetic DNA
tgatacgacccacaatag

SEQ ID NO: 4793 - DNA, 18 bp, Artificial Sequence
  Synthetic DNA
tgatacgactcaatacag

SEQ ID NO: 4794 - DNA, 18 bp, Artificial Sequence
  Synthetic DNA
tgatacgactgactctag

SEQ ID NO: 4795 - DNA, 18 bp, Artificial Sequence
  Synthetic DNA
tgatacgatccactatag

SEQ ID NO: 4796 - DNA, 18 bp, Artificial Sequence
  Synthetic DNA
tgatccgacacactatag

SEQ ID NO: 4797 - DNA, 18 bp, Artificial Sequence
  Synthetic DNA
tgatgcgacttactatag

SEQ ID NO: 4798 - DNA, 18 bp, Artificial Sequence
  Synthetic DNA
tgctacgactcactaaag

SEQ ID NO: 4799 - DNA, 18 bp, Artificial Sequence
  Synthetic DNA
tggtacgactcactagag

SEQ ID NO: 4800 - DNA, 18 bp, Artificial Sequence
  Synthetic DNA
taatacgacactctattg

SEQ ID NO: 4801 - DNA, 18 bp, Artificial Sequence
  Synthetic DNA
atatacgactcactattg

SEQ ID NO: 4802 - DNA, 18 bp, Artificial Sequence
  Synthetic DNA
caatacgactctctattg

SEQ ID NO: 4803 - DNA, 18 bp, Artificial Sequence
  Synthetic DNA
taatacgcctcacattag

SEQ ID NO: 4804 - DNA, 18 bp, Artificial Sequence
  Synthetic DNA
tattacgactcactaatg

SEQ ID NO: 4805 - DNA, 18 bp, Artificial Sequence
  Synthetic DNA
aaatacgtctcactatcg

SEQ ID NO: 4806 - DNA, 18 bp, Artificial Sequence
  Synthetic DNA
aaatacgtctcactgtag

SEQ ID NO: 4807 - DNA, 18 bp, Artificial Sequence
  Synthetic DNA
taatacaactcgctttag

SEQ ID NO: 4808 - DNA, 18 bp, Artificial Sequence
  Synthetic DNA
tattacgactcacttttg

SEQ ID NO: 4809 - DNA, 18 bp, Artificial Sequence
  Synthetic DNA
ttatatgactcactctag

SEQ ID NO: 4810 - DNA, 18 bp, Artificial Sequence
  Synthetic DNA
taattctacccactatag

SEQ ID NO: 4811 - DNA, 18 bp, Artificial Sequence
  Synthetic DNA
aaatacgactcacttttg

SEQ ID NO: 4812 - DNA, 18 bp, Artificial Sequence
  Synthetic DNA
tatttcgactcaccatag

SEQ ID NO: 4813 - DNA, 18 bp, Artificial Sequence
  Synthetic DNA
taatacgactctctgttg

SEQ ID NO: 4814 - DNA, 18 bp, Artificial Sequence
  Synthetic DNA
aaatacaactcactgtag

SEQ ID NO: 4815 - DNA, 18 bp, Artificial Sequence
  Synthetic DNA
taatactactcacttttg

SEQ ID NO: 4816 - DNA, 18 bp, Artificial Sequence
  Synthetic DNA
taatacgactcccttaag

SEQ ID NO: 4817 - DNA, 18 bp, Artificial Sequence
  Synthetic DNA
aaatacgtctcagtatag

SEQ ID NO: 4818 - DNA, 18 bp, Artificial Sequence
  Synthetic DNA
taaatccactcactatag

SEQ ID NO: 4819 - DNA, 18 bp, Artificial Sequence
  Synthetic DNA
taataagactcaccaaag

SEQ ID NO: 4820 - DNA, 18 bp, Artificial Sequence
  Synthetic DNA
taatacgactcactttta

SEQ ID NO: 4821 - DNA, 18 bp, Artificial Sequence
  Synthetic DNA
taataggactcactgttg

SEQ ID NO: 4822 - DNA, 18 bp, Artificial Sequence
  Synthetic DNA
taatatgactcgctaaag

SEQ ID NO: 4823 - DNA, 18 bp, Artificial Sequence
  Synthetic DNA
tcatacgactgactattg

SEQ ID NO: 4824 - DNA, 18 bp, Artificial Sequence
  Synthetic DNA
ttgtacgactcactgtag

SEQ ID NO: 4825 - DNA, 18 bp, Artificial Sequence
  Synthetic DNA
tcttacgactcactttag

SEQ ID NO: 4826 - DNA, 18 bp, Artificial Sequence
  Synthetic DNA
aaattggactcactatag

SEQ ID NO: 4827 - DNA, 18 bp, Artificial Sequence
  Synthetic DNA
taataataatcactatag

SEQ ID NO: 4828 - DNA, 18 bp, Artificial Sequence
  Synthetic DNA
taatacgtctcaatacag

SEQ ID NO: 4829 - DNA, 18 bp, Artificial Sequence
  Synthetic DNA
acatacgactcactaaag

SEQ ID NO: 4830 - DNA, 18 bp, Artificial Sequence
  Synthetic DNA
taataggactcacaaaag

SEQ ID NO: 4831 - DNA, 18 bp, Artificial Sequence
  Synthetic DNA
taatatgacttactgtag

SEQ ID NO: 4832 - DNA, 18 bp, Artificial Sequence
  Synthetic DNA
tactacatctcactatag

SEQ ID NO: 4833 - DNA, 18 bp, Artificial Sequence
  Synthetic DNA
aaatacggctcagtatag

SEQ ID NO: 4834 - DNA, 18 bp, Artificial Sequence
  Synthetic DNA
aactacgactcacaatag

SEQ ID NO: 4835 - DNA, 18 bp, Artificial Sequence
  Synthetic DNA
cattacgagtcactatag

SEQ ID NO: 4836 - DNA, 18 bp, Artificial Sequence
  Synthetic DNA
taacacgacacattatag

SEQ ID NO: 4837 - DNA, 18 bp, Artificial Sequence
  Synthetic DNA
taatacaattcgctatag

SEQ ID NO: 4838 - DNA, 18 bp, Artificial Sequence
  Synthetic DNA
taataccactcactcttg

SEQ ID NO: 4839 - DNA, 18 bp, Artificial Sequence
  Synthetic DNA
taatacggctcattatcg

SEQ ID NO: 4840 - DNA, 18 bp, Artificial Sequence
  Synthetic DNA
tactacgactctttatag

SEQ ID NO: 4841 - DNA, 18 bp, Artificial Sequence
  Synthetic DNA
tactactaatcactatag

SEQ ID NO: 4842 - DNA, 18 bp, Artificial Sequence
  Synthetic DNA
tattgcggctcactatag

SEQ ID NO: 4843 - DNA, 18 bp, Artificial Sequence
  Synthetic DNA
taaagcgacacactatag

SEQ ID NO: 4844 - DNA, 18 bp, Artificial Sequence
  Synthetic DNA
taattcgactctctatcg

SEQ ID NO: 4845 - DNA, 18 bp, Artificial Sequence
  Synthetic DNA
tagtacgtctcacaatag

SEQ ID NO: 4846 - DNA, 18 bp, Artificial Sequence
  Synthetic DNA
caatacgactcagtaaag

SEQ ID NO: 4847 - DNA, 18 bp, Artificial Sequence
  Synthetic DNA
taatacgactcaacattg

SEQ ID NO: 4848 - DNA, 18 bp, Artificial Sequence
  Synthetic DNA
taatacgtctcactgtcg

SEQ ID NO: 4849 - DNA, 18 bp, Artificial Sequence
  Synthetic DNA
ttttacgactcactatgg

SEQ ID NO: 4850 - DNA, 18 bp, Artificial Sequence
  Synthetic DNA
ttatacgactctctaaag

SEQ ID NO: 4851 - DNA, 18 bp, Artificial Sequence
  Synthetic DNA
tattacgactcgctttag

SEQ ID NO: 4852 - DNA, 18 bp, Artificial Sequence
  Synthetic DNA
aaatacgacgcactgtag

SEQ ID NO: 4853 - DNA, 18 bp, Artificial Sequence
  Synthetic DNA
taatgcgacttactaaag

SEQ ID NO: 4854 - DNA, 18 bp, Artificial Sequence
  Synthetic DNA
tgatacgactcattattg

SEQ ID NO: 4855 - DNA, 18 bp, Artificial Sequence
  Synthetic DNA
ttataccactcactctag

SEQ ID NO: 4856 - DNA, 18 bp, Artificial Sequence
  Synthetic DNA
ttatgcgactaactatag

SEQ ID NO: 4857 - DNA, 18 bp, Artificial Sequence
  Synthetic DNA
aaatacgactcaccctag

SEQ ID NO: 4858 - DNA, 18 bp, Artificial Sequence
  Synthetic DNA
aaatacgcctaactatag

SEQ ID NO: 4859 - DNA, 18 bp, Artificial Sequence
  Synthetic DNA
aaatatgactccctatag

SEQ ID NO: 4860 - DNA, 18 bp, Artificial Sequence
  Synthetic DNA
aaatccgactaactatag

SEQ ID NO: 4861 - DNA, 18 bp, Artificial Sequence
  Synthetic DNA
caacacgactccctatag

SEQ ID NO: 4862 - DNA, 18 bp, Artificial Sequence
  Synthetic DNA
caatacgactcactttgg

SEQ ID NO: 4863 - DNA, 18 bp, Artificial Sequence
  Synthetic DNA
gaatacgactcgctttag

SEQ ID NO: 4864 - DNA, 18 bp, Artificial Sequence
  Synthetic DNA
gaatacgtctcaatatag

SEQ ID NO: 4865 - DNA, 18 bp, Artificial Sequence
  Synthetic DNA
taacacccctcactatag

SEQ ID NO: 4866 - DNA, 18 bp, Artificial Sequence
  Synthetic DNA
taagacgattcacaatag

SEQ ID NO: 4867 - DNA, 18 bp, Artificial Sequence
  Synthetic DNA
taatacaactaactatgg

SEQ ID NO: 4868 - DNA, 18 bp, Artificial Sequence
  Synthetic DNA
taatacaactcgctgtag

SEQ ID NO: 4869 - DNA, 18 bp, Artificial Sequence
  Synthetic DNA
taatacaactgactacag

SEQ ID NO: 4870 - DNA, 18 bp, Artificial Sequence
  Synthetic DNA
taataccgctcaccatag

SEQ ID NO: 4871 - DNA, 18 bp, Artificial Sequence
  Synthetic DNA
taatacgactcttgatag

SEQ ID NO: 4872 - DNA, 18 bp, Artificial Sequence
  Synthetic DNA
taatacgactgcatatag

SEQ ID NO: 4873 - DNA, 18 bp, Artificial Sequence
  Synthetic DNA
taatactacccactacag

SEQ ID NO: 4874 - DNA, 18 bp, Artificial Sequence
  Synthetic DNA
taatactcctcactgtag

SEQ ID NO: 4875 - DNA, 18 bp, Artificial Sequence
  Synthetic DNA
taataggaatcactctag

SEQ ID NO: 4876 - DNA, 18 bp, Artificial Sequence
  Synthetic DNA
taatcagactcactatcg

SEQ ID NO: 4877 - DNA, 18 bp, Artificial Sequence
  Synthetic DNA
taatccgactaaatatag

SEQ ID NO: 4878 - DNA, 18 bp, Artificial Sequence
  Synthetic DNA
taatccgactgactttag

SEQ ID NO: 4879 - DNA, 18 bp, Artificial Sequence
  Synthetic DNA
taatgagactcagtatag

SEQ ID NO: 4880 - DNA, 18 bp, Artificial Sequence
  Synthetic DNA
tagtacgactcggtatag

SEQ ID NO: 4881 - DNA, 18 bp, Artificial Sequence
  Synthetic DNA
ttaggcgactcactatag

SEQ ID NO: 4882 - DNA, 18 bp, Artificial Sequence
  Synthetic DNA
tatttcgactcactaaag

SEQ ID NO: 4883 - DNA, 18 bp, Artificial Sequence
  Synthetic DNA
taatacaactctctacag

SEQ ID NO: 4884 - DNA, 18 bp, Artificial Sequence
  Synthetic DNA
ttatacgcctcacaatag

SEQ ID NO: 4885 - DNA, 18 bp, Artificial Sequence
  Synthetic DNA
taattcgactcagtacag

SEQ ID NO: 4886 - DNA, 18 bp, Artificial Sequence
  Synthetic DNA
tcatacgactaaccatag

SEQ ID NO: 4887 - DNA, 18 bp, Artificial Sequence
  Synthetic DNA
taattcgtctcactgtag

SEQ ID NO: 4888 - DNA, 18 bp, Artificial Sequence
  Synthetic DNA
ttatacgactctctattg

SEQ ID NO: 4889 - DNA, 18 bp, Artificial Sequence
  Synthetic DNA
ttttacgactcactattg

SEQ ID NO: 4890 - DNA, 18 bp, Artificial Sequence
  Synthetic DNA
taacacaactcactattg

SEQ ID NO: 4891 - DNA, 18 bp, Artificial Sequence
  Synthetic DNA
taatacgagactctatag

SEQ ID NO: 4892 - DNA, 18 bp, Artificial Sequence
  Synthetic DNA
caacacaactcactatag

SEQ ID NO: 4893 - DNA, 18 bp, Artificial Sequence
  Synthetic DNA
taacacgactcaatatcg

SEQ ID NO: 4894 - DNA, 18 bp, Artificial Sequence
  Synthetic DNA
taacatgactcattatag

SEQ ID NO: 4895 - DNA, 18 bp, Artificial Sequence
  Synthetic DNA
taataagaatcactctag

SEQ ID NO: 4896 - DNA, 18 bp, Artificial Sequence
  Synthetic DNA
taatacgattaactatcg

SEQ ID NO: 4897 - DNA, 18 bp, Artificial Sequence
  Synthetic DNA
taatagaaatcactatag

SEQ ID NO: 4898 - DNA, 18 bp, Artificial Sequence
  Synthetic DNA
taatatgactcgccatag

SEQ ID NO: 4899 - DNA, 18 bp, Artificial Sequence
  Synthetic DNA
taatatgcatcactatag

SEQ ID NO: 4900 - DNA, 18 bp, Artificial Sequence
  Synthetic DNA
taatatgcctcactatcg

SEQ ID NO: 4901 - DNA, 18 bp, Artificial Sequence
  Synthetic DNA
tagtacgacacaatatag

SEQ ID NO: 4902 - DNA, 18 bp, Artificial Sequence
  Synthetic DNA
tagtacgactctctatgg

SEQ ID NO: 4903 - DNA, 18 bp, Artificial Sequence
  Synthetic DNA
tgattggactcactatag

SEQ ID NO: 4904 - DNA, 18 bp, Artificial Sequence
  Synthetic DNA
aaatacgactaactttag

SEQ ID NO: 4905 - DNA, 18 bp, Artificial Sequence
  Synthetic DNA
ttaaacgactcagtatag

SEQ ID NO: 4906 - DNA, 18 bp, Artificial Sequence
  Synthetic DNA
taactcgtctcactatag

SEQ ID NO: 4907 - DNA, 18 bp, Artificial Sequence
  Synthetic DNA
taatacgtatctctatag

SEQ ID NO: 4908 - DNA, 18 bp, Artificial Sequence
  Synthetic DNA
aaatacgacttactctag

SEQ ID NO: 4909 - DNA, 18 bp, Artificial Sequence
  Synthetic DNA
aattccgactcactatag

SEQ ID NO: 4910 - DNA, 18 bp, Artificial Sequence
  Synthetic DNA
caataagactcacaatag

SEQ ID NO: 4911 - DNA, 18 bp, Artificial Sequence
  Synthetic DNA
taataagactcactcaag

SEQ ID NO: 4912 - DNA, 18 bp, Artificial Sequence
  Synthetic DNA
taatacgacccactttgg

SEQ ID NO: 4913 - DNA, 18 bp, Artificial Sequence
  Synthetic DNA
taatacgtctcgctgtag

SEQ ID NO: 4914 - DNA, 18 bp, Artificial Sequence
  Synthetic DNA
tattacgactcacttaag

SEQ ID NO: 4915 - DNA, 18 bp, Artificial Sequence
  Synthetic DNA
aaataagactcactatcg

SEQ ID NO: 4916 - DNA, 18 bp, Artificial Sequence
  Synthetic DNA
taaaacgactcgatatag

SEQ ID NO: 4917 - DNA, 18 bp, Artificial Sequence
  Synthetic DNA
taatacgactcagcattg

SEQ ID NO: 4918 - DNA, 18 bp, Artificial Sequence
  Synthetic DNA
taattcgacacactatcg

SEQ ID NO: 4919 - DNA, 18 bp, Artificial Sequence
  Synthetic DNA
taattccattcactatag

SEQ ID NO: 4920 - DNA, 18 bp, Artificial Sequence
  Synthetic DNA
taatacgacagactattg

SEQ ID NO: 4921 - DNA, 18 bp, Artificial Sequence
  Synthetic DNA
taaaaggtctcactatag

SEQ ID NO: 4922 - DNA, 18 bp, Artificial Sequence
  Synthetic DNA
taatccaactcactttag

SEQ ID NO: 4923 - DNA, 18 bp, Artificial Sequence
  Synthetic DNA
tgatacgactcactaatg

SEQ ID NO: 4924 - DNA, 18 bp, Artificial Sequence
  Synthetic DNA
taatacaactctctttag

SEQ ID NO: 4925 - DNA, 18 bp, Artificial Sequence
  Synthetic DNA
taatatgactcactcaag

SEQ ID NO: 4926 - DNA, 18 bp, Artificial Sequence
  Synthetic DNA
taatacgactgtctattg

SEQ ID NO: 4927 - DNA, 18 bp, Artificial Sequence
  Synthetic DNA
tcatacgactcaccattg

SEQ ID NO: 4928 - DNA, 18 bp, Artificial Sequence
  Synthetic DNA
taatacgacacaacatag

SEQ ID NO: 4929 - DNA, 18 bp, Artificial Sequence
  Synthetic DNA
taatagagctcactatag

SEQ ID NO: 4930 - DNA, 18 bp, Artificial Sequence
  Synthetic DNA
taatatgactcactttgg

SEQ ID NO: 4931 - DNA, 18 bp, Artificial Sequence
  Synthetic DNA
caatacgatgcactatag

SEQ ID NO: 4932 - DNA, 18 bp, Artificial Sequence
  Synthetic DNA
taaaacgactcactctcg

SEQ ID NO: 4933 - DNA, 18 bp, Artificial Sequence
  Synthetic DNA
taatacaactgactaaag

SEQ ID NO: 4934 - DNA, 18 bp, Artificial Sequence
  Synthetic DNA
taatacgacacactgtcg

SEQ ID NO: 4935 - DNA, 18 bp, Artificial Sequence
  Synthetic DNA
taatacgtctccctacag

SEQ ID NO: 4936 - DNA, 18 bp, Artificial Sequence
  Synthetic DNA
taatataactcactatcg

SEQ ID NO: 4937 - DNA, 18 bp, Artificial Sequence
  Synthetic DNA
taattcgacacgctatag

SEQ ID NO: 4938 - DNA, 18 bp, Artificial Sequence
  Synthetic DNA
taattcgactcaccagag

SEQ ID NO: 4939 - DNA, 18 bp, Artificial Sequence
  Synthetic DNA
taattcgactccctgtag

SEQ ID NO: 4940 - DNA, 18 bp, Artificial Sequence
  Synthetic DNA
tattacgagtcactatcg

SEQ ID NO: 4941 - DNA, 18 bp, Artificial Sequence
  Synthetic DNA
tgataccactcattatag

SEQ ID NO: 4942 - DNA, 18 bp, Artificial Sequence
  Synthetic DNA
tgtcacgactcactatag

SEQ ID NO: 4943 - DNA, 18 bp, Artificial Sequence
  Synthetic DNA
ttatatgactcactagag

SEQ ID NO: 4944 - DNA, 18 bp, Artificial Sequence
  Synthetic DNA
taatacgtctcactgtgg

SEQ ID NO: 4945 - DNA, 18 bp, Artificial Sequence
  Synthetic DNA
taattcgactggctatag

SEQ ID NO: 4946 - DNA, 18 bp, Artificial Sequence
  Synthetic DNA
tactgcgactctctatag

SEQ ID NO: 4947 - DNA, 18 bp, Artificial Sequence
  Synthetic DNA
tagtacgagtcacaatag

SEQ ID NO: 4948 - DNA, 18 bp, Artificial Sequence
  Synthetic DNA
aaatacgagtcattatag

SEQ ID NO: 4949 - DNA, 18 bp, Artificial Sequence
  Synthetic DNA
aaataggactcagtatag

SEQ ID NO: 4950 - DNA, 18 bp, Artificial Sequence
  Synthetic DNA
cgaaacgactcactatag

SEQ ID NO: 4951 - DNA, 18 bp, Artificial Sequence
  Synthetic DNA
gaaaacgacacactatag

SEQ ID NO: 4952 - DNA, 18 bp, Artificial Sequence
  Synthetic DNA
gaatatgactctctatag

SEQ ID NO: 4953 - DNA, 18 bp, Artificial Sequence
  Synthetic DNA
gattatgactcactatag

SEQ ID NO: 4954 - DNA, 18 bp, Artificial Sequence
  Synthetic DNA
taaaacgactcactgtcg

SEQ ID NO: 4955 - DNA, 18 bp, Artificial Sequence
  Synthetic DNA
taaaacgactcagtatgg

SEQ ID NO: 4956 - DNA, 18 bp, Artificial Sequence
  Synthetic DNA
taaaacggctcactacag

SEQ ID NO: 4957 - DNA, 18 bp, Artificial Sequence
  Synthetic DNA
taataagacccactatcg

SEQ ID NO: 4958 - DNA, 18 bp, Artificial Sequence
  Synthetic DNA
taatacgacagattatag

SEQ ID NO: 4959 - DNA, 18 bp, Artificial Sequence
  Synthetic DNA
taatacgatgcattatag

SEQ ID NO: 4960 - DNA, 18 bp, Artificial Sequence
  Synthetic DNA
taatacgattcgctacag

SEQ ID NO: 4961 - DNA, 18 bp, Artificial Sequence
  Synthetic DNA
taatacggctcgcaatag

SEQ ID NO: 4962 - DNA, 18 bp, Artificial Sequence
  Synthetic DNA
taatacgtctaacgatag

SEQ ID NO: 4963 - DNA, 18 bp, Artificial Sequence
  Synthetic DNA
taataggactcaatttag

SEQ ID NO: 4964 - DNA, 18 bp, Artificial Sequence
  Synthetic DNA
taataggcctcactttag

SEQ ID NO: 4965 - DNA, 18 bp, Artificial Sequence
  Synthetic DNA
taatccgactcagtctag

SEQ ID NO: 4966 - DNA, 18 bp, Artificial Sequence
  Synthetic DNA
taatgcgactcataatag

SEQ ID NO: 4967 - DNA, 18 bp, Artificial Sequence
  Synthetic DNA
taatgcgacttaccatag

SEQ ID NO: 4968 - DNA, 18 bp, Artificial Sequence
  Synthetic DNA
taatgcgccacactatag

SEQ ID NO: 4969 - DNA, 18 bp, Artificial Sequence
  Synthetic DNA
tactacgagtcactattg

SEQ ID NO: 4970 - DNA, 18 bp, Artificial Sequence
  Synthetic DNA
tactacgtctcactagag

SEQ ID NO: 4971 - DNA, 18 bp, Artificial Sequence
  Synthetic DNA
tagtatgactcactatgg

SEQ ID NO: 4972 - DNA, 18 bp, Artificial Sequence
  Synthetic DNA
tattatgactcacgatag

SEQ ID NO: 4973 - DNA, 18 bp, Artificial Sequence
  Synthetic DNA
tcacacgacacactatag

SEQ ID NO: 4974 - DNA, 18 bp, Artificial Sequence
  Synthetic DNA
tcatacgactgactacag

SEQ ID NO: 4975 - DNA, 18 bp, Artificial Sequence
  Synthetic DNA
tcctacgacacactatag

SEQ ID NO: 4976 - DNA, 18 bp, Artificial Sequence
  Synthetic DNA
tctgacgactcactatag

SEQ ID NO: 4977 - DNA, 18 bp, Artificial Sequence
  Synthetic DNA
aaatacgaatcactatgg

SEQ ID NO: 4978 - DNA, 18 bp, Artificial Sequence
  Synthetic DNA
aaatccgactccctatag

SEQ ID NO: 4979 - DNA, 18 bp, Artificial Sequence
  Synthetic DNA
aagtacgactcactatcg

SEQ ID NO: 4980 - DNA, 18 bp, Artificial Sequence
  Synthetic DNA
agatacgactcactctag

SEQ ID NO: 4981 - DNA, 18 bp, Artificial Sequence
  Synthetic DNA
caagacgactcactctag

SEQ ID NO: 4982 - DNA, 18 bp, Artificial Sequence
  Synthetic DNA
caataccactcactagag

SEQ ID NO: 4983 - DNA, 18 bp, Artificial Sequence
  Synthetic DNA
caatacgaatcactctag

SEQ ID NO: 4984 - DNA, 18 bp, Artificial Sequence
  Synthetic DNA
caatacgactcaatatgg

SEQ ID NO: 4985 - DNA, 18 bp, Artificial Sequence
  Synthetic DNA
caatacgactcacttgag

SEQ ID NO: 4986 - DNA, 18 bp, Artificial Sequence
  Synthetic DNA
caatatgactcactgtag

SEQ ID NO: 4987 - DNA, 18 bp, Artificial Sequence
  Synthetic DNA
gaatacgaaacactatag

SEQ ID NO: 4988 - DNA, 18 bp, Artificial Sequence
  Synthetic DNA
gaatacggctcactttag

SEQ ID NO: 4989 - DNA, 18 bp, Artificial Sequence
  Synthetic DNA
gactacgactaactatag

SEQ ID NO: 4990 - DNA, 18 bp, Artificial Sequence
  Synthetic DNA
taaaacgacccactagag

SEQ ID NO: 4991 - DNA, 18 bp, Artificial Sequence
  Synthetic DNA
taaaacgactcactcgag

SEQ ID NO: 4992 - DNA, 18 bp, Artificial Sequence
  Synthetic DNA
taacacgactccctacag

SEQ ID NO: 4993 - DNA, 18 bp, Artificial Sequence
  Synthetic DNA
taacacgactccctgtag

SEQ ID NO: 4994 - DNA, 18 bp, Artificial Sequence
  Synthetic DNA
taagacaactcaccatag

SEQ ID NO: 4995 - DNA, 18 bp, Artificial Sequence
  Synthetic DNA
taagacgacatactatag

SEQ ID NO: 4996 - DNA, 18 bp, Artificial Sequence
  Synthetic DNA
taagacgactaaatatag

SEQ ID NO: 4997 - DNA, 18 bp, Artificial Sequence
  Synthetic DNA
taataagacgcattatag

SEQ ID NO: 4998 - DNA, 18 bp, Artificial Sequence
  Synthetic DNA
taataagactcagtatcg

SEQ ID NO: 4999 - DNA, 18 bp, Artificial Sequence
  Synthetic DNA
taataaggctgactatag

SEQ ID NO: 5000 - DNA, 18 bp, Artificial Sequence
  Synthetic DNA
taataagtctcactataa

SEQ ID NO: 5001 - DNA, 18 bp, Artificial Sequence
  Synthetic DNA
taatacaagtcactagag

SEQ ID NO: 5002 - DNA, 18 bp, Artificial Sequence
  Synthetic DNA
taatacacgtcactatag

SEQ ID NO: 5003 - DNA, 18 bp, Artificial Sequence
  Synthetic DNA
taataccactcacgatgg

SEQ ID NO: 5004 - DNA, 18 bp, Artificial Sequence
  Synthetic DNA
taataccactcgctctag

SEQ ID NO: 5005 - DNA, 18 bp, Artificial Sequence
  Synthetic DNA
taataccagtcactatgg

SEQ ID NO: 5006 - DNA, 18 bp, Artificial Sequence
  Synthetic DNA
taataccgcgcactatag

SEQ ID NO: 5007 - DNA, 18 bp, Artificial Sequence
  Synthetic DNA
taataccgctcactctag

SEQ ID NO: 5008 - DNA, 18 bp, Artificial Sequence
  Synthetic DNA
taataccggtcactatag

SEQ ID NO: 5009 - DNA, 18 bp, Artificial Sequence
  Synthetic DNA
taatacgaatcacgatcg

SEQ ID NO: 5010 - DNA, 18 bp, Artificial Sequence
  Synthetic DNA
taatacgaattacgatag

SEQ ID NO: 5011 - DNA, 18 bp, Artificial Sequence
  Synthetic DNA
taatacgacacactatta

SEQ ID NO: 5012 - DNA, 18 bp, Artificial Sequence
  Synthetic DNA
taatacgacatactataa

SEQ ID NO: 5013 - DNA, 18 bp, Artificial Sequence
  Synthetic DNA
taatacgacccaatatgg

SEQ ID NO: 5014 - DNA, 18 bp, Artificial Sequence
  Synthetic DNA
taatacgactcaattgag

SEQ ID NO: 5015 - DNA, 18 bp, Artificial Sequence
  Synthetic DNA
taatacgactgactgaag

SEQ ID NO: 5016 - DNA, 18 bp, Artificial Sequence
  Synthetic DNA
taatacgacttggtatag

SEQ ID NO: 5017 - DNA, 18 bp, Artificial Sequence
  Synthetic DNA
taatacgaggcgctatag

SEQ ID NO: 5018 - DNA, 18 bp, Artificial Sequence
  Synthetic DNA
taatacgagtcagtacag

SEQ ID NO: 5019 - DNA, 18 bp, Artificial Sequence
  Synthetic DNA
taatacgagtcgatatag

SEQ ID NO: 5020 - DNA, 18 bp, Artificial Sequence
  Synthetic DNA
taatacgcatcgctatag

SEQ ID NO: 5021 - DNA, 18 bp, Artificial Sequence
  Synthetic DNA
taatacgcctcattatgg

SEQ ID NO: 5022 - DNA, 18 bp, Artificial Sequence
  Synthetic DNA
taatacgcctcgctagag

SEQ ID NO: 5023 - DNA, 18 bp, Artificial Sequence
  Synthetic DNA
taatacggttcactagag

SEQ ID NO: 5024 - DNA, 18 bp, Artificial Sequence
  Synthetic DNA
taatacggttccctatag

SEQ ID NO: 5025 - DNA, 18 bp, Artificial Sequence
  Synthetic DNA
taatacgtctaactagag

SEQ ID NO: 5026 - DNA, 18 bp, Artificial Sequence
  Synthetic DNA
taatactacgccctatag

SEQ ID NO: 5027 - DNA, 18 bp, Artificial Sequence
  Synthetic DNA
taatactactcactaggg

SEQ ID NO: 5028 - DNA, 18 bp, Artificial Sequence
  Synthetic DNA
taatactccccactatag

SEQ ID NO: 5029 - DNA, 18 bp, Artificial Sequence
  Synthetic DNA
taataggacccgctatag

SEQ ID NO: 5030 - DNA, 18 bp, Artificial Sequence
  Synthetic DNA
taataggactcactacgg

SEQ ID NO: 5031 - DNA, 18 bp, Artificial Sequence
  Synthetic DNA
taataggactcactgcag

SEQ ID NO: 5032 - DNA, 18 bp, Artificial Sequence
  Synthetic DNA
taataggactcattctag

SEQ ID NO: 5033 - DNA, 18 bp, Artificial Sequence
  Synthetic DNA
taatataactgactatag

SEQ ID NO: 5034 - DNA, 18 bp, Artificial Sequence
  Synthetic DNA
taatatcactcactagag

SEQ ID NO: 5035 - DNA, 18 bp, Artificial Sequence
  Synthetic DNA
taatatgcctgactatag

SEQ ID NO: 5036 - DNA, 18 bp, Artificial Sequence
  Synthetic DNA
taatcgtactcactatag

SEQ ID NO: 5037 - DNA, 18 bp, Artificial Sequence
  Synthetic DNA
taatgccactcgctatag

SEQ ID NO: 5038 - DNA, 18 bp, Artificial Sequence
  Synthetic DNA
taatgcgacgcactaaag

SEQ ID NO: 5039 - DNA, 18 bp, Artificial Sequence
  Synthetic DNA
taatgcgactaactatgg

SEQ ID NO: 5040 - DNA, 18 bp, Artificial Sequence
  Synthetic DNA
taatgtggctcactatag

SEQ ID NO: 5041 - DNA, 18 bp, Artificial Sequence
  Synthetic DNA
tacaacgactcactatgg

SEQ ID NO: 5042 - DNA, 18 bp, Artificial Sequence
  Synthetic DNA
tacgacgattcactatag

SEQ ID NO: 5043 - DNA, 18 bp, Artificial Sequence
  Synthetic DNA
tactacgaatcactgtag

SEQ ID NO: 5044 - DNA, 18 bp, Artificial Sequence
  Synthetic DNA
tactacgactctgtatag

SEQ ID NO: 5045 - DNA, 18 bp, Artificial Sequence
  Synthetic DNA
tactacggttcactatag

SEQ ID NO: 5046 - DNA, 18 bp, Artificial Sequence
  Synthetic DNA
tagtaccactcactagag

SEQ ID NO: 5047 - DNA, 18 bp, Artificial Sequence
  Synthetic DNA
tagtacgactctctagag

SEQ ID NO: 5048 - DNA, 18 bp, Artificial Sequence
  Synthetic DNA
tagtacgactgacgatag

SEQ ID NO: 5049 - DNA, 18 bp, Artificial Sequence
  Synthetic DNA
tagtacggctgactatag

SEQ ID NO: 5050 - DNA, 18 bp, Artificial Sequence
  Synthetic DNA
tagtaggactcaatatag

SEQ ID NO: 5051 - DNA, 18 bp, Artificial Sequence
  Synthetic DNA
tagttcgactcaccatag

SEQ ID NO: 5052 - DNA, 18 bp, Artificial Sequence
  Synthetic DNA
tcataagaatcactatag

SEQ ID NO: 5053 - DNA, 18 bp, Artificial Sequence
  Synthetic DNA
tcatacgacacaccatag

SEQ ID NO: 5054 - DNA, 18 bp, Artificial Sequence
  Synthetic DNA
tcatacgactcagtctag

SEQ ID NO: 5055 - DNA, 18 bp, Artificial Sequence
  Synthetic DNA
tcatacgcctcgctatag

SEQ ID NO: 5056 - DNA, 18 bp, Artificial Sequence
  Synthetic DNA
tcctactactcactatag

SEQ ID NO: 5057 - DNA, 18 bp, Artificial Sequence
  Synthetic DNA
tgacacggctcactatag

SEQ ID NO: 5058 - DNA, 18 bp, Artificial Sequence
  Synthetic DNA
tgataccactcactctag

SEQ ID NO: 5059 - DNA, 18 bp, Artificial Sequence
  Synthetic DNA
tgatacgaatcgctatag

SEQ ID NO: 5060 - DNA, 18 bp, Artificial Sequence
  Synthetic DNA
tgatacgactcaccattg

SEQ ID NO: 5061 - DNA, 18 bp, Artificial Sequence
  Synthetic DNA
tgatacgcctcactacag

SEQ ID NO: 5062 - DNA, 18 bp, Artificial Sequence
  Synthetic DNA
tgatagcactcactatag

SEQ ID NO: 5063 - DNA, 18 bp, Artificial Sequence
  Synthetic DNA
caatacgacacactattg

SEQ ID NO: 5064 - DNA, 18 bp, Artificial Sequence
  Synthetic DNA
aaataagactcactttag

SEQ ID NO: 5065 - DNA, 18 bp, Artificial Sequence
  Synthetic DNA
taatacatctcactacag

SEQ ID NO: 5066 - DNA, 18 bp, Artificial Sequence
  Synthetic DNA
caaaacaactcactatag

SEQ ID NO: 5067 - DNA, 18 bp, Artificial Sequence
  Synthetic DNA
taatgcgactcaatttag

SEQ ID NO: 5068 - DNA, 18 bp, Artificial Sequence
  Synthetic DNA
taatacgactcagttaag

SEQ ID NO: 5069 - DNA, 18 bp, Artificial Sequence
  Synthetic DNA
taatacgacccatcatag

SEQ ID NO: 5070 - DNA, 18 bp, Artificial Sequence
  Synthetic DNA
taaaacggctcactttag

SEQ ID NO: 5071 - DNA, 18 bp, Artificial Sequence
  Synthetic DNA
caatacgactcaccattg

SEQ ID NO: 5072 - DNA, 18 bp, Artificial Sequence
  Synthetic DNA
gaatacgactcactaatg

SEQ ID NO: 5073 - DNA, 18 bp, Artificial Sequence
  Synthetic DNA
taatatgactcactgaag

SEQ ID NO: 5074 - DNA, 18 bp, Artificial Sequence
  Synthetic DNA
taatccaactcactctag

SEQ ID NO: 5075 - DNA, 18 bp, Artificial Sequence
  Synthetic DNA
tagttcgattcactatag

SEQ ID NO: 5076 - DNA, 18 bp, Artificial Sequence
  Synthetic DNA
tcatacgtctcactatcg

SEQ ID NO: 5077 - DNA, 18 bp, Artificial Sequence
  Synthetic DNA
tgaaacgactcactttag

SEQ ID NO: 5078 - DNA, 18 bp, Artificial Sequence
  Synthetic DNA
caatacgtctcactattg

SEQ ID NO: 5079 - DNA, 18 bp, Artificial Sequence
  Synthetic DNA
ttatacggctcactaaag

SEQ ID NO: 5080 - DNA, 18 bp, Artificial Sequence
  Synthetic DNA
taacacgactcacaattg

SEQ ID NO: 5081 - DNA, 18 bp, Artificial Sequence
  Synthetic DNA
caatacgcctcactctag

SEQ ID NO: 5082 - DNA, 18 bp, Artificial Sequence
  Synthetic DNA
cattacgactcactatgg

SEQ ID NO: 5083 - DNA, 18 bp, Artificial Sequence
  Synthetic DNA
taataccactacctatag

SEQ ID NO: 5084 - DNA, 18 bp, Artificial Sequence
  Synthetic DNA
taattcgaatcactagag

SEQ ID NO: 5085 - DNA, 18 bp, Artificial Sequence
  Synthetic DNA
tactacgattcactctag

SEQ ID NO: 5086 - DNA, 18 bp, Artificial Sequence
  Synthetic DNA
tcctaggactcactatag

SEQ ID NO: 5087 - DNA, 18 bp, Artificial Sequence
  Synthetic DNA
tgattcggctcactatag

SEQ ID NO: 5088 - DNA, 18 bp, Artificial Sequence
  Synthetic DNA
ttatacgccccactatag

SEQ ID NO: 5089 - DNA, 18 bp, Artificial Sequence
  Synthetic DNA
tattacgtctcaccatag

SEQ ID NO: 5090 - DNA, 18 bp, Artificial Sequence
  Synthetic DNA
ttctacgacttactatag

SEQ ID NO: 5091 - DNA, 18 bp, Artificial Sequence
  Synthetic DNA
taacacgactcactttgg

SEQ ID NO: 5092 - DNA, 18 bp, Artificial Sequence
  Synthetic DNA
taataccactcacttcag

SEQ ID NO: 5093 - DNA, 18 bp, Artificial Sequence
  Synthetic DNA
taatacgattcgctttag

SEQ ID NO: 5094 - DNA, 18 bp, Artificial Sequence
  Synthetic DNA
taatacgaatcactttgg

SEQ ID NO: 5095 - DNA, 18 bp, Artificial Sequence
  Synthetic DNA
taatacgactctctcttg

SEQ ID NO: 5096 - DNA, 18 bp, Artificial Sequence
  Synthetic DNA
taatccgtcttactatag

SEQ ID NO: 5097 - DNA, 18 bp, Artificial Sequence
  Synthetic DNA
ttatacgacacgctatag

SEQ ID NO: 5098 - DNA, 18 bp, Artificial Sequence
  Synthetic DNA
taatacaactcacaatcg

SEQ ID NO: 5099 - DNA, 18 bp, Artificial Sequence
  Synthetic DNA
taatacatctcgctatag

SEQ ID NO: 5100 - DNA, 18 bp, Artificial Sequence
  Synthetic DNA
taatgcgactctctttag

SEQ ID NO: 5101 - DNA, 18 bp, Artificial Sequence
  Synthetic DNA
aaatgcgaatcactatag

SEQ ID NO: 5102 - DNA, 18 bp, Artificial Sequence
  Synthetic DNA
taaaaagcctcactatag

SEQ ID NO: 5103 - DNA, 18 bp, Artificial Sequence
  Synthetic DNA
taaaacggctcactattg

SEQ ID NO: 5104 - DNA, 18 bp, Artificial Sequence
  Synthetic DNA
taatacagctcactacag

SEQ ID NO: 5105 - DNA, 18 bp, Artificial Sequence
  Synthetic DNA
taatacgactaactgttg

SEQ ID NO: 5106 - DNA, 18 bp, Artificial Sequence
  Synthetic DNA
taatacgactcacttccg

SEQ ID NO: 5107 - DNA, 18 bp, Artificial Sequence
  Synthetic DNA
taatacgacttacactag

SEQ ID NO: 5108 - DNA, 18 bp, Artificial Sequence
  Synthetic DNA
taatatgccacactatag

SEQ ID NO: 5109 - DNA, 18 bp, Artificial Sequence
  Synthetic DNA
taatcagattcactatag

SEQ ID NO: 5110 - DNA, 18 bp, Artificial Sequence
  Synthetic DNA
taatgcgactaactaaag

SEQ ID NO: 5111 - DNA, 18 bp, Artificial Sequence
  Synthetic DNA
aaatcccactcactatag

SEQ ID NO: 5112 - DNA, 18 bp, Artificial Sequence
  Synthetic DNA
aaatgcgagtcactatag

SEQ ID NO: 5113 - DNA, 18 bp, Artificial Sequence
  Synthetic DNA
acatacgactcactacag

SEQ ID NO: 5114 - DNA, 18 bp, Artificial Sequence
  Synthetic DNA
caatccgacacactatag

SEQ ID NO: 5115 - DNA, 18 bp, Artificial Sequence
  Synthetic DNA
ccatacgactcaatatag

SEQ ID NO: 5116 - DNA, 18 bp, Artificial Sequence
  Synthetic DNA
taaaacgactccgtatag

SEQ ID NO: 5117 - DNA, 18 bp, Artificial Sequence
  Synthetic DNA
taaaacgactggctatag

SEQ ID NO: 5118 - DNA, 18 bp, Artificial Sequence
  Synthetic DNA
taacaggactcactttag

SEQ ID NO: 5119 - DNA, 18 bp, Artificial Sequence
  Synthetic DNA
taagacgcctcactttag

SEQ ID NO: 5120 - DNA, 18 bp, Artificial Sequence
  Synthetic DNA
taagacttctcactatag

SEQ ID NO: 5121 - DNA, 18 bp, Artificial Sequence
  Synthetic DNA
taataccacacactatcg

SEQ ID NO: 5122 - DNA, 18 bp, Artificial Sequence
  Synthetic DNA
taatacgaatcacgttag

SEQ ID NO: 5123 - DNA, 18 bp, Artificial Sequence
  Synthetic DNA
taatacgactcaagattg

SEQ ID NO: 5124 - DNA, 18 bp, Artificial Sequence
  Synthetic DNA
taatacgacttactgtcg

SEQ ID NO: 5125 - DNA, 18 bp, Artificial Sequence
  Synthetic DNA
taatacgagtcacaatcg

SEQ ID NO: 5126 - DNA, 18 bp, Artificial Sequence
  Synthetic DNA
taatacgatcgactatag

SEQ ID NO: 5127 - DNA, 18 bp, Artificial Sequence
  Synthetic DNA
taatacgcctcaatctag

SEQ ID NO: 5128 - DNA, 18 bp, Artificial Sequence
  Synthetic DNA
taatacgcctcacttgag

SEQ ID NO: 5129 - DNA, 18 bp, Artificial Sequence
  Synthetic DNA
taatacgtctcacgacag

SEQ ID NO: 5130 - DNA, 18 bp, Artificial Sequence
  Synthetic DNA
taatacgtctcagtgtag

SEQ ID NO: 5131 - DNA, 18 bp, Artificial Sequence
  Synthetic DNA
taatactaatcactagag

SEQ ID NO: 5132 - DNA, 18 bp, Artificial Sequence
  Synthetic DNA
taatatgactcaccgtag

SEQ ID NO: 5133 - DNA, 18 bp, Artificial Sequence
  Synthetic DNA
taatatgactcattacag

SEQ ID NO: 5134 - DNA, 18 bp, Artificial Sequence
  Synthetic DNA
taatgtgacacactatag

SEQ ID NO: 5135 - DNA, 18 bp, Artificial Sequence
  Synthetic DNA
taattcccctcactatag

SEQ ID NO: 5136 - DNA, 18 bp, Artificial Sequence
  Synthetic DNA
tactacaactcactatcg

SEQ ID NO: 5137 - DNA, 18 bp, Artificial Sequence
  Synthetic DNA
tagtacgactcattctag

SEQ ID NO: 5138 - DNA, 18 bp, Artificial Sequence
  Synthetic DNA
tagttcgacgcactatag

SEQ ID NO: 5139 - DNA, 18 bp, Artificial Sequence
  Synthetic DNA
tcacacgactcagtatag

SEQ ID NO: 5140 - DNA, 18 bp, Artificial Sequence
  Synthetic DNA
tcattcgactcagtatag

SEQ ID NO: 5141 - DNA, 18 bp, Artificial Sequence
  Synthetic DNA
taatacgactcacgaatg

SEQ ID NO: 5142 - DNA, 18 bp, Artificial Sequence
  Synthetic DNA
taattcggctcacaatag

SEQ ID NO: 5143 - DNA, 18 bp, Artificial Sequence
  Synthetic DNA
taatacgattctctattg

SEQ ID NO: 5144 - DNA, 18 bp, Artificial Sequence
  Synthetic DNA
ctatatgactcactatag

SEQ ID NO: 5145 - DNA, 18 bp, Artificial Sequence
  Synthetic DNA
tattccgactcactacag

SEQ ID NO: 5146 - DNA, 18 bp, Artificial Sequence
  Synthetic DNA
caacacgattcactatag

SEQ ID NO: 5147 - DNA, 18 bp, Artificial Sequence
  Synthetic DNA
taaaacacctcactatag

SEQ ID NO: 5148 - DNA, 18 bp, Artificial Sequence
  Synthetic DNA
taataagactctctatcg

SEQ ID NO: 5149 - DNA, 18 bp, Artificial Sequence
  Synthetic DNA
taatacaaatcactacag

SEQ ID NO: 5150 - DNA, 18 bp, Artificial Sequence
  Synthetic DNA
taatacaactctctagag

SEQ ID NO: 5151 - DNA, 18 bp, Artificial Sequence
  Synthetic DNA
taatacgactcgcgattg

SEQ ID NO: 5152 - DNA, 18 bp, Artificial Sequence
  Synthetic DNA
taatacgactctctacgg

SEQ ID NO: 5153 - DNA, 18 bp, Artificial Sequence
  Synthetic DNA
taatacgattcacttgag

SEQ ID NO: 5154 - DNA, 18 bp, Artificial Sequence
  Synthetic DNA
taatccgactcattaaag

SEQ ID NO: 5155 - DNA, 18 bp, Artificial Sequence
  Synthetic DNA
taatccgtctcaccatag

SEQ ID NO: 5156 - DNA, 18 bp, Artificial Sequence
  Synthetic DNA
taattcgactcagtatcg

SEQ ID NO: 5157 - DNA, 18 bp, Artificial Sequence
  Synthetic DNA
tcatacggctcactattg

SEQ ID NO: 5158 - DNA, 18 bp, Artificial Sequence
  Synthetic DNA
ttatacgactaactatcg

SEQ ID NO: 5159 - DNA, 18 bp, Artificial Sequence
  Synthetic DNA
ttatacgactcaatctag

SEQ ID NO: 5160 - DNA, 18 bp, Artificial Sequence
  Synthetic DNA
ttataagactcactatcg

SEQ ID NO: 5161 - DNA, 18 bp, Artificial Sequence
  Synthetic DNA
aagtacgactcactctag

SEQ ID NO: 5162 - DNA, 18 bp, Artificial Sequence
  Synthetic DNA
taatacaagtcactctag

SEQ ID NO: 5163 - DNA, 18 bp, Artificial Sequence
  Synthetic DNA
taatgtgactcactattg

SEQ ID NO: 5164 - DNA, 18 bp, Artificial Sequence
  Synthetic DNA
taaaacgactcactgaag

SEQ ID NO: 5165 - DNA, 18 bp, Artificial Sequence
  Synthetic DNA
taatacaactcaccattg

SEQ ID NO: 5166 - DNA, 18 bp, Artificial Sequence
  Synthetic DNA
taatacgccacacaatag

SEQ ID NO: 5167 - DNA, 18 bp, Artificial Sequence
  Synthetic DNA
tattacgactcactaacg

SEQ ID NO: 5168 - DNA, 18 bp, Artificial Sequence
  Synthetic DNA
taaaacgcctcacaatag

SEQ ID NO: 5169 - DNA, 18 bp, Artificial Sequence
  Synthetic DNA
taatacacctcactattg

SEQ ID NO: 5170 - DNA, 18 bp, Artificial Sequence
  Synthetic DNA
taatacgacaaactatgg

SEQ ID NO: 5171 - DNA, 18 bp, Artificial Sequence
  Synthetic DNA
taattcgcctctctatag

SEQ ID NO: 5172 - DNA, 18 bp, Artificial Sequence
  Synthetic DNA
taattggactcattatag

SEQ ID NO: 5173 - DNA, 18 bp, Artificial Sequence
  Synthetic DNA
tattacaactcacaatag

SEQ ID NO: 5174 - DNA, 18 bp, Artificial Sequence
  Synthetic DNA
taattagactcattatag

SEQ ID NO: 5175 - DNA, 18 bp, Artificial Sequence
  Synthetic DNA
ttatacgccacactatag

SEQ ID NO: 5176 - DNA, 18 bp, Artificial Sequence
  Synthetic DNA
taatacgcatcacaatag

SEQ ID NO: 5177 - DNA, 18 bp, Artificial Sequence
  Synthetic DNA
taatacgtctcacttttg

SEQ ID NO: 5178 - DNA, 18 bp, Artificial Sequence
  Synthetic DNA
caatacgactcacaattg

SEQ ID NO: 5179 - DNA, 18 bp, Artificial Sequence
  Synthetic DNA
tcatactactcactaaag

SEQ ID NO: 5180 - DNA, 18 bp, Artificial Sequence
  Synthetic DNA
taatacgccactctatag

SEQ ID NO: 5181 - DNA, 18 bp, Artificial Sequence
  Synthetic DNA
taatacgagtcaccaaag

SEQ ID NO: 5182 - DNA, 18 bp, Artificial Sequence
  Synthetic DNA
taatacgtatcgctatag

SEQ ID NO: 5183 - DNA, 18 bp, Artificial Sequence
  Synthetic DNA
taatactacacactatcg

SEQ ID NO: 5184 - DNA, 18 bp, Artificial Sequence
  Synthetic DNA
ttatgctactcactatag

SEQ ID NO: 5185 - DNA, 18 bp, Artificial Sequence
  Synthetic DNA
aaataagcctcactatag

SEQ ID NO: 5186 - DNA, 18 bp, Artificial Sequence
  Synthetic DNA
taatactactcaatgtag

SEQ ID NO: 5187 - DNA, 18 bp, Artificial Sequence
  Synthetic DNA
taatgtgactcattatag

SEQ ID NO: 5188 - DNA, 18 bp, Artificial Sequence
  Synthetic DNA
tattacgacgcactgtag

SEQ ID NO: 5189 - DNA, 18 bp, Artificial Sequence
  Synthetic DNA
tgatacgactcacttcag

SEQ ID NO: 5190 - DNA, 18 bp, Artificial Sequence
  Synthetic DNA
ttatacaacgcactatag

SEQ ID NO: 5191 - DNA, 18 bp, Artificial Sequence
  Synthetic DNA
aaatacgactcatgatag

SEQ ID NO: 5192 - DNA, 18 bp, Artificial Sequence
  Synthetic DNA
caaaacgactcacgatag

SEQ ID NO: 5193 - DNA, 18 bp, Artificial Sequence
  Synthetic DNA
caatacgactccttatag

SEQ ID NO: 5194 - DNA, 18 bp, Artificial Sequence
  Synthetic DNA
cagtacgactcactaaag

SEQ ID NO: 5195 - DNA, 18 bp, Artificial Sequence
  Synthetic DNA
gaataccactaactatag

SEQ ID NO: 5196 - DNA, 18 bp, Artificial Sequence
  Synthetic DNA
taaaacgactccccatag

SEQ ID NO: 5197 - DNA, 18 bp, Artificial Sequence
  Synthetic DNA
taaaccgcctcactatag

SEQ ID NO: 5198 - DNA, 18 bp, Artificial Sequence
  Synthetic DNA
taaagcgactcagtatag

SEQ ID NO: 5199 - DNA, 18 bp, Artificial Sequence
  Synthetic DNA
taacacgactaactgtag

SEQ ID NO: 5200 - DNA, 18 bp, Artificial Sequence
  Synthetic DNA
taataagattcactctag

SEQ ID NO: 5201 - DNA, 18 bp, Artificial Sequence
  Synthetic DNA
taatacaactaactgtag

SEQ ID NO: 5202 - DNA, 18 bp, Artificial Sequence
  Synthetic DNA
taatacgacacactacgg

SEQ ID NO: 5203 - DNA, 18 bp, Artificial Sequence
  Synthetic DNA
taatacgacgcgctaaag

SEQ ID NO: 5204 - DNA, 18 bp, Artificial Sequence
  Synthetic DNA
taatacgactaacaagag

SEQ ID NO: 5205 - DNA, 18 bp, Artificial Sequence
  Synthetic DNA
taatacgactcattggag

SEQ ID NO: 5206 - DNA, 18 bp, Artificial Sequence
  Synthetic DNA
taatacgcctctctatcg

SEQ ID NO: 5207 - DNA, 18 bp, Artificial Sequence
  Synthetic DNA
taatacgtctcaggatag

SEQ ID NO: 5208 - DNA, 18 bp, Artificial Sequence
  Synthetic DNA
taatacgtgccactatag

SEQ ID NO: 5209 - DNA, 18 bp, Artificial Sequence
  Synthetic DNA
taataggactcgcaatag

SEQ ID NO: 5210 - DNA, 18 bp, Artificial Sequence
  Synthetic DNA
taatatgactaactgtag

SEQ ID NO: 5211 - DNA, 18 bp, Artificial Sequence
  Synthetic DNA
taatccgacccactacag

SEQ ID NO: 5212 - DNA, 18 bp, Artificial Sequence
  Synthetic DNA
taatccgactcaatacag

SEQ ID NO: 5213 - DNA, 18 bp, Artificial Sequence
  Synthetic DNA
taatctgactcgctatag

SEQ ID NO: 5214 - DNA, 18 bp, Artificial Sequence
  Synthetic DNA
taatgcgactcagcatag

SEQ ID NO: 5215 - DNA, 18 bp, Artificial Sequence
  Synthetic DNA
taatgcgagtgactatag

SEQ ID NO: 5216 - DNA, 18 bp, Artificial Sequence
  Synthetic DNA
taatgtgcctcactatag

SEQ ID NO: 5217 - DNA, 18 bp, Artificial Sequence
  Synthetic DNA
taattcgacgcactttag

SEQ ID NO: 5218 - DNA, 18 bp, Artificial Sequence
  Synthetic DNA
taattcgcctcacgatag

SEQ ID NO: 5219 - DNA, 18 bp, Artificial Sequence
  Synthetic DNA
tagcacgactctctatag

SEQ ID NO: 5220 - DNA, 18 bp, Artificial Sequence
  Synthetic DNA
tagtacgacccaatatag

SEQ ID NO: 5221 - DNA, 18 bp, Artificial Sequence
  Synthetic DNA
tcatacaactcagtatag

SEQ ID NO: 5222 - DNA, 18 bp, Artificial Sequence
  Synthetic DNA
tcatacgactctctagag

SEQ ID NO: 5223 - DNA, 18 bp, Artificial Sequence
  Synthetic DNA
tcgtacgacacactatag

SEQ ID NO: 5224 - DNA, 18 bp, Artificial Sequence
  Synthetic DNA
tgaaacgactcagtatag

SEQ ID NO: 5225 - DNA, 18 bp, Artificial Sequence
  Synthetic DNA
tgataagaatcactatag

SEQ ID NO: 5226 - DNA, 18 bp, Artificial Sequence
  Synthetic DNA
tgatacgactctctagag

SEQ ID NO: 5227 - DNA, 18 bp, Artificial Sequence
  Synthetic DNA
tgattcgagtcactatag

SEQ ID NO: 5228 - DNA, 18 bp, Artificial Sequence
  Synthetic DNA
ttagacgactcactaaag

SEQ ID NO: 5229 - DNA, 18 bp, Artificial Sequence
  Synthetic DNA
ttatacgactcgctgtag

SEQ ID NO: 5230 - DNA, 18 bp, Artificial Sequence
  Synthetic DNA
aaatacgactccctagag

SEQ ID NO: 5231 - DNA, 18 bp, Artificial Sequence
  Synthetic DNA
aaatacgagtcactatcg

SEQ ID NO: 5232 - DNA, 18 bp, Artificial Sequence
  Synthetic DNA
aaataggactcactatgg

SEQ ID NO: 5233 - DNA, 18 bp, Artificial Sequence
  Synthetic DNA
aaataggactccctatag

SEQ ID NO: 5234 - DNA, 18 bp, Artificial Sequence
  Synthetic DNA
caatacgacacactatcg

SEQ ID NO: 5235 - DNA, 18 bp, Artificial Sequence
  Synthetic DNA
caatacgacccactctag

SEQ ID NO: 5236 - DNA, 18 bp, Artificial Sequence
  Synthetic DNA
caatacgacgcaccatag

SEQ ID NO: 5237 - DNA, 18 bp, Artificial Sequence
  Synthetic DNA
caatacgagtcactatcg

SEQ ID NO: 5238 - DNA, 18 bp, Artificial Sequence
  Synthetic DNA
caatacgattcactatcg

SEQ ID NO: 5239 - DNA, 18 bp, Artificial Sequence
  Synthetic DNA
cagtacgactcagtatag

SEQ ID NO: 5240 - DNA, 18 bp, Artificial Sequence
  Synthetic DNA
cgataagactcactatag

SEQ ID NO: 5241 - DNA, 18 bp, Artificial Sequence
  Synthetic DNA
gaaaacgactcattatag

SEQ ID NO: 5242 - DNA, 18 bp, Artificial Sequence
  Synthetic DNA
gaataccattcactatag

SEQ ID NO: 5243 - DNA, 18 bp, Artificial Sequence
  Synthetic DNA
gaatacgattcactctag

SEQ ID NO: 5244 - DNA, 18 bp, Artificial Sequence
  Synthetic DNA
gaatacgtctaactatag

SEQ ID NO: 5245 - DNA, 18 bp, Artificial Sequence
  Synthetic DNA
gaatactcctcactatag

SEQ ID NO: 5246 - DNA, 18 bp, Artificial Sequence
  Synthetic DNA
gaatatgactcaccatag

SEQ ID NO: 5247 - DNA, 18 bp, Artificial Sequence
  Synthetic DNA
taaaaagactcacgatag

SEQ ID NO: 5248 - DNA, 18 bp, Artificial Sequence
  Synthetic DNA
taaaaccactcagtatag

SEQ ID NO: 5249 - DNA, 18 bp, Artificial Sequence
  Synthetic DNA
taaaaggactgactatag

SEQ ID NO: 5250 - DNA, 18 bp, Artificial Sequence
  Synthetic DNA
taaaatgactcactagag

SEQ ID NO: 5251 - DNA, 18 bp, Artificial Sequence
  Synthetic DNA
taacacaactcactatgg

SEQ ID NO: 5252 - DNA, 18 bp, Artificial Sequence
  Synthetic DNA
taacaccacgcactatag

SEQ ID NO: 5253 - DNA, 18 bp, Artificial Sequence
  Synthetic DNA
taacacgactcgctatgg

SEQ ID NO: 5254 - DNA, 18 bp, Artificial Sequence
  Synthetic DNA
taacaggaatcactatag

SEQ ID NO: 5255 - DNA, 18 bp, Artificial Sequence
  Synthetic DNA
taacaggactcactatgg

SEQ ID NO: 5256 - DNA, 18 bp, Artificial Sequence
  Synthetic DNA
taacgggactcactatag

SEQ ID NO: 5257 - DNA, 18 bp, Artificial Sequence
  Synthetic DNA
taactggactcactatag

SEQ ID NO: 5258 - DNA, 18 bp, Artificial Sequence
  Synthetic DNA
taagacgactcaccaaag

SEQ ID NO: 5259 - DNA, 18 bp, Artificial Sequence
  Synthetic DNA
taagacgactcatcatag

SEQ ID NO: 5260 - DNA, 18 bp, Artificial Sequence
  Synthetic DNA
taagacgactccatatag

SEQ ID NO: 5261 - DNA, 18 bp, Artificial Sequence
  Synthetic DNA
taagactgctcactatag

SEQ ID NO: 5262 - DNA, 18 bp, Artificial Sequence
  Synthetic DNA
taagaggactcattatag

SEQ ID NO: 5263 - DNA, 18 bp, Artificial Sequence
  Synthetic DNA
taatacaacccaccatag

SEQ ID NO: 5264 - DNA, 18 bp, Artificial Sequence
  Synthetic DNA
taatacaacgcacaatag

SEQ ID NO: 5265 - DNA, 18 bp, Artificial Sequence
  Synthetic DNA
taatacagcccactatag

SEQ ID NO: 5266 - DNA, 18 bp, Artificial Sequence
  Synthetic DNA
taatacagctgactatag

SEQ ID NO: 5267 - DNA, 18 bp, Artificial Sequence
  Synthetic DNA
taataccactcagtgtag

SEQ ID NO: 5268 - DNA, 18 bp, Artificial Sequence
  Synthetic DNA
taatacgaaccagtatag

SEQ ID NO: 5269 - DNA, 18 bp, Artificial Sequence
  Synthetic DNA
taatacgaccccccatag

SEQ ID NO: 5270 - DNA, 18 bp, Artificial Sequence
  Synthetic DNA
taatacgactcaataggg

SEQ ID NO: 5271 - DNA, 18 bp, Artificial Sequence
  Synthetic DNA
taatacgactcacaatcc

SEQ ID NO: 5272 - DNA, 18 bp, Artificial Sequence
  Synthetic DNA
taatacgactcgatagag

SEQ ID NO: 5273 - DNA, 18 bp, Artificial Sequence
  Synthetic DNA
taatacgactgactaagg

SEQ ID NO: 5274 - DNA, 18 bp, Artificial Sequence
  Synthetic DNA
taatacgactgcctacag

SEQ ID NO: 5275 - DNA, 18 bp, Artificial Sequence
  Synthetic DNA
taatacgacttaagatag

SEQ ID NO: 5276 - DNA, 18 bp, Artificial Sequence
  Synthetic DNA
taatacgacttaccctag

SEQ ID NO: 5277 - DNA, 18 bp, Artificial Sequence
  Synthetic DNA
taatacgagtaactatcg

SEQ ID NO: 5278 - DNA, 18 bp, Artificial Sequence
  Synthetic DNA
taatacgagtcaatatgg

SEQ ID NO: 5279 - DNA, 18 bp, Artificial Sequence
  Synthetic DNA
taatacgagtcacagtag

SEQ ID NO: 5280 - DNA, 18 bp, Artificial Sequence
  Synthetic DNA
taatacgagtgactgtag

SEQ ID NO: 5281 - DNA, 18 bp, Artificial Sequence
  Synthetic DNA
taatacgagttgctatag

SEQ ID NO: 5282 - DNA, 18 bp, Artificial Sequence
  Synthetic DNA
taatacggctacctatag

SEQ ID NO: 5283 - DNA, 18 bp, Artificial Sequence
  Synthetic DNA
taatacgtctcacgatcg

SEQ ID NO: 5284 - DNA, 18 bp, Artificial Sequence
  Synthetic DNA
taatactagttactatag

SEQ ID NO: 5285 - DNA, 18 bp, Artificial Sequence
  Synthetic DNA
taataggaatcagtatag

SEQ ID NO: 5286 - DNA, 18 bp, Artificial Sequence
  Synthetic DNA
taataggagttactatag

SEQ ID NO: 5287 - DNA, 18 bp, Artificial Sequence
  Synthetic DNA
taatatccctcactatag

SEQ ID NO: 5288 - DNA, 18 bp, Artificial Sequence
  Synthetic DNA
taatccgactgactatgg

SEQ ID NO: 5289 - DNA, 18 bp, Artificial Sequence
  Synthetic DNA
taatcggactcactgtag

SEQ ID NO: 5290 - DNA, 18 bp, Artificial Sequence
  Synthetic DNA
taatgcgacccactaaag

SEQ ID NO: 5291 - DNA, 18 bp, Artificial Sequence
  Synthetic DNA
taatgcgacgcactattg

SEQ ID NO: 5292 - DNA, 18 bp, Artificial Sequence
  Synthetic DNA
taatgcgactagctatag

SEQ ID NO: 5293 - DNA, 18 bp, Artificial Sequence
  Synthetic DNA
taatgcgagtcactctag

SEQ ID NO: 5294 - DNA, 18 bp, Artificial Sequence
  Synthetic DNA
taatgcgcctcattatag

SEQ ID NO: 5295 - DNA, 18 bp, Artificial Sequence
  Synthetic DNA
taatgtgactcaccatag

SEQ ID NO: 5296 - DNA, 18 bp, Artificial Sequence
  Synthetic DNA
taattcgactccctatgg

SEQ ID NO: 5297 - DNA, 18 bp, Artificial Sequence
  Synthetic DNA
tactacgacttactatcg

SEQ ID NO: 5298 - DNA, 18 bp, Artificial Sequence
  Synthetic DNA
tactacgagtcacaatag

SEQ ID NO: 5299 - DNA, 18 bp, Artificial Sequence
  Synthetic DNA
tactactactcactacag

SEQ ID NO: 5300 - DNA, 18 bp, Artificial Sequence
  Synthetic DNA
tactccgactcactattg

SEQ ID NO: 5301 - DNA, 18 bp, Artificial Sequence
  Synthetic DNA
taggacgactcaccatag

SEQ ID NO: 5302 - DNA, 18 bp, Artificial Sequence
  Synthetic DNA
taggacgacttactatag

SEQ ID NO: 5303 - DNA, 18 bp, Artificial Sequence
  Synthetic DNA
tagggcgactcactatag

SEQ ID NO: 5304 - DNA, 18 bp, Artificial Sequence
  Synthetic DNA
tagtagggctcactatag

SEQ ID NO: 5305 - DNA, 18 bp, Artificial Sequence
  Synthetic DNA
tatgacgactcaatatag

SEQ ID NO: 5306 - DNA, 18 bp, Artificial Sequence
  Synthetic DNA
tcatgcgactcactctag

SEQ ID NO: 5307 - DNA, 18 bp, Artificial Sequence
  Synthetic DNA
tgatacgactaactatcg

SEQ ID NO: 5308 - DNA, 18 bp, Artificial Sequence
  Synthetic DNA
tgatacgactcgctctag

SEQ ID NO: 5309 - DNA, 18 bp, Artificial Sequence
  Synthetic DNA
tgatacgattcactatgg

SEQ ID NO: 5310 - DNA, 18 bp, Artificial Sequence
  Synthetic DNA
tgatacgcatcactatag

SEQ ID NO: 5311 - DNA, 18 bp, Artificial Sequence
  Synthetic DNA
tgatccgactcaatatag

SEQ ID NO: 5312 - DNA, 18 bp, Artificial Sequence
  Synthetic DNA
tgctaccactcactatag

SEQ ID NO: 5313 - DNA, 18 bp, Artificial Sequence
  Synthetic DNA
ttacacgactcagtatag

SEQ ID NO: 5314 - DNA, 18 bp, Artificial Sequence
  Synthetic DNA
ttatacgacgcactacag

SEQ ID NO: 5315 - DNA, 18 bp, Artificial Sequence
  Synthetic DNA
gattacgacacactatag

SEQ ID NO: 5316 - DNA, 18 bp, Artificial Sequence
  Synthetic DNA
taaaaccactccctatag

SEQ ID NO: 5317 - DNA, 18 bp, Artificial Sequence
  Synthetic DNA
taaaacgactcgctagag

SEQ ID NO: 5318 - DNA, 18 bp, Artificial Sequence
  Synthetic DNA
taagacgactctctaaag

SEQ ID NO: 5319 - DNA, 18 bp, Artificial Sequence
  Synthetic DNA
taatacgaaacaatatag

SEQ ID NO: 5320 - DNA, 18 bp, Artificial Sequence
  Synthetic DNA
taatacgcctcacaatcg

SEQ ID NO: 5321 - DNA, 18 bp, Artificial Sequence
  Synthetic DNA
taatactactcccaatag

SEQ ID NO: 5322 - DNA, 18 bp, Artificial Sequence
  Synthetic DNA
taataggactaactattg

SEQ ID NO: 5323 - DNA, 18 bp, Artificial Sequence
  Synthetic DNA
taataggactcacactag

SEQ ID NO: 5324 - DNA, 18 bp, Artificial Sequence
  Synthetic DNA
tactacgtctgactatag

SEQ ID NO: 5325 - DNA, 18 bp, Artificial Sequence
  Synthetic DNA
tattacgccttactatag

SEQ ID NO: 5326 - DNA, 18 bp, Artificial Sequence
  Synthetic DNA
tgatacgactcagtattg

SEQ ID NO: 5327 - DNA, 18 bp, Artificial Sequence
  Synthetic DNA
ttgtacgactcgctatag

SEQ ID NO: 5328 - DNA, 18 bp, Artificial Sequence
  Synthetic DNA
aattacgactcactttag

SEQ ID NO: 5329 - DNA, 18 bp, Artificial Sequence
  Synthetic DNA
aaatacgaataactatag

SEQ ID NO: 5330 - DNA, 18 bp, Artificial Sequence
  Synthetic DNA
tattacgactcactagtg

SEQ ID NO: 5331 - DNA, 18 bp, Artificial Sequence
  Synthetic DNA
agaaacgactcactatag

SEQ ID NO: 5332 - DNA, 18 bp, Artificial Sequence
  Synthetic DNA
taataagactcacactag

SEQ ID NO: 5333 - DNA, 18 bp, Artificial Sequence
  Synthetic DNA
taatcctacacactatag

SEQ ID NO: 5334 - DNA, 18 bp, Artificial Sequence
  Synthetic DNA
atatacgactcactaaag

SEQ ID NO: 5335 - DNA, 18 bp, Artificial Sequence
  Synthetic DNA
aaataagactcactaaag

SEQ ID NO: 5336 - DNA, 18 bp, Artificial Sequence
  Synthetic DNA
tcatacgtctcactaaag

SEQ ID NO: 5337 - DNA, 18 bp, Artificial Sequence
  Synthetic DNA
aaatacgactcgcaatag

SEQ ID NO: 5338 - DNA, 18 bp, Artificial Sequence
  Synthetic DNA
taataagactctgtatag

SEQ ID NO: 5339 - DNA, 18 bp, Artificial Sequence
  Synthetic DNA
tattaagactcactttag

SEQ ID NO: 5340 - DNA, 18 bp, Artificial Sequence
  Synthetic DNA
taatacaacctactatag

SEQ ID NO: 5341 - DNA, 18 bp, Artificial Sequence
  Synthetic DNA
taatgtgactcactacag

SEQ ID NO: 5342 - DNA, 18 bp, Artificial Sequence
  Synthetic DNA
tgatccgactcactattg

SEQ ID NO: 5343 - DNA, 18 bp, Artificial Sequence
  Synthetic DNA
aaatacgtctcactaaag

SEQ ID NO: 5344 - DNA, 18 bp, Artificial Sequence
  Synthetic DNA
taatacgactcacatttg

SEQ ID NO: 5345 - DNA, 18 bp, Artificial Sequence
  Synthetic DNA
tattaagactcactattg

SEQ ID NO: 5346 - DNA, 18 bp, Artificial Sequence
  Synthetic DNA
taatacatctcactctag

SEQ ID NO: 5347 - DNA, 18 bp, Artificial Sequence
  Synthetic DNA
taataggactcaatattg

SEQ ID NO: 5348 - DNA, 18 bp, Artificial Sequence
  Synthetic DNA
aaataccacttactatag

SEQ ID NO: 5349 - DNA, 18 bp, Artificial Sequence
  Synthetic DNA
taacaccactcacaatag

SEQ ID NO: 5350 - DNA, 18 bp, Artificial Sequence
  Synthetic DNA
taatacggctcattattg

SEQ ID NO: 5351 - DNA, 18 bp, Artificial Sequence
  Synthetic DNA
taatacggctctgtatag

SEQ ID NO: 5352 - DNA, 18 bp, Artificial Sequence
  Synthetic DNA
taatatgactcacaagag

SEQ ID NO: 5353 - DNA, 18 bp, Artificial Sequence
  Synthetic DNA
tacaacgactgactatag

SEQ ID NO: 5354 - DNA, 18 bp, Artificial Sequence
  Synthetic DNA
tcatacgtctcactacag

SEQ ID NO: 5355 - DNA, 18 bp, Artificial Sequence
  Synthetic DNA
tcatatgactaactatag

SEQ ID NO: 5356 - DNA, 18 bp, Artificial Sequence
  Synthetic DNA
ttataccactgactatag

SEQ ID NO: 5357 - DNA, 18 bp, Artificial Sequence
  Synthetic DNA
taatttgactctctatag

SEQ ID NO: 5358 - DNA, 18 bp, Artificial Sequence
  Synthetic DNA
taatacgactcatcattg

SEQ ID NO: 5359 - DNA, 18 bp, Artificial Sequence
  Synthetic DNA
tgatacgtctctctatag

SEQ ID NO: 5360 - DNA, 18 bp, Artificial Sequence
  Synthetic DNA
tattacgactctctaaag

SEQ ID NO: 5361 - DNA, 18 bp, Artificial Sequence
  Synthetic DNA
aattacgactcactacag

SEQ ID NO: 5362 - DNA, 18 bp, Artificial Sequence
  Synthetic DNA
atatacgactcgctatag

SEQ ID NO: 5363 - DNA, 18 bp, Artificial Sequence
  Synthetic DNA
caatactactaactatag

SEQ ID NO: 5364 - DNA, 18 bp, Artificial Sequence
  Synthetic DNA
taatacgacgcacattag

SEQ ID NO: 5365 - DNA, 18 bp, Artificial Sequence
  Synthetic DNA
taatacgacttattacag

SEQ ID NO: 5366 - DNA, 18 bp, Artificial Sequence
  Synthetic DNA
taatatgcctcactttag

SEQ ID NO: 5367 - DNA, 18 bp, Artificial Sequence
  Synthetic DNA
taattcgactacctatag

SEQ ID NO: 5368 - DNA, 18 bp, Artificial Sequence
  Synthetic DNA
tattacgaatcactatcg

SEQ ID NO: 5369 - DNA, 18 bp, Artificial Sequence
  Synthetic DNA
ttatacgactgactacag

SEQ ID NO: 5370 - DNA, 18 bp, Artificial Sequence
  Synthetic DNA
ttatgcgactcaatatag

SEQ ID NO: 5371 - DNA, 18 bp, Artificial Sequence
  Synthetic DNA
agatgcgactcactatag

SEQ ID NO: 5372 - DNA, 18 bp, Artificial Sequence
  Synthetic DNA
taagacgactccctattg

SEQ ID NO: 5373 - DNA, 18 bp, Artificial Sequence
  Synthetic DNA
taataagaatcgctatag

SEQ ID NO: 5374 - DNA, 18 bp, Artificial Sequence
  Synthetic DNA
taataagactgattatag

SEQ ID NO: 5375 - DNA, 18 bp, Artificial Sequence
  Synthetic DNA
taatacaactcaagatag

SEQ ID NO: 5376 - DNA, 18 bp, Artificial Sequence
  Synthetic DNA
taataccacacactgtag

SEQ ID NO: 5377 - DNA, 18 bp, Artificial Sequence
  Synthetic DNA
taatacgactaaagatag

SEQ ID NO: 5378 - DNA, 18 bp, Artificial Sequence
  Synthetic DNA
taatacgactcaatatta

SEQ ID NO: 5379 - DNA, 18 bp, Artificial Sequence
  Synthetic DNA
taatacgattcaccctag

SEQ ID NO: 5380 - DNA, 18 bp, Artificial Sequence
  Synthetic DNA
taatacgcctcactgaag

SEQ ID NO: 5381 - DNA, 18 bp, Artificial Sequence
  Synthetic DNA
taatacgcctcagtttag

SEQ ID NO: 5382 - DNA, 18 bp, Artificial Sequence
  Synthetic DNA
taatacgtatgactatag

SEQ ID NO: 5383 - DNA, 18 bp, Artificial Sequence
  Synthetic DNA
taatacgtctcaccctag

SEQ ID NO: 5384 - DNA, 18 bp, Artificial Sequence
  Synthetic DNA
taatactactaactatgg

SEQ ID NO: 5385 - DNA, 18 bp, Artificial Sequence
  Synthetic DNA
taatactcctcactctag

SEQ ID NO: 5386 - DNA, 18 bp, Artificial Sequence
  Synthetic DNA
taataggactcacaatgg

SEQ ID NO: 5387 - DNA, 18 bp, Artificial Sequence
  Synthetic DNA
taatatgagtcactaaag

SEQ ID NO: 5388 - DNA, 18 bp, Artificial Sequence
  Synthetic DNA
taatccgactaactatcg

SEQ ID NO: 5389 - DNA, 18 bp, Artificial Sequence
  Synthetic DNA
taatccgattcactgtag

SEQ ID NO: 5390 - DNA, 18 bp, Artificial Sequence
  Synthetic DNA
taatccgtctcactatgg

SEQ ID NO: 5391 - DNA, 18 bp, Artificial Sequence
  Synthetic DNA
taatgagactcactagag

SEQ ID NO: 5392 - DNA, 18 bp, Artificial Sequence
  Synthetic DNA
tactacgactcattatcg

SEQ ID NO: 5393 - DNA, 18 bp, Artificial Sequence
  Synthetic DNA
tactacgagtcactaaag

SEQ ID NO: 5394 - DNA, 18 bp, Artificial Sequence
  Synthetic DNA
tagtacgacccaccatag

SEQ ID NO: 5395 - DNA, 18 bp, Artificial Sequence
  Synthetic DNA
tagtacgattcaccatag

SEQ ID NO: 5396 - DNA, 18 bp, Artificial Sequence
  Synthetic DNA
tcatgcgactcacaatag

SEQ ID NO: 5397 - DNA, 18 bp, Artificial Sequence
  Synthetic DNA
tgacacgactcactatcg

SEQ ID NO: 5398 - DNA, 18 bp, Artificial Sequence
  Synthetic DNA
tgacacgactcactattg

SEQ ID NO: 5399 - DNA, 18 bp, Artificial Sequence
  Synthetic DNA
tgatacgactaagtatag

SEQ ID NO: 5400 - DNA, 18 bp, Artificial Sequence
  Synthetic DNA
ttatacgactcactggag

SEQ ID NO: 5401 - DNA, 18 bp, Artificial Sequence
  Synthetic DNA
taataagactcactaatg

SEQ ID NO: 5402 - DNA, 18 bp, Artificial Sequence
  Synthetic DNA
ttacacgattcactatag

SEQ ID NO: 5403 - DNA, 18 bp, Artificial Sequence
  Synthetic DNA
caattcgtctcactatag

SEQ ID NO: 5404 - DNA, 18 bp, Artificial Sequence
  Synthetic DNA
taataccactctttatag

SEQ ID NO: 5405 - DNA, 18 bp, Artificial Sequence
  Synthetic DNA
ctatacgactcactaaag

SEQ ID NO: 5406 - DNA, 18 bp, Artificial Sequence
  Synthetic DNA
taatacgacttacaacag

SEQ ID NO: 5407 - DNA, 18 bp, Artificial Sequence
  Synthetic DNA
aaatactactccctatag

SEQ ID NO: 5408 - DNA, 18 bp, Artificial Sequence
  Synthetic DNA
caataagtctcactatag

SEQ ID NO: 5409 - DNA, 18 bp, Artificial Sequence
  Synthetic DNA
ctatacgaatcactatag

SEQ ID NO: 5410 - DNA, 18 bp, Artificial Sequence
  Synthetic DNA
taaaacgacgctctatag

SEQ ID NO: 5411 - DNA, 18 bp, Artificial Sequence
  Synthetic DNA
taaaagaactcactatag

SEQ ID NO: 5412 - DNA, 18 bp, Artificial Sequence
  Synthetic DNA
taactcgactcattatag

SEQ ID NO: 5413 - DNA, 18 bp, Artificial Sequence
  Synthetic DNA
taatacaacgcactattg

SEQ ID NO: 5414 - DNA, 18 bp, Artificial Sequence
  Synthetic DNA
taatacaactcaatatgg

SEQ ID NO: 5415 - DNA, 18 bp, Artificial Sequence
  Synthetic DNA
taatacgaatcacagtag

SEQ ID NO: 5416 - DNA, 18 bp, Artificial Sequence
  Synthetic DNA
taatacgacagactctag

SEQ ID NO: 5417 - DNA, 18 bp, Artificial Sequence
  Synthetic DNA
taatacgactcaatagtg

SEQ ID NO: 5418 - DNA, 18 bp, Artificial Sequence
  Synthetic DNA
taatacgactgactaccg

SEQ ID NO: 5419 - DNA, 18 bp, Artificial Sequence
  Synthetic DNA
taatacggctcgctttag

SEQ ID NO: 5420 - DNA, 18 bp, Artificial Sequence
  Synthetic DNA
taatacgtgtcaatatag

SEQ ID NO: 5421 - DNA, 18 bp, Artificial Sequence
  Synthetic DNA
taatgagactcaccatag

SEQ ID NO: 5422 - DNA, 18 bp, Artificial Sequence
  Synthetic DNA
tgataccactcacaatag

SEQ ID NO: 5423 - DNA, 18 bp, Artificial Sequence
  Synthetic DNA
tgatacgactcattctag

SEQ ID NO: 5424 - DNA, 18 bp, Artificial Sequence
  Synthetic DNA
ttatacgactaactacag

SEQ ID NO: 5425 - DNA, 18 bp, Artificial Sequence
  Synthetic DNA
taaatcgactcactattg

SEQ ID NO: 5426 - DNA, 18 bp, Artificial Sequence
  Synthetic DNA
taataagactaactttag

SEQ ID NO: 5427 - DNA, 18 bp, Artificial Sequence
  Synthetic DNA
taatccgacacactttag

SEQ ID NO: 5428 - DNA, 18 bp, Artificial Sequence
  Synthetic DNA
tcatacaactctctatag

SEQ ID NO: 5429 - DNA, 18 bp, Artificial Sequence
  Synthetic DNA
taatacgaatcactcaag

SEQ ID NO: 5430 - DNA, 18 bp, Artificial Sequence
  Synthetic DNA
taatacgcttcactaaag

SEQ ID NO: 5431 - DNA, 18 bp, Artificial Sequence
  Synthetic DNA
taatatgactcaaaatag

SEQ ID NO: 5432 - DNA, 18 bp, Artificial Sequence
  Synthetic DNA
tagtacgtcttactatag

SEQ ID NO: 5433 - DNA, 18 bp, Artificial Sequence
  Synthetic DNA
tattacgaatcgctatag

SEQ ID NO: 5434 - DNA, 18 bp, Artificial Sequence
  Synthetic DNA
tgttacgactaactatag

SEQ ID NO: 5435 - DNA, 18 bp, Artificial Sequence
  Synthetic DNA
aaataccactcactattg

SEQ ID NO: 5436 - DNA, 18 bp, Artificial Sequence
  Synthetic DNA
taaaaggactcactttag

SEQ ID NO: 5437 - DNA, 18 bp, Artificial Sequence
  Synthetic DNA
taatacaactcagtttag

SEQ ID NO: 5438 - DNA, 18 bp, Artificial Sequence
  Synthetic DNA
taatactactacctatag

SEQ ID NO: 5439 - DNA, 18 bp, Artificial Sequence
  Synthetic DNA
taatccgactcaatattg

SEQ ID NO: 5440 - DNA, 18 bp, Artificial Sequence
  Synthetic DNA
tatcaagactcactatag

SEQ ID NO: 5441 - DNA, 18 bp, Artificial Sequence
  Synthetic DNA
tattgcgaatcactatag

SEQ ID NO: 5442 - DNA, 18 bp, Artificial Sequence
  Synthetic DNA
taatacgcctaactattg

SEQ ID NO: 5443 - DNA, 18 bp, Artificial Sequence
  Synthetic DNA
taattcgacacaccatag

SEQ ID NO: 5444 - DNA, 18 bp, Artificial Sequence
  Synthetic DNA
taattcgactcattacag

SEQ ID NO: 5445 - DNA, 18 bp, Artificial Sequence
  Synthetic DNA
taattcgactgactaaag

SEQ ID NO: 5446 - DNA, 18 bp, Artificial Sequence
  Synthetic DNA
taatgcaactcacaatag

SEQ ID NO: 5447 - DNA, 18 bp, Artificial Sequence
  Synthetic DNA
ttatacaactcaatatag

SEQ ID NO: 5448 - DNA, 18 bp, Artificial Sequence
  Synthetic DNA
taattcaactcactaaag

SEQ ID NO: 5449 - DNA, 18 bp, Artificial Sequence
  Synthetic DNA
tattacgactcaccattg

SEQ ID NO: 5450 - DNA, 18 bp, Artificial Sequence
  Synthetic DNA
taatacgtttcactttag

SEQ ID NO: 5451 - DNA, 18 bp, Artificial Sequence
  Synthetic DNA
tactacgacactctatag

SEQ ID NO: 5452 - DNA, 18 bp, Artificial Sequence
  Synthetic DNA
taatacgacgctctattg

SEQ ID NO: 5453 - DNA, 18 bp, Artificial Sequence
  Synthetic DNA
taaagctactcactatag

SEQ ID NO: 5454 - DNA, 18 bp, Artificial Sequence
  Synthetic DNA
tacttcgtctcactatag

SEQ ID NO: 5455 - DNA, 18 bp, Artificial Sequence
  Synthetic DNA
taatacgactctccctag

SEQ ID NO: 5456 - DNA, 18 bp, Artificial Sequence
  Synthetic DNA
taatacgagtcaatttag

SEQ ID NO: 5457 - DNA, 18 bp, Artificial Sequence
  Synthetic DNA
taatacgcatctctatag

SEQ ID NO: 5458 - DNA, 18 bp, Artificial Sequence
  Synthetic DNA
taatccaactctctatag

SEQ ID NO: 5459 - DNA, 18 bp, Artificial Sequence
  Synthetic DNA
tattacgactctgtatag

SEQ ID NO: 5460 - DNA, 18 bp, Artificial Sequence
  Synthetic DNA
aaatccgtctcactatag

SEQ ID NO: 5461 - DNA, 18 bp, Artificial Sequence
  Synthetic DNA
caataagactcattatag

SEQ ID NO: 5462 - DNA, 18 bp, Artificial Sequence
  Synthetic DNA
taatgtgacttactatag

SEQ ID NO: 5463 - DNA, 18 bp, Artificial Sequence
  Synthetic DNA
tattacgactaactctag

SEQ ID NO: 5464 - DNA, 18 bp, Artificial Sequence
  Synthetic DNA
tattacgacttactctag

SEQ ID NO: 5465 - DNA, 18 bp, Artificial Sequence
  Synthetic DNA
tattacgacttagtatag

SEQ ID NO: 5466 - DNA, 18 bp, Artificial Sequence
  Synthetic DNA
tgatacgacacaatatag

SEQ ID NO: 5467 - DNA, 18 bp, Artificial Sequence
  Synthetic DNA
tgatacgactcaatttag

SEQ ID NO: 5468 - DNA, 18 bp, Artificial Sequence
  Synthetic DNA
acatacgactaactatag

SEQ ID NO: 5469 - DNA, 18 bp, Artificial Sequence
  Synthetic DNA
taataccaatcattatag

SEQ ID NO: 5470 - DNA, 18 bp, Artificial Sequence
  Synthetic DNA
taatacgaatcactaacg

SEQ ID NO: 5471 - DNA, 18 bp, Artificial Sequence
  Synthetic DNA
taatacgacccaccatgg

SEQ ID NO: 5472 - DNA, 18 bp, Artificial Sequence
  Synthetic DNA
taatatcattcactatag

SEQ ID NO: 5473 - DNA, 18 bp, Artificial Sequence
  Synthetic DNA
taatatgacccactattg

SEQ ID NO: 5474 - DNA, 18 bp, Artificial Sequence
  Synthetic DNA
taatatgcctcacaatag

SEQ ID NO: 5475 - DNA, 18 bp, Artificial Sequence
  Synthetic DNA
taatgcgactgactattg

SEQ ID NO: 5476 - DNA, 18 bp, Artificial Sequence
  Synthetic DNA
taattcgactccctacag

SEQ ID NO: 5477 - DNA, 18 bp, Artificial Sequence
  Synthetic DNA
taattcgactctcgatag

SEQ ID NO: 5478 - DNA, 18 bp, Artificial Sequence
  Synthetic DNA
tactacgactcaataaag

SEQ ID NO: 5479 - DNA, 18 bp, Artificial Sequence
  Synthetic DNA
tactacgattcactaaag

SEQ ID NO: 5480 - DNA, 18 bp, Artificial Sequence
  Synthetic DNA
tagtacgactaactattg

SEQ ID NO: 5481 - DNA, 18 bp, Artificial Sequence
  Synthetic DNA
tcatacgacccactaaag

SEQ ID NO: 5482 - DNA, 18 bp, Artificial Sequence
  Synthetic DNA
aaagacgactcactattg

SEQ ID NO: 5483 - DNA, 18 bp, Artificial Sequence
  Synthetic DNA
gtatacgactctctatag

SEQ ID NO: 5484 - DNA, 18 bp, Artificial Sequence
  Synthetic DNA
taaaaccagtcactatag

SEQ ID NO: 5485 - DNA, 18 bp, Artificial Sequence
  Synthetic DNA
taaaacgacccactgtag

SEQ ID NO: 5486 - DNA, 18 bp, Artificial Sequence
  Synthetic DNA
taaaacgactgactgtag

SEQ ID NO: 5487 - DNA, 18 bp, Artificial Sequence
  Synthetic DNA
taaaacgcctcagtatag

SEQ ID NO: 5488 - DNA, 18 bp, Artificial Sequence
  Synthetic DNA
taaaaggactcactatgg

SEQ ID NO: 5489 - DNA, 18 bp, Artificial Sequence
  Synthetic DNA
taacacggctcactattg

SEQ ID NO: 5490 - DNA, 18 bp, Artificial Sequence
  Synthetic DNA
taatacaacttcctatag

SEQ ID NO: 5491 - DNA, 18 bp, Artificial Sequence
  Synthetic DNA
taataccactcactaccg

SEQ ID NO: 5492 - DNA, 18 bp, Artificial Sequence
  Synthetic DNA
taatacgactaaatacag

SEQ ID NO: 5493 - DNA, 18 bp, Artificial Sequence
  Synthetic DNA
taatacgagacactgtag

SEQ ID NO: 5494 - DNA, 18 bp, Artificial Sequence
  Synthetic DNA
taatacgagccaccatag

SEQ ID NO: 5495 - DNA, 18 bp, Artificial Sequence
  Synthetic DNA
taatacgagtaactatgg

SEQ ID NO: 5496 - DNA, 18 bp, Artificial Sequence
  Synthetic DNA
taatacgccttactacag

SEQ ID NO: 5497 - DNA, 18 bp, Artificial Sequence
  Synthetic DNA
taatactagtcactatgg

SEQ ID NO: 5498 - DNA, 18 bp, Artificial Sequence
  Synthetic DNA
taatagcactcactgtag

SEQ ID NO: 5499 - DNA, 18 bp, Artificial Sequence
  Synthetic DNA
taataggactgactttag

SEQ ID NO: 5500 - DNA, 18 bp, Artificial Sequence
  Synthetic DNA
taatagtactcaccatag

SEQ ID NO: 5501 - DNA, 18 bp, Artificial Sequence
  Synthetic DNA
taatatgactaactagag

SEQ ID NO: 5502 - DNA, 18 bp, Artificial Sequence
  Synthetic DNA
taatccgaatcactacag

SEQ ID NO: 5503 - DNA, 18 bp, Artificial Sequence
  Synthetic DNA
taatgccactcattatag

SEQ ID NO: 5504 - DNA, 18 bp, Artificial Sequence
  Synthetic DNA
taatgcgtctccctatag

SEQ ID NO: 5505 - DNA, 18 bp, Artificial Sequence
  Synthetic DNA
taattcgacccactctag

SEQ ID NO: 5506 - DNA, 18 bp, Artificial Sequence
  Synthetic DNA
tactaccaatcactatag

SEQ ID NO: 5507 - DNA, 18 bp, Artificial Sequence
  Synthetic DNA
tactaccactcgctatag

SEQ ID NO: 5508 - DNA, 18 bp, Artificial Sequence
  Synthetic DNA
tagtacgactcataatag

SEQ ID NO: 5509 - DNA, 18 bp, Artificial Sequence
  Synthetic DNA
tagtacgtctcactatgg

SEQ ID NO: 5510 - DNA, 18 bp, Artificial Sequence
  Synthetic DNA
tattacgactcacgttag

SEQ ID NO: 5511 - DNA, 18 bp, Artificial Sequence
  Synthetic DNA
tcatatgactcactctag

SEQ ID NO: 5512 - DNA, 18 bp, Artificial Sequence
  Synthetic DNA
tgatacgactcgctacag

SEQ ID NO: 5513 - DNA, 18 bp, Artificial Sequence
  Synthetic DNA
tgatacgtctgactatag

SEQ ID NO: 5514 - DNA, 18 bp, Artificial Sequence
  Synthetic DNA
ttagactactcactatag

SEQ ID NO: 5515 - DNA, 18 bp, Artificial Sequence
  Synthetic DNA
ttatacgacccagtatag

SEQ ID NO: 5516 - DNA, 18 bp, Artificial Sequence
  Synthetic DNA
ttgtacgactgactatag

SEQ ID NO: 5517 - DNA, 18 bp, Artificial Sequence
  Synthetic DNA
aaataccactcactacag

SEQ ID NO: 5518 - DNA, 18 bp, Artificial Sequence
  Synthetic DNA
aaatacgactctctataa

SEQ ID NO: 5519 - DNA, 18 bp, Artificial Sequence
  Synthetic DNA
aaatccgactcagtatag

SEQ ID NO: 5520 - DNA, 18 bp, Artificial Sequence
  Synthetic DNA
caataagactgactatag

SEQ ID NO: 5521 - DNA, 18 bp, Artificial Sequence
  Synthetic DNA
caatacgacgcaatatag

SEQ ID NO: 5522 - DNA, 18 bp, Artificial Sequence
  Synthetic DNA
caatacgactgaatatag

SEQ ID NO: 5523 - DNA, 18 bp, Artificial Sequence
  Synthetic DNA
caatacggctcagtatag

SEQ ID NO: 5524 - DNA, 18 bp, Artificial Sequence
  Synthetic DNA
cactacgactcactagag

SEQ ID NO: 5525 - DNA, 18 bp, Artificial Sequence
  Synthetic DNA
cactacgacttactatag

SEQ ID NO: 5526 - DNA, 18 bp, Artificial Sequence
  Synthetic DNA
cactacgcctcactatag

SEQ ID NO: 5527 - DNA, 18 bp, Artificial Sequence
  Synthetic DNA
cattacgactcaccatag

SEQ ID NO: 5528 - DNA, 18 bp, Artificial Sequence
  Synthetic DNA
ccatatgactcactatag

SEQ ID NO: 5529 - DNA, 18 bp, Artificial Sequence
  Synthetic DNA
gaaaacgactcgctatag

SEQ ID NO: 5530 - DNA, 18 bp, Artificial Sequence
  Synthetic DNA
gaataccactccctatag

SEQ ID NO: 5531 - DNA, 18 bp, Artificial Sequence
  Synthetic DNA
gaatacgaatcacaatag

SEQ ID NO: 5532 - DNA, 18 bp, Artificial Sequence
  Synthetic DNA
gaatacgactaattatag

SEQ ID NO: 5533 - DNA, 18 bp, Artificial Sequence
  Synthetic DNA
gaatacgactttctatag

SEQ ID NO: 5534 - DNA, 18 bp, Artificial Sequence
  Synthetic DNA
gaatcagactcactatag

SEQ ID NO: 5535 - DNA, 18 bp, Artificial Sequence
  Synthetic DNA
gaattcgagtcactatag

SEQ ID NO: 5536 - DNA, 18 bp, Artificial Sequence
  Synthetic DNA
taaaacgactcaatagag

SEQ ID NO: 5537 - DNA, 18 bp, Artificial Sequence
  Synthetic DNA
taaaacgactccctacag

SEQ ID NO: 5538 - DNA, 18 bp, Artificial Sequence
  Synthetic DNA
taacaagactcactatcg

SEQ ID NO: 5539 - DNA, 18 bp, Artificial Sequence
  Synthetic DNA
taacacaagtcactatag

SEQ ID NO: 5540 - DNA, 18 bp, Artificial Sequence
  Synthetic DNA
taacacgactaactacag

SEQ ID NO: 5541 - DNA, 18 bp, Artificial Sequence
  Synthetic DNA
taacacgactcactagtg

SEQ ID NO: 5542 - DNA, 18 bp, Artificial Sequence
  Synthetic DNA
taacacgcctcaccatag

SEQ ID NO: 5543 - DNA, 18 bp, Artificial Sequence
  Synthetic DNA
taagaccactaactatag

SEQ ID NO: 5544 - DNA, 18 bp, Artificial Sequence
  Synthetic DNA
taagacgattccctatag

SEQ ID NO: 5545 - DNA, 18 bp, Artificial Sequence
  Synthetic DNA
taataacactcactatgg

SEQ ID NO: 5546 - DNA, 18 bp, Artificial Sequence
  Synthetic DNA
taataagaatcaccatag

SEQ ID NO: 5547 - DNA, 18 bp, Artificial Sequence
  Synthetic DNA
taataccacgcactaaag

SEQ ID NO: 5548 - DNA, 18 bp, Artificial Sequence
  Synthetic DNA
taataccactcagcatag

SEQ ID NO: 5549 - DNA, 18 bp, Artificial Sequence
  Synthetic DNA
taataccgctcactagag

SEQ ID NO: 5550 - DNA, 18 bp, Artificial Sequence
  Synthetic DNA
taatacgaaccgctatag

SEQ ID NO: 5551 - DNA, 18 bp, Artificial Sequence
  Synthetic DNA
taatacgaatcattgtag

SEQ ID NO: 5552 - DNA, 18 bp, Artificial Sequence
  Synthetic DNA
taatacgacccacactag

SEQ ID NO: 5553 - DNA, 18 bp, Artificial Sequence
  Synthetic DNA
taatacgacgaactatcg

SEQ ID NO: 5554 - DNA, 18 bp, Artificial Sequence
  Synthetic DNA
taatacgacgcacgttag

SEQ ID NO: 5555 - DNA, 18 bp, Artificial Sequence
  Synthetic DNA
taatacgacgcgcaatag

SEQ ID NO: 5556 - DNA, 18 bp, Artificial Sequence
  Synthetic DNA
taatacgactaagtacag

SEQ ID NO: 5557 - DNA, 18 bp, Artificial Sequence
  Synthetic DNA
taatacgactcagtgtcg

SEQ ID NO: 5558 - DNA, 18 bp, Artificial Sequence
  Synthetic DNA
taatacgacttacgatcg

SEQ ID NO: 5559 - DNA, 18 bp, Artificial Sequence
  Synthetic DNA
taatacgatccaatatag

SEQ ID NO: 5560 - DNA, 18 bp, Artificial Sequence
  Synthetic DNA
taatacgatgccctatag

SEQ ID NO: 5561 - DNA, 18 bp, Artificial Sequence
  Synthetic DNA
taatacgatgtactatag

SEQ ID NO: 5562 - DNA, 18 bp, Artificial Sequence
  Synthetic DNA
taatacgcctcaccctag

SEQ ID NO: 5563 - DNA, 18 bp, Artificial Sequence
  Synthetic DNA
taatacgcctcattacag

SEQ ID NO: 5564 - DNA, 18 bp, Artificial Sequence
  Synthetic DNA
taatacgcgtcactatgg

SEQ ID NO: 5565 - DNA, 18 bp, Artificial Sequence
  Synthetic DNA
taatacggatcactgtag

SEQ ID NO: 5566 - DNA, 18 bp, Artificial Sequence
  Synthetic DNA
taatacggcgcactttag

SEQ ID NO: 5567 - DNA, 18 bp, Artificial Sequence
  Synthetic DNA
taatacggctgactatcg

SEQ ID NO: 5568 - DNA, 18 bp, Artificial Sequence
  Synthetic DNA
taatacgtcccactgtag

SEQ ID NO: 5569 - DNA, 18 bp, Artificial Sequence
  Synthetic DNA
taatacgtctcactagcg

SEQ ID NO: 5570 - DNA, 18 bp, Artificial Sequence
  Synthetic DNA
taatactacacacgatag

SEQ ID NO: 5571 - DNA, 18 bp, Artificial Sequence
  Synthetic DNA
taataggacgcactttag

SEQ ID NO: 5572 - DNA, 18 bp, Artificial Sequence
  Synthetic DNA
taataggacttattatag

SEQ ID NO: 5573 - DNA, 18 bp, Artificial Sequence
  Synthetic DNA
taataggcctcaatatag

SEQ ID NO: 5574 - DNA, 18 bp, Artificial Sequence
  Synthetic DNA
taatatgactcgctatgg

SEQ ID NO: 5575 - DNA, 18 bp, Artificial Sequence
  Synthetic DNA
taatatgcctcactaaag

SEQ ID NO: 5576 - DNA, 18 bp, Artificial Sequence
  Synthetic DNA
taatcccactcagtatag

SEQ ID NO: 5577 - DNA, 18 bp, Artificial Sequence
  Synthetic DNA
taatcggacgcactatag

SEQ ID NO: 5578 - DNA, 18 bp, Artificial Sequence
  Synthetic DNA
taatgcgactccttatag

SEQ ID NO: 5579 - DNA, 18 bp, Artificial Sequence
  Synthetic DNA
taatgcgactgaatatag

SEQ ID NO: 5580 - DNA, 18 bp, Artificial Sequence
  Synthetic DNA
taatgcggcttactatag

SEQ ID NO: 5581 - DNA, 18 bp, Artificial Sequence
  Synthetic DNA
tactactacccactatag

SEQ ID NO: 5582 - DNA, 18 bp, Artificial Sequence
  Synthetic DNA
tagcacgcctcactatag

SEQ ID NO: 5583 - DNA, 18 bp, Artificial Sequence
  Synthetic DNA
tagtacgacgcacaatag

SEQ ID NO: 5584 - DNA, 18 bp, Artificial Sequence
  Synthetic DNA
tagtaggacgcactatag

SEQ ID NO: 5585 - DNA, 18 bp, Artificial Sequence
  Synthetic DNA
tagtccgacgcactatag

SEQ ID NO: 5586 - DNA, 18 bp, Artificial Sequence
  Synthetic DNA
tagtccgactcactaaag

SEQ ID NO: 5587 - DNA, 18 bp, Artificial Sequence
  Synthetic DNA
tattccgactcactgtag

SEQ ID NO: 5588 - DNA, 18 bp, Artificial Sequence
  Synthetic DNA
tcatacaacccactatag

SEQ ID NO: 5589 - DNA, 18 bp, Artificial Sequence
  Synthetic DNA
tcatacgaatcaatatag

SEQ ID NO: 5590 - DNA, 18 bp, Artificial Sequence
  Synthetic DNA
tcatacgactcactatta

SEQ ID NO: 5591 - DNA, 18 bp, Artificial Sequence
  Synthetic DNA
tcatacggctctctatag

SEQ ID NO: 5592 - DNA, 18 bp, Artificial Sequence
  Synthetic DNA
tcatccgaatcactatag

SEQ ID NO: 5593 - DNA, 18 bp, Artificial Sequence
  Synthetic DNA
tcctacgacttactatag

SEQ ID NO: 5594 - DNA, 18 bp, Artificial Sequence
  Synthetic DNA
tgatacaactcactatgg

SEQ ID NO: 5595 - DNA, 18 bp, Artificial Sequence
  Synthetic DNA
tgatacgactcattatcg

SEQ ID NO: 5596 - DNA, 18 bp, Artificial Sequence
  Synthetic DNA
tgatgcggctcactatag

SEQ ID NO: 5597 - DNA, 18 bp, Artificial Sequence
  Synthetic DNA
ttagacgactcagtatag

SEQ ID NO: 5598 - DNA, 18 bp, Artificial Sequence
  Synthetic DNA
aaattcgaatcactatag

SEQ ID NO: 5599 - DNA, 18 bp, Artificial Sequence
  Synthetic DNA
ttatgcgattcactatag

SEQ ID NO: 5600 - DNA, 18 bp, Artificial Sequence
  Synthetic DNA
ttatacaactctctatag

SEQ ID NO: 5601 - DNA, 18 bp, Artificial Sequence
  Synthetic DNA
aaatacgtctctctatag

SEQ ID NO: 5602 - DNA, 18 bp, Artificial Sequence
  Synthetic DNA
tgatacgtctcactattg

SEQ ID NO: 5603 - DNA, 18 bp, Artificial Sequence
  Synthetic DNA
aagtacgactcacaatag

SEQ ID NO: 5604 - DNA, 18 bp, Artificial Sequence
  Synthetic DNA
taaaacgactccctttag

SEQ ID NO: 5605 - DNA, 18 bp, Artificial Sequence
  Synthetic DNA
taatacgtctcaatatcg

SEQ ID NO: 5606 - DNA, 18 bp, Artificial Sequence
  Synthetic DNA
tattacgactcacttgag

SEQ ID NO: 5607 - DNA, 18 bp, Artificial Sequence
  Synthetic DNA
agattcgactcactatag

SEQ ID NO: 5608 - DNA, 18 bp, Artificial Sequence
  Synthetic DNA
taaaacgagtcacaatag

SEQ ID NO: 5609 - DNA, 18 bp, Artificial Sequence
  Synthetic DNA
taagtctactcactatag

SEQ ID NO: 5610 - DNA, 18 bp, Artificial Sequence
  Synthetic DNA
taatacgaatcactactg

SEQ ID NO: 5611 - DNA, 18 bp, Artificial Sequence
  Synthetic DNA
taatacgactctgcatag

SEQ ID NO: 5612 - DNA, 18 bp, Artificial Sequence
  Synthetic DNA
taattagaatcactatag

SEQ ID NO: 5613 - DNA, 18 bp, Artificial Sequence
  Synthetic DNA
taattcgactcgcaatag

SEQ ID NO: 5614 - DNA, 18 bp, Artificial Sequence
  Synthetic DNA
taatacgtcacactgtag

SEQ ID NO: 5615 - DNA, 18 bp, Artificial Sequence
  Synthetic DNA
tactacgactctctaaag

SEQ ID NO: 5616 - DNA, 18 bp, Artificial Sequence
  Synthetic DNA
aaatacgattcactatcg

SEQ ID NO: 5617 - DNA, 18 bp, Artificial Sequence
  Synthetic DNA
taatccgaaacactatag

SEQ ID NO: 5618 - DNA, 18 bp, Artificial Sequence
  Synthetic DNA
taatgcgacttaatatag

SEQ ID NO: 5619 - DNA, 18 bp, Artificial Sequence
  Synthetic DNA
taatgcgtctcactacag

SEQ ID NO: 5620 - DNA, 18 bp, Artificial Sequence
  Synthetic DNA
tcatacgattctctatag

SEQ ID NO: 5621 - DNA, 18 bp, Artificial Sequence
  Synthetic DNA
ttacacaactcactatag

SEQ ID NO: 5622 - DNA, 18 bp, Artificial Sequence
  Synthetic DNA
aaatatgactcacaatag

SEQ ID NO: 5623 - DNA, 18 bp, Artificial Sequence
  Synthetic DNA
taataccactcactaatg

SEQ ID NO: 5624 - DNA, 18 bp, Artificial Sequence
  Synthetic DNA
taatgcgactctctattg

SEQ ID NO: 5625 - DNA, 18 bp, Artificial Sequence
  Synthetic DNA
aaatatgactcaatatag

SEQ ID NO: 5626 - DNA, 18 bp, Artificial Sequence
  Synthetic DNA
taaaacgacaccctatag

SEQ ID NO: 5627 - DNA, 18 bp, Artificial Sequence
  Synthetic DNA
taatacgaaccactttag

SEQ ID NO: 5628 - DNA, 18 bp, Artificial Sequence
  Synthetic DNA
taatacgactcagtactg

SEQ ID NO: 5629 - DNA, 18 bp, Artificial Sequence
  Synthetic DNA
taatactattcactgtag

SEQ ID NO: 5630 - DNA, 18 bp, Artificial Sequence
  Synthetic DNA
tactacgcctcactttag

SEQ ID NO: 5631 - DNA, 18 bp, Artificial Sequence
  Synthetic DNA
tattaagactgactatag

SEQ ID NO: 5632 - DNA, 18 bp, Artificial Sequence
  Synthetic DNA
tattacgactcactaccg

SEQ ID NO: 5633 - DNA, 18 bp, Artificial Sequence
  Synthetic DNA
tattgcgactaactatag

SEQ ID NO: 5634 - DNA, 18 bp, Artificial Sequence
  Synthetic DNA
tcttacgactcattatag

SEQ ID NO: 5635 - DNA, 18 bp, Artificial Sequence
  Synthetic DNA
ttatacgactccctatgg

SEQ ID NO: 5636 - DNA, 18 bp, Artificial Sequence
  Synthetic DNA
taaaacaactcactaaag

SEQ ID NO: 5637 - DNA, 18 bp, Artificial Sequence
  Synthetic DNA
taatataactcactttag

SEQ ID NO: 5638 - DNA, 18 bp, Artificial Sequence
  Synthetic DNA
atatacgactcagtatag

SEQ ID NO: 5639 - DNA, 18 bp, Artificial Sequence
  Synthetic DNA
taatatgcctctctatag

SEQ ID NO: 5640 - DNA, 18 bp, Artificial Sequence
  Synthetic DNA
tattacgactcaatgtag

SEQ ID NO: 5641 - DNA, 18 bp, Artificial Sequence
  Synthetic DNA
ttatacgactcgatatag

SEQ ID NO: 5642 - DNA, 18 bp, Artificial Sequence
  Synthetic DNA
ttatacgactgacaatag

SEQ ID NO: 5643 - DNA, 18 bp, Artificial Sequence
  Synthetic DNA
taaaacgactcacttcag

SEQ ID NO: 5644 - DNA, 18 bp, Artificial Sequence
  Synthetic DNA
taatacgtttcaccatag

SEQ ID NO: 5645 - DNA, 18 bp, Artificial Sequence
  Synthetic DNA
taatacatctcaatatag

SEQ ID NO: 5646 - DNA, 18 bp, Artificial Sequence
  Synthetic DNA
taatccgtctcactaaag

SEQ ID NO: 5647 - DNA, 18 bp, Artificial Sequence
  Synthetic DNA
taatacgactcacattcg

SEQ ID NO: 5648 - DNA, 18 bp, Artificial Sequence
  Synthetic DNA
taataagactcagtaaag

SEQ ID NO: 5649 - DNA, 18 bp, Artificial Sequence
  Synthetic DNA
taatactactcacgttag

SEQ ID NO: 5650 - DNA, 18 bp, Artificial Sequence
  Synthetic DNA
taatatgtctcactacag

SEQ ID NO: 5651 - DNA, 18 bp, Artificial Sequence
  Synthetic DNA
tactacgactcactcttg

SEQ ID NO: 5652 - DNA, 18 bp, Artificial Sequence
  Synthetic DNA
tgatacgacttactacag

SEQ ID NO: 5653 - DNA, 18 bp, Artificial Sequence
  Synthetic DNA
ttatccgactcactatcg

SEQ ID NO: 5654 - DNA, 18 bp, Artificial Sequence
  Synthetic DNA
ttgtacgactcactatcg

SEQ ID NO: 5655 - DNA, 18 bp, Artificial Sequence
  Synthetic DNA
aaatacgcctcaccatag

SEQ ID NO: 5656 - DNA, 18 bp, Artificial Sequence
  Synthetic DNA
aaataggactcactacag

SEQ ID NO: 5657 - DNA, 18 bp, Artificial Sequence
  Synthetic DNA
caatacgacccagtatag

SEQ ID NO: 5658 - DNA, 18 bp, Artificial Sequence
  Synthetic DNA
caatacggctcattatag

SEQ ID NO: 5659 - DNA, 18 bp, Artificial Sequence
  Synthetic DNA
caatactactcaatatag

SEQ ID NO: 5660 - DNA, 18 bp, Artificial Sequence
  Synthetic DNA
cactacaactcactatag

SEQ ID NO: 5661 - DNA, 18 bp, Artificial Sequence
  Synthetic DNA
gaatacgtctcactaaag

SEQ ID NO: 5662 - DNA, 18 bp, Artificial Sequence
  Synthetic DNA
taagttgactcactatag

SEQ ID NO: 5663 - DNA, 18 bp, Artificial Sequence
  Synthetic DNA
taatacaactccctatcg

SEQ ID NO: 5664 - DNA, 18 bp, Artificial Sequence
  Synthetic DNA
taataccactgactttag

SEQ ID NO: 5665 - DNA, 18 bp, Artificial Sequence
  Synthetic DNA
taatacgacacaatgtag

SEQ ID NO: 5666 - DNA, 18 bp, Artificial Sequence
  Synthetic DNA
taatacgactaattctag

SEQ ID NO: 5667 - DNA, 18 bp, Artificial Sequence
  Synthetic DNA
taatacgactcattgtgg

SEQ ID NO: 5668 - DNA, 18 bp, Artificial Sequence
  Synthetic DNA
taatacgagacaccatag

SEQ ID NO: 5669 - DNA, 18 bp, Artificial Sequence
  Synthetic DNA
taatacgattcactcgag

SEQ ID NO: 5670 - DNA, 18 bp, Artificial Sequence
  Synthetic DNA
taatattacgcactatag

SEQ ID NO: 5671 - DNA, 18 bp, Artificial Sequence
  Synthetic DNA
taatccgactctctacag

SEQ ID NO: 5672 - DNA, 18 bp, Artificial Sequence
  Synthetic DNA
taatccgacttactacag

SEQ ID NO: 5673 - DNA, 18 bp, Artificial Sequence
  Synthetic DNA
taatgagagtcactatag

SEQ ID NO: 5674 - DNA, 18 bp, Artificial Sequence
  Synthetic DNA
taatgcgactacctatag

SEQ ID NO: 5675 - DNA, 18 bp, Artificial Sequence
  Synthetic DNA
taattggagtcactatag

SEQ ID NO: 5676 - DNA, 18 bp, Artificial Sequence
  Synthetic DNA
tactatggctcactatag

SEQ ID NO: 5677 - DNA, 18 bp, Artificial Sequence
  Synthetic DNA
tagtacaactccctatag

SEQ ID NO: 5678 - DNA, 18 bp, Artificial Sequence
  Synthetic DNA
tagtacgacttactagag

SEQ ID NO: 5679 - DNA, 18 bp, Artificial Sequence
  Synthetic DNA
tattccggctcactatag

SEQ ID NO: 5680 - DNA, 18 bp, Artificial Sequence
  Synthetic DNA
tcatacaactcactatgg

SEQ ID NO: 5681 - DNA, 18 bp, Artificial Sequence
  Synthetic DNA
tcctacgactcagtatag

SEQ ID NO: 5682 - DNA, 18 bp, Artificial Sequence
  Synthetic DNA
tcttaggactcactatag

SEQ ID NO: 5683 - DNA, 18 bp, Artificial Sequence
  Synthetic DNA
tgatacgaatcattatag

SEQ ID NO: 5684 - DNA, 18 bp, Artificial Sequence
  Synthetic DNA
tgatacgactcagcatag

SEQ ID NO: 5685 - DNA, 18 bp, Artificial Sequence
  Synthetic DNA
tgatacgattcagtatag

SEQ ID NO: 5686 - DNA, 18 bp, Artificial Sequence
  Synthetic DNA
tgatgcgactcaatatag

SEQ ID NO: 5687 - DNA, 18 bp, Artificial Sequence
  Synthetic DNA
taatacgactacctattg

SEQ ID NO: 5688 - DNA, 18 bp, Artificial Sequence
  Synthetic DNA
tcatacaacacactatag

SEQ ID NO: 5689 - DNA, 18 bp, Artificial Sequence
  Synthetic DNA
ttatgtgactcactatag

SEQ ID NO: 5690 - DNA, 18 bp, Artificial Sequence
  Synthetic DNA
aaatacaactcactattg

SEQ ID NO: 5691 - DNA, 18 bp, Artificial Sequence
  Synthetic DNA
ttatccgactcactattg

SEQ ID NO: 5692 - DNA, 18 bp, Artificial Sequence
  Synthetic DNA
aaatacgtctcactacag

SEQ ID NO: 5693 - DNA, 18 bp, Artificial Sequence
  Synthetic DNA
taaaaagactcacaatag

SEQ ID NO: 5694 - DNA, 18 bp, Artificial Sequence
  Synthetic DNA
tattacgtctcactatcg

SEQ ID NO: 5695 - DNA, 18 bp, Artificial Sequence
  Synthetic DNA
aaatacgactcattatcg

SEQ ID NO: 5696 - DNA, 18 bp, Artificial Sequence
  Synthetic DNA
atgtacgactcactatag

SEQ ID NO: 5697 - DNA, 18 bp, Artificial Sequence
  Synthetic DNA
taatatgactcactcttg

SEQ ID NO: 5698 - DNA, 18 bp, Artificial Sequence
  Synthetic DNA
aattaagactcactatag

SEQ ID NO: 5699 - DNA, 18 bp, Artificial Sequence
  Synthetic DNA
taatgctactcactattg

SEQ ID NO: 5700 - DNA, 18 bp, Artificial Sequence
  Synthetic DNA
taaaactactcactacag

SEQ ID NO: 5701 - DNA, 18 bp, Artificial Sequence
  Synthetic DNA
tgataagactcactattg

SEQ ID NO: 5702 - DNA, 18 bp, Artificial Sequence
  Synthetic DNA
ttttacggctcactatag

SEQ ID NO: 5703 - DNA, 18 bp, Artificial Sequence
  Synthetic DNA
aaatacgcctcacaatag

SEQ ID NO: 5704 - DNA, 18 bp, Artificial Sequence
  Synthetic DNA
taaaacgcctcactgtag

SEQ ID NO: 5705 - DNA, 18 bp, Artificial Sequence
  Synthetic DNA
taacacgactgtctatag

SEQ ID NO: 5706 - DNA, 18 bp, Artificial Sequence
  Synthetic DNA
taataccactcaatattg

SEQ ID NO: 5707 - DNA, 18 bp, Artificial Sequence
  Synthetic DNA
taatacgacaaactatcg

SEQ ID NO: 5708 - DNA, 18 bp, Artificial Sequence
  Synthetic DNA
taatacgactcaaaatgg

SEQ ID NO: 5709 - DNA, 18 bp, Artificial Sequence
  Synthetic DNA
taatacgattcgctatcg

SEQ ID NO: 5710 - DNA, 18 bp, Artificial Sequence
  Synthetic DNA
taattcgactcaatatgg

SEQ ID NO: 5711 - DNA, 18 bp, Artificial Sequence
  Synthetic DNA
taattcgactcactagcg

SEQ ID NO: 5712 - DNA, 18 bp, Artificial Sequence
  Synthetic DNA
tattacgaaccactatag

SEQ ID NO: 5713 - DNA, 18 bp, Artificial Sequence
  Synthetic DNA
tattgccactcactatag

SEQ ID NO: 5714 - DNA, 18 bp, Artificial Sequence
  Synthetic DNA
tcatactactcattatag

SEQ ID NO: 5715 - DNA, 18 bp, Artificial Sequence
  Synthetic DNA
tattaaaactcactatag

SEQ ID NO: 5716 - DNA, 18 bp, Artificial Sequence
  Synthetic DNA
taatacgacaaactctag

SEQ ID NO: 5717 - DNA, 18 bp, Artificial Sequence
  Synthetic DNA
tgatatgactcactattg

SEQ ID NO: 5718 - DNA, 18 bp, Artificial Sequence
  Synthetic DNA
cattacgactcactacag

SEQ ID NO: 5719 - DNA, 18 bp, Artificial Sequence
  Synthetic DNA
taaaaccactcattatag

SEQ ID NO: 5720 - DNA, 18 bp, Artificial Sequence
  Synthetic DNA
taaagcgactcaatatag

SEQ ID NO: 5721 - DNA, 18 bp, Artificial Sequence
  Synthetic DNA
taatacgactcacactcg

SEQ ID NO: 5722 - DNA, 18 bp, Artificial Sequence
  Synthetic DNA
taatacgtctcactgttg

SEQ ID NO: 5723 - DNA, 18 bp, Artificial Sequence
  Synthetic DNA
taatataactaactatag

SEQ ID NO: 5724 - DNA, 18 bp, Artificial Sequence
  Synthetic DNA
taatgcgattcactttag

SEQ ID NO: 5725 - DNA, 18 bp, Artificial Sequence
  Synthetic DNA
taatacgtctcaataaag

SEQ ID NO: 5726 - DNA, 18 bp, Artificial Sequence
  Synthetic DNA
taaaccgactcactattg

SEQ ID NO: 5727 - DNA, 18 bp, Artificial Sequence
  Synthetic DNA
taatattacttactatag

SEQ ID NO: 5728 - DNA, 18 bp, Artificial Sequence
  Synthetic DNA
taacacaactcactaaag

SEQ ID NO: 5729 - DNA, 18 bp, Artificial Sequence
  Synthetic DNA
ttataaaactcactatag

SEQ ID NO: 5730 - DNA, 18 bp, Artificial Sequence
  Synthetic DNA
ttatactacttactatag

SEQ ID NO: 5731 - DNA, 18 bp, Artificial Sequence
  Synthetic DNA
ttatacaactcactaaag

SEQ ID NO: 5732 - DNA, 18 bp, Artificial Sequence
  Synthetic DNA
taataggactctctttag

SEQ ID NO: 5733 - DNA, 18 bp, Artificial Sequence
  Synthetic DNA
taaaacgactctccatag

SEQ ID NO: 5734 - DNA, 18 bp, Artificial Sequence
  Synthetic DNA
taatacaattcactacag

SEQ ID NO: 5735 - DNA, 18 bp, Artificial Sequence
  Synthetic DNA
taatacggctttctatag

SEQ ID NO: 5736 - DNA, 18 bp, Artificial Sequence
  Synthetic DNA
taattcgactctctctag

SEQ ID NO: 5737 - DNA, 18 bp, Artificial Sequence
  Synthetic DNA
caatacgacacactaaag

SEQ ID NO: 5738 - DNA, 18 bp, Artificial Sequence
  Synthetic DNA
taaatcgactcactatcg

SEQ ID NO: 5739 - DNA, 18 bp, Artificial Sequence
  Synthetic DNA
taatgccactcactattg

SEQ ID NO: 5740 - DNA, 18 bp, Artificial Sequence
  Synthetic DNA
taattcgactcactagtg

SEQ ID NO: 5741 - DNA, 18 bp, Artificial Sequence
  Synthetic DNA
taccacgactctctatag

SEQ ID NO: 5742 - DNA, 18 bp, Artificial Sequence
  Synthetic DNA
aactacgactcactctag

SEQ ID NO: 5743 - DNA, 18 bp, Artificial Sequence
  Synthetic DNA
ctatacgactcaccatag

SEQ ID NO: 5744 - DNA, 18 bp, Artificial Sequence
  Synthetic DNA
taaaacgaatcactagag

SEQ ID NO: 5745 - DNA, 18 bp, Artificial Sequence
  Synthetic DNA
taattcaacgcactatag

SEQ ID NO: 5746 - DNA, 18 bp, Artificial Sequence
  Synthetic DNA
tattatgactcagtatag

SEQ ID NO: 5747 - DNA, 18 bp, Artificial Sequence
  Synthetic DNA
ttatacgactcgttatag

SEQ ID NO: 5748 - DNA, 18 bp, Artificial Sequence
  Synthetic DNA
ttatccgactcagtatag

SEQ ID NO: 5749 - DNA, 18 bp, Artificial Sequence
  Synthetic DNA
ttctacgactcactatcg

SEQ ID NO: 5750 - DNA, 18 bp, Artificial Sequence
  Synthetic DNA
aaatacgacttactagag

SEQ ID NO: 5751 - DNA, 18 bp, Artificial Sequence
  Synthetic DNA
agatacgactcaccatag

SEQ ID NO: 5752 - DNA, 18 bp, Artificial Sequence
  Synthetic DNA
caatacgaatcactagag

SEQ ID NO: 5753 - DNA, 18 bp, Artificial Sequence
  Synthetic DNA
caatactcctcactatag

SEQ ID NO: 5754 - DNA, 18 bp, Artificial Sequence
  Synthetic DNA
ccatacgactcactttag

SEQ ID NO: 5755 - DNA, 18 bp, Artificial Sequence
  Synthetic DNA
gattacgactcattatag

SEQ ID NO: 5756 - DNA, 18 bp, Artificial Sequence
  Synthetic DNA
gtatacgaatcactatag

SEQ ID NO: 5757 - DNA, 18 bp, Artificial Sequence
  Synthetic DNA
taaaacgactcactggag

SEQ ID NO: 5758 - DNA, 18 bp, Artificial Sequence
  Synthetic DNA
taaaacgcctcgctatag

SEQ ID NO: 5759 - DNA, 18 bp, Artificial Sequence
  Synthetic DNA
taaagcgactccctatag

SEQ ID NO: 5760 - DNA, 18 bp, Artificial Sequence
  Synthetic DNA
taacacgcctaactatag

SEQ ID NO: 5761 - DNA, 18 bp, Artificial Sequence
  Synthetic DNA
taagacgaatcactacag

SEQ ID NO: 5762 - DNA, 18 bp, Artificial Sequence
  Synthetic DNA
taagacgactcactgaag

SEQ ID NO: 5763 - DNA, 18 bp, Artificial Sequence
  Synthetic DNA
taataagactcaatctag

SEQ ID NO: 5764 - DNA, 18 bp, Artificial Sequence
  Synthetic DNA
taatacaaatcactatcg

SEQ ID NO: 5765 - DNA, 18 bp, Artificial Sequence
  Synthetic DNA
taatacgaatccttatag

SEQ ID NO: 5766 - DNA, 18 bp, Artificial Sequence
  Synthetic DNA
taatacgaatgacaatag

SEQ ID NO: 5767 - DNA, 18 bp, Artificial Sequence
  Synthetic DNA
taatacgactgactctcg

SEQ ID NO: 5768 - DNA, 18 bp, Artificial Sequence
  Synthetic DNA
taatacgattgcctatag

SEQ ID NO: 5769 - DNA, 18 bp, Artificial Sequence
  Synthetic DNA
taatacgcatccctatag

SEQ ID NO: 5770 - DNA, 18 bp, Artificial Sequence
  Synthetic DNA
taatacgcctaactatgg

SEQ ID NO: 5771 - DNA, 18 bp, Artificial Sequence
  Synthetic DNA
taatacgcctcagtattg

SEQ ID NO: 5772 - DNA, 18 bp, Artificial Sequence
  Synthetic DNA
taatactacttgctatag

SEQ ID NO: 5773 - DNA, 18 bp, Artificial Sequence
  Synthetic DNA
taatatgactcacggtag

SEQ ID NO: 5774 - DNA, 18 bp, Artificial Sequence
  Synthetic DNA
taatatggctcaatatag

SEQ ID NO: 5775 - DNA, 18 bp, Artificial Sequence
  Synthetic DNA
taatccgactcacgattg

SEQ ID NO: 5776 - DNA, 18 bp, Artificial Sequence
  Synthetic DNA
taatctgactaactatag

SEQ ID NO: 5777 - DNA, 18 bp, Artificial Sequence
  Synthetic DNA
taatgcgactcattagag

SEQ ID NO: 5778 - DNA, 18 bp, Artificial Sequence
  Synthetic DNA
tactacgacaccctatag

SEQ ID NO: 5779 - DNA, 18 bp, Artificial Sequence
  Synthetic DNA
tactacgtctcgctatag

SEQ ID NO: 5780 - DNA, 18 bp, Artificial Sequence
  Synthetic DNA
tactactactcactctag

SEQ ID NO: 5781 - DNA, 18 bp, Artificial Sequence
  Synthetic DNA
tactatgactcactatcg

SEQ ID NO: 5782 - DNA, 18 bp, Artificial Sequence
  Synthetic DNA
tagtataactcactatag

SEQ ID NO: 5783 - DNA, 18 bp, Artificial Sequence
  Synthetic DNA
tagttccactcactatag

SEQ ID NO: 5784 - DNA, 18 bp, Artificial Sequence
  Synthetic DNA
tagttcgactcactatcg

SEQ ID NO: 5785 - DNA, 18 bp, Artificial Sequence
  Synthetic DNA
tattacgacccactagag

SEQ ID NO: 5786 - DNA, 18 bp, Artificial Sequence
  Synthetic DNA
tcaaacgaatcactatag

SEQ ID NO: 5787 - DNA, 18 bp, Artificial Sequence
  Synthetic DNA
tcataagactaactatag

SEQ ID NO: 5788 - DNA, 18 bp, Artificial Sequence
  Synthetic DNA
tcatgtgactcactatag

SEQ ID NO: 5789 - DNA, 18 bp, Artificial Sequence
  Synthetic DNA
tgatacgaatccctatag

SEQ ID NO: 5790 - DNA, 18 bp, Artificial Sequence
  Synthetic DNA
tgatacgactgactacag

SEQ ID NO: 5791 - DNA, 18 bp, Artificial Sequence
  Synthetic DNA
tgatatgactcaatatag

SEQ ID NO: 5792 - DNA, 18 bp, Artificial Sequence
  Synthetic DNA
tgatatgattcactatag

SEQ ID NO: 5793 - DNA, 18 bp, Artificial Sequence
  Synthetic DNA
ttatacgactgagtatag

SEQ ID NO: 5794 - DNA, 18 bp, Artificial Sequence
  Synthetic DNA
ttatacgagtcacgatag

SEQ ID NO: 5795 - DNA, 18 bp, Artificial Sequence
  Synthetic DNA
ttattcgacgcactatag

SEQ ID NO: 5796 - DNA, 18 bp, Artificial Sequence
  Synthetic DNA
aaatacgactcactatcc

SEQ ID NO: 5797 - DNA, 18 bp, Artificial Sequence
  Synthetic DNA
aaatacggctcaccatag

SEQ ID NO: 5798 - DNA, 18 bp, Artificial Sequence
  Synthetic DNA
aaatacggctccctatag

SEQ ID NO: 5799 - DNA, 18 bp, Artificial Sequence
  Synthetic DNA
caaaacgactcactatcg

SEQ ID NO: 5800 - DNA, 18 bp, Artificial Sequence
  Synthetic DNA
caatacgacttagtatag

SEQ ID NO: 5801 - DNA, 18 bp, Artificial Sequence
  Synthetic DNA
caatactactcgctatag

SEQ ID NO: 5802 - DNA, 18 bp, Artificial Sequence
  Synthetic DNA
caatactactgactatag

SEQ ID NO: 5803 - DNA, 18 bp, Artificial Sequence
  Synthetic DNA
cagtacgactaactatag

SEQ ID NO: 5804 - DNA, 18 bp, Artificial Sequence
  Synthetic DNA
gaataccactcactttag

SEQ ID NO: 5805 - DNA, 18 bp, Artificial Sequence
  Synthetic DNA
gaatactactcaccatag

SEQ ID NO: 5806 - DNA, 18 bp, Artificial Sequence
  Synthetic DNA
gaataggactcactattg

SEQ ID NO: 5807 - DNA, 18 bp, Artificial Sequence
  Synthetic DNA
gagtacgtctcactatag

SEQ ID NO: 5808 - DNA, 18 bp, Artificial Sequence
  Synthetic DNA
taaaaagacgcactatag

SEQ ID NO: 5809 - DNA, 18 bp, Artificial Sequence
  Synthetic DNA
taaaacgactccctagag

SEQ ID NO: 5810 - DNA, 18 bp, Artificial Sequence
  Synthetic DNA
taaaacgacttagtatag

SEQ ID NO: 5811 - DNA, 18 bp, Artificial Sequence
  Synthetic DNA
taaaacgagtcactctag

SEQ ID NO: 5812 - DNA, 18 bp, Artificial Sequence
  Synthetic DNA
taaaacggctcacgatag

SEQ ID NO: 5813 - DNA, 18 bp, Artificial Sequence
  Synthetic DNA
taacaccactcactacag

SEQ ID NO: 5814 - DNA, 18 bp, Artificial Sequence
  Synthetic DNA
taacacgactcagaatag

SEQ ID NO: 5815 - DNA, 18 bp, Artificial Sequence
  Synthetic DNA
taacccgactcaatatag

SEQ ID NO: 5816 - DNA, 18 bp, Artificial Sequence
  Synthetic DNA
taacgcgactaactatag

SEQ ID NO: 5817 - DNA, 18 bp, Artificial Sequence
  Synthetic DNA
taagacgactcacaatgg

SEQ ID NO: 5818 - DNA, 18 bp, Artificial Sequence
  Synthetic DNA
taagtcgacccactatag

SEQ ID NO: 5819 - DNA, 18 bp, Artificial Sequence
  Synthetic DNA
taataacacgcactatag

SEQ ID NO: 5820 - DNA, 18 bp, Artificial Sequence
  Synthetic DNA
taataagactcactgtac

SEQ ID NO: 5821 - DNA, 18 bp, Artificial Sequence
  Synthetic DNA
taataagactgacgatag

SEQ ID NO: 5822 - DNA, 18 bp, Artificial Sequence
  Synthetic DNA
taatacaacccactctag

SEQ ID NO: 5823 - DNA, 18 bp, Artificial Sequence
  Synthetic DNA
taatacaactcacgatcg

SEQ ID NO: 5824 - DNA, 18 bp, Artificial Sequence
  Synthetic DNA
taatacagctcactagag

SEQ ID NO: 5825 - DNA, 18 bp, Artificial Sequence
  Synthetic DNA
taataccaatgactatag

SEQ ID NO: 5826 - DNA, 18 bp, Artificial Sequence
  Synthetic DNA
taataccactcacgttag

SEQ ID NO: 5827 - DNA, 18 bp, Artificial Sequence
  Synthetic DNA
taataccactccctatcg

SEQ ID NO: 5828 - DNA, 18 bp, Artificial Sequence
  Synthetic DNA
taatacccctcactttag

SEQ ID NO: 5829 - DNA, 18 bp, Artificial Sequence
  Synthetic DNA
taatacgaaacactatgg

SEQ ID NO: 5830 - DNA, 18 bp, Artificial Sequence
  Synthetic DNA
taatacgaagcactctag

SEQ ID NO: 5831 - DNA, 18 bp, Artificial Sequence
  Synthetic DNA
taatacgacccattctag

SEQ ID NO: 5832 - DNA, 18 bp, Artificial Sequence
  Synthetic DNA
taatacgactcaccgtcg

SEQ ID NO: 5833 - DNA, 18 bp, Artificial Sequence
  Synthetic DNA
taatacgactcatcatgg

SEQ ID NO: 5834 - DNA, 18 bp, Artificial Sequence
  Synthetic DNA
taatacgactccccctag

SEQ ID NO: 5835 - DNA, 18 bp, Artificial Sequence
  Synthetic DNA
taatacgactcggtttag

SEQ ID NO: 5836 - DNA, 18 bp, Artificial Sequence
  Synthetic DNA
taatacgactctctgtgg

SEQ ID NO: 5837 - DNA, 18 bp, Artificial Sequence
  Synthetic DNA
taatacgactgaatagag

SEQ ID NO: 5838 - DNA, 18 bp, Artificial Sequence
  Synthetic DNA
taatacgactgactactg

SEQ ID NO: 5839 - DNA, 18 bp, Artificial Sequence
  Synthetic DNA
taatacgagtgactttag

SEQ ID NO: 5840 - DNA, 18 bp, Artificial Sequence
  Synthetic DNA
taatacgcatcactacag

SEQ ID NO: 5841 - DNA, 18 bp, Artificial Sequence
  Synthetic DNA
taatacggctcacactag

SEQ ID NO: 5842 - DNA, 18 bp, Artificial Sequence
  Synthetic DNA
taatacgtcccacgatag

SEQ ID NO: 5843 - DNA, 18 bp, Artificial Sequence
  Synthetic DNA
taatacgtctcagtagag

SEQ ID NO: 5844 - DNA, 18 bp, Artificial Sequence
  Synthetic DNA
taatacgtctgcctatag

SEQ ID NO: 5845 - DNA, 18 bp, Artificial Sequence
  Synthetic DNA
taatactactcaagatag

SEQ ID NO: 5846 - DNA, 18 bp, Artificial Sequence
  Synthetic DNA
taataggacccaccatag

SEQ ID NO: 5847 - DNA, 18 bp, Artificial Sequence
  Synthetic DNA
taataggacgcacaatag

SEQ ID NO: 5848 - DNA, 18 bp, Artificial Sequence
  Synthetic DNA
taatatcaatcactatag

SEQ ID NO: 5849 - DNA, 18 bp, Artificial Sequence
  Synthetic DNA
taatatgacccattatag

SEQ ID NO: 5850 - DNA, 18 bp, Artificial Sequence
  Synthetic DNA
taatccgaatcaccatag

SEQ ID NO: 5851 - DNA, 18 bp, Artificial Sequence
  Synthetic DNA
taatccgaatcagtatag

SEQ ID NO: 5852 - DNA, 18 bp, Artificial Sequence
  Synthetic DNA
taatccgacttactagag

SEQ ID NO: 5853 - DNA, 18 bp, Artificial Sequence
  Synthetic DNA
taatgcgacccactatcg

SEQ ID NO: 5854 - DNA, 18 bp, Artificial Sequence
  Synthetic DNA
tactagggctcactatag

SEQ ID NO: 5855 - DNA, 18 bp, Artificial Sequence
  Synthetic DNA
taggaagactcactatag

SEQ ID NO: 5856 - DNA, 18 bp, Artificial Sequence
  Synthetic DNA
tagtaagactcacgatag

SEQ ID NO: 5857 - DNA, 18 bp, Artificial Sequence
  Synthetic DNA
tattacgacgcactacag

SEQ ID NO: 5858 - DNA, 18 bp, Artificial Sequence
  Synthetic DNA
tattacgagccactatag

SEQ ID NO: 5859 - DNA, 18 bp, Artificial Sequence
  Synthetic DNA
tattaggacgcactatag

SEQ ID NO: 5860 - DNA, 18 bp, Artificial Sequence
  Synthetic DNA
tcacaggactcactatag

SEQ ID NO: 5861 - DNA, 18 bp, Artificial Sequence
  Synthetic DNA
tcatacgactcagaatag

SEQ ID NO: 5862 - DNA, 18 bp, Artificial Sequence
  Synthetic DNA
tcatactactcacgatag

SEQ ID NO: 5863 - DNA, 18 bp, Artificial Sequence
  Synthetic DNA
tcatcagactcactatag

SEQ ID NO: 5864 - DNA, 18 bp, Artificial Sequence
  Synthetic DNA
tgatacgacgcactatcg

SEQ ID NO: 5865 - DNA, 18 bp, Artificial Sequence
  Synthetic DNA
tgatacgcttcactatag

SEQ ID NO: 5866 - DNA, 18 bp, Artificial Sequence
  Synthetic DNA
tgataggagtcactatag

SEQ ID NO: 5867 - DNA, 18 bp, Artificial Sequence
  Synthetic DNA
tggtacgactccctatag

SEQ ID NO: 5868 - DNA, 18 bp, Artificial Sequence
  Synthetic DNA
ttatacgactcactatcc

SEQ ID NO: 5869 - DNA, 18 bp, Artificial Sequence
  Synthetic DNA
ttatacgactcactgtac

SEQ ID NO: 5870 - DNA, 18 bp, Artificial Sequence
  Synthetic DNA
ttatacgactctctataa

SEQ ID NO: 5871 - DNA, 18 bp, Artificial Sequence
  Synthetic DNA
ttatacggctcaccatag

SEQ ID NO: 5872 - DNA, 18 bp, Artificial Sequence
  Synthetic DNA
tattacgtctcactttag

SEQ ID NO: 5873 - DNA, 18 bp, Artificial Sequence
  Synthetic DNA
taaaacgactcaataaag

SEQ ID NO: 5874 - DNA, 18 bp, Artificial Sequence
  Synthetic DNA
taataagtctcactctag

SEQ ID NO: 5875 - DNA, 18 bp, Artificial Sequence
  Synthetic DNA
tattacgcctcactttag

SEQ ID NO: 5876 - DNA, 18 bp, Artificial Sequence
  Synthetic DNA
ttatactcctcactatag

SEQ ID NO: 5877 - DNA, 18 bp, Artificial Sequence
  Synthetic DNA
aaatacaactctctatag

SEQ ID NO: 5878 - DNA, 18 bp, Artificial Sequence
  Synthetic DNA
taattcgtctaactatag

SEQ ID NO: 5879 - DNA, 18 bp, Artificial Sequence
  Synthetic DNA
aaacacgacacactatag

SEQ ID NO: 5880 - DNA, 18 bp, Artificial Sequence
  Synthetic DNA
aaatacgactcacagtag

SEQ ID NO: 5881 - DNA, 18 bp, Artificial Sequence
  Synthetic DNA
aaatatgactcactacag

SEQ ID NO: 5882 - DNA, 18 bp, Artificial Sequence
  Synthetic DNA
aaattcgactcactacag

SEQ ID NO: 5883 - DNA, 18 bp, Artificial Sequence
  Synthetic DNA
taataccactcaccattg

SEQ ID NO: 5884 - DNA, 18 bp, Artificial Sequence
  Synthetic DNA
taatacgtttcactatgg

SEQ ID NO: 5885 - DNA, 18 bp, Artificial Sequence
  Synthetic DNA
taatatgtctcagtatag

SEQ ID NO: 5886 - DNA, 18 bp, Artificial Sequence
  Synthetic DNA
tagtttgactcactatag

SEQ ID NO: 5887 - DNA, 18 bp, Artificial Sequence
  Synthetic DNA
tataaagactcactatag

SEQ ID NO: 5888 - DNA, 18 bp, Artificial Sequence
  Synthetic DNA
aaatacgactcacaaaag

SEQ ID NO: 5889 - DNA, 18 bp, Artificial Sequence
  Synthetic DNA
taacacgactatctatag

SEQ ID NO: 5890 - DNA, 18 bp, Artificial Sequence
  Synthetic DNA
taatacgacacgcaatag

SEQ ID NO: 5891 - DNA, 18 bp, Artificial Sequence
  Synthetic DNA
caatacgactcaccacag

SEQ ID NO: 5892 - DNA, 18 bp, Artificial Sequence
  Synthetic DNA
taataccactcaatgtag

SEQ ID NO: 5893 - DNA, 18 bp, Artificial Sequence
  Synthetic DNA
taatccaattcactatag

SEQ ID NO: 5894 - DNA, 18 bp, Artificial Sequence
  Synthetic DNA
taattcgcctaactatag

SEQ ID NO: 5895 - DNA, 18 bp, Artificial Sequence
  Synthetic DNA
tattacgacgcactattg

SEQ ID NO: 5896 - DNA, 18 bp, Artificial Sequence
  Synthetic DNA
tattacgactacctatag

SEQ ID NO: 5897 - DNA, 18 bp, Artificial Sequence
  Synthetic DNA
tcatacgacacaatatag

SEQ ID NO: 5898 - DNA, 18 bp, Artificial Sequence
  Synthetic DNA
tttgacgactcactatag

SEQ ID NO: 5899 - DNA, 18 bp, Artificial Sequence
  Synthetic DNA
taataagactctccatag

SEQ ID NO: 5900 - DNA, 18 bp, Artificial Sequence
  Synthetic DNA
aaatacgaccaactatag

SEQ ID NO: 5901 - DNA, 18 bp, Artificial Sequence
  Synthetic DNA
caataccactcactttag

SEQ ID NO: 5902 - DNA, 18 bp, Artificial Sequence
  Synthetic DNA
caatacgactgacaatag

SEQ ID NO: 5903 - DNA, 18 bp, Artificial Sequence
  Synthetic DNA
taatacgatacactgtag

SEQ ID NO: 5904 - DNA, 18 bp, Artificial Sequence
  Synthetic DNA
taatactactccctaaag

SEQ ID NO: 5905 - DNA, 18 bp, Artificial Sequence
  Synthetic DNA
taatgcaactctctatag

SEQ ID NO: 5906 - DNA, 18 bp, Artificial Sequence
  Synthetic DNA
tagtacaactaactatag

SEQ ID NO: 5907 - DNA, 18 bp, Artificial Sequence
  Synthetic DNA
tagtacgactctatatag

SEQ ID NO: 5908 - DNA, 18 bp, Artificial Sequence
  Synthetic DNA
tgatccgtctcactatag

SEQ ID NO: 5909 - DNA, 18 bp, Artificial Sequence
  Synthetic DNA
taatacgtctcaaaatag

SEQ ID NO: 5910 - DNA, 18 bp, Artificial Sequence
  Synthetic DNA
aaatacgactaaccatag

SEQ ID NO: 5911 - DNA, 18 bp, Artificial Sequence
  Synthetic DNA
tcatacgacttactaaag

SEQ ID NO: 5912 - DNA, 18 bp, Artificial Sequence
  Synthetic DNA
ttatccgactcaatatag

SEQ ID NO: 5913 - DNA, 18 bp, Artificial Sequence
  Synthetic DNA
tatcacgactcactattg

SEQ ID NO: 5914 - DNA, 18 bp, Artificial Sequence
  Synthetic DNA
taatacgttacactatag

SEQ ID NO: 5915 - DNA, 18 bp, Artificial Sequence
  Synthetic DNA
aaaatcgactcactatag

SEQ ID NO: 5916 - DNA, 18 bp, Artificial Sequence
  Synthetic DNA
caaaacgactcactattg

SEQ ID NO: 5917 - DNA, 18 bp, Artificial Sequence
  Synthetic DNA
taaaacaactcactatcg

SEQ ID NO: 5918 - DNA, 18 bp, Artificial Sequence
  Synthetic DNA
taatatgagtcactttag

SEQ ID NO: 5919 - DNA, 18 bp, Artificial Sequence
  Synthetic DNA
tattacgactcactaagg

SEQ ID NO: 5920 - DNA, 18 bp, Artificial Sequence
  Synthetic DNA
tcatacgtctccctatag

SEQ ID NO: 5921 - DNA, 18 bp, Artificial Sequence
  Synthetic DNA
ttatacgcctcaatatag

SEQ ID NO: 5922 - DNA, 18 bp, Artificial Sequence
  Synthetic DNA
aaatgagactcactatag

SEQ ID NO: 5923 - DNA, 18 bp, Artificial Sequence
  Synthetic DNA
agatacggctcactatag

SEQ ID NO: 5924 - DNA, 18 bp, Artificial Sequence
  Synthetic DNA
caatacgactcaatctag

SEQ ID NO: 5925 - DNA, 18 bp, Artificial Sequence
  Synthetic DNA
caatacgactcactccag

SEQ ID NO: 5926 - DNA, 18 bp, Artificial Sequence
  Synthetic DNA
caatacgactcagtatgg

SEQ ID NO: 5927 - DNA, 18 bp, Artificial Sequence
  Synthetic DNA
gaatacaactcacaatag

SEQ ID NO: 5928 - DNA, 18 bp, Artificial Sequence
  Synthetic DNA
gtatactactcactatag

SEQ ID NO: 5929 - DNA, 18 bp, Artificial Sequence
  Synthetic DNA
taaaacgactcacgacag

SEQ ID NO: 5930 - DNA, 18 bp, Artificial Sequence
  Synthetic DNA
taacacggcttactatag

SEQ ID NO: 5931 - DNA, 18 bp, Artificial Sequence
  Synthetic DNA
taacactactcgctatag

SEQ ID NO: 5932 - DNA, 18 bp, Artificial Sequence
  Synthetic DNA
taacgcgaatcactatag

SEQ ID NO: 5933 - DNA, 18 bp, Artificial Sequence
  Synthetic DNA
taataaaactcagtatag

SEQ ID NO: 5934 - DNA, 18 bp, Artificial Sequence
  Synthetic DNA
taataagacccactacag

SEQ ID NO: 5935 - DNA, 18 bp, Artificial Sequence
  Synthetic DNA
taatacgacccacagtag

SEQ ID NO: 5936 - DNA, 18 bp, Artificial Sequence
  Synthetic DNA
taatacgaccccctttag

SEQ ID NO: 5937 - DNA, 18 bp, Artificial Sequence
  Synthetic DNA
taatacgactaaatctag

SEQ ID NO: 5938 - DNA, 18 bp, Artificial Sequence
  Synthetic DNA
taatacgactcaatctcg

SEQ ID NO: 5939 - DNA, 18 bp, Artificial Sequence
  Synthetic DNA
taatacgactcattagcg

SEQ ID NO: 5940 - DNA, 18 bp, Artificial Sequence
  Synthetic DNA
taatacgactcgctgaag

SEQ ID NO: 5941 - DNA, 18 bp, Artificial Sequence
  Synthetic DNA
taatacgattcactaggg

SEQ ID NO: 5942 - DNA, 18 bp, Artificial Sequence
  Synthetic DNA
taatacggttcaccatag

SEQ ID NO: 5943 - DNA, 18 bp, Artificial Sequence
  Synthetic DNA
taatacgtctcactctgg

SEQ ID NO: 5944 - DNA, 18 bp, Artificial Sequence
  Synthetic DNA
taatactacgcgctatag

SEQ ID NO: 5945 - DNA, 18 bp, Artificial Sequence
  Synthetic DNA
taatactattcagtatag

SEQ ID NO: 5946 - DNA, 18 bp, Artificial Sequence
  Synthetic DNA
taataggactcgctttag

SEQ ID NO: 5947 - DNA, 18 bp, Artificial Sequence
  Synthetic DNA
taatatgactacctatag

SEQ ID NO: 5948 - DNA, 18 bp, Artificial Sequence
  Synthetic DNA
taatccgactcatcatag

SEQ ID NO: 5949 - DNA, 18 bp, Artificial Sequence
  Synthetic DNA
taatccgactgattatag

SEQ ID NO: 5950 - DNA, 18 bp, Artificial Sequence
  Synthetic DNA
taatgcgacttacgatag

SEQ ID NO: 5951 - DNA, 18 bp, Artificial Sequence
  Synthetic DNA
taattagagtcactatag

SEQ ID NO: 5952 - DNA, 18 bp, Artificial Sequence
  Synthetic DNA
tagtacgactcaacatag

SEQ ID NO: 5953 - DNA, 18 bp, Artificial Sequence
  Synthetic DNA
tagtacgcctcactgtag

SEQ ID NO: 5954 - DNA, 18 bp, Artificial Sequence
  Synthetic DNA
tcatacgaatcactctag

SEQ ID NO: 5955 - DNA, 18 bp, Artificial Sequence
  Synthetic DNA
tgatacgactcactgtcg

SEQ ID NO: 5956 - DNA, 18 bp, Artificial Sequence
  Synthetic DNA
tattacgtctcgctatag

SEQ ID NO: 5957 - DNA, 18 bp, Artificial Sequence
  Synthetic DNA
tattacgactatctatag

SEQ ID NO: 5958 - DNA, 18 bp, Artificial Sequence
  Synthetic DNA
taatgcgtcttactatag

SEQ ID NO: 5959 - DNA, 18 bp, Artificial Sequence
  Synthetic DNA
taattcgagtcactttag

SEQ ID NO: 5960 - DNA, 18 bp, Artificial Sequence
  Synthetic DNA
atctacgactcactatag

SEQ ID NO: 5961 - DNA, 18 bp, Artificial Sequence
  Synthetic DNA
aaatacggttcactatag

SEQ ID NO: 5962 - DNA, 18 bp, Artificial Sequence
  Synthetic DNA
caaaacgactcactatgg

SEQ ID NO: 5963 - DNA, 18 bp, Artificial Sequence
  Synthetic DNA
taaaacgactaactgtag

SEQ ID NO: 5964 - DNA, 18 bp, Artificial Sequence
  Synthetic DNA
taacacgaatcacaatag

SEQ ID NO: 5965 - DNA, 18 bp, Artificial Sequence
  Synthetic DNA
taatacgacttgatatag

SEQ ID NO: 5966 - DNA, 18 bp, Artificial Sequence
  Synthetic DNA
taatacgattcaatatcg

SEQ ID NO: 5967 - DNA, 18 bp, Artificial Sequence
  Synthetic DNA
taatactactcgccatag

SEQ ID NO: 5968 - DNA, 18 bp, Artificial Sequence
  Synthetic DNA
tactatgagtcactatag

SEQ ID NO: 5969 - DNA, 18 bp, Artificial Sequence
  Synthetic DNA
tagtgcgactcactatcg

SEQ ID NO: 5970 - DNA, 18 bp, Artificial Sequence
  Synthetic DNA
tattaccagtcactatag

SEQ ID NO: 5971 - DNA, 18 bp, Artificial Sequence
  Synthetic DNA
tcatacgatacactatag

SEQ ID NO: 5972 - DNA, 18 bp, Artificial Sequence
  Synthetic DNA
tcatatgactcacaatag

SEQ ID NO: 5973 - DNA, 18 bp, Artificial Sequence
  Synthetic DNA
aaatacgactcaccattg

SEQ ID NO: 5974 - DNA, 18 bp, Artificial Sequence
  Synthetic DNA
aaattcgactcagtatag

SEQ ID NO: 5975 - DNA, 18 bp, Artificial Sequence
  Synthetic DNA
taatactactcactagtg

SEQ ID NO: 5976 - DNA, 18 bp, Artificial Sequence
  Synthetic DNA
taataggtatcactatag

SEQ ID NO: 5977 - DNA, 18 bp, Artificial Sequence
  Synthetic DNA
taattcgactgacaatag

SEQ ID NO: 5978 - DNA, 18 bp, Artificial Sequence
  Synthetic DNA
tcttacgtctcactatag

SEQ ID NO: 5979 - DNA, 18 bp, Artificial Sequence
  Synthetic DNA
taaacctactcactatag

SEQ ID NO: 5980 - DNA, 18 bp, Artificial Sequence
  Synthetic DNA
taacacaactcactttag

SEQ ID NO: 5981 - DNA, 18 bp, Artificial Sequence
  Synthetic DNA
taataccatacactatag

SEQ ID NO: 5982 - DNA, 18 bp, Artificial Sequence
  Synthetic DNA
taatactgctctctatag

SEQ ID NO: 5983 - DNA, 18 bp, Artificial Sequence
  Synthetic DNA
taattccactcacaatag

SEQ ID NO: 5984 - DNA, 18 bp, Artificial Sequence
  Synthetic DNA
tattacgactctctatcg

SEQ ID NO: 5985 - DNA, 18 bp, Artificial Sequence
  Synthetic DNA
aaaaatgactcactatag

SEQ ID NO: 5986 - DNA, 18 bp, Artificial Sequence
  Synthetic DNA
tattatcactcactatag

SEQ ID NO: 5987 - DNA, 18 bp, Artificial Sequence
  Synthetic DNA
ttatactactcactatgg

SEQ ID NO: 5988 - DNA, 18 bp, Artificial Sequence
  Synthetic DNA
ttttacgagtcactatag

SEQ ID NO: 5989 - DNA, 18 bp, Artificial Sequence
  Synthetic DNA
ttattcgaatcactatag

SEQ ID NO: 5990 - DNA, 18 bp, Artificial Sequence
  Synthetic DNA
aaacacgactcactttag

SEQ ID NO: 5991 - DNA, 18 bp, Artificial Sequence
  Synthetic DNA
tattacgactctctatgg

SEQ ID NO: 5992 - DNA, 18 bp, Artificial Sequence
  Synthetic DNA
taatacaactctctatcg

SEQ ID NO: 5993 - DNA, 18 bp, Artificial Sequence
  Synthetic DNA
aaatacgtctcactattg

SEQ ID NO: 5994 - DNA, 18 bp, Artificial Sequence
  Synthetic DNA
tatttcgactcattatag

SEQ ID NO: 5995 - DNA, 18 bp, Artificial Sequence
  Synthetic DNA
taataggactctctattg

SEQ ID NO: 5996 - DNA, 18 bp, Artificial Sequence
  Synthetic DNA
taatccgactctctattg

SEQ ID NO: 5997 - DNA, 18 bp, Artificial Sequence
  Synthetic DNA
taatccgtcacactatag

SEQ ID NO: 5998 - DNA, 18 bp, Artificial Sequence
  Synthetic DNA
tactacgaatcactattg

SEQ ID NO: 5999 - DNA, 18 bp, Artificial Sequence
  Synthetic DNA
ttctacgactcattatag

SEQ ID NO: 6000 - DNA, 18 bp, Artificial Sequence
  Synthetic DNA
taatagaactctctatag

SEQ ID NO: 6001 - DNA, 18 bp, Artificial Sequence
  Synthetic DNA
taataaggctcactttag

SEQ ID NO: 6002 - DNA, 18 bp, Artificial Sequence
  Synthetic DNA
taatacaactcactgaag

SEQ ID NO: 6003 - DNA, 18 bp, Artificial Sequence
  Synthetic DNA
taatatgacccactttag

SEQ ID NO: 6004 - DNA, 18 bp, Artificial Sequence
  Synthetic DNA
taattcgacccaatatag

SEQ ID NO: 6005 - DNA, 18 bp, Artificial Sequence
  Synthetic DNA
tcacaagactcactatag

SEQ ID NO: 6006 - DNA, 18 bp, Artificial Sequence
  Synthetic DNA
tcatgcgactcactaaag

SEQ ID NO: 6007 - DNA, 18 bp, Artificial Sequence
  Synthetic DNA
ttataccactcactagag

SEQ ID NO: 6008 - DNA, 18 bp, Artificial Sequence
  Synthetic DNA
taataagactcacaatcg

SEQ ID NO: 6009 - DNA, 18 bp, Artificial Sequence
  Synthetic DNA
taatacgactcgcattag

SEQ ID NO: 6010 - DNA, 18 bp, Artificial Sequence
  Synthetic DNA
ttctacgactcactattg

SEQ ID NO: 6011 - DNA, 18 bp, Artificial Sequence
  Synthetic DNA
aaatacgagccactatag

SEQ ID NO: 6012 - DNA, 18 bp, Artificial Sequence
  Synthetic DNA
acataggactcactatag

SEQ ID NO: 6013 - DNA, 18 bp, Artificial Sequence
  Synthetic DNA
cagtacgactcattatag

SEQ ID NO: 6014 - DNA, 18 bp, Artificial Sequence
  Synthetic DNA
taacacgactcacaatcg

SEQ ID NO: 6015 - DNA, 18 bp, Artificial Sequence
  Synthetic DNA
taagaatactcactatag

SEQ ID NO: 6016 - DNA, 18 bp, Artificial Sequence
  Synthetic DNA
taataacacacactatag

SEQ ID NO: 6017 - DNA, 18 bp, Artificial Sequence
  Synthetic DNA
taataagactcactaagg

SEQ ID NO: 6018 - DNA, 18 bp, Artificial Sequence
  Synthetic DNA
taataagactcactctgg

SEQ ID NO: 6019 - DNA, 18 bp, Artificial Sequence
  Synthetic DNA
taataagtctcacgatag

SEQ ID NO: 6020 - DNA, 18 bp, Artificial Sequence
  Synthetic DNA
taatacgacaaaccatag

SEQ ID NO: 6021 - DNA, 18 bp, Artificial Sequence
  Synthetic DNA
taatacgactcaaaatcg

SEQ ID NO: 6022 - DNA, 18 bp, Artificial Sequence
  Synthetic DNA
taatacgactgataatag

SEQ ID NO: 6023 - DNA, 18 bp, Artificial Sequence
  Synthetic DNA
taatacgagacactctag

SEQ ID NO: 6024 - DNA, 18 bp, Artificial Sequence
  Synthetic DNA
taatacgagtcactttgg

SEQ ID NO: 6025 - DNA, 18 bp, Artificial Sequence
  Synthetic DNA
taataggactccctattg

SEQ ID NO: 6026 - DNA, 18 bp, Artificial Sequence
  Synthetic DNA
taatatgactaaatatag

SEQ ID NO: 6027 - DNA, 18 bp, Artificial Sequence
  Synthetic DNA
taatatgactcatcatag

SEQ ID NO: 6028 - DNA, 18 bp, Artificial Sequence
  Synthetic DNA
taatccgactcactaagg

SEQ ID NO: 6029 - DNA, 18 bp, Artificial Sequence
  Synthetic DNA
taatgagactctctatag

SEQ ID NO: 6030 - DNA, 18 bp, Artificial Sequence
  Synthetic DNA
taatgcgactcagaatag

SEQ ID NO: 6031 - DNA, 18 bp, Artificial Sequence
  Synthetic DNA
taattcgactcattatgg

SEQ ID NO: 6032 - DNA, 18 bp, Artificial Sequence
  Synthetic DNA
tagtacgactcattgtag

SEQ ID NO: 6033 - DNA, 18 bp, Artificial Sequence
  Synthetic DNA
tcacgcgactcactatag

SEQ ID NO: 6034 - DNA, 18 bp, Artificial Sequence
  Synthetic DNA
tcatacaactcaccatag

SEQ ID NO: 6035 - DNA, 18 bp, Artificial Sequence
  Synthetic DNA
tgataccactcgctatag

SEQ ID NO: 6036 - DNA, 18 bp, Artificial Sequence
  Synthetic DNA
tgatacgactctccatag

SEQ ID NO: 6037 - DNA, 18 bp, Artificial Sequence
  Synthetic DNA
ttatacgactctcgatag

SEQ ID NO: 6038 - DNA, 18 bp, Artificial Sequence
  Synthetic DNA
aaatacgactcagcatag

SEQ ID NO: 6039 - DNA, 18 bp, Artificial Sequence
  Synthetic DNA
aaatacgactcgctgtag

SEQ ID NO: 6040 - DNA, 18 bp, Artificial Sequence
  Synthetic DNA
caatacgacttactctag

SEQ ID NO: 6041 - DNA, 18 bp, Artificial Sequence
  Synthetic DNA
caatatgactcaatatag

SEQ ID NO: 6042 - DNA, 18 bp, Artificial Sequence
  Synthetic DNA
cactacgactcaccatag

SEQ ID NO: 6043 - DNA, 18 bp, Artificial Sequence
  Synthetic DNA
ccatacgactcactctag

SEQ ID NO: 6044 - DNA, 18 bp, Artificial Sequence
  Synthetic DNA
gaacactactcactatag

SEQ ID NO: 6045 - DNA, 18 bp, Artificial Sequence
  Synthetic DNA
gaatacgccacactatag

SEQ ID NO: 6046 - DNA, 18 bp, Artificial Sequence
  Synthetic DNA
gaatacgtcccactatag

SEQ ID NO: 6047 - DNA, 18 bp, Artificial Sequence
  Synthetic DNA
gaattcgactcaatatag

SEQ ID NO: 6048 - DNA, 18 bp, Artificial Sequence
  Synthetic DNA
taaaacgactcagcatag

SEQ ID NO: 6049 - DNA, 18 bp, Artificial Sequence
  Synthetic DNA
taacaccactcaccatag

SEQ ID NO: 6050 - DNA, 18 bp, Artificial Sequence
  Synthetic DNA
taacacgacacactgtag

SEQ ID NO: 6051 - DNA, 18 bp, Artificial Sequence
  Synthetic DNA
taacacgactgactattg

SEQ ID NO: 6052 - DNA, 18 bp, Artificial Sequence
  Synthetic DNA
taacgcgactcgctatag

SEQ ID NO: 6053 - DNA, 18 bp, Artificial Sequence
  Synthetic DNA
taagaccaatcactatag

SEQ ID NO: 6054 - DNA, 18 bp, Artificial Sequence
  Synthetic DNA
taagacgacgcactttag

SEQ ID NO: 6055 - DNA, 18 bp, Artificial Sequence
  Synthetic DNA
taagacgactaactatcg

SEQ ID NO: 6056 - DNA, 18 bp, Artificial Sequence
  Synthetic DNA
taaggcaactcactatag

SEQ ID NO: 6057 - DNA, 18 bp, Artificial Sequence
  Synthetic DNA
taatacaactcaccgtag

SEQ ID NO: 6058 - DNA, 18 bp, Artificial Sequence
  Synthetic DNA
taatacaactggctatag

SEQ ID NO: 6059 - DNA, 18 bp, Artificial Sequence
  Synthetic DNA
taatacaacttactagag

SEQ ID NO: 6060 - DNA, 18 bp, Artificial Sequence
  Synthetic DNA
taatacaattcacgatag

SEQ ID NO: 6061 - DNA, 18 bp, Artificial Sequence
  Synthetic DNA
taataccacccattatag

SEQ ID NO: 6062 - DNA, 18 bp, Artificial Sequence
  Synthetic DNA
taataccacctactatag

SEQ ID NO: 6063 - DNA, 18 bp, Artificial Sequence
  Synthetic DNA
taataccagtgactatag

SEQ ID NO: 6064 - DNA, 18 bp, Artificial Sequence
  Synthetic DNA
taatacccctcaccatag

SEQ ID NO: 6065 - DNA, 18 bp, Artificial Sequence
  Synthetic DNA
taatacgacacacgatcg

SEQ ID NO: 6066 - DNA, 18 bp, Artificial Sequence
  Synthetic DNA
taatacgacaccgtatag

SEQ ID NO: 6067 - DNA, 18 bp, Artificial Sequence
  Synthetic DNA
taatacgacccattagag

SEQ ID NO: 6068 - DNA, 18 bp, Artificial Sequence
  Synthetic DNA
taatacgactaacgctag

SEQ ID NO: 6069 - DNA, 18 bp, Artificial Sequence
  Synthetic DNA
taatacgactccacatag

SEQ ID NO: 6070 - DNA, 18 bp, Artificial Sequence
  Synthetic DNA
taatacgactcccgttag

SEQ ID NO: 6071 - DNA, 18 bp, Artificial Sequence
  Synthetic DNA
taatacgactgaatatgg

SEQ ID NO: 6072 - DNA, 18 bp, Artificial Sequence
  Synthetic DNA
taatacgattgactatcg

SEQ ID NO: 6073 - DNA, 18 bp, Artificial Sequence
  Synthetic DNA
taatacgatttactagag

SEQ ID NO: 6074 - DNA, 18 bp, Artificial Sequence
  Synthetic DNA
taatacgcatcacgatag

SEQ ID NO: 6075 - DNA, 18 bp, Artificial Sequence
  Synthetic DNA
taatacgccacactagag

SEQ ID NO: 6076 - DNA, 18 bp, Artificial Sequence
  Synthetic DNA
taatacgccccgctatag

SEQ ID NO: 6077 - DNA, 18 bp, Artificial Sequence
  Synthetic DNA
taatacggatcgctatag

SEQ ID NO: 6078 - DNA, 18 bp, Artificial Sequence
  Synthetic DNA
taatacggctcaacatag

SEQ ID NO: 6079 - DNA, 18 bp, Artificial Sequence
  Synthetic DNA
taatacggctcaccatcg

SEQ ID NO: 6080 - DNA, 18 bp, Artificial Sequence
  Synthetic DNA
taatacggctgacgatag

SEQ ID NO: 6081 - DNA, 18 bp, Artificial Sequence
  Synthetic DNA
taatactagtgactatag

SEQ ID NO: 6082 - DNA, 18 bp, Artificial Sequence
  Synthetic DNA
taatagcactcactagag

SEQ ID NO: 6083 - DNA, 18 bp, Artificial Sequence
  Synthetic DNA
taataggcctcagtatag

SEQ ID NO: 6084 - DNA, 18 bp, Artificial Sequence
  Synthetic DNA
taatatgactccctatgg

SEQ ID NO: 6085 - DNA, 18 bp, Artificial Sequence
  Synthetic DNA
taatccacctcactatag

SEQ ID NO: 6086 - DNA, 18 bp, Artificial Sequence
  Synthetic DNA
taatccgactcaatgtag

SEQ ID NO: 6087 - DNA, 18 bp, Artificial Sequence
  Synthetic DNA
taatccgagtcactaaag

SEQ ID NO: 6088 - DNA, 18 bp, Artificial Sequence
  Synthetic DNA
taatgcggctcaatatag

SEQ ID NO: 6089 - DNA, 18 bp, Artificial Sequence
  Synthetic DNA
taattcgacgcactagag

SEQ ID NO: 6090 - DNA, 18 bp, Artificial Sequence
  Synthetic DNA
taattgcactcactatag

SEQ ID NO: 6091 - DNA, 18 bp, Artificial Sequence
  Synthetic DNA
tacgacgactcactttag

SEQ ID NO: 6092 - DNA, 18 bp, Artificial Sequence
  Synthetic DNA
tactacgaccgactatag

SEQ ID NO: 6093 - DNA, 18 bp, Artificial Sequence
  Synthetic DNA
tactacggatcactatag

SEQ ID NO: 6094 - DNA, 18 bp, Artificial Sequence
  Synthetic DNA
tagtacgactcgctttag

SEQ ID NO: 6095 - DNA, 18 bp, Artificial Sequence
  Synthetic DNA
tagttcgacccactatag

SEQ ID NO: 6096 - DNA, 18 bp, Artificial Sequence
  Synthetic DNA
tataacgactcactataa

SEQ ID NO: 6097 - DNA, 18 bp, Artificial Sequence
  Synthetic DNA
tattaccactcagtatag

SEQ ID NO: 6098 - DNA, 18 bp, Artificial Sequence
  Synthetic DNA
tattacgactcgctatgg

SEQ ID NO: 6099 - DNA, 18 bp, Artificial Sequence
  Synthetic DNA
tcatacgactcaccatgg

SEQ ID NO: 6100 - DNA, 18 bp, Artificial Sequence
  Synthetic DNA
tcatacgactgactttag

SEQ ID NO: 6101 - DNA, 18 bp, Artificial Sequence
  Synthetic DNA
tcatactactcactctag

SEQ ID NO: 6102 - DNA, 18 bp, Artificial Sequence
  Synthetic DNA
tcatccgactcactctag

SEQ ID NO: 6103 - DNA, 18 bp, Artificial Sequence
  Synthetic DNA
tcatccgactcgctatag

SEQ ID NO: 6104 - DNA, 18 bp, Artificial Sequence
  Synthetic DNA
tgatacgacttattatag

SEQ ID NO: 6105 - DNA, 18 bp, Artificial Sequence
  Synthetic DNA
tgatacgcctcacaatag

SEQ ID NO: 6106 - DNA, 18 bp, Artificial Sequence
  Synthetic DNA
tgatgcgactcagtatag

SEQ ID NO: 6107 - DNA, 18 bp, Artificial Sequence
  Synthetic DNA
tggtccgactcactatag

SEQ ID NO: 6108 - DNA, 18 bp, Artificial Sequence
  Synthetic DNA
ttatacgactcaccgtag

SEQ ID NO: 6109 - DNA, 18 bp, Artificial Sequence
  Synthetic DNA
ttatacgactcactagcg

SEQ ID NO: 6110 - DNA, 18 bp, Artificial Sequence
  Synthetic DNA
ttatacgactcactttaa

SEQ ID NO: 6111 - DNA, 18 bp, Artificial Sequence
  Synthetic DNA
taatacgactctatattg

SEQ ID NO: 6112 - DNA, 18 bp, Artificial Sequence
  Synthetic DNA
ttatacgactcaccttag

SEQ ID NO: 6113 - DNA, 18 bp, Artificial Sequence
  Synthetic DNA
tagatcgactcactatag

SEQ ID NO: 6114 - DNA, 18 bp, Artificial Sequence
  Synthetic DNA
tgattcgactcactttag

SEQ ID NO: 6115 - DNA, 18 bp, Artificial Sequence
  Synthetic DNA
ttataagactcattatag

SEQ ID NO: 6116 - DNA, 18 bp, Artificial Sequence
  Synthetic DNA
tactacgactcacttttg

SEQ ID NO: 6117 - DNA, 18 bp, Artificial Sequence
  Synthetic DNA
taatactactctctgtag

SEQ ID NO: 6118 - DNA, 18 bp, Artificial Sequence
  Synthetic DNA
taatgcgtatcactatag

SEQ ID NO: 6119 - DNA, 18 bp, Artificial Sequence
  Synthetic DNA
taattcgtcccactatag

SEQ ID NO: 6120 - DNA, 18 bp, Artificial Sequence
  Synthetic DNA
tgataagtctcactatag

SEQ ID NO: 6121 - DNA, 18 bp, Artificial Sequence
  Synthetic DNA
taatccgactcacttttg

SEQ ID NO: 6122 - DNA, 18 bp, Artificial Sequence
  Synthetic DNA
caatacaactcattatag

SEQ ID NO: 6123 - DNA, 18 bp, Artificial Sequence
  Synthetic DNA
taatacgagtcattttag

SEQ ID NO: 6124 - DNA, 18 bp, Artificial Sequence
  Synthetic DNA
taatacgagttactattg

SEQ ID NO: 6125 - DNA, 18 bp, Artificial Sequence
  Synthetic DNA
taatagatctcactatag

SEQ ID NO: 6126 - DNA, 18 bp, Artificial Sequence
  Synthetic DNA
taatgcgactcaatattg

SEQ ID NO: 6127 - DNA, 18 bp, Artificial Sequence
  Synthetic DNA
taatgcgactcacaattg

SEQ ID NO: 6128 - DNA, 18 bp, Artificial Sequence
  Synthetic DNA
tattacgacttactatgg

SEQ ID NO: 6129 - DNA, 18 bp, Artificial Sequence
  Synthetic DNA
taatacgactcaattttg

SEQ ID NO: 6130 - DNA, 18 bp, Artificial Sequence
  Synthetic DNA
taatacgacacccaatag

SEQ ID NO: 6131 - DNA, 18 bp, Artificial Sequence
  Synthetic DNA
taatacgactcgcaattg

SEQ ID NO: 6132 - DNA, 18 bp, Artificial Sequence
  Synthetic DNA
tattatgaatcactatag

SEQ ID NO: 6133 - DNA, 18 bp, Artificial Sequence
  Synthetic DNA
cattacgactctctatag

SEQ ID NO: 6134 - DNA, 18 bp, Artificial Sequence
  Synthetic DNA
taacacgacacactattg

SEQ ID NO: 6135 - DNA, 18 bp, Artificial Sequence
  Synthetic DNA
aaatacgattcaccatag

SEQ ID NO: 6136 - DNA, 18 bp, Artificial Sequence
  Synthetic DNA
cattccgactcactatag

SEQ ID NO: 6137 - DNA, 18 bp, Artificial Sequence
  Synthetic DNA
taacacgactctatatag

SEQ ID NO: 6138 - DNA, 18 bp, Artificial Sequence
  Synthetic DNA
taataagacacagtatag

SEQ ID NO: 6139 - DNA, 18 bp, Artificial Sequence
  Synthetic DNA
taatacgactcactcagg

SEQ ID NO: 6140 - DNA, 18 bp, Artificial Sequence
  Synthetic DNA
taatatgcctcactattg

SEQ ID NO: 6141 - DNA, 18 bp, Artificial Sequence
  Synthetic DNA
tcacacgactcgctatag

SEQ ID NO: 6142 - DNA, 18 bp, Artificial Sequence
  Synthetic DNA
tgatacgattcacaatag

SEQ ID NO: 6143 - DNA, 18 bp, Artificial Sequence
  Synthetic DNA
ttatacgactgactatcg

SEQ ID NO: 6144 - DNA, 18 bp, Artificial Sequence
  Synthetic DNA
taatttgactcactattg

SEQ ID NO: 6145 - DNA, 18 bp, Artificial Sequence
  Synthetic DNA
ttttacgactcacaatag

SEQ ID NO: 6146 - DNA, 18 bp, Artificial Sequence
  Synthetic DNA
taataccactctctattg

SEQ ID NO: 6147 - DNA, 18 bp, Artificial Sequence
  Synthetic DNA
aaatactgctcactatag

SEQ ID NO: 6148 - DNA, 18 bp, Artificial Sequence
  Synthetic DNA
aaataggtctcactatag

SEQ ID NO: 6149 - DNA, 18 bp, Artificial Sequence
  Synthetic DNA
tataccgactcactatag

SEQ ID NO: 6150 - DNA, 18 bp, Artificial Sequence
  Synthetic DNA
taacacgactctctttag

SEQ ID NO: 6151 - DNA, 18 bp, Artificial Sequence
  Synthetic DNA
taatacgtttcactgtag

SEQ ID NO: 6152 - DNA, 18 bp, Artificial Sequence
  Synthetic DNA
taattcgactcacattag

SEQ ID NO: 6153 - DNA, 18 bp, Artificial Sequence
  Synthetic DNA
tacaacgtctcactatag

SEQ ID NO: 6154 - DNA, 18 bp, Artificial Sequence
  Synthetic DNA
taataagattcactattg

SEQ ID NO: 6155 - DNA, 18 bp, Artificial Sequence
  Synthetic DNA
taatacgactctctttcg

SEQ ID NO: 6156 - DNA, 18 bp, Artificial Sequence
  Synthetic DNA
taatacgagtcacttttg

SEQ ID NO: 6157 - DNA, 18 bp, Artificial Sequence
  Synthetic DNA
taattctactcactatcg

SEQ ID NO: 6158 - DNA, 18 bp, Artificial Sequence
  Synthetic DNA
tacatcgactcactatag

SEQ ID NO: 6159 - DNA, 18 bp, Artificial Sequence
  Synthetic DNA
tattgcgactctctatag

SEQ ID NO: 6160 - DNA, 18 bp, Artificial Sequence
  Synthetic DNA
taacacgacaaactatag

SEQ ID NO: 6161 - DNA, 18 bp, Artificial Sequence
  Synthetic DNA
taataggactaactaaag

SEQ ID NO: 6162 - DNA, 18 bp, Artificial Sequence
  Synthetic DNA
taattcgactccctaaag

SEQ ID NO: 6163 - DNA, 18 bp, Artificial Sequence
  Synthetic DNA
tgatactactcactaaag

SEQ ID NO: 6164 - DNA, 18 bp, Artificial Sequence
  Synthetic DNA
ttatatggctcactatag

SEQ ID NO: 6165 - DNA, 18 bp, Artificial Sequence
  Synthetic DNA
aaataagactgactatag

SEQ ID NO: 6166 - DNA, 18 bp, Artificial Sequence
  Synthetic DNA
acatacgagtcactatag

SEQ ID NO: 6167 - DNA, 18 bp, Artificial Sequence
  Synthetic DNA
cactacgactcactaaag

SEQ ID NO: 6168 - DNA, 18 bp, Artificial Sequence
  Synthetic DNA
ctatacgactcactatcg

SEQ ID NO: 6169 - DNA, 18 bp, Artificial Sequence
  Synthetic DNA
taaaacgactcaatatgg

SEQ ID NO: 6170 - DNA, 18 bp, Artificial Sequence
  Synthetic DNA
taacacaacttactatag

SEQ ID NO: 6171 - DNA, 18 bp, Artificial Sequence
  Synthetic DNA
taagacgattcactaaag

SEQ ID NO: 6172 - DNA, 18 bp, Artificial Sequence
  Synthetic DNA
taataccacttactatcg

SEQ ID NO: 6173 - DNA, 18 bp, Artificial Sequence
  Synthetic DNA
taatacgaataagtatag

SEQ ID NO: 6174 - DNA, 18 bp, Artificial Sequence
  Synthetic DNA
taatacgcctcattctag

SEQ ID NO: 6175 - DNA, 18 bp, Artificial Sequence
  Synthetic DNA
taatacggctcattttag

SEQ ID NO: 6176 - DNA, 18 bp, Artificial Sequence
  Synthetic DNA
taatacgtgtcagtatag

SEQ ID NO: 6177 - DNA, 18 bp, Artificial Sequence
  Synthetic DNA
taatactactcattacag

SEQ ID NO: 6178 - DNA, 18 bp, Artificial Sequence
  Synthetic DNA
taatactactcgttatag

SEQ ID NO: 6179 - DNA, 18 bp, Artificial Sequence
  Synthetic DNA
taatatgtctcactatgg

SEQ ID NO: 6180 - DNA, 18 bp, Artificial Sequence
  Synthetic DNA
taatccgactcactctcg

SEQ ID NO: 6181 - DNA, 18 bp, Artificial Sequence
  Synthetic DNA
taattcgactccctctag

SEQ ID NO: 6182 - DNA, 18 bp, Artificial Sequence
  Synthetic DNA
tagtaagactcattatag

SEQ ID NO: 6183 - DNA, 18 bp, Artificial Sequence
  Synthetic DNA
tagtacgattcactacag

SEQ ID NO: 6184 - DNA, 18 bp, Artificial Sequence
  Synthetic DNA
tcagacgattcactatag

SEQ ID NO: 6185 - DNA, 18 bp, Artificial Sequence
  Synthetic DNA
tgatacggctcactttag

SEQ ID NO: 6186 - DNA, 18 bp, Artificial Sequence
  Synthetic DNA
tgattcgactcagtatag

SEQ ID NO: 6187 - DNA, 18 bp, Artificial Sequence
  Synthetic DNA
ttataccactcagtatag

SEQ ID NO: 6188 - DNA, 18 bp, Artificial Sequence
  Synthetic DNA
ttatacgactgaatatag

SEQ ID NO: 6189 - DNA, 18 bp, Artificial Sequence
  Synthetic DNA
taattcttctcactatag

SEQ ID NO: 6190 - DNA, 18 bp, Artificial Sequence
  Synthetic DNA
aaattcgactcactttag

SEQ ID NO: 6191 - DNA, 18 bp, Artificial Sequence
  Synthetic DNA
ttacacgactaactatag

SEQ ID NO: 6192 - DNA, 18 bp, Artificial Sequence
  Synthetic DNA
ttatccgactctctatag

SEQ ID NO: 6193 - DNA, 18 bp, Artificial Sequence
  Synthetic DNA
tattacgactctctctag

SEQ ID NO: 6194 - DNA, 18 bp, Artificial Sequence
  Synthetic DNA
taataagtctaactatag

SEQ ID NO: 6195 - DNA, 18 bp, Artificial Sequence
  Synthetic DNA
ttatacgactcacaatcg

SEQ ID NO: 6196 - DNA, 18 bp, Artificial Sequence
  Synthetic DNA
taaaaccactctctatag

SEQ ID NO: 6197 - DNA, 18 bp, Artificial Sequence
  Synthetic DNA
taatatctctcactatag

SEQ ID NO: 6198 - DNA, 18 bp, Artificial Sequence
  Synthetic DNA
aaataccactaactatag

SEQ ID NO: 6199 - DNA, 18 bp, Artificial Sequence
  Synthetic DNA
aaatactacccactatag

SEQ ID NO: 6200 - DNA, 18 bp, Artificial Sequence
  Synthetic DNA
caatgcgactaactatag

SEQ ID NO: 6201 - DNA, 18 bp, Artificial Sequence
  Synthetic DNA
gtatacgtctcactatag

SEQ ID NO: 6202 - DNA, 18 bp, Artificial Sequence
  Synthetic DNA
taaaatgcctcactatag

SEQ ID NO: 6203 - DNA, 18 bp, Artificial Sequence
  Synthetic DNA
taatacgacacatgatag

SEQ ID NO: 6204 - DNA, 18 bp, Artificial Sequence
  Synthetic DNA
taatacgataccctatag

SEQ ID NO: 6205 - DNA, 18 bp, Artificial Sequence
  Synthetic DNA
taatactactaaatatag

SEQ ID NO: 6206 - DNA, 18 bp, Artificial Sequence
  Synthetic DNA
taatattcctcactatag

SEQ ID NO: 6207 - DNA, 18 bp, Artificial Sequence
  Synthetic DNA
taattcgactcaatctag

SEQ ID NO: 6208 - DNA, 18 bp, Artificial Sequence
  Synthetic DNA
taattcgactcaatgtag

SEQ ID NO: 6209 - DNA, 18 bp, Artificial Sequence
  Synthetic DNA
tactaccattcactatag

SEQ ID NO: 6210 - DNA, 18 bp, Artificial Sequence
  Synthetic DNA
tgatacgactcactcaag

SEQ ID NO: 6211 - DNA, 18 bp, Artificial Sequence
  Synthetic DNA
taatacgtctcactttcg

SEQ ID NO: 6212 - DNA, 18 bp, Artificial Sequence
  Synthetic DNA
tattacggctcactattg

SEQ ID NO: 6213 - DNA, 18 bp, Artificial Sequence
  Synthetic DNA
aaatacgactcacaatgg

SEQ ID NO: 6214 - DNA, 18 bp, Artificial Sequence
  Synthetic DNA
aaatacgactccctaaag

SEQ ID NO: 6215 - DNA, 18 bp, Artificial Sequence
  Synthetic DNA
aaattcgagtcactatag

SEQ ID NO: 6216 - DNA, 18 bp, Artificial Sequence
  Synthetic DNA
taacactactcacaatag

SEQ ID NO: 6217 - DNA, 18 bp, Artificial Sequence
  Synthetic DNA
taataagactccctttag

SEQ ID NO: 6218 - DNA, 18 bp, Artificial Sequence
  Synthetic DNA
taatacaagtcactttag

SEQ ID NO: 6219 - DNA, 18 bp, Artificial Sequence
  Synthetic DNA
taatacctatcactatag

SEQ ID NO: 6220 - DNA, 18 bp, Artificial Sequence
  Synthetic DNA
taatacgactgattaaag

SEQ ID NO: 6221 - DNA, 18 bp, Artificial Sequence
  Synthetic DNA
taatacgatccactaaag

SEQ ID NO: 6222 - DNA, 18 bp, Artificial Sequence
  Synthetic DNA
taatactactcactgaag

SEQ ID NO: 6223 - DNA, 18 bp, Artificial Sequence
  Synthetic DNA
taatactcctcactaaag

SEQ ID NO: 6224 - DNA, 18 bp, Artificial Sequence
  Synthetic DNA
taataggaatcactattg

SEQ ID NO: 6225 - DNA, 18 bp, Artificial Sequence
  Synthetic DNA
taatgtgactcaatatag

SEQ ID NO: 6226 - DNA, 18 bp, Artificial Sequence
  Synthetic DNA
tagttcgtctcactatag

SEQ ID NO: 6227 - DNA, 18 bp, Artificial Sequence
  Synthetic DNA
tgaaacgactcacaatag

SEQ ID NO: 6228 - DNA, 18 bp, Artificial Sequence
  Synthetic DNA
taaatcgactcactaaag

SEQ ID NO: 6229 - DNA, 18 bp, Artificial Sequence
  Synthetic DNA
ctaaacgactcactatag

SEQ ID NO: 6230 - DNA, 18 bp, Artificial Sequence
  Synthetic DNA
taatacgacccaatattg

SEQ ID NO: 6231 - DNA, 18 bp, Artificial Sequence
  Synthetic DNA
tattactcctcactatag

SEQ ID NO: 6232 - DNA, 18 bp, Artificial Sequence
  Synthetic DNA
ttatacgactaactctag

SEQ ID NO: 6233 - DNA, 18 bp, Artificial Sequence
  Synthetic DNA
caaaacgacacactatag

SEQ ID NO: 6234 - DNA, 18 bp, Artificial Sequence
  Synthetic DNA
taaaactactcaatatag

SEQ ID NO: 6235 - DNA, 18 bp, Artificial Sequence
  Synthetic DNA
taatacgactcaacttag

SEQ ID NO: 6236 - DNA, 18 bp, Artificial Sequence
  Synthetic DNA
ttatacgactgactaaag

SEQ ID NO: 6237 - DNA, 18 bp, Artificial Sequence
  Synthetic DNA
tataacgtctcactatag

SEQ ID NO: 6238 - DNA, 18 bp, Artificial Sequence
  Synthetic DNA
taaaaatactcactatag

SEQ ID NO: 6239 - DNA, 18 bp, Artificial Sequence
  Synthetic DNA
tattacgactcaccaaag

SEQ ID NO: 6240 - DNA, 18 bp, Artificial Sequence
  Synthetic DNA
taattcgactctccatag

SEQ ID NO: 6241 - DNA, 18 bp, Artificial Sequence
  Synthetic DNA
tactacaactcactttag

SEQ ID NO: 6242 - DNA, 18 bp, Artificial Sequence
  Synthetic DNA
taatactacttactttag

SEQ ID NO: 6243 - DNA, 18 bp, Artificial Sequence
  Synthetic DNA
tactacgtctcacaatag

SEQ ID NO: 6244 - DNA, 18 bp, Artificial Sequence
  Synthetic DNA
tgatacgtttcactatag

SEQ ID NO: 6245 - DNA, 18 bp, Artificial Sequence
  Synthetic DNA
taattcgacacactctag

SEQ ID NO: 6246 - DNA, 18 bp, Artificial Sequence
  Synthetic DNA
ttatactactcactctag

SEQ ID NO: 6247 - DNA, 18 bp, Artificial Sequence
  Synthetic DNA
taatacgtctaattatag

SEQ ID NO: 6248 - DNA, 18 bp, Artificial Sequence
  Synthetic DNA
taatatgactcacaacag

SEQ ID NO: 6249 - DNA, 18 bp, Artificial Sequence
  Synthetic DNA
tattacgactcacaatgg

SEQ ID NO: 6250 - DNA, 18 bp, Artificial Sequence
  Synthetic DNA
caatacgactcattaaag

SEQ ID NO: 6251 - DNA, 18 bp, Artificial Sequence
  Synthetic DNA
tactacgatacactatag

SEQ ID NO: 6252 - DNA, 18 bp, Artificial Sequence
  Synthetic DNA
tattacgactgactttag

SEQ ID NO: 6253 - DNA, 18 bp, Artificial Sequence
  Synthetic DNA
caatacctctcactatag

SEQ ID NO: 6254 - DNA, 18 bp, Artificial Sequence
  Synthetic DNA
taataagactgactaaag

SEQ ID NO: 6255 - DNA, 18 bp, Artificial Sequence
  Synthetic DNA
taataccactcactgaag

SEQ ID NO: 6256 - DNA, 18 bp, Artificial Sequence
  Synthetic DNA
taataccactcgctttag

SEQ ID NO: 6257 - DNA, 18 bp, Artificial Sequence
  Synthetic DNA
taatacgactaactagtg

SEQ ID NO: 6258 - DNA, 18 bp, Artificial Sequence
  Synthetic DNA
taatacgactccctaacg

SEQ ID NO: 6259 - DNA, 18 bp, Artificial Sequence
  Synthetic DNA
taatacgactctttatcg

SEQ ID NO: 6260 - DNA, 18 bp, Artificial Sequence
  Synthetic DNA
taatactaatcactctag

SEQ ID NO: 6261 - DNA, 18 bp, Artificial Sequence
  Synthetic DNA
tagtacgattcactttag

SEQ ID NO: 6262 - DNA, 18 bp, Artificial Sequence
  Synthetic DNA
tcatacgattcactatcg

SEQ ID NO: 6263 - DNA, 18 bp, Artificial Sequence
  Synthetic DNA
ttatacgactccccatag

SEQ ID NO: 6264 - DNA, 18 bp, Artificial Sequence
  Synthetic DNA
aaataccactccctatag

SEQ ID NO: 6265 - DNA, 18 bp, Artificial Sequence
  Synthetic DNA
aactacgtctcactatag

SEQ ID NO: 6266 - DNA, 18 bp, Artificial Sequence
  Synthetic DNA
caaaacgacttactatag

SEQ ID NO: 6267 - DNA, 18 bp, Artificial Sequence
  Synthetic DNA
caacacggctcactatag

SEQ ID NO: 6268 - DNA, 18 bp, Artificial Sequence
  Synthetic DNA
caatacaactcactatgg

SEQ ID NO: 6269 - DNA, 18 bp, Artificial Sequence
  Synthetic DNA
caatacgactcagcatag

SEQ ID NO: 6270 - DNA, 18 bp, Artificial Sequence
  Synthetic DNA
caatatggctcactatag

SEQ ID NO: 6271 - DNA, 18 bp, Artificial Sequence
  Synthetic DNA
taacacggctcattatag

SEQ ID NO: 6272 - DNA, 18 bp, Artificial Sequence
  Synthetic DNA
taataatagtcactatag

SEQ ID NO: 6273 - DNA, 18 bp, Artificial Sequence
  Synthetic DNA
taatacaactcagcatag

SEQ ID NO: 6274 - DNA, 18 bp, Artificial Sequence
  Synthetic DNA
taatacgaataactatgg

SEQ ID NO: 6275 - DNA, 18 bp, Artificial Sequence
  Synthetic DNA
taatacgaataactctag

SEQ ID NO: 6276 - DNA, 18 bp, Artificial Sequence
  Synthetic DNA
taatacgacccaaaatag

SEQ ID NO: 6277 - DNA, 18 bp, Artificial Sequence
  Synthetic DNA
taatacgacctactatgg

SEQ ID NO: 6278 - DNA, 18 bp, Artificial Sequence
  Synthetic DNA
taatacgagatactatag

SEQ ID NO: 6279 - DNA, 18 bp, Artificial Sequence
  Synthetic DNA
taatacgattcaatatgg

SEQ ID NO: 6280 - DNA, 18 bp, Artificial Sequence
  Synthetic DNA
taatacgcctgactttag

SEQ ID NO: 6281 - DNA, 18 bp, Artificial Sequence
  Synthetic DNA
taatacggctcactaacg

SEQ ID NO: 6282 - DNA, 18 bp, Artificial Sequence
  Synthetic DNA
taatacggctccctttag

SEQ ID NO: 6283 - DNA, 18 bp, Artificial Sequence
  Synthetic DNA
taatacggttcactttag

SEQ ID NO: 6284 - DNA, 18 bp, Artificial Sequence
  Synthetic DNA
taatactactcacaagag

SEQ ID NO: 6285 - DNA, 18 bp, Artificial Sequence
  Synthetic DNA
taatactactgactatgg

SEQ ID NO: 6286 - DNA, 18 bp, Artificial Sequence
  Synthetic DNA
taatatgaatgactatag

SEQ ID NO: 6287 - DNA, 18 bp, Artificial Sequence
  Synthetic DNA
taatccgacacaccatag

SEQ ID NO: 6288 - DNA, 18 bp, Artificial Sequence
  Synthetic DNA
taatctggctcactatag

SEQ ID NO: 6289 - DNA, 18 bp, Artificial Sequence
  Synthetic DNA
taatgcgagtcactaaag

SEQ ID NO: 6290 - DNA, 18 bp, Artificial Sequence
  Synthetic DNA
taattcgactccctatcg

SEQ ID NO: 6291 - DNA, 18 bp, Artificial Sequence
  Synthetic DNA
tactacgactcacaatcg

SEQ ID NO: 6292 - DNA, 18 bp, Artificial Sequence
  Synthetic DNA
tattacgactaactatgg

SEQ ID NO: 6293 - DNA, 18 bp, Artificial Sequence
  Synthetic DNA
tattacgccccactatag

SEQ ID NO: 6294 - DNA, 18 bp, Artificial Sequence
  Synthetic DNA
tcatacgagttactatag

SEQ ID NO: 6295 - DNA, 18 bp, Artificial Sequence
  Synthetic DNA
tcatacgattcactgtag

SEQ ID NO: 6296 - DNA, 18 bp, Artificial Sequence
  Synthetic DNA
tcatactacgcactatag

SEQ ID NO: 6297 - DNA, 18 bp, Artificial Sequence
  Synthetic DNA
ttatacgagacactatag

SEQ ID NO: 6298 - DNA, 18 bp, Artificial Sequence
  Synthetic DNA
aaatacgcctcactgtag

SEQ ID NO: 6299 - DNA, 18 bp, Artificial Sequence
  Synthetic DNA
aaatacggcccactatag

SEQ ID NO: 6300 - DNA, 18 bp, Artificial Sequence
  Synthetic DNA
aaatacggctcactagag

SEQ ID NO: 6301 - DNA, 18 bp, Artificial Sequence
  Synthetic DNA
agatacgactcactacag

SEQ ID NO: 6302 - DNA, 18 bp, Artificial Sequence
  Synthetic DNA
caatacggctcactttag

SEQ ID NO: 6303 - DNA, 18 bp, Artificial Sequence
  Synthetic DNA
caataggactcattatag

SEQ ID NO: 6304 - DNA, 18 bp, Artificial Sequence
  Synthetic DNA
caatccgactcactatcg

SEQ ID NO: 6305 - DNA, 18 bp, Artificial Sequence
  Synthetic DNA
gaatacgactcactccag

SEQ ID NO: 6306 - DNA, 18 bp, Artificial Sequence
  Synthetic DNA
gaatacgacttactctag

SEQ ID NO: 6307 - DNA, 18 bp, Artificial Sequence
  Synthetic DNA
gaatacgtatcactatag

SEQ ID NO: 6308 - DNA, 18 bp, Artificial Sequence
  Synthetic DNA
gactatgactcactatag

SEQ ID NO: 6309 - DNA, 18 bp, Artificial Sequence
  Synthetic DNA
gattacgattcactatag

SEQ ID NO: 6310 - DNA, 18 bp, Artificial Sequence
  Synthetic DNA
taaaacgactcaagatag

SEQ ID NO: 6311 - DNA, 18 bp, Artificial Sequence
  Synthetic DNA
taaaacgactcactgtgg

SEQ ID NO: 6312 - DNA, 18 bp, Artificial Sequence
  Synthetic DNA
taaaacgagccactatag

SEQ ID NO: 6313 - DNA, 18 bp, Artificial Sequence
  Synthetic DNA
taaaacgaggcactatag

SEQ ID NO: 6314 - DNA, 18 bp, Artificial Sequence
  Synthetic DNA
taaaacggctcactgtag

SEQ ID NO: 6315 - DNA, 18 bp, Artificial Sequence
  Synthetic DNA
taacaagactcactatgg

SEQ ID NO: 6316 - DNA, 18 bp, Artificial Sequence
  Synthetic DNA
taacacgactcacgttag

SEQ ID NO: 6317 - DNA, 18 bp, Artificial Sequence
  Synthetic DNA
taacacgactcactaggg

SEQ ID NO: 6318 - DNA, 18 bp, Artificial Sequence
  Synthetic DNA
taacacgagtcattatag

SEQ ID NO: 6319 - DNA, 18 bp, Artificial Sequence
  Synthetic DNA
taacagtactcactatag

SEQ ID NO: 6320 - DNA, 18 bp, Artificial Sequence
  Synthetic DNA
taagaccactcaatatag

SEQ ID NO: 6321 - DNA, 18 bp, Artificial Sequence
  Synthetic DNA
taataagacttagtatag

SEQ ID NO: 6322 - DNA, 18 bp, Artificial Sequence
  Synthetic DNA
taatacaacccactatcg

SEQ ID NO: 6323 - DNA, 18 bp, Artificial Sequence
  Synthetic DNA
taatacaacgcactatgg

SEQ ID NO: 6324 - DNA, 18 bp, Artificial Sequence
  Synthetic DNA
taatacacctcactatcg

SEQ ID NO: 6325 - DNA, 18 bp, Artificial Sequence
  Synthetic DNA
taataccaatcactagag

SEQ ID NO: 6326 - DNA, 18 bp, Artificial Sequence
  Synthetic DNA
taataccactcaatacag

SEQ ID NO: 6327 - DNA, 18 bp, Artificial Sequence
  Synthetic DNA
taatacgacccactgtgg

SEQ ID NO: 6328 - DNA, 18 bp, Artificial Sequence
  Synthetic DNA
taatacgacgaaatatag

SEQ ID NO: 6329 - DNA, 18 bp, Artificial Sequence
  Synthetic DNA
taatacgactagatatag

SEQ ID NO: 6330 - DNA, 18 bp, Artificial Sequence
  Synthetic DNA
taatacgactcacttcgg

SEQ ID NO: 6331 - DNA, 18 bp, Artificial Sequence
  Synthetic DNA
taatacgactcaggttag

SEQ ID NO: 6332 - DNA, 18 bp, Artificial Sequence
  Synthetic DNA
taatacgactcgttagag

SEQ ID NO: 6333 - DNA, 18 bp, Artificial Sequence
  Synthetic DNA
taatacgactgcctatcg

SEQ ID NO: 6334 - DNA, 18 bp, Artificial Sequence
  Synthetic DNA
taatacgatccactagag

SEQ ID NO: 6335 - DNA, 18 bp, Artificial Sequence
  Synthetic DNA
taatacgcctcaatgtag

SEQ ID NO: 6336 - DNA, 18 bp, Artificial Sequence
  Synthetic DNA
taatacggcacagtatag

SEQ ID NO: 6337 - DNA, 18 bp, Artificial Sequence
  Synthetic DNA
taatacggctctctatcg

SEQ ID NO: 6338 - DNA, 18 bp, Artificial Sequence
  Synthetic DNA
taatacgggttactatag

SEQ ID NO: 6339 - DNA, 18 bp, Artificial Sequence
  Synthetic DNA
taatacgtctcacgaaag

SEQ ID NO: 6340 - DNA, 18 bp, Artificial Sequence
  Synthetic DNA
taatactactcaccgtag

SEQ ID NO: 6341 - DNA, 18 bp, Artificial Sequence
  Synthetic DNA
taatactactccctctag

SEQ ID NO: 6342 - DNA, 18 bp, Artificial Sequence
  Synthetic DNA
taatactagtcgctatag

SEQ ID NO: 6343 - DNA, 18 bp, Artificial Sequence
  Synthetic DNA
taataggacccacaatag

SEQ ID NO: 6344 - DNA, 18 bp, Artificial Sequence
  Synthetic DNA
taataggaccctctatag

SEQ ID NO: 6345 - DNA, 18 bp, Artificial Sequence
  Synthetic DNA
taataggactcgctgtag

SEQ ID NO: 6346 - DNA, 18 bp, Artificial Sequence
  Synthetic DNA
taataggtctcagtatag

SEQ ID NO: 6347 - DNA, 18 bp, Artificial Sequence
  Synthetic DNA
taatatgaatccctatag

SEQ ID NO: 6348 - DNA, 18 bp, Artificial Sequence
  Synthetic DNA
taatatgactaactacag

SEQ ID NO: 6349 - DNA, 18 bp, Artificial Sequence
  Synthetic DNA
taatatgactcggtatag

SEQ ID NO: 6350 - DNA, 18 bp, Artificial Sequence
  Synthetic DNA
taatatgacttactagag

SEQ ID NO: 6351 - DNA, 18 bp, Artificial Sequence
  Synthetic DNA
taatatggctcactctag

SEQ ID NO: 6352 - DNA, 18 bp, Artificial Sequence
  Synthetic DNA
taatatggctgactatag

SEQ ID NO: 6353 - DNA, 18 bp, Artificial Sequence
  Synthetic DNA
taatccgactaactgtag

SEQ ID NO: 6354 - DNA, 18 bp, Artificial Sequence
  Synthetic DNA
taatccgactcactatta

SEQ ID NO: 6355 - DNA, 18 bp, Artificial Sequence
  Synthetic DNA
taatccgactcgttatag

SEQ ID NO: 6356 - DNA, 18 bp, Artificial Sequence
  Synthetic DNA
taatgcgactcccaatag

SEQ ID NO: 6357 - DNA, 18 bp, Artificial Sequence
  Synthetic DNA
taatgcgacttcctatag

SEQ ID NO: 6358 - DNA, 18 bp, Artificial Sequence
  Synthetic DNA
taatgcgtctcaccatag

SEQ ID NO: 6359 - DNA, 18 bp, Artificial Sequence
  Synthetic DNA
taatgcgtctcactatgg

SEQ ID NO: 6360 - DNA, 18 bp, Artificial Sequence
  Synthetic DNA
taattcgactcaagatag

SEQ ID NO: 6361 - DNA, 18 bp, Artificial Sequence
  Synthetic DNA
taccacgacccactatag

SEQ ID NO: 6362 - DNA, 18 bp, Artificial Sequence
  Synthetic DNA
taccacgattcactatag

SEQ ID NO: 6363 - DNA, 18 bp, Artificial Sequence
  Synthetic DNA
tactacgactcgccatag

SEQ ID NO: 6364 - DNA, 18 bp, Artificial Sequence
  Synthetic DNA
tactacggctcactattg

SEQ ID NO: 6365 - DNA, 18 bp, Artificial Sequence
  Synthetic DNA
tactatgactcactgtag

SEQ ID NO: 6366 - DNA, 18 bp, Artificial Sequence
  Synthetic DNA
tagcacgactcagtatag

SEQ ID NO: 6367 - DNA, 18 bp, Artificial Sequence
  Synthetic DNA
tagtacgactcaatgtag

SEQ ID NO: 6368 - DNA, 18 bp, Artificial Sequence
  Synthetic DNA
tagtatgactcgctatag

SEQ ID NO: 6369 - DNA, 18 bp, Artificial Sequence
  Synthetic DNA
tatcacgactcactataa

SEQ ID NO: 6370 - DNA, 18 bp, Artificial Sequence
  Synthetic DNA
tattacgagtcactgtag

SEQ ID NO: 6371 - DNA, 18 bp, Artificial Sequence
  Synthetic DNA
tattacggctcactacag

SEQ ID NO: 6372 - DNA, 18 bp, Artificial Sequence
  Synthetic DNA
tattaggactccctatag

SEQ ID NO: 6373 - DNA, 18 bp, Artificial Sequence
  Synthetic DNA
tattgcgacgcactatag

SEQ ID NO: 6374 - DNA, 18 bp, Artificial Sequence
  Synthetic DNA
tcacacgcctcactatag

SEQ ID NO: 6375 - DNA, 18 bp, Artificial Sequence
  Synthetic DNA
tcatacgaatcaccatag

SEQ ID NO: 6376 - DNA, 18 bp, Artificial Sequence
  Synthetic DNA
tcatacgaatcactgtag

SEQ ID NO: 6377 - DNA, 18 bp, Artificial Sequence
  Synthetic DNA
tcatacgactcacttgag

SEQ ID NO: 6378 - DNA, 18 bp, Artificial Sequence
  Synthetic DNA
tcatacgagtcactatgg

SEQ ID NO: 6379 - DNA, 18 bp, Artificial Sequence
  Synthetic DNA
tcatactactcgctatag

SEQ ID NO: 6380 - DNA, 18 bp, Artificial Sequence
  Synthetic DNA
tcataggactcactctag

SEQ ID NO: 6381 - DNA, 18 bp, Artificial Sequence
  Synthetic DNA
tcataggactcattatag

SEQ ID NO: 6382 - DNA, 18 bp, Artificial Sequence
  Synthetic DNA
tcataggactccctatag

SEQ ID NO: 6383 - DNA, 18 bp, Artificial Sequence
  Synthetic DNA
tgatacgactgactaaag

SEQ ID NO: 6384 - DNA, 18 bp, Artificial Sequence
  Synthetic DNA
tgatccgacttactatag

SEQ ID NO: 6385 - DNA, 18 bp, Artificial Sequence
  Synthetic DNA
ttatacgaatcactagag

SEQ ID NO: 6386 - DNA, 18 bp, Artificial Sequence
  Synthetic DNA
ttatacgacgcattatag

SEQ ID NO: 6387 - DNA, 18 bp, Artificial Sequence
  Synthetic DNA
ttatacgactcccgatag

SEQ ID NO: 6388 - DNA, 18 bp, Artificial Sequence
  Synthetic DNA
tcatacgactcacttaag

SEQ ID NO: 6389 - DNA, 18 bp, Artificial Sequence
  Synthetic DNA
tataacgactcactgtag

SEQ ID NO: 6390 - DNA, 18 bp, Artificial Sequence
  Synthetic DNA
ttgtacgactcactattg

SEQ ID NO: 6391 - DNA, 18 bp, Artificial Sequence
  Synthetic DNA
tattccgacacactatag

SEQ ID NO: 6392 - DNA, 18 bp, Artificial Sequence
  Synthetic DNA
ttataggactcattatag

SEQ ID NO: 6393 - DNA, 18 bp, Artificial Sequence
  Synthetic DNA
taatacgactcatttaag

SEQ ID NO: 6394 - DNA, 18 bp, Artificial Sequence
  Synthetic DNA
taataagccacactatag

SEQ ID NO: 6395 - DNA, 18 bp, Artificial Sequence
  Synthetic DNA
tactacgactctcaatag

SEQ ID NO: 6396 - DNA, 18 bp, Artificial Sequence
  Synthetic DNA
ttatacgccttactatag

SEQ ID NO: 6397 - DNA, 18 bp, Artificial Sequence
  Synthetic DNA
taattctacacactatag

SEQ ID NO: 6398 - DNA, 18 bp, Artificial Sequence
  Synthetic DNA
taaatcgactcaatatag

SEQ ID NO: 6399 - DNA, 18 bp, Artificial Sequence
  Synthetic DNA
tattaccactcactattg

SEQ ID NO: 6400 - DNA, 18 bp, Artificial Sequence
  Synthetic DNA
taatacgactcgttttag

SEQ ID NO: 6401 - DNA, 18 bp, Artificial Sequence
  Synthetic DNA
taatacgattaaatatag

SEQ ID NO: 6402 - DNA, 18 bp, Artificial Sequence
  Synthetic DNA
taatactgctcactttag

SEQ ID NO: 6403 - DNA, 18 bp, Artificial Sequence
  Synthetic DNA
taatgcgacaaactatag

SEQ ID NO: 6404 - DNA, 18 bp, Artificial Sequence
  Synthetic DNA
taattcaactcagtatag

SEQ ID NO: 6405 - DNA, 18 bp, Artificial Sequence
  Synthetic DNA
tcacacgactctctatag

SEQ ID NO: 6406 - DNA, 18 bp, Artificial Sequence
  Synthetic DNA
taataagactctctattg

SEQ ID NO: 6407 - DNA, 18 bp, Artificial Sequence
  Synthetic DNA
ttatacgactaactattg

SEQ ID NO: 6408 - DNA, 18 bp, Artificial Sequence
  Synthetic DNA
caaaacgtctcactatag

SEQ ID NO: 6409 - DNA, 18 bp, Artificial Sequence
  Synthetic DNA
ctattcgactcactatag

SEQ ID NO: 6410 - DNA, 18 bp, Artificial Sequence
  Synthetic DNA
taattctattcactatag

SEQ ID NO: 6411 - DNA, 18 bp, Artificial Sequence
  Synthetic DNA
tacttcgactcactattg

SEQ ID NO: 6412 - DNA, 18 bp, Artificial Sequence
  Synthetic DNA
tattacgactcagtattg

SEQ ID NO: 6413 - DNA, 18 bp, Artificial Sequence
  Synthetic DNA
atatatgactcactatag

SEQ ID NO: 6414 - DNA, 18 bp, Artificial Sequence
  Synthetic DNA
caatacgactctctttag

SEQ ID NO: 6415 - DNA, 18 bp, Artificial Sequence
  Synthetic DNA
ttatccgactcactaaag

SEQ ID NO: 6416 - DNA, 18 bp, Artificial Sequence
  Synthetic DNA
aaagacgtctcactatag

SEQ ID NO: 6417 - DNA, 18 bp, Artificial Sequence
  Synthetic DNA
aaatacaactccctatag

SEQ ID NO: 6418 - DNA, 18 bp, Artificial Sequence
  Synthetic DNA
aaataccaatcactatag

SEQ ID NO: 6419 - DNA, 18 bp, Artificial Sequence
  Synthetic DNA
taataagacttgctatag

SEQ ID NO: 6420 - DNA, 18 bp, Artificial Sequence
  Synthetic DNA
taatacgacccaataaag

SEQ ID NO: 6421 - DNA, 18 bp, Artificial Sequence
  Synthetic DNA
taatacgagacaatatag

SEQ ID NO: 6422 - DNA, 18 bp, Artificial Sequence
  Synthetic DNA
taatacgattctctatgg

SEQ ID NO: 6423 - DNA, 18 bp, Artificial Sequence
  Synthetic DNA
taatacggctcactaagg

SEQ ID NO: 6424 - DNA, 18 bp, Artificial Sequence
  Synthetic DNA
taatacgtcgcacaatag

SEQ ID NO: 6425 - DNA, 18 bp, Artificial Sequence
  Synthetic DNA
taatacgtctaactgtag

SEQ ID NO: 6426 - DNA, 18 bp, Artificial Sequence
  Synthetic DNA
taatacgtgtcactgtag

SEQ ID NO: 6427 - DNA, 18 bp, Artificial Sequence
  Synthetic DNA
tattaggactgactatag

SEQ ID NO: 6428 - DNA, 18 bp, Artificial Sequence
  Synthetic DNA
ttatacgacttagtatag

SEQ ID NO: 6429 - DNA, 18 bp, Artificial Sequence
  Synthetic DNA
ttatacgtcgcactatag

SEQ ID NO: 6430 - DNA, 18 bp, Artificial Sequence
  Synthetic DNA
aaatacgactcaatattg

SEQ ID NO: 6431 - DNA, 18 bp, Artificial Sequence
  Synthetic DNA
taatacgactctctttgg

SEQ ID NO: 6432 - DNA, 18 bp, Artificial Sequence
  Synthetic DNA
taatgcaactcattatag

SEQ ID NO: 6433 - DNA, 18 bp, Artificial Sequence
  Synthetic DNA
ttatgcgactcacaatag

SEQ ID NO: 6434 - DNA, 18 bp, Artificial Sequence
  Synthetic DNA
taaaaagactcactttag

SEQ ID NO: 6435 - DNA, 18 bp, Artificial Sequence
  Synthetic DNA
taatacgactctttaaag

SEQ ID NO: 6436 - DNA, 18 bp, Artificial Sequence
  Synthetic DNA
taaaacgacacactgtag

SEQ ID NO: 6437 - DNA, 18 bp, Artificial Sequence
  Synthetic DNA
taacacgactcaccattg

SEQ ID NO: 6438 - DNA, 18 bp, Artificial Sequence
  Synthetic DNA
taatacgactatctgtag

SEQ ID NO: 6439 - DNA, 18 bp, Artificial Sequence
  Synthetic DNA
taatacgactccccaaag

SEQ ID NO: 6440 - DNA, 18 bp, Artificial Sequence
  Synthetic DNA
taatacggttcacaatag

SEQ ID NO: 6441 - DNA, 18 bp, Artificial Sequence
  Synthetic DNA
tacaacgacttactatag

SEQ ID NO: 6442 - DNA, 18 bp, Artificial Sequence
  Synthetic DNA
tactacgattcaatatag

SEQ ID NO: 6443 - DNA, 18 bp, Artificial Sequence
  Synthetic DNA
tagttcgactcattatag

SEQ ID NO: 6444 - DNA, 18 bp, Artificial Sequence
  Synthetic DNA
aaatacccctcactatag

SEQ ID NO: 6445 - DNA, 18 bp, Artificial Sequence
  Synthetic DNA
aaatacgactaactctag

SEQ ID NO: 6446 - DNA, 18 bp, Artificial Sequence
  Synthetic DNA
aactccgactcactatag

SEQ ID NO: 6447 - DNA, 18 bp, Artificial Sequence
  Synthetic DNA
aagtaccactcactatag

SEQ ID NO: 6448 - DNA, 18 bp, Artificial Sequence
  Synthetic DNA
aattacgactcactatgg

SEQ ID NO: 6449 - DNA, 18 bp, Artificial Sequence
  Synthetic DNA
caatacgactaactattg

SEQ ID NO: 6450 - DNA, 18 bp, Artificial Sequence
  Synthetic DNA
caatgcgattcactatag

SEQ ID NO: 6451 - DNA, 18 bp, Artificial Sequence
  Synthetic DNA
taaaaaggctcactatag

SEQ ID NO: 6452 - DNA, 18 bp, Artificial Sequence
  Synthetic DNA
taaaacgacttactgtag

SEQ ID NO: 6453 - DNA, 18 bp, Artificial Sequence
  Synthetic DNA
taaaacgcctaactatag

SEQ ID NO: 6454 - DNA, 18 bp, Artificial Sequence
  Synthetic DNA
taaaacgcctcactagag

SEQ ID NO: 6455 - DNA, 18 bp, Artificial Sequence
  Synthetic DNA
taaaactactccctatag

SEQ ID NO: 6456 - DNA, 18 bp, Artificial Sequence
  Synthetic DNA
taacacaactcactacag

SEQ ID NO: 6457 - DNA, 18 bp, Artificial Sequence
  Synthetic DNA
taagactactcactttag

SEQ ID NO: 6458 - DNA, 18 bp, Artificial Sequence
  Synthetic DNA
taataccactcaccttag

SEQ ID NO: 6459 - DNA, 18 bp, Artificial Sequence
  Synthetic DNA
taatacgactcactcacg

SEQ ID NO: 6460 - DNA, 18 bp, Artificial Sequence
  Synthetic DNA
taatacgacttgccatag

SEQ ID NO: 6461 - DNA, 18 bp, Artificial Sequence
  Synthetic DNA
taatacgccacaatatag

SEQ ID NO: 6462 - DNA, 18 bp, Artificial Sequence
  Synthetic DNA
taatacggctaactctag

SEQ ID NO: 6463 - DNA, 18 bp, Artificial Sequence
  Synthetic DNA
taatacggttgactatag

SEQ ID NO: 6464 - DNA, 18 bp, Artificial Sequence
  Synthetic DNA
taatacgtctcagtacag

SEQ ID NO: 6465 - DNA, 18 bp, Artificial Sequence
  Synthetic DNA
taatactgcacactatag

SEQ ID NO: 6466 - DNA, 18 bp, Artificial Sequence
  Synthetic DNA
taatccgactcaataaag

SEQ ID NO: 6467 - DNA, 18 bp, Artificial Sequence
  Synthetic DNA
taatccgactcacaacag

SEQ ID NO: 6468 - DNA, 18 bp, Artificial Sequence
  Synthetic DNA
taatgcgacacgctatag

SEQ ID NO: 6469 - DNA, 18 bp, Artificial Sequence
  Synthetic DNA
tactacgtctccctatag

SEQ ID NO: 6470 - DNA, 18 bp, Artificial Sequence
  Synthetic DNA
tagtacgagttactatag

SEQ ID NO: 6471 - DNA, 18 bp, Artificial Sequence
  Synthetic DNA
tagtacgcctcactctag

SEQ ID NO: 6472 - DNA, 18 bp, Artificial Sequence
  Synthetic DNA
tcatacgactcaaaatag

SEQ ID NO: 6473 - DNA, 18 bp, Artificial Sequence
  Synthetic DNA
tgatacaactgactatag

SEQ ID NO: 6474 - DNA, 18 bp, Artificial Sequence
  Synthetic DNA
tgatacgactcactgttg

SEQ ID NO: 6475 - DNA, 18 bp, Artificial Sequence
  Synthetic DNA
tgatacgtctcactgtag

SEQ ID NO: 6476 - DNA, 18 bp, Artificial Sequence
  Synthetic DNA
ttatacgagtcaccatag

SEQ ID NO: 6477 - DNA, 18 bp, Artificial Sequence
  Synthetic DNA
ttgtaccactcactatag

SEQ ID NO: 6478 - DNA, 18 bp, Artificial Sequence
  Synthetic DNA
atatacgactcaccatag

SEQ ID NO: 6479 - DNA, 18 bp, Artificial Sequence
  Synthetic DNA
taataccattcactaaag

SEQ ID NO: 6480 - DNA, 18 bp, Artificial Sequence
  Synthetic DNA
taatatgactcacagtag

SEQ ID NO: 6481 - DNA, 18 bp, Artificial Sequence
  Synthetic DNA
ttctaagactcactatag

SEQ ID NO: 6482 - DNA, 18 bp, Artificial Sequence
  Synthetic DNA
taaaacgatacactatag

SEQ ID NO: 6483 - DNA, 18 bp, Artificial Sequence
  Synthetic DNA
taatactactcaccaaag

SEQ ID NO: 6484 - DNA, 18 bp, Artificial Sequence
  Synthetic DNA
catttcgactcactatag

SEQ ID NO: 6485 - DNA, 18 bp, Artificial Sequence
  Synthetic DNA
taatacgactctctactg

SEQ ID NO: 6486 - DNA, 18 bp, Artificial Sequence
  Synthetic DNA
taatacgcttcactttag

SEQ ID NO: 6487 - DNA, 18 bp, Artificial Sequence
  Synthetic DNA
taatacgagtcgctttag

SEQ ID NO: 6488 - DNA, 18 bp, Artificial Sequence
  Synthetic DNA
taatccgacacaatatag

SEQ ID NO: 6489 - DNA, 18 bp, Artificial Sequence
  Synthetic DNA
taatccgacttactctag

SEQ ID NO: 6490 - DNA, 18 bp, Artificial Sequence
  Synthetic DNA
tagtacgtctcattatag

SEQ ID NO: 6491 - DNA, 18 bp, Artificial Sequence
  Synthetic DNA
tattactactcactgtag

SEQ ID NO: 6492 - DNA, 18 bp, Artificial Sequence
  Synthetic DNA
taattcgactcattaaag

SEQ ID NO: 6493 - DNA, 18 bp, Artificial Sequence
  Synthetic DNA
tattacgacccactattg

SEQ ID NO: 6494 - DNA, 18 bp, Artificial Sequence
  Synthetic DNA
atatacgactcactatgg

SEQ ID NO: 6495 - DNA, 18 bp, Artificial Sequence
  Synthetic DNA
taaaacgactctctacag

SEQ ID NO: 6496 - DNA, 18 bp, Artificial Sequence
  Synthetic DNA
taatacgaataacaatag

SEQ ID NO: 6497 - DNA, 18 bp, Artificial Sequence
  Synthetic DNA
taatagttctcactatag

SEQ ID NO: 6498 - DNA, 18 bp, Artificial Sequence
  Synthetic DNA
tattacgactcagaatag

SEQ ID NO: 6499 - DNA, 18 bp, Artificial Sequence
  Synthetic DNA
ttatacgactcacgattg

SEQ ID NO: 6500 - DNA, 18 bp, Artificial Sequence
  Synthetic DNA
aaacacgtctcactatag

SEQ ID NO: 6501 - DNA, 18 bp, Artificial Sequence
  Synthetic DNA
acatacgactcactattg

SEQ ID NO: 6502 - DNA, 18 bp, Artificial Sequence
  Synthetic DNA
taatacgccacactaaag

SEQ ID NO: 6503 - DNA, 18 bp, Artificial Sequence
  Synthetic DNA
taatatgactgtctatag

SEQ ID NO: 6504 - DNA, 18 bp, Artificial Sequence
  Synthetic DNA
tattatgactcactctag

SEQ ID NO: 6505 - DNA, 18 bp, Artificial Sequence
  Synthetic DNA
ttatacgacactctatag

SEQ ID NO: 6506 - DNA, 18 bp, Artificial Sequence
  Synthetic DNA
taataagtctccctatag

SEQ ID NO: 6507 - DNA, 18 bp, Artificial Sequence
  Synthetic DNA
tataacgaatcactatag

SEQ ID NO: 6508 - DNA, 18 bp, Artificial Sequence
  Synthetic DNA
taattcgactcacttaag

SEQ ID NO: 6509 - DNA, 18 bp, Artificial Sequence
  Synthetic DNA
ttatactactcaccatag

SEQ ID NO: 6510 - DNA, 18 bp, Artificial Sequence
  Synthetic DNA
taaaacgactcacaattg

SEQ ID NO: 6511 - DNA, 18 bp, Artificial Sequence
  Synthetic DNA
tatttcaactcactatag

SEQ ID NO: 6512 - DNA, 18 bp, Artificial Sequence
  Synthetic DNA
ttatacgatacactatag

SEQ ID NO: 6513 - DNA, 18 bp, Artificial Sequence
  Synthetic DNA
aaatacaacttactatag

SEQ ID NO: 6514 - DNA, 18 bp, Artificial Sequence
  Synthetic DNA
caattcgactctctatag

SEQ ID NO: 6515 - DNA, 18 bp, Artificial Sequence
  Synthetic DNA
taattccacacactatag

SEQ ID NO: 6516 - DNA, 18 bp, Artificial Sequence
  Synthetic DNA
tcatacgacacactattg

SEQ ID NO: 6517 - DNA, 18 bp, Artificial Sequence
  Synthetic DNA
tgatacgactctctattg

SEQ ID NO: 6518 - DNA, 18 bp, Artificial Sequence
  Synthetic DNA
caatactactcacaatag

SEQ ID NO: 6519 - DNA, 18 bp, Artificial Sequence
  Synthetic DNA
ctatacgactaactatag

SEQ ID NO: 6520 - DNA, 18 bp, Artificial Sequence
  Synthetic DNA
taacacgactcactcaag

SEQ ID NO: 6521 - DNA, 18 bp, Artificial Sequence
  Synthetic DNA
taatacgaatcacgattg

SEQ ID NO: 6522 - DNA, 18 bp, Artificial Sequence
  Synthetic DNA
taatacgagtcactcaag

SEQ ID NO: 6523 - DNA, 18 bp, Artificial Sequence
  Synthetic DNA
taatacgattagctatag

SEQ ID NO: 6524 - DNA, 18 bp, Artificial Sequence
  Synthetic DNA
taatgtgactcactttag

SEQ ID NO: 6525 - DNA, 18 bp, Artificial Sequence
  Synthetic DNA
aaaaacgacttactatag

SEQ ID NO: 6526 - DNA, 18 bp, Artificial Sequence
  Synthetic DNA
taacactcctcactatag

SEQ ID NO: 6527 - DNA, 18 bp, Artificial Sequence
  Synthetic DNA
taacatgactcactttag

SEQ ID NO: 6528 - DNA, 18 bp, Artificial Sequence
  Synthetic DNA
taatacgacctacaatag

SEQ ID NO: 6529 - DNA, 18 bp, Artificial Sequence
  Synthetic DNA
tatttcgagtcactatag

SEQ ID NO: 6530 - DNA, 18 bp, Artificial Sequence
  Synthetic DNA
aaatacgacacactgtag

SEQ ID NO: 6531 - DNA, 18 bp, Artificial Sequence
  Synthetic DNA
caatgcgactcactattg

SEQ ID NO: 6532 - DNA, 18 bp, Artificial Sequence
  Synthetic DNA
ccttacgactcactatag

SEQ ID NO: 6533 - DNA, 18 bp, Artificial Sequence
  Synthetic DNA
taacacgacagactatag

SEQ ID NO: 6534 - DNA, 18 bp, Artificial Sequence
  Synthetic DNA
taacacgactcacaatgg

SEQ ID NO: 6535 - DNA, 18 bp, Artificial Sequence
  Synthetic DNA
taacactactcaccatag

SEQ ID NO: 6536 - DNA, 18 bp, Artificial Sequence
  Synthetic DNA
taagacaactctctatag

SEQ ID NO: 6537 - DNA, 18 bp, Artificial Sequence
  Synthetic DNA
taataagactcattagag

SEQ ID NO: 6538 - DNA, 18 bp, Artificial Sequence
  Synthetic DNA
taatacacctcaccatag

SEQ ID NO: 6539 - DNA, 18 bp, Artificial Sequence
  Synthetic DNA
taatacggattactatag

SEQ ID NO: 6540 - DNA, 18 bp, Artificial Sequence
  Synthetic DNA
taatacggtttactatag

SEQ ID NO: 6541 - DNA, 18 bp, Artificial Sequence
  Synthetic DNA
taataggactacctatag

SEQ ID NO: 6542 - DNA, 18 bp, Artificial Sequence
  Synthetic DNA
taatatgacacgctatag

SEQ ID NO: 6543 - DNA, 18 bp, Artificial Sequence
  Synthetic DNA
taatatgactcaatacag

SEQ ID NO: 6544 - DNA, 18 bp, Artificial Sequence
  Synthetic DNA
taatccgaatgactatag

SEQ ID NO: 6545 - DNA, 18 bp, Artificial Sequence
  Synthetic DNA
taatctgactcattatag

SEQ ID NO: 6546 - DNA, 18 bp, Artificial Sequence
  Synthetic DNA
taatgcgactcaatatcg

SEQ ID NO: 6547 - DNA, 18 bp, Artificial Sequence
  Synthetic DNA
tagtacgacttaatatag

SEQ ID NO: 6548 - DNA, 18 bp, Artificial Sequence
  Synthetic DNA
tattaagactcacgatag

SEQ ID NO: 6549 - DNA, 18 bp, Artificial Sequence
  Synthetic DNA
tgataagactcacaatag

SEQ ID NO: 6550 - DNA, 18 bp, Artificial Sequence
  Synthetic DNA
tgatacgactctcgatag

SEQ ID NO: 6551 - DNA, 18 bp, Artificial Sequence
  Synthetic DNA
tgatacggctcactatgg

SEQ ID NO: 6552 - DNA, 18 bp, Artificial Sequence
  Synthetic DNA
tgatacggctcgctatag

SEQ ID NO: 6553 - DNA, 18 bp, Artificial Sequence
  Synthetic DNA
tgatccgactcactttag

SEQ ID NO: 6554 - DNA, 18 bp, Artificial Sequence
  Synthetic DNA
ttatacgaccaactatag

SEQ ID NO: 6555 - DNA, 18 bp, Artificial Sequence
  Synthetic DNA
ttatacgagtcattatag

SEQ ID NO: 6556 - DNA, 18 bp, Artificial Sequence
  Synthetic DNA
ttgtacgactcactacag

SEQ ID NO: 6557 - DNA, 18 bp, Artificial Sequence
  Synthetic DNA
aaaaacgactcacgatag

SEQ ID NO: 6558 - DNA, 18 bp, Artificial Sequence
  Synthetic DNA
aaatacgacgcaatatag

SEQ ID NO: 6559 - DNA, 18 bp, Artificial Sequence
  Synthetic DNA
aaatacgacttgctatag

SEQ ID NO: 6560 - DNA, 18 bp, Artificial Sequence
  Synthetic DNA
caataccactaactatag

SEQ ID NO: 6561 - DNA, 18 bp, Artificial Sequence
  Synthetic DNA
caataccagtcactatag

SEQ ID NO: 6562 - DNA, 18 bp, Artificial Sequence
  Synthetic DNA
caatacgactaactgtag

SEQ ID NO: 6563 - DNA, 18 bp, Artificial Sequence
  Synthetic DNA
gaaaactactcactatag

SEQ ID NO: 6564 - DNA, 18 bp, Artificial Sequence
  Synthetic DNA
gaatacgacacactacag

SEQ ID NO: 6565 - DNA, 18 bp, Artificial Sequence
  Synthetic DNA
gaatacgactcactcttg

SEQ ID NO: 6566 - DNA, 18 bp, Artificial Sequence
  Synthetic DNA
gaatacggctcactatcg

SEQ ID NO: 6567 - DNA, 18 bp, Artificial Sequence
  Synthetic DNA
gcattcgactcactatag

SEQ ID NO: 6568 - DNA, 18 bp, Artificial Sequence
  Synthetic DNA
ggatacgactcacaatag

SEQ ID NO: 6569 - DNA, 18 bp, Artificial Sequence
  Synthetic DNA
taaaacgaccgactatag

SEQ ID NO: 6570 - DNA, 18 bp, Artificial Sequence
  Synthetic DNA
taacaccactcactaaag

SEQ ID NO: 6571 - DNA, 18 bp, Artificial Sequence
  Synthetic DNA
taacaccagtcactatag

SEQ ID NO: 6572 - DNA, 18 bp, Artificial Sequence
  Synthetic DNA
taacacgattcactgtag

SEQ ID NO: 6573 - DNA, 18 bp, Artificial Sequence
  Synthetic DNA
taagacgaatcacaatag

SEQ ID NO: 6574 - DNA, 18 bp, Artificial Sequence
  Synthetic DNA
taagacgattcactattg

SEQ ID NO: 6575 - DNA, 18 bp, Artificial Sequence
  Synthetic DNA
taataacagtcactatag

SEQ ID NO: 6576 - DNA, 18 bp, Artificial Sequence
  Synthetic DNA
taataagactcactgtgg

SEQ ID NO: 6577 - DNA, 18 bp, Artificial Sequence
  Synthetic DNA
taatacaacccgctatag

SEQ ID NO: 6578 - DNA, 18 bp, Artificial Sequence
  Synthetic DNA
taatacaacgaactatag

SEQ ID NO: 6579 - DNA, 18 bp, Artificial Sequence
  Synthetic DNA
taatacaactaactagag

SEQ ID NO: 6580 - DNA, 18 bp, Artificial Sequence
  Synthetic DNA
taatacaactgactatcg

SEQ ID NO: 6581 - DNA, 18 bp, Artificial Sequence
  Synthetic DNA
taataccaatcagtatag

SEQ ID NO: 6582 - DNA, 18 bp, Artificial Sequence
  Synthetic DNA
taataccactcccgatag

SEQ ID NO: 6583 - DNA, 18 bp, Artificial Sequence
  Synthetic DNA
taatacgaaccactatgg

SEQ ID NO: 6584 - DNA, 18 bp, Artificial Sequence
  Synthetic DNA
taatacgacagactagag

SEQ ID NO: 6585 - DNA, 18 bp, Artificial Sequence
  Synthetic DNA
taatacgacccagtattg

SEQ ID NO: 6586 - DNA, 18 bp, Artificial Sequence
  Synthetic DNA
taatacgacccagtttag

SEQ ID NO: 6587 - DNA, 18 bp, Artificial Sequence
  Synthetic DNA
taatacgaccgcctatag

SEQ ID NO: 6588 - DNA, 18 bp, Artificial Sequence
  Synthetic DNA
taatacgactacctagag

SEQ ID NO: 6589 - DNA, 18 bp, Artificial Sequence
  Synthetic DNA
taatacgactcacagtac

SEQ ID NO: 6590 - DNA, 18 bp, Artificial Sequence
  Synthetic DNA
taatacgattcggtatag

SEQ ID NO: 6591 - DNA, 18 bp, Artificial Sequence
  Synthetic DNA
taatacgcctcacgagag

SEQ ID NO: 6592 - DNA, 18 bp, Artificial Sequence
  Synthetic DNA
taatacggatcactatcg

SEQ ID NO: 6593 - DNA, 18 bp, Artificial Sequence
  Synthetic DNA
taatacggctgactttag

SEQ ID NO: 6594 - DNA, 18 bp, Artificial Sequence
  Synthetic DNA
taatacgtcgcattatag

SEQ ID NO: 6595 - DNA, 18 bp, Artificial Sequence
  Synthetic DNA
taatactactcacggtag

SEQ ID NO: 6596 - DNA, 18 bp, Artificial Sequence
  Synthetic DNA
taatactactcagtagag

SEQ ID NO: 6597 - DNA, 18 bp, Artificial Sequence
  Synthetic DNA
taatagaactaactatag

SEQ ID NO: 6598 - DNA, 18 bp, Artificial Sequence
  Synthetic DNA
taatagcactccctatag

SEQ ID NO: 6599 - DNA, 18 bp, Artificial Sequence
  Synthetic DNA
taatagtacccactatag

SEQ ID NO: 6600 - DNA, 18 bp, Artificial Sequence
  Synthetic DNA
taatatcactcacgatag

SEQ ID NO: 6601 - DNA, 18 bp, Artificial Sequence
  Synthetic DNA
taatatgaccgactatag

SEQ ID NO: 6602 - DNA, 18 bp, Artificial Sequence
  Synthetic DNA
taatatgacgcactatgg

SEQ ID NO: 6603 - DNA, 18 bp, Artificial Sequence
  Synthetic DNA
taatatgactcgctctag

SEQ ID NO: 6604 - DNA, 18 bp, Artificial Sequence
  Synthetic DNA
taatccgactcgctgtag

SEQ ID NO: 6605 - DNA, 18 bp, Artificial Sequence
  Synthetic DNA
taatccgactggctatag

SEQ ID NO: 6606 - DNA, 18 bp, Artificial Sequence
  Synthetic DNA
taatctgactcactatcg

SEQ ID NO: 6607 - DNA, 18 bp, Artificial Sequence
  Synthetic DNA
taatgcgatccactatag

SEQ ID NO: 6608 - DNA, 18 bp, Artificial Sequence
  Synthetic DNA
taattagactcacgatag

SEQ ID NO: 6609 - DNA, 18 bp, Artificial Sequence
  Synthetic DNA
tactaccactaactatag

SEQ ID NO: 6610 - DNA, 18 bp, Artificial Sequence
  Synthetic DNA
tactaccactcactacag

SEQ ID NO: 6611 - DNA, 18 bp, Artificial Sequence
  Synthetic DNA
tactaggactcactgtag

SEQ ID NO: 6612 - DNA, 18 bp, Artificial Sequence
  Synthetic DNA
tagtacgacccactatgg

SEQ ID NO: 6613 - DNA, 18 bp, Artificial Sequence
  Synthetic DNA
tagtacgactcagtacag

SEQ ID NO: 6614 - DNA, 18 bp, Artificial Sequence
  Synthetic DNA
tagtacgtctcactctag

SEQ ID NO: 6615 - DNA, 18 bp, Artificial Sequence
  Synthetic DNA
tagtgcgactcaccatag

SEQ ID NO: 6616 - DNA, 18 bp, Artificial Sequence
  Synthetic DNA
tattacggctcgctatag

SEQ ID NO: 6617 - DNA, 18 bp, Artificial Sequence
  Synthetic DNA
tcatacgacacactatcg

SEQ ID NO: 6618 - DNA, 18 bp, Artificial Sequence
  Synthetic DNA
tcatacgactctctatcg

SEQ ID NO: 6619 - DNA, 18 bp, Artificial Sequence
  Synthetic DNA
tcatacgacttaccatag

SEQ ID NO: 6620 - DNA, 18 bp, Artificial Sequence
  Synthetic DNA
tcatacgcctcactatcg

SEQ ID NO: 6621 - DNA, 18 bp, Artificial Sequence
  Synthetic DNA
tcatacggctcactttag

SEQ ID NO: 6622 - DNA, 18 bp, Artificial Sequence
  Synthetic DNA
tgatacgactcactccag

SEQ ID NO: 6623 - DNA, 18 bp, Artificial Sequence
  Synthetic DNA
tgatgccactcactatag

SEQ ID NO: 6624 - DNA, 18 bp, Artificial Sequence
  Synthetic DNA
ttctacgactcgctatag

SEQ ID NO: 6625 - DNA, 18 bp, Artificial Sequence
  Synthetic DNA
ttattcgactctctatag

SEQ ID NO: 6626 - DNA, 18 bp, Artificial Sequence
  Synthetic DNA
taatacgactctcttttg

SEQ ID NO: 6627 - DNA, 18 bp, Artificial Sequence
  Synthetic DNA
aattacgtctcactatag

SEQ ID NO: 6628 - DNA, 18 bp, Artificial Sequence
  Synthetic DNA
taatacgattttctatag

SEQ ID NO: 6629 - DNA, 18 bp, Artificial Sequence
  Synthetic DNA
taataagtctcactttag

SEQ ID NO: 6630 - DNA, 18 bp, Artificial Sequence
  Synthetic DNA
taaaacgactcacaagag

SEQ ID NO: 6631 - DNA, 18 bp, Artificial Sequence
  Synthetic DNA
taacatgactcactattg

SEQ ID NO: 6632 - DNA, 18 bp, Artificial Sequence
  Synthetic DNA
taataagactcacagtag

SEQ ID NO: 6633 - DNA, 18 bp, Artificial Sequence
  Synthetic DNA
taatactactctctatcg

SEQ ID NO: 6634 - DNA, 18 bp, Artificial Sequence
  Synthetic DNA
taatatgactctctacag

SEQ ID NO: 6635 - DNA, 18 bp, Artificial Sequence
  Synthetic DNA
caatacgactatctatag

SEQ ID NO: 6636 - DNA, 18 bp, Artificial Sequence
  Synthetic DNA
caatacgattcattatag

SEQ ID NO: 6637 - DNA, 18 bp, Artificial Sequence
  Synthetic DNA
caatactactcactattg

SEQ ID NO: 6638 - DNA, 18 bp, Artificial Sequence
  Synthetic DNA
taacaagacttactatag

SEQ ID NO: 6639 - DNA, 18 bp, Artificial Sequence
  Synthetic DNA
taatacgactcatagtag

SEQ ID NO: 6640 - DNA, 18 bp, Artificial Sequence
  Synthetic DNA
taatactcatcactatag

SEQ ID NO: 6641 - DNA, 18 bp, Artificial Sequence
  Synthetic DNA
taatacttctcgctatag

SEQ ID NO: 6642 - DNA, 18 bp, Artificial Sequence
  Synthetic DNA
taattcaacccactatag

SEQ ID NO: 6643 - DNA, 18 bp, Artificial Sequence
  Synthetic DNA
tagtacgactttctatag

SEQ ID NO: 6644 - DNA, 18 bp, Artificial Sequence
  Synthetic DNA
tcataagacacactatag

SEQ ID NO: 6645 - DNA, 18 bp, Artificial Sequence
  Synthetic DNA
tgatacgattcactttag

SEQ ID NO: 6646 - DNA, 18 bp, Artificial Sequence
  Synthetic DNA
taatacgactctcttcag

SEQ ID NO: 6647 - DNA, 18 bp, Artificial Sequence
  Synthetic DNA
ttatacgactcgcaatag

SEQ ID NO: 6648 - DNA, 18 bp, Artificial Sequence
  Synthetic DNA
taataagactcaccattg

SEQ ID NO: 6649 - DNA, 18 bp, Artificial Sequence
  Synthetic DNA
taataagcatcactatag

SEQ ID NO: 6650 - DNA, 18 bp, Artificial Sequence
  Synthetic DNA
taatacgactctctagtg

SEQ ID NO: 6651 - DNA, 18 bp, Artificial Sequence
  Synthetic DNA
taatacgattcagtattg

SEQ ID NO: 6652 - DNA, 18 bp, Artificial Sequence
  Synthetic DNA
taatactacccattatag

SEQ ID NO: 6653 - DNA, 18 bp, Artificial Sequence
  Synthetic DNA
taatactcctaactatag

SEQ ID NO: 6654 - DNA, 18 bp, Artificial Sequence
  Synthetic DNA
taatataactcactgtag

SEQ ID NO: 6655 - DNA, 18 bp, Artificial Sequence
  Synthetic DNA
taatccgactctccatag

SEQ ID NO: 6656 - DNA, 18 bp, Artificial Sequence
  Synthetic DNA
ttatacgaatcagtatag

SEQ ID NO: 6657 - DNA, 18 bp, Artificial Sequence
  Synthetic DNA
taattcgattcactatcg

SEQ ID NO: 6658 - DNA, 18 bp, Artificial Sequence
  Synthetic DNA
tactacgactcacattag

SEQ ID NO: 6659 - DNA, 18 bp, Artificial Sequence
  Synthetic DNA
tattacgaatcactaaag

SEQ ID NO: 6660 - DNA, 18 bp, Artificial Sequence
  Synthetic DNA
tatttctactcactatag

SEQ ID NO: 6661 - DNA, 18 bp, Artificial Sequence
  Synthetic DNA
taatacgactttttatag

SEQ ID NO: 6662 - DNA, 18 bp, Artificial Sequence
  Synthetic DNA
taatttgactcactttag

SEQ ID NO: 6663 - DNA, 18 bp, Artificial Sequence
  Synthetic DNA
ttatacgactctctctag

SEQ ID NO: 6664 - DNA, 18 bp, Artificial Sequence
  Synthetic DNA
taataagacttactaaag

SEQ ID NO: 6665 - DNA, 18 bp, Artificial Sequence
  Synthetic DNA
aaatatgcctcactatag

SEQ ID NO: 6666 - DNA, 18 bp, Artificial Sequence
  Synthetic DNA
taactcgactcaccatag

SEQ ID NO: 6667 - DNA, 18 bp, Artificial Sequence
  Synthetic DNA
taatacgtctcattagag

SEQ ID NO: 6668 - DNA, 18 bp, Artificial Sequence
  Synthetic DNA
taattctactcactgtag

SEQ ID NO: 6669 - DNA, 18 bp, Artificial Sequence
  Synthetic DNA
tattactactcactctag

SEQ ID NO: 6670 - DNA, 18 bp, Artificial Sequence
  Synthetic DNA
ttatacgaatcgctatag

SEQ ID NO: 6671 - DNA, 18 bp, Artificial Sequence
  Synthetic DNA
ttatacgactcagtttag

SEQ ID NO: 6672 - DNA, 18 bp, Artificial Sequence
  Synthetic DNA
caacacgactcactaaag

SEQ ID NO: 6673 - DNA, 18 bp, Artificial Sequence
  Synthetic DNA
caatacgaaccactatag

SEQ ID NO: 6674 - DNA, 18 bp, Artificial Sequence
  Synthetic DNA
catcacgactcactatag

SEQ ID NO: 6675 - DNA, 18 bp, Artificial Sequence
  Synthetic DNA
cgatacgactcactaaag

SEQ ID NO: 6676 - DNA, 18 bp, Artificial Sequence
  Synthetic DNA
taaactgactcactatag

SEQ ID NO: 6677 - DNA, 18 bp, Artificial Sequence
  Synthetic DNA
taacacgactcactaagg

SEQ ID NO: 6678 - DNA, 18 bp, Artificial Sequence
  Synthetic DNA
taacacgcctcactttag

SEQ ID NO: 6679 - DNA, 18 bp, Artificial Sequence
  Synthetic DNA
taataagactgactgtag

SEQ ID NO: 6680 - DNA, 18 bp, Artificial Sequence
  Synthetic DNA
taatacgaatcgctacag

SEQ ID NO: 6681 - DNA, 18 bp, Artificial Sequence
  Synthetic DNA
taatacgactcattgcag

SEQ ID NO: 6682 - DNA, 18 bp, Artificial Sequence
  Synthetic DNA
taatacggctcactcttg

SEQ ID NO: 6683 - DNA, 18 bp, Artificial Sequence
  Synthetic DNA
taatatgactcaccatcg

SEQ ID NO: 6684 - DNA, 18 bp, Artificial Sequence
  Synthetic DNA
taatcccattcactatag

SEQ ID NO: 6685 - DNA, 18 bp, Artificial Sequence
  Synthetic DNA
taatccggctcactttag

SEQ ID NO: 6686 - DNA, 18 bp, Artificial Sequence
  Synthetic DNA
taatgagactcactatgg

SEQ ID NO: 6687 - DNA, 18 bp, Artificial Sequence
  Synthetic DNA
taatgccactctctatag

SEQ ID NO: 6688 - DNA, 18 bp, Artificial Sequence
  Synthetic DNA
taatgcgactctcgatag

SEQ ID NO: 6689 - DNA, 18 bp, Artificial Sequence
  Synthetic DNA
taattcgactgcctatag

SEQ ID NO: 6690 - DNA, 18 bp, Artificial Sequence
  Synthetic DNA
tactacgaattactatag

SEQ ID NO: 6691 - DNA, 18 bp, Artificial Sequence
  Synthetic DNA
tactactgctcactatag

SEQ ID NO: 6692 - DNA, 18 bp, Artificial Sequence
  Synthetic DNA
tattaagactcactgtag

SEQ ID NO: 6693 - DNA, 18 bp, Artificial Sequence
  Synthetic DNA
tattacgagttactatag

SEQ ID NO: 6694 - DNA, 18 bp, Artificial Sequence
  Synthetic DNA
tgaaacgactcattatag

SEQ ID NO: 6695 - DNA, 18 bp, Artificial Sequence
  Synthetic DNA
ttatacaactcactatgg

SEQ ID NO: 6696 - DNA, 18 bp, Artificial Sequence
  Synthetic DNA
ttatacgagtccctatag

SEQ ID NO: 6697 - DNA, 18 bp, Artificial Sequence
  Synthetic DNA
ttattctactcactatag

SEQ ID NO: 6698 - DNA, 18 bp, Artificial Sequence
  Synthetic DNA
taatatgactcacttaag

SEQ ID NO: 6699 - DNA, 18 bp, Artificial Sequence
  Synthetic DNA
taatacctctcactttag

SEQ ID NO: 6700 - DNA, 18 bp, Artificial Sequence
  Synthetic DNA
tactacgtctcactattg

SEQ ID NO: 6701 - DNA, 18 bp, Artificial Sequence
  Synthetic DNA
taatacgaatcaataaag

SEQ ID NO: 6702 - DNA, 18 bp, Artificial Sequence
  Synthetic DNA
ttctactactcactatag

SEQ ID NO: 6703 - DNA, 18 bp, Artificial Sequence
  Synthetic DNA
taacacgactaactattg

SEQ ID NO: 6704 - DNA, 18 bp, Artificial Sequence
  Synthetic DNA
taatacgtgtcactaaag

SEQ ID NO: 6705 - DNA, 18 bp, Artificial Sequence
  Synthetic DNA
tagaatgactcactatag

SEQ ID NO: 6706 - DNA, 18 bp, Artificial Sequence
  Synthetic DNA
tattacgactcccaatag

SEQ ID NO: 6707 - DNA, 18 bp, Artificial Sequence
  Synthetic DNA
cattacgaatcactatag

SEQ ID NO: 6708 - DNA, 18 bp, Artificial Sequence
  Synthetic DNA
cattaggactcactatag

SEQ ID NO: 6709 - DNA, 18 bp, Artificial Sequence
  Synthetic DNA
taaaaggacttactatag

SEQ ID NO: 6710 - DNA, 18 bp, Artificial Sequence
  Synthetic DNA
taacacgattcaatatag

SEQ ID NO: 6711 - DNA, 18 bp, Artificial Sequence
  Synthetic DNA
taatacgactcccaatcg

SEQ ID NO: 6712 - DNA, 18 bp, Artificial Sequence
  Synthetic DNA
taatatgacactctatag

SEQ ID NO: 6713 - DNA, 18 bp, Artificial Sequence
  Synthetic DNA
aattacgactcaatatag

SEQ ID NO: 6714 - DNA, 18 bp, Artificial Sequence
  Synthetic DNA
taatacgactctctaacg

SEQ ID NO: 6715 - DNA, 18 bp, Artificial Sequence
  Synthetic DNA
aaatacgactcgctttag

SEQ ID NO: 6716 - DNA, 18 bp, Artificial Sequence
  Synthetic DNA
taatacgattcacaagag

SEQ ID NO: 6717 - DNA, 18 bp, Artificial Sequence
  Synthetic DNA
taatacggaacactatag

SEQ ID NO: 6718 - DNA, 18 bp, Artificial Sequence
  Synthetic DNA
taatacgtcttactgtag

SEQ ID NO: 6719 - DNA, 18 bp, Artificial Sequence
  Synthetic DNA
tactactactcactattg

SEQ ID NO: 6720 - DNA, 18 bp, Artificial Sequence
  Synthetic DNA
tagcacgtctcactatag

SEQ ID NO: 6721 - DNA, 18 bp, Artificial Sequence
  Synthetic DNA
ttataggaatcactatag

SEQ ID NO: 6722 - DNA, 18 bp, Artificial Sequence
  Synthetic DNA
taaaacgactaactaaag

SEQ ID NO: 6723 - DNA, 18 bp, Artificial Sequence
  Synthetic DNA
taaaacgactccctattg

SEQ ID NO: 6724 - DNA, 18 bp, Artificial Sequence
  Synthetic DNA
taaaacgactctgtatag

SEQ ID NO: 6725 - DNA, 18 bp, Artificial Sequence
  Synthetic DNA
taatacgtatcaatatag

SEQ ID NO: 6726 - DNA, 18 bp, Artificial Sequence
  Synthetic DNA
taatacgactcagaaaag

SEQ ID NO: 6727 - DNA, 18 bp, Artificial Sequence
  Synthetic DNA
ttatacgactcattaaag

SEQ ID NO: 6728 - DNA, 18 bp, Artificial Sequence
  Synthetic DNA
taatacgactctccaaag

SEQ ID NO: 6729 - DNA, 18 bp, Artificial Sequence
  Synthetic DNA
atatacgacttactatag

SEQ ID NO: 6730 - DNA, 18 bp, Artificial Sequence
  Synthetic DNA
taatacgactaactaatg

SEQ ID NO: 6731 - DNA, 18 bp, Artificial Sequence
  Synthetic DNA
atatacgactcactttag

SEQ ID NO: 6732 - DNA, 18 bp, Artificial Sequence
  Synthetic DNA
taaaactactcacaatag

SEQ ID NO: 6733 - DNA, 18 bp, Artificial Sequence
  Synthetic DNA
taattcgactaactttag

SEQ ID NO: 6734 - DNA, 18 bp, Artificial Sequence
  Synthetic DNA
taataccattcacaatag

SEQ ID NO: 6735 - DNA, 18 bp, Artificial Sequence
  Synthetic DNA
taaaacgactctctgtag

SEQ ID NO: 6736 - DNA, 18 bp, Artificial Sequence
  Synthetic DNA
taatacgacttactactg

SEQ ID NO: 6737 - DNA, 18 bp, Artificial Sequence
  Synthetic DNA
taatacgtctcccaatag

SEQ ID NO: 6738 - DNA, 18 bp, Artificial Sequence
  Synthetic DNA
taatacgtgacactatag

SEQ ID NO: 6739 - DNA, 18 bp, Artificial Sequence
  Synthetic DNA
taatcagactctctatag

SEQ ID NO: 6740 - DNA, 18 bp, Artificial Sequence
  Synthetic DNA
tgatacgtctcactttag

SEQ ID NO: 6741 - DNA, 18 bp, Artificial Sequence
  Synthetic DNA
aaatactactcactctag

SEQ ID NO: 6742 - DNA, 18 bp, Artificial Sequence
  Synthetic DNA
ccattcgactcactatag

SEQ ID NO: 6743 - DNA, 18 bp, Artificial Sequence
  Synthetic DNA
cgatacgactctctatag

SEQ ID NO: 6744 - DNA, 18 bp, Artificial Sequence
  Synthetic DNA
taacaagactcactaaag

SEQ ID NO: 6745 - DNA, 18 bp, Artificial Sequence
  Synthetic DNA
taacacgactcaccaaag

SEQ ID NO: 6746 - DNA, 18 bp, Artificial Sequence
  Synthetic DNA
taacacgatttactatag

SEQ ID NO: 6747 - DNA, 18 bp, Artificial Sequence
  Synthetic DNA
taatacaacacactctag

SEQ ID NO: 6748 - DNA, 18 bp, Artificial Sequence
  Synthetic DNA
taatacgaccctatatag

SEQ ID NO: 6749 - DNA, 18 bp, Artificial Sequence
  Synthetic DNA
taatgcgactcattttag

SEQ ID NO: 6750 - DNA, 18 bp, Artificial Sequence
  Synthetic DNA
taatgcgattcactattg

SEQ ID NO: 6751 - DNA, 18 bp, Artificial Sequence
  Synthetic DNA
tactacgtctcactatcg

SEQ ID NO: 6752 - DNA, 18 bp, Artificial Sequence
  Synthetic DNA
tatgacgtctcactatag

SEQ ID NO: 6753 - DNA, 18 bp, Artificial Sequence
  Synthetic DNA
tattacgactcaatatcg

SEQ ID NO: 6754 - DNA, 18 bp, Artificial Sequence
  Synthetic DNA
tattatggctcactatag

SEQ ID NO: 6755 - DNA, 18 bp, Artificial Sequence
  Synthetic DNA
tgataatactcactatag

SEQ ID NO: 6756 - DNA, 18 bp, Artificial Sequence
  Synthetic DNA
ttagacgactcactattg

SEQ ID NO: 6757 - DNA, 18 bp, Artificial Sequence
  Synthetic DNA
aaatacgatttactatag

SEQ ID NO: 6758 - DNA, 18 bp, Artificial Sequence
  Synthetic DNA
aaataggactcattatag

SEQ ID NO: 6759 - DNA, 18 bp, Artificial Sequence
  Synthetic DNA
atatacgacccactatag

SEQ ID NO: 6760 - DNA, 18 bp, Artificial Sequence
  Synthetic DNA
taatacgaatcactaagg

SEQ ID NO: 6761 - DNA, 18 bp, Artificial Sequence
  Synthetic DNA
taatccgaatcacaatag

SEQ ID NO: 6762 - DNA, 18 bp, Artificial Sequence
  Synthetic DNA
taatcctactcactttag

SEQ ID NO: 6763 - DNA, 18 bp, Artificial Sequence
  Synthetic DNA
tactaggtctcactatag

SEQ ID NO: 6764 - DNA, 18 bp, Artificial Sequence
  Synthetic DNA
aaatacgcctcactattg

SEQ ID NO: 6765 - DNA, 18 bp, Artificial Sequence
  Synthetic DNA
caatacgactcacaacag

SEQ ID NO: 6766 - DNA, 18 bp, Artificial Sequence
  Synthetic DNA
caatccaactcactatag

SEQ ID NO: 6767 - DNA, 18 bp, Artificial Sequence
  Synthetic DNA
caattcgactccctatag

SEQ ID NO: 6768 - DNA, 18 bp, Artificial Sequence
  Synthetic DNA
caattcgcctcactatag

SEQ ID NO: 6769 - DNA, 18 bp, Artificial Sequence
  Synthetic DNA
taaaacgacttactctag

SEQ ID NO: 6770 - DNA, 18 bp, Artificial Sequence
  Synthetic DNA
taaaacggctcattatag

SEQ ID NO: 6771 - DNA, 18 bp, Artificial Sequence
  Synthetic DNA
taataagactcaccgtag

SEQ ID NO: 6772 - DNA, 18 bp, Artificial Sequence
  Synthetic DNA
taataagactctctgtag

SEQ ID NO: 6773 - DNA, 18 bp, Artificial Sequence
  Synthetic DNA
taataagcctcactacag

SEQ ID NO: 6774 - DNA, 18 bp, Artificial Sequence
  Synthetic DNA
taataccaataactatag

SEQ ID NO: 6775 - DNA, 18 bp, Artificial Sequence
  Synthetic DNA
taatacgaattactctag

SEQ ID NO: 6776 - DNA, 18 bp, Artificial Sequence
  Synthetic DNA
taatacgactccaaatag

SEQ ID NO: 6777 - DNA, 18 bp, Artificial Sequence
  Synthetic DNA
taatacgactctctctgg

SEQ ID NO: 6778 - DNA, 18 bp, Artificial Sequence
  Synthetic DNA
taatacgatacactacag

SEQ ID NO: 6779 - DNA, 18 bp, Artificial Sequence
  Synthetic DNA
taatagtactcacaatag

SEQ ID NO: 6780 - DNA, 18 bp, Artificial Sequence
  Synthetic DNA
taatccgcctctctatag

SEQ ID NO: 6781 - DNA, 18 bp, Artificial Sequence
  Synthetic DNA
taatccgtttcactatag

SEQ ID NO: 6782 - DNA, 18 bp, Artificial Sequence
  Synthetic DNA
taatgctactcgctatag

SEQ ID NO: 6783 - DNA, 18 bp, Artificial Sequence
  Synthetic DNA
taatttggctcactatag

SEQ ID NO: 6784 - DNA, 18 bp, Artificial Sequence
  Synthetic DNA
tagtatgactcactatcg

SEQ ID NO: 6785 - DNA, 18 bp, Artificial Sequence
  Synthetic DNA
tcaaacgattcactatag

SEQ ID NO: 6786 - DNA, 18 bp, Artificial Sequence
  Synthetic DNA
tcatacgactaaatatag

SEQ ID NO: 6787 - DNA, 18 bp, Artificial Sequence
  Synthetic DNA
tgatacgaatcactattg

SEQ ID NO: 6788 - DNA, 18 bp, Artificial Sequence
  Synthetic DNA
tgttacgactcactatcg

SEQ ID NO: 6789 - DNA, 18 bp, Artificial Sequence
  Synthetic DNA
ttatacgagtgactatag

SEQ ID NO: 6790 - DNA, 18 bp, Artificial Sequence
  Synthetic DNA
aaacacgacgcactatag

SEQ ID NO: 6791 - DNA, 18 bp, Artificial Sequence
  Synthetic DNA
aaataagacgcactatag

SEQ ID NO: 6792 - DNA, 18 bp, Artificial Sequence
  Synthetic DNA
aaatacgactcactgtgg

SEQ ID NO: 6793 - DNA, 18 bp, Artificial Sequence
  Synthetic DNA
aaatgcggctcactatag

SEQ ID NO: 6794 - DNA, 18 bp, Artificial Sequence
  Synthetic DNA
aactacgacgcactatag

SEQ ID NO: 6795 - DNA, 18 bp, Artificial Sequence
  Synthetic DNA
caataagactcaatatag

SEQ ID NO: 6796 - DNA, 18 bp, Artificial Sequence
  Synthetic DNA
caatacgactcaatacag

SEQ ID NO: 6797 - DNA, 18 bp, Artificial Sequence
  Synthetic DNA
caatactgctcactatag

SEQ ID NO: 6798 - DNA, 18 bp, Artificial Sequence
  Synthetic DNA
caatccgactaactatag

SEQ ID NO: 6799 - DNA, 18 bp, Artificial Sequence
  Synthetic DNA
caattcgactcactatgg

SEQ ID NO: 6800 - DNA, 18 bp, Artificial Sequence
  Synthetic DNA
gaatacgactcgttatag

SEQ ID NO: 6801 - DNA, 18 bp, Artificial Sequence
  Synthetic DNA
gaatacgactgactatcg

SEQ ID NO: 6802 - DNA, 18 bp, Artificial Sequence
  Synthetic DNA
gactacgactcactttag

SEQ ID NO: 6803 - DNA, 18 bp, Artificial Sequence
  Synthetic DNA
ggatacgacccactatag

SEQ ID NO: 6804 - DNA, 18 bp, Artificial Sequence
  Synthetic DNA
taaaacaacccactatag

SEQ ID NO: 6805 - DNA, 18 bp, Artificial Sequence
  Synthetic DNA
taacacgacttactctag

SEQ ID NO: 6806 - DNA, 18 bp, Artificial Sequence
  Synthetic DNA
taacgccactcactatag

SEQ ID NO: 6807 - DNA, 18 bp, Artificial Sequence
  Synthetic DNA
taagactactcagtatag

SEQ ID NO: 6808 - DNA, 18 bp, Artificial Sequence
  Synthetic DNA
taatacaacccactatgg

SEQ ID NO: 6809 - DNA, 18 bp, Artificial Sequence
  Synthetic DNA
taatacaaccccctatag

SEQ ID NO: 6810 - DNA, 18 bp, Artificial Sequence
  Synthetic DNA
taatacaaccgactatag

SEQ ID NO: 6811 - DNA, 18 bp, Artificial Sequence
  Synthetic DNA
taataccaaccactatag

SEQ ID NO: 6812 - DNA, 18 bp, Artificial Sequence
  Synthetic DNA
taatacgacacactaccg

SEQ ID NO: 6813 - DNA, 18 bp, Artificial Sequence
  Synthetic DNA
taatacgactaggtatag

SEQ ID NO: 6814 - DNA, 18 bp, Artificial Sequence
  Synthetic DNA
taatacgactcacaaggg

SEQ ID NO: 6815 - DNA, 18 bp, Artificial Sequence
  Synthetic DNA
taatacgactcatggtag

SEQ ID NO: 6816 - DNA, 18 bp, Artificial Sequence
  Synthetic DNA
taatacgactcccgacag

SEQ ID NO: 6817 - DNA, 18 bp, Artificial Sequence
  Synthetic DNA
taatacgacttcctctag

SEQ ID NO: 6818 - DNA, 18 bp, Artificial Sequence
  Synthetic DNA
taatacgagccacaatag

SEQ ID NO: 6819 - DNA, 18 bp, Artificial Sequence
  Synthetic DNA
taatacgagcccctatag

SEQ ID NO: 6820 - DNA, 18 bp, Artificial Sequence
  Synthetic DNA
taatacgattcgctatgg

SEQ ID NO: 6821 - DNA, 18 bp, Artificial Sequence
  Synthetic DNA
taatacgattctctatcg

SEQ ID NO: 6822 - DNA, 18 bp, Artificial Sequence
  Synthetic DNA
taatacgcctacctatag

SEQ ID NO: 6823 - DNA, 18 bp, Artificial Sequence
  Synthetic DNA
taatacgcctagctatag

SEQ ID NO: 6824 - DNA, 18 bp, Artificial Sequence
  Synthetic DNA
taatacgcctcaccacag

SEQ ID NO: 6825 - DNA, 18 bp, Artificial Sequence
  Synthetic DNA
taatacgcctccctttag

SEQ ID NO: 6826 - DNA, 18 bp, Artificial Sequence
  Synthetic DNA
taatacgcctcgctaaag

SEQ ID NO: 6827 - DNA, 18 bp, Artificial Sequence
  Synthetic DNA
taatactaagcactatag

SEQ ID NO: 6828 - DNA, 18 bp, Artificial Sequence
  Synthetic DNA
taataggactaaccatag

SEQ ID NO: 6829 - DNA, 18 bp, Artificial Sequence
  Synthetic DNA
taataggactccatatag

SEQ ID NO: 6830 - DNA, 18 bp, Artificial Sequence
  Synthetic DNA
taatatgactgaccatag

SEQ ID NO: 6831 - DNA, 18 bp, Artificial Sequence
  Synthetic DNA
taatccgacaccctatag

SEQ ID NO: 6832 - DNA, 18 bp, Artificial Sequence
  Synthetic DNA
taatccgactccctctag

SEQ ID NO: 6833 - DNA, 18 bp, Artificial Sequence
  Synthetic DNA
taatccggctcaatatag

SEQ ID NO: 6834 - DNA, 18 bp, Artificial Sequence
  Synthetic DNA
taatcctactcactatcg

SEQ ID NO: 6835 - DNA, 18 bp, Artificial Sequence
  Synthetic DNA
taatcggactcattatag

SEQ ID NO: 6836 - DNA, 18 bp, Artificial Sequence
  Synthetic DNA
taatgagactcactgtag

SEQ ID NO: 6837 - DNA, 18 bp, Artificial Sequence
  Synthetic DNA
taatgaggctcactatag

SEQ ID NO: 6838 - DNA, 18 bp, Artificial Sequence
  Synthetic DNA
taatgcgactggctatag

SEQ ID NO: 6839 - DNA, 18 bp, Artificial Sequence
  Synthetic DNA
taatgtgactcactgtag

SEQ ID NO: 6840 - DNA, 18 bp, Artificial Sequence
  Synthetic DNA
taattcgagtcactagag

SEQ ID NO: 6841 - DNA, 18 bp, Artificial Sequence
  Synthetic DNA
tactacgactgacaatag

SEQ ID NO: 6842 - DNA, 18 bp, Artificial Sequence
  Synthetic DNA
tagcactactcactatag

SEQ ID NO: 6843 - DNA, 18 bp, Artificial Sequence
  Synthetic DNA
taggacgattcactatag

SEQ ID NO: 6844 - DNA, 18 bp, Artificial Sequence
  Synthetic DNA
tagtacgacccattatag

SEQ ID NO: 6845 - DNA, 18 bp, Artificial Sequence
  Synthetic DNA
tagtacgactcactagtg

SEQ ID NO: 6846 - DNA, 18 bp, Artificial Sequence
  Synthetic DNA
tagtacggctcactttag

SEQ ID NO: 6847 - DNA, 18 bp, Artificial Sequence
  Synthetic DNA
tagtacgtctcgctatag

SEQ ID NO: 6848 - DNA, 18 bp, Artificial Sequence
  Synthetic DNA
tagtcagactcactatag

SEQ ID NO: 6849 - DNA, 18 bp, Artificial Sequence
  Synthetic DNA
tatcacgacccactatag

SEQ ID NO: 6850 - DNA, 18 bp, Artificial Sequence
  Synthetic DNA
tatgacgactcacaatag

SEQ ID NO: 6851 - DNA, 18 bp, Artificial Sequence
  Synthetic DNA
tattacgacttacgatag

SEQ ID NO: 6852 - DNA, 18 bp, Artificial Sequence
  Synthetic DNA
tcataagactcactacag

SEQ ID NO: 6853 - DNA, 18 bp, Artificial Sequence
  Synthetic DNA
tcatacaactccctatag

SEQ ID NO: 6854 - DNA, 18 bp, Artificial Sequence
  Synthetic DNA
tcatacgactctgtatag

SEQ ID NO: 6855 - DNA, 18 bp, Artificial Sequence
  Synthetic DNA
tcatacgcctcactgtag

SEQ ID NO: 6856 - DNA, 18 bp, Artificial Sequence
  Synthetic DNA
tcatacgtcgcactatag

SEQ ID NO: 6857 - DNA, 18 bp, Artificial Sequence
  Synthetic DNA
tcgtacgactgactatag

SEQ ID NO: 6858 - DNA, 18 bp, Artificial Sequence
  Synthetic DNA
tgataccactcaatatag

SEQ ID NO: 6859 - DNA, 18 bp, Artificial Sequence
  Synthetic DNA
ttacacgactgactatag

SEQ ID NO: 6860 - DNA, 18 bp, Artificial Sequence
  Synthetic DNA
atatacgactcacaatag

SEQ ID NO: 6861 - DNA, 18 bp, Artificial Sequence
  Synthetic DNA
taatacaactctctattg

SEQ ID NO: 6862 - DNA, 18 bp, Artificial Sequence
  Synthetic DNA
tattacgactcacattag

SEQ ID NO: 6863 - DNA, 18 bp, Artificial Sequence
  Synthetic DNA
tgttacgactcacaatag

SEQ ID NO: 6864 - DNA, 18 bp, Artificial Sequence
  Synthetic DNA
ttataatactcactatag

SEQ ID NO: 6865 - DNA, 18 bp, Artificial Sequence
  Synthetic DNA
tataacgattcactatag

SEQ ID NO: 6866 - DNA, 18 bp, Artificial Sequence
  Synthetic DNA
taatacgtatcactacag

SEQ ID NO: 6867 - DNA, 18 bp, Artificial Sequence
  Synthetic DNA
taatacgacaaactattg

SEQ ID NO: 6868 - DNA, 18 bp, Artificial Sequence
  Synthetic DNA
taatacgtcacaatatag

SEQ ID NO: 6869 - DNA, 18 bp, Artificial Sequence
  Synthetic DNA
taatacgactctgtattg

SEQ ID NO: 6870 - DNA, 18 bp, Artificial Sequence
  Synthetic DNA
taatacgattcattctag

SEQ ID NO: 6871 - DNA, 18 bp, Artificial Sequence
  Synthetic DNA
caatacgtctcactaaag

SEQ ID NO: 6872 - DNA, 18 bp, Artificial Sequence
  Synthetic DNA
taatacgtctaactaaag

SEQ ID NO: 6873 - DNA, 18 bp, Artificial Sequence
  Synthetic DNA
aaattctactcactatag

SEQ ID NO: 6874 - DNA, 18 bp, Artificial Sequence
  Synthetic DNA
aaacacgactcattatag

SEQ ID NO: 6875 - DNA, 18 bp, Artificial Sequence
  Synthetic DNA
taatacatctcactatgg

SEQ ID NO: 6876 - DNA, 18 bp, Artificial Sequence
  Synthetic DNA
taatacgactcattgaag

SEQ ID NO: 6877 - DNA, 18 bp, Artificial Sequence
  Synthetic DNA
taatacgagttactaaag

SEQ ID NO: 6878 - DNA, 18 bp, Artificial Sequence
  Synthetic DNA
taatgctattcactatag

SEQ ID NO: 6879 - DNA, 18 bp, Artificial Sequence
  Synthetic DNA
tattacgacccacaatag

SEQ ID NO: 6880 - DNA, 18 bp, Artificial Sequence
  Synthetic DNA
tattacggctcaatatag

SEQ ID NO: 6881 - DNA, 18 bp, Artificial Sequence
  Synthetic DNA
taattagactctctatag

SEQ ID NO: 6882 - DNA, 18 bp, Artificial Sequence
  Synthetic DNA
taattcaactcactatcg

SEQ ID NO: 6883 - DNA, 18 bp, Artificial Sequence
  Synthetic DNA
taaaacgactgactaaag

SEQ ID NO: 6884 - DNA, 18 bp, Artificial Sequence
  Synthetic DNA
taaaacgagtcattatag

SEQ ID NO: 6885 - DNA, 18 bp, Artificial Sequence
  Synthetic DNA
taaaactactcgctatag

SEQ ID NO: 6886 - DNA, 18 bp, Artificial Sequence
  Synthetic DNA
taatacaacccactattg

SEQ ID NO: 6887 - DNA, 18 bp, Artificial Sequence
  Synthetic DNA
taatacgacacattacag

SEQ ID NO: 6888 - DNA, 18 bp, Artificial Sequence
  Synthetic DNA
taatacgtctcagcatag

SEQ ID NO: 6889 - DNA, 18 bp, Artificial Sequence
  Synthetic DNA
taatactactaacgatag

SEQ ID NO: 6890 - DNA, 18 bp, Artificial Sequence
  Synthetic DNA
taatactatttactatag

SEQ ID NO: 6891 - DNA, 18 bp, Artificial Sequence
  Synthetic DNA
taatctgactctctatag

SEQ ID NO: 6892 - DNA, 18 bp, Artificial Sequence
  Synthetic DNA
taatgctactcactttag

SEQ ID NO: 6893 - DNA, 18 bp, Artificial Sequence
  Synthetic DNA
tagaacgactcactttag

SEQ ID NO: 6894 - DNA, 18 bp, Artificial Sequence
  Synthetic DNA
tattaccactcactatgg

SEQ ID NO: 6895 - DNA, 18 bp, Artificial Sequence
  Synthetic DNA
taatacgactcccattag

SEQ ID NO: 6896 - DNA, 18 bp, Artificial Sequence
  Synthetic DNA
taattcgacacactaaag

SEQ ID NO: 6897 - DNA, 18 bp, Artificial Sequence
  Synthetic DNA
taatacgaatccctattg

SEQ ID NO: 6898 - DNA, 18 bp, Artificial Sequence
  Synthetic DNA
taatacgactcatcttag

SEQ ID NO: 6899 - DNA, 18 bp, Artificial Sequence
  Synthetic DNA
tattactactccctatag

SEQ ID NO: 6900 - DNA, 18 bp, Artificial Sequence
  Synthetic DNA
ttatacgactccctattg

SEQ ID NO: 6901 - DNA, 18 bp, Artificial Sequence
  Synthetic DNA
taatacgtctaactattg

SEQ ID NO: 6902 - DNA, 18 bp, Artificial Sequence
  Synthetic DNA
ttttacgactaactatag

SEQ ID NO: 6903 - DNA, 18 bp, Artificial Sequence
  Synthetic DNA
ttatacgactcacaaaag

SEQ ID NO: 6904 - DNA, 18 bp, Artificial Sequence
  Synthetic DNA
caaaacgactcactaaag

SEQ ID NO: 6905 - DNA, 18 bp, Artificial Sequence
  Synthetic DNA
taataagaatcacaatag

SEQ ID NO: 6906 - DNA, 18 bp, Artificial Sequence
  Synthetic DNA
taataagactcaatttag

SEQ ID NO: 6907 - DNA, 18 bp, Artificial Sequence
  Synthetic DNA
taatacgtctcacaatgg

SEQ ID NO: 6908 - DNA, 18 bp, Artificial Sequence
  Synthetic DNA
taataagtctcactaaag

SEQ ID NO: 6909 - DNA, 18 bp, Artificial Sequence
  Synthetic DNA
aaatacgagtcactattg

SEQ ID NO: 6910 - DNA, 18 bp, Artificial Sequence
  Synthetic DNA
aaatacgtctcactatgg

SEQ ID NO: 6911 - DNA, 18 bp, Artificial Sequence
  Synthetic DNA
taaaaggactctctatag

SEQ ID NO: 6912 - DNA, 18 bp, Artificial Sequence
  Synthetic DNA
taacactactcaatatag

SEQ ID NO: 6913 - DNA, 18 bp, Artificial Sequence
  Synthetic DNA
taataccactaacaatag

SEQ ID NO: 6914 - DNA, 18 bp, Artificial Sequence
  Synthetic DNA
taataggactcaataaag

SEQ ID NO: 6915 - DNA, 18 bp, Artificial Sequence
  Synthetic DNA
taattctactcgctatag

SEQ ID NO: 6916 - DNA, 18 bp, Artificial Sequence
  Synthetic DNA
taatttgactcacgatag

SEQ ID NO: 6917 - DNA, 18 bp, Artificial Sequence
  Synthetic DNA
tactactactcaccatag

SEQ ID NO: 6918 - DNA, 18 bp, Artificial Sequence
  Synthetic DNA
tattacgactcagtaaag

SEQ ID NO: 6919 - DNA, 18 bp, Artificial Sequence
  Synthetic DNA
tgatacaactctctatag

SEQ ID NO: 6920 - DNA, 18 bp, Artificial Sequence
  Synthetic DNA
ttatacgtgtcactatag

SEQ ID NO: 6921 - DNA, 18 bp, Artificial Sequence
  Synthetic DNA
aaatacgaatcactatcg

SEQ ID NO: 6922 - DNA, 18 bp, Artificial Sequence
  Synthetic DNA
aaatacgacttagtatag

SEQ ID NO: 6923 - DNA, 18 bp, Artificial Sequence
  Synthetic DNA
aaatacgattcactacag

SEQ ID NO: 6924 - DNA, 18 bp, Artificial Sequence
  Synthetic DNA
caatccgtctcactatag

SEQ ID NO: 6925 - DNA, 18 bp, Artificial Sequence
  Synthetic DNA
taacacgagacactatag

SEQ ID NO: 6926 - DNA, 18 bp, Artificial Sequence
  Synthetic DNA
taacacgattccctatag

SEQ ID NO: 6927 - DNA, 18 bp, Artificial Sequence
  Synthetic DNA
taataagactcactgcag

SEQ ID NO: 6928 - DNA, 18 bp, Artificial Sequence
  Synthetic DNA
taataagagtctctatag

SEQ ID NO: 6929 - DNA, 18 bp, Artificial Sequence
  Synthetic DNA
taataagagttactatag

SEQ ID NO: 6930 - DNA, 18 bp, Artificial Sequence
  Synthetic DNA
taatacaccttactatag

SEQ ID NO: 6931 - DNA, 18 bp, Artificial Sequence
  Synthetic DNA
taatacacttcactatag

SEQ ID NO: 6932 - DNA, 18 bp, Artificial Sequence
  Synthetic DNA
taatacgaataaatatag

SEQ ID NO: 6933 - DNA, 18 bp, Artificial Sequence
  Synthetic DNA
taatacgcctcactctcg

SEQ ID NO: 6934 - DNA, 18 bp, Artificial Sequence
  Synthetic DNA
taatcccactctctatag

SEQ ID NO: 6935 - DNA, 18 bp, Artificial Sequence
  Synthetic DNA
taatccgactcactgaag

SEQ ID NO: 6936 - DNA, 18 bp, Artificial Sequence
  Synthetic DNA
taatccgactcagtttag

SEQ ID NO: 6937 - DNA, 18 bp, Artificial Sequence
  Synthetic DNA
taatgagactaactatag

SEQ ID NO: 6938 - DNA, 18 bp, Artificial Sequence
  Synthetic DNA
taatgagacttactatag

SEQ ID NO: 6939 - DNA, 18 bp, Artificial Sequence
  Synthetic DNA
taattacactcactatag

SEQ ID NO: 6940 - DNA, 18 bp, Artificial Sequence
  Synthetic DNA
tactactactcaatatag

SEQ ID NO: 6941 - DNA, 18 bp, Artificial Sequence
  Synthetic DNA
tagtacgtctcagtatag

SEQ ID NO: 6942 - DNA, 18 bp, Artificial Sequence
  Synthetic DNA
tattacgagtcactctag

SEQ ID NO: 6943 - DNA, 18 bp, Artificial Sequence
  Synthetic DNA
tcatacgactcgctttag

SEQ ID NO: 6944 - DNA, 18 bp, Artificial Sequence
  Synthetic DNA
ttacacgactcgctatag

SEQ ID NO: 6945 - DNA, 18 bp, Artificial Sequence
  Synthetic DNA
taaaacgtctcaatatag

SEQ ID NO: 6946 - DNA, 18 bp, Artificial Sequence
  Synthetic DNA
taatactcctcactattg

SEQ ID NO: 6947 - DNA, 18 bp, Artificial Sequence
  Synthetic DNA
taatacgtcttaatatag

SEQ ID NO: 6948 - DNA, 18 bp, Artificial Sequence
  Synthetic DNA
taataggacttactttag

SEQ ID NO: 6949 - DNA, 18 bp, Artificial Sequence
  Synthetic DNA
aaatacgattcactgtag

SEQ ID NO: 6950 - DNA, 18 bp, Artificial Sequence
  Synthetic DNA
caatacgactctttatag

SEQ ID NO: 6951 - DNA, 18 bp, Artificial Sequence
  Synthetic DNA
caatactacacactatag

SEQ ID NO: 6952 - DNA, 18 bp, Artificial Sequence
  Synthetic DNA
ccatacgactcactattg

SEQ ID NO: 6953 - DNA, 18 bp, Artificial Sequence
  Synthetic DNA
taaaacgactctctatgg

SEQ ID NO: 6954 - DNA, 18 bp, Artificial Sequence
  Synthetic DNA
taaaacgatccactatag

SEQ ID NO: 6955 - DNA, 18 bp, Artificial Sequence
  Synthetic DNA
taaaccgacccactatag

SEQ ID NO: 6956 - DNA, 18 bp, Artificial Sequence
  Synthetic DNA
taaaccgactcactttag

SEQ ID NO: 6957 - DNA, 18 bp, Artificial Sequence
  Synthetic DNA
taagacgactcacaattg

SEQ ID NO: 6958 - DNA, 18 bp, Artificial Sequence
  Synthetic DNA
taatacaaatcactgtag

SEQ ID NO: 6959 - DNA, 18 bp, Artificial Sequence
  Synthetic DNA
taatacgacacactagcg

SEQ ID NO: 6960 - DNA, 18 bp, Artificial Sequence
  Synthetic DNA
taatacgacacattgtag

SEQ ID NO: 6961 - DNA, 18 bp, Artificial Sequence
  Synthetic DNA
taatacgacaccttatag

SEQ ID NO: 6962 - DNA, 18 bp, Artificial Sequence
  Synthetic DNA
taatacgactatctatcg

SEQ ID NO: 6963 - DNA, 18 bp, Artificial Sequence
  Synthetic DNA
taatacgagacactacag

SEQ ID NO: 6964 - DNA, 18 bp, Artificial Sequence
  Synthetic DNA
tagtacgatacactatag

SEQ ID NO: 6965 - DNA, 18 bp, Artificial Sequence
  Synthetic DNA
tattcccactcactatag

SEQ ID NO: 6966 - DNA, 18 bp, Artificial Sequence
  Synthetic DNA
tcaaacgactcactgtag

SEQ ID NO: 6967 - DNA, 18 bp, Artificial Sequence
  Synthetic DNA
taatacatatcactatag

SEQ ID NO: 6968 - DNA, 18 bp, Artificial Sequence
  Synthetic DNA
taacacgtctcactttag

SEQ ID NO: 6969 - DNA, 18 bp, Artificial Sequence
  Synthetic DNA
taataccactcacaaaag

SEQ ID NO: 6970 - DNA, 18 bp, Artificial Sequence
  Synthetic DNA
taatacgactctaaatag

SEQ ID NO: 6971 - DNA, 18 bp, Artificial Sequence
  Synthetic DNA
aaatacgcctcactttag

SEQ ID NO: 6972 - DNA, 18 bp, Artificial Sequence
  Synthetic DNA
taataagacaaactatag

SEQ ID NO: 6973 - DNA, 18 bp, Artificial Sequence
  Synthetic DNA
taatactactcattatcg

SEQ ID NO: 6974 - DNA, 18 bp, Artificial Sequence
  Synthetic DNA
taataggactttctatag

SEQ ID NO: 6975 - DNA, 18 bp, Artificial Sequence
  Synthetic DNA
taatgctactcactaaag

SEQ ID NO: 6976 - DNA, 18 bp, Artificial Sequence
  Synthetic DNA
tattacgactcacgattg

SEQ ID NO: 6977 - DNA, 18 bp, Artificial Sequence
  Synthetic DNA
ttacacgactcattatag

SEQ ID NO: 6978 - DNA, 18 bp, Artificial Sequence
  Synthetic DNA
ttataggactcaatatag

SEQ ID NO: 6979 - DNA, 18 bp, Artificial Sequence
  Synthetic DNA
tgatactactcactattg

SEQ ID NO: 6980 - DNA, 18 bp, Artificial Sequence
  Synthetic DNA
tattacgattcactaaag

SEQ ID NO: 6981 - DNA, 18 bp, Artificial Sequence
  Synthetic DNA
taatactactcactttcg

SEQ ID NO: 6982 - DNA, 18 bp, Artificial Sequence
  Synthetic DNA
aaatacgactctccatag

SEQ ID NO: 6983 - DNA, 18 bp, Artificial Sequence
  Synthetic DNA
taaaaggactcacaatag

SEQ ID NO: 6984 - DNA, 18 bp, Artificial Sequence
  Synthetic DNA
taatacggctcacattag

SEQ ID NO: 6985 - DNA, 18 bp, Artificial Sequence
  Synthetic DNA
tgattcgactcactaaag

SEQ ID NO: 6986 - DNA, 18 bp, Artificial Sequence
  Synthetic DNA
taatacgacttaatttag

SEQ ID NO: 6987 - DNA, 18 bp, Artificial Sequence
  Synthetic DNA
taatacgattctccatag

SEQ ID NO: 6988 - DNA, 18 bp, Artificial Sequence
  Synthetic DNA
taattcgaatccctatag

SEQ ID NO: 6989 - DNA, 18 bp, Artificial Sequence
  Synthetic DNA
tactacgtcacactatag

SEQ ID NO: 6990 - DNA, 18 bp, Artificial Sequence
  Synthetic DNA
ttacacgactctctatag

SEQ ID NO: 6991 - DNA, 18 bp, Artificial Sequence
  Synthetic DNA
caataggactctctatag

SEQ ID NO: 6992 - DNA, 18 bp, Artificial Sequence
  Synthetic DNA
gtattcgactcactatag

SEQ ID NO: 6993 - DNA, 18 bp, Artificial Sequence
  Synthetic DNA
taaaacgcttcactatag

SEQ ID NO: 6994 - DNA, 18 bp, Artificial Sequence
  Synthetic DNA
taatacgacacactgtgg

SEQ ID NO: 6995 - DNA, 18 bp, Artificial Sequence
  Synthetic DNA
taatacgatttactatgg

SEQ ID NO: 6996 - DNA, 18 bp, Artificial Sequence
  Synthetic DNA
taatactccacactatag

SEQ ID NO: 6997 - DNA, 18 bp, Artificial Sequence
  Synthetic DNA
taatccgactgtctatag

SEQ ID NO: 6998 - DNA, 18 bp, Artificial Sequence
  Synthetic DNA
tagtacgactctctacag

SEQ ID NO: 6999 - DNA, 18 bp, Artificial Sequence
  Synthetic DNA
tagttcgactaactatag

SEQ ID NO: 7000 - DNA, 18 bp, Artificial Sequence
  Synthetic DNA
tcatactactgactatag

SEQ ID NO: 7001 - DNA, 18 bp, Artificial Sequence
  Synthetic DNA
tgatacgactcgcaatag

SEQ ID NO: 7002 - DNA, 18 bp, Artificial Sequence
  Synthetic DNA
ttgtaggactcactatag

SEQ ID NO: 7003 - DNA, 18 bp, Artificial Sequence
  Synthetic DNA
aaatacggctctctatag

SEQ ID NO: 7004 - DNA, 18 bp, Artificial Sequence
  Synthetic DNA
taaaatgagtcactatag

SEQ ID NO: 7005 - DNA, 18 bp, Artificial Sequence
  Synthetic DNA
taatacgactcatcaaag

SEQ ID NO: 7006 - DNA, 18 bp, Artificial Sequence
  Synthetic DNA
taatacgactgacaattg

SEQ ID NO: 7007 - DNA, 18 bp, Artificial Sequence
  Synthetic DNA
taatatgactctgtatag

SEQ ID NO: 7008 - DNA, 18 bp, Artificial Sequence
  Synthetic DNA
tgatacgaatcactaaag

SEQ ID NO: 7009 - DNA, 18 bp, Artificial Sequence
  Synthetic DNA
tgttacgactcactatgg

SEQ ID NO: 7010 - DNA, 18 bp, Artificial Sequence
  Synthetic DNA
aaatacgacgcattatag

SEQ ID NO: 7011 - DNA, 18 bp, Artificial Sequence
  Synthetic DNA
aaatacgactcacaagag

SEQ ID NO: 7012 - DNA, 18 bp, Artificial Sequence
  Synthetic DNA
aaatatgactcactatgg

SEQ ID NO: 7013 - DNA, 18 bp, Artificial Sequence
  Synthetic DNA
caatacgagccactatag

SEQ ID NO: 7014 - DNA, 18 bp, Artificial Sequence
  Synthetic DNA
gaatacgtctcactattg

SEQ ID NO: 7015 - DNA, 18 bp, Artificial Sequence
  Synthetic DNA
taaaactacgcactatag

SEQ ID NO: 7016 - DNA, 18 bp, Artificial Sequence
  Synthetic DNA
taaaaggactccctatag

SEQ ID NO: 7017 - DNA, 18 bp, Artificial Sequence
  Synthetic DNA
taacacggctctctatag

SEQ ID NO: 7018 - DNA, 18 bp, Artificial Sequence
  Synthetic DNA
taagacgactcacttaag

SEQ ID NO: 7019 - DNA, 18 bp, Artificial Sequence
  Synthetic DNA
taatacaactacctatag

SEQ ID NO: 7020 - DNA, 18 bp, Artificial Sequence
  Synthetic DNA
taataccacacacgatag

SEQ ID NO: 7021 - DNA, 18 bp, Artificial Sequence
  Synthetic DNA
taatacgaaccaatatag

SEQ ID NO: 7022 - DNA, 18 bp, Artificial Sequence
  Synthetic DNA
taatacgacaaagtatag

SEQ ID NO: 7023 - DNA, 18 bp, Artificial Sequence
  Synthetic DNA
taatacgacctactacag

SEQ ID NO: 7024 - DNA, 18 bp, Artificial Sequence
  Synthetic DNA
taatacgactccttttag

SEQ ID NO: 7025 - DNA, 18 bp, Artificial Sequence
  Synthetic DNA
taatacgactcgctctcg

SEQ ID NO: 7026 - DNA, 18 bp, Artificial Sequence
  Synthetic DNA
taatacgcctcgctttag

SEQ ID NO: 7027 - DNA, 18 bp, Artificial Sequence
  Synthetic DNA
taatactacttactacag

SEQ ID NO: 7028 - DNA, 18 bp, Artificial Sequence
  Synthetic DNA
taatactcctcattatag

SEQ ID NO: 7029 - DNA, 18 bp, Artificial Sequence
  Synthetic DNA
taatacttcgcactatag

SEQ ID NO: 7030 - DNA, 18 bp, Artificial Sequence
  Synthetic DNA
taatatgaatcactatgg

SEQ ID NO: 7031 - DNA, 18 bp, Artificial Sequence
  Synthetic DNA
taatatgattcactgtag

SEQ ID NO: 7032 - DNA, 18 bp, Artificial Sequence
  Synthetic DNA
taatgcaacttactatag

SEQ ID NO: 7033 - DNA, 18 bp, Artificial Sequence
  Synthetic DNA
taatgcgactccctttag

SEQ ID NO: 7034 - DNA, 18 bp, Artificial Sequence
  Synthetic DNA
taatgctactcaatatag

SEQ ID NO: 7035 - DNA, 18 bp, Artificial Sequence
  Synthetic DNA
taatgggactcacaatag

SEQ ID NO: 7036 - DNA, 18 bp, Artificial Sequence
  Synthetic DNA
taattcgactcgttatag

SEQ ID NO: 7037 - DNA, 18 bp, Artificial Sequence
  Synthetic DNA
tactacaactcactatgg

SEQ ID NO: 7038 - DNA, 18 bp, Artificial Sequence
  Synthetic DNA
tagcacgacccactatag

SEQ ID NO: 7039 - DNA, 18 bp, Artificial Sequence
  Synthetic DNA
tagtacgattcactatgg

SEQ ID NO: 7040 - DNA, 18 bp, Artificial Sequence
  Synthetic DNA
tagtacgtcccactatag

SEQ ID NO: 7041 - DNA, 18 bp, Artificial Sequence
  Synthetic DNA
tattacgactccgtatag

SEQ ID NO: 7042 - DNA, 18 bp, Artificial Sequence
  Synthetic DNA
tattaggactaactatag

SEQ ID NO: 7043 - DNA, 18 bp, Artificial Sequence
  Synthetic DNA
tattccgactcagtatag

SEQ ID NO: 7044 - DNA, 18 bp, Artificial Sequence
  Synthetic DNA
tattcggactcactatag

SEQ ID NO: 7045 - DNA, 18 bp, Artificial Sequence
  Synthetic DNA
aactacgactcactatgg

SEQ ID NO: 7046 - DNA, 18 bp, Artificial Sequence
  Synthetic DNA
aactacgactgactatag

SEQ ID NO: 7047 - DNA, 18 bp, Artificial Sequence
  Synthetic DNA
aactacgcctcactatag

SEQ ID NO: 7048 - DNA, 18 bp, Artificial Sequence
  Synthetic DNA
acatacgacccactatag

SEQ ID NO: 7049 - DNA, 18 bp, Artificial Sequence
  Synthetic DNA
caataagactcactatcg

SEQ ID NO: 7050 - DNA, 18 bp, Artificial Sequence
  Synthetic DNA
caatacgcctcactatgg

SEQ ID NO: 7051 - DNA, 18 bp, Artificial Sequence
  Synthetic DNA
caatacggctaactatag

SEQ ID NO: 7052 - DNA, 18 bp, Artificial Sequence
  Synthetic DNA
cgacacgactcactatag

SEQ ID NO: 7053 - DNA, 18 bp, Artificial Sequence
  Synthetic DNA
gaacacgtctcactatag

SEQ ID NO: 7054 - DNA, 18 bp, Artificial Sequence
  Synthetic DNA
gaatacaactcactctag

SEQ ID NO: 7055 - DNA, 18 bp, Artificial Sequence
  Synthetic DNA
gaatacgaatcactaaag

SEQ ID NO: 7056 - DNA, 18 bp, Artificial Sequence
  Synthetic DNA
gaatacgacaccctatag

SEQ ID NO: 7057 - DNA, 18 bp, Artificial Sequence
  Synthetic DNA
gaatacgactcaatattg

SEQ ID NO: 7058 - DNA, 18 bp, Artificial Sequence
  Synthetic DNA
gaatacgactcattaaag

SEQ ID NO: 7059 - DNA, 18 bp, Artificial Sequence
  Synthetic DNA
gaatacgatccactatag

SEQ ID NO: 7060 - DNA, 18 bp, Artificial Sequence
  Synthetic DNA
gaatacgatttactatag

SEQ ID NO: 7061 - DNA, 18 bp, Artificial Sequence
  Synthetic DNA
gaatacgccccactatag

SEQ ID NO: 7062 - DNA, 18 bp, Artificial Sequence
  Synthetic DNA
taaaacaactcacgatag

SEQ ID NO: 7063 - DNA, 18 bp, Artificial Sequence
  Synthetic DNA
taaaacgactcgctgtag

SEQ ID NO: 7064 - DNA, 18 bp, Artificial Sequence
  Synthetic DNA
taaaacgagtaactatag

SEQ ID NO: 7065 - DNA, 18 bp, Artificial Sequence
  Synthetic DNA
taaaacgcctgactatag

SEQ ID NO: 7066 - DNA, 18 bp, Artificial Sequence
  Synthetic DNA
taacaccactcactattg

SEQ ID NO: 7067 - DNA, 18 bp, Artificial Sequence
  Synthetic DNA
taacacgacccaatatag

SEQ ID NO: 7068 - DNA, 18 bp, Artificial Sequence
  Synthetic DNA
taacacgactcacttgag

SEQ ID NO: 7069 - DNA, 18 bp, Artificial Sequence
  Synthetic DNA
taacacgactgactatcg

SEQ ID NO: 7070 - DNA, 18 bp, Artificial Sequence
  Synthetic DNA
taacacgacttaatatag

SEQ ID NO: 7071 - DNA, 18 bp, Artificial Sequence
  Synthetic DNA
taagactaatcactatag

SEQ ID NO: 7072 - DNA, 18 bp, Artificial Sequence
  Synthetic DNA
taagatgtctcactatag

SEQ ID NO: 7073 - DNA, 18 bp, Artificial Sequence
  Synthetic DNA
taaggcgactcaatatag

SEQ ID NO: 7074 - DNA, 18 bp, Artificial Sequence
  Synthetic DNA
taataaaactcacgatag

SEQ ID NO: 7075 - DNA, 18 bp, Artificial Sequence
  Synthetic DNA
taataacactcgctatag

SEQ ID NO: 7076 - DNA, 18 bp, Artificial Sequence
  Synthetic DNA
taataagacttactagag

SEQ ID NO: 7077 - DNA, 18 bp, Artificial Sequence
  Synthetic DNA
taatacaactcactttaa

SEQ ID NO: 7078 - DNA, 18 bp, Artificial Sequence
  Synthetic DNA
taatacaactgactgtag

SEQ ID NO: 7079 - DNA, 18 bp, Artificial Sequence
  Synthetic DNA
taatacagctcactctag

SEQ ID NO: 7080 - DNA, 18 bp, Artificial Sequence
  Synthetic DNA
taataccactccatatag

SEQ ID NO: 7081 - DNA, 18 bp, Artificial Sequence
  Synthetic DNA
taataccactcgctatgg

SEQ ID NO: 7082 - DNA, 18 bp, Artificial Sequence
  Synthetic DNA
taatacgaatcaccgtag

SEQ ID NO: 7083 - DNA, 18 bp, Artificial Sequence
  Synthetic DNA
taatacgaccctctatgg

SEQ ID NO: 7084 - DNA, 18 bp, Artificial Sequence
  Synthetic DNA
taatacgacgctctatcg

SEQ ID NO: 7085 - DNA, 18 bp, Artificial Sequence
  Synthetic DNA
taatacgactaaatatcg

SEQ ID NO: 7086 - DNA, 18 bp, Artificial Sequence
  Synthetic DNA
taatacgactaatgatag

SEQ ID NO: 7087 - DNA, 18 bp, Artificial Sequence
  Synthetic DNA
taatacgactcaagttag

SEQ ID NO: 7088 - DNA, 18 bp, Artificial Sequence
  Synthetic DNA
taatacgactcactggaa

SEQ ID NO: 7089 - DNA, 18 bp, Artificial Sequence
  Synthetic DNA
taatacgactccatctag

SEQ ID NO: 7090 - DNA, 18 bp, Artificial Sequence
  Synthetic DNA
taatacgactccccacag

SEQ ID NO: 7091 - DNA, 18 bp, Artificial Sequence
  Synthetic DNA
taatacgactgcctatgg

SEQ ID NO: 7092 - DNA, 18 bp, Artificial Sequence
  Synthetic DNA
taatacgacttactcgag

SEQ ID NO: 7093 - DNA, 18 bp, Artificial Sequence
  Synthetic DNA
taatacgagtaactctag

SEQ ID NO: 7094 - DNA, 18 bp, Artificial Sequence
  Synthetic DNA
taatacgagtccctaaag

SEQ ID NO: 7095 - DNA, 18 bp, Artificial Sequence
  Synthetic DNA
taatacgatccgctatag

SEQ ID NO: 7096 - DNA, 18 bp, Artificial Sequence
  Synthetic DNA
taatacgattgactacag

SEQ ID NO: 7097 - DNA, 18 bp, Artificial Sequence
  Synthetic DNA
taatacgccgcactctag

SEQ ID NO: 7098 - DNA, 18 bp, Artificial Sequence
  Synthetic DNA
taatacgcttgactatag

SEQ ID NO: 7099 - DNA, 18 bp, Artificial Sequence
  Synthetic DNA
taatacggcttcctatag

SEQ ID NO: 7100 - DNA, 18 bp, Artificial Sequence
  Synthetic DNA
taatacgtcgcgctatag

SEQ ID NO: 7101 - DNA, 18 bp, Artificial Sequence
  Synthetic DNA
taatagtactcactgtag

SEQ ID NO: 7102 - DNA, 18 bp, Artificial Sequence
  Synthetic DNA
taatccgactcaatatgg

SEQ ID NO: 7103 - DNA, 18 bp, Artificial Sequence
  Synthetic DNA
taatccgactcaccaaag

SEQ ID NO: 7104 - DNA, 18 bp, Artificial Sequence
  Synthetic DNA
taatccgactcactgtgg

SEQ ID NO: 7105 - DNA, 18 bp, Artificial Sequence
  Synthetic DNA
taatccgattcactatcg

SEQ ID NO: 7106 - DNA, 18 bp, Artificial Sequence
  Synthetic DNA
taatcctactcactagag

SEQ ID NO: 7107 - DNA, 18 bp, Artificial Sequence
  Synthetic DNA
taatgcgaatcactacag

SEQ ID NO: 7108 - DNA, 18 bp, Artificial Sequence
  Synthetic DNA
taattcgaccccctatag

SEQ ID NO: 7109 - DNA, 18 bp, Artificial Sequence
  Synthetic DNA
taattcgagtcagtatag

SEQ ID NO: 7110 - DNA, 18 bp, Artificial Sequence
  Synthetic DNA
taattggactgactatag

SEQ ID NO: 7111 - DNA, 18 bp, Artificial Sequence
  Synthetic DNA
tactacgactcactagcg

SEQ ID NO: 7112 - DNA, 18 bp, Artificial Sequence
  Synthetic DNA
tactacgactcactgaag

SEQ ID NO: 7113 - DNA, 18 bp, Artificial Sequence
  Synthetic DNA
tactacgattcactatcg

SEQ ID NO: 7114 - DNA, 18 bp, Artificial Sequence
  Synthetic DNA
tactacgccgcactatag

SEQ ID NO: 7115 - DNA, 18 bp, Artificial Sequence
  Synthetic DNA
tactacggctcactacag

SEQ ID NO: 7116 - DNA, 18 bp, Artificial Sequence
  Synthetic DNA
tagtaagactcactgtag

SEQ ID NO: 7117 - DNA, 18 bp, Artificial Sequence
  Synthetic DNA
tagtaccactcactaaag

SEQ ID NO: 7118 - DNA, 18 bp, Artificial Sequence
  Synthetic DNA
tagtacgacacactctag

SEQ ID NO: 7119 - DNA, 18 bp, Artificial Sequence
  Synthetic DNA
tagtacgacttactacag

SEQ ID NO: 7120 - DNA, 18 bp, Artificial Sequence
  Synthetic DNA
tagtacggctcactaaag

SEQ ID NO: 7121 - DNA, 18 bp, Artificial Sequence
  Synthetic DNA
tagtgcgagtcactatag

SEQ ID NO: 7122 - DNA, 18 bp, Artificial Sequence
  Synthetic DNA
tcatacgactcggtatag

SEQ ID NO: 7123 - DNA, 18 bp, Artificial Sequence
  Synthetic DNA
tcatccgactctctatag

SEQ ID NO: 7124 - DNA, 18 bp, Artificial Sequence
  Synthetic DNA
tgacaggactcactatag

SEQ ID NO: 7125 - DNA, 18 bp, Artificial Sequence
  Synthetic DNA
tgatacgacttaatatag

SEQ ID NO: 7126 - DNA, 18 bp, Artificial Sequence
  Synthetic DNA
tgattcgactcacgatag

SEQ ID NO: 7127 - DNA, 18 bp, Artificial Sequence
  Synthetic DNA
ttatacggctcactgtag

SEQ ID NO: 7128 - DNA, 18 bp, Artificial Sequence
  Synthetic DNA
ttatgcgacccactatag

SEQ ID NO: 7129 - DNA, 18 bp, Artificial Sequence
  Synthetic DNA
tatttcgactcactacag

SEQ ID NO: 7130 - DNA, 18 bp, Artificial Sequence
  Synthetic DNA
taatactactcaaaatag

SEQ ID NO: 7131 - DNA, 18 bp, Artificial Sequence
  Synthetic DNA
tactacgattcacaatag

SEQ ID NO: 7132 - DNA, 18 bp, Artificial Sequence
  Synthetic DNA
taatacgtcagactatag

SEQ ID NO: 7133 - DNA, 18 bp, Artificial Sequence
  Synthetic DNA
taatataactcaatatag

SEQ ID NO: 7134 - DNA, 18 bp, Artificial Sequence
  Synthetic DNA
taattgtactcactatag

SEQ ID NO: 7135 - DNA, 18 bp, Artificial Sequence
  Synthetic DNA
tcatactactcactattg

SEQ ID NO: 7136 - DNA, 18 bp, Artificial Sequence
  Synthetic DNA
tcttacgactcactattg

SEQ ID NO: 7137 - DNA, 18 bp, Artificial Sequence
  Synthetic DNA
taataagactcacaaaag

SEQ ID NO: 7138 - DNA, 18 bp, Artificial Sequence
  Synthetic DNA
tattacgactcacactag

SEQ ID NO: 7139 - DNA, 18 bp, Artificial Sequence
  Synthetic DNA
aattacgactcacgatag

SEQ ID NO: 7140 - DNA, 18 bp, Artificial Sequence
  Synthetic DNA
caatacgactctctaaag

SEQ ID NO: 7141 - DNA, 18 bp, Artificial Sequence
  Synthetic DNA
taatacgactctacatag

SEQ ID NO: 7142 - DNA, 18 bp, Artificial Sequence
  Synthetic DNA
taatactacacaccatag

SEQ ID NO: 7143 - DNA, 18 bp, Artificial Sequence
  Synthetic DNA
taattcgaatcactacag

SEQ ID NO: 7144 - DNA, 18 bp, Artificial Sequence
  Synthetic DNA
taattcggctctctatag

SEQ ID NO: 7145 - DNA, 18 bp, Artificial Sequence
  Synthetic DNA
taattctactcagtatag

SEQ ID NO: 7146 - DNA, 18 bp, Artificial Sequence
  Synthetic DNA
tattacgactcaatacag

SEQ ID NO: 7147 - DNA, 18 bp, Artificial Sequence
  Synthetic DNA
taattcgactccctttag

SEQ ID NO: 7148 - DNA, 18 bp, Artificial Sequence
  Synthetic DNA
tagttcgactctctatag

SEQ ID NO: 7149 - DNA, 18 bp, Artificial Sequence
  Synthetic DNA
taattcaactcacaatag

SEQ ID NO: 7150 - DNA, 18 bp, Artificial Sequence
  Synthetic DNA
taattcaactcactattg

SEQ ID NO: 7151 - DNA, 18 bp, Artificial Sequence
  Synthetic DNA
aaatacgagacactatag

SEQ ID NO: 7152 - DNA, 18 bp, Artificial Sequence
  Synthetic DNA
aattacgacccactatag

SEQ ID NO: 7153 - DNA, 18 bp, Artificial Sequence
  Synthetic DNA
taaaatgacccactatag

SEQ ID NO: 7154 - DNA, 18 bp, Artificial Sequence
  Synthetic DNA
taatacgaaccacaatag

SEQ ID NO: 7155 - DNA, 18 bp, Artificial Sequence
  Synthetic DNA
taatacgactaacaatgg

SEQ ID NO: 7156 - DNA, 18 bp, Artificial Sequence
  Synthetic DNA
taatacgtctctgtatag

SEQ ID NO: 7157 - DNA, 18 bp, Artificial Sequence
  Synthetic DNA
taatacgtcttagtatag

SEQ ID NO: 7158 - DNA, 18 bp, Artificial Sequence
  Synthetic DNA
taattcgacgcattatag

SEQ ID NO: 7159 - DNA, 18 bp, Artificial Sequence
  Synthetic DNA
tactgcgactcactttag

SEQ ID NO: 7160 - DNA, 18 bp, Artificial Sequence
  Synthetic DNA
tagtacgaatcactattg

SEQ ID NO: 7161 - DNA, 18 bp, Artificial Sequence
  Synthetic DNA
tattccgactcactctag

SEQ ID NO: 7162 - DNA, 18 bp, Artificial Sequence
  Synthetic DNA
taatacgactctcttaag

SEQ ID NO: 7163 - DNA, 18 bp, Artificial Sequence
  Synthetic DNA
taatacgtctcaatattg

SEQ ID NO: 7164 - DNA, 18 bp, Artificial Sequence
  Synthetic DNA
taatactactctctctag

SEQ ID NO: 7165 - DNA, 18 bp, Artificial Sequence
  Synthetic DNA
tagtacgactcacttttg

SEQ ID NO: 7166 - DNA, 18 bp, Artificial Sequence
  Synthetic DNA
tatcacgactctctatag

SEQ ID NO: 7167 - DNA, 18 bp, Artificial Sequence
  Synthetic DNA
caatacgacttactttag

SEQ ID NO: 7168 - DNA, 18 bp, Artificial Sequence
  Synthetic DNA
taatacgaaactctatag

SEQ ID NO: 7169 - DNA, 18 bp, Artificial Sequence
  Synthetic DNA
aaatatgactaactatag

SEQ ID NO: 7170 - DNA, 18 bp, Artificial Sequence
  Synthetic DNA
taataccacaaactatag

SEQ ID NO: 7171 - DNA, 18 bp, Artificial Sequence
  Synthetic DNA
taatacgaatcacaatgg

SEQ ID NO: 7172 - DNA, 18 bp, Artificial Sequence
  Synthetic DNA
taataggacacattatag

SEQ ID NO: 7173 - DNA, 18 bp, Artificial Sequence
  Synthetic DNA
aaatgcaactcactatag

SEQ ID NO: 7174 - DNA, 18 bp, Artificial Sequence
  Synthetic DNA
taacacgactcactatta

SEQ ID NO: 7175 - DNA, 18 bp, Artificial Sequence
  Synthetic DNA
taacacgactcgctttag

SEQ ID NO: 7176 - DNA, 18 bp, Artificial Sequence
  Synthetic DNA
taagacgactctctattg

SEQ ID NO: 7177 - DNA, 18 bp, Artificial Sequence
  Synthetic DNA
taataagactcacgttag

SEQ ID NO: 7178 - DNA, 18 bp, Artificial Sequence
  Synthetic DNA
taatacaattcactgtag

SEQ ID NO: 7179 - DNA, 18 bp, Artificial Sequence
  Synthetic DNA
taatacgacttattagag

SEQ ID NO: 7180 - DNA, 18 bp, Artificial Sequence
  Synthetic DNA
taatacgattctctagag

SEQ ID NO: 7181 - DNA, 18 bp, Artificial Sequence
  Synthetic DNA
taatacgccacaccatag

SEQ ID NO: 7182 - DNA, 18 bp, Artificial Sequence
  Synthetic DNA
taatacgcctaattatag

SEQ ID NO: 7183 - DNA, 18 bp, Artificial Sequence
  Synthetic DNA
taatacgcctcactttgg

SEQ ID NO: 7184 - DNA, 18 bp, Artificial Sequence
  Synthetic DNA
taatacgtttcactagag

SEQ ID NO: 7185 - DNA, 18 bp, Artificial Sequence
  Synthetic DNA
taatatgactaaccatag

SEQ ID NO: 7186 - DNA, 18 bp, Artificial Sequence
  Synthetic DNA
taatccgactcacagtag

SEQ ID NO: 7187 - DNA, 18 bp, Artificial Sequence
  Synthetic DNA
taatccggctcactattg

SEQ ID NO: 7188 - DNA, 18 bp, Artificial Sequence
  Synthetic DNA
taatgcgagtcactattg

SEQ ID NO: 7189 - DNA, 18 bp, Artificial Sequence
  Synthetic DNA
taattccactcactatcg

SEQ ID NO: 7190 - DNA, 18 bp, Artificial Sequence
  Synthetic DNA
tactacaactcaccatag

SEQ ID NO: 7191 - DNA, 18 bp, Artificial Sequence
  Synthetic DNA
tattacgactcacggtag

SEQ ID NO: 7192 - DNA, 18 bp, Artificial Sequence
  Synthetic DNA
tcatacgcctaactatag

SEQ ID NO: 7193 - DNA, 18 bp, Artificial Sequence
  Synthetic DNA
tcatgcgtctcactatag

SEQ ID NO: 7194 - DNA, 18 bp, Artificial Sequence
  Synthetic DNA
tgatacgagtcactaaag

SEQ ID NO: 7195 - DNA, 18 bp, Artificial Sequence
  Synthetic DNA
tgctacaactcactatag

SEQ ID NO: 7196 - DNA, 18 bp, Artificial Sequence
  Synthetic DNA
taatacgtcacagtatag

SEQ ID NO: 7197 - DNA, 18 bp, Artificial Sequence
  Synthetic DNA
taatacgaatcactaatg

SEQ ID NO: 7198 - DNA, 18 bp, Artificial Sequence
  Synthetic DNA
taatacaactctctaaag

SEQ ID NO: 7199 - DNA, 18 bp, Artificial Sequence
  Synthetic DNA
ttttacgaatcactatag

SEQ ID NO: 7200 - DNA, 18 bp, Artificial Sequence
  Synthetic DNA
caataagactcactattg

SEQ ID NO: 7201 - DNA, 18 bp, Artificial Sequence
  Synthetic DNA
taaaacgactaactattg

SEQ ID NO: 7202 - DNA, 18 bp, Artificial Sequence
  Synthetic DNA
taacacgactcactaatg

SEQ ID NO: 7203 - DNA, 18 bp, Artificial Sequence
  Synthetic DNA
tactacgactcactaatg

SEQ ID NO: 7204 - DNA, 18 bp, Artificial Sequence
  Synthetic DNA
tattaccactcacaatag

SEQ ID NO: 7205 - DNA, 18 bp, Artificial Sequence
  Synthetic DNA
taatacgactcacaagtg

SEQ ID NO: 7206 - DNA, 18 bp, Artificial Sequence
  Synthetic DNA
ttatacgaatcaatatag

SEQ ID NO: 7207 - DNA, 18 bp, Artificial Sequence
  Synthetic DNA
aagttcgactcactatag

SEQ ID NO: 7208 - DNA, 18 bp, Artificial Sequence
  Synthetic DNA
taaaatgactcactatcg

SEQ ID NO: 7209 - DNA, 18 bp, Artificial Sequence
  Synthetic DNA
taaaatgacttactatag

SEQ ID NO: 7210 - DNA, 18 bp, Artificial Sequence
  Synthetic DNA
taaatcgagtcactatag

SEQ ID NO: 7211 - DNA, 18 bp, Artificial Sequence
  Synthetic DNA
taataggtctcactgtag

SEQ ID NO: 7212 - DNA, 18 bp, Artificial Sequence
  Synthetic DNA
taatatgacacaatatag

SEQ ID NO: 7213 - DNA, 18 bp, Artificial Sequence
  Synthetic DNA
taatcagtctcactatag

SEQ ID NO: 7214 - DNA, 18 bp, Artificial Sequence
  Synthetic DNA
taatcttactcactatag

SEQ ID NO: 7215 - DNA, 18 bp, Artificial Sequence
  Synthetic DNA
taatgcgaccctctatag

SEQ ID NO: 7216 - DNA, 18 bp, Artificial Sequence
  Synthetic DNA
tagttcgactcaatatag

SEQ ID NO: 7217 - DNA, 18 bp, Artificial Sequence
  Synthetic DNA
tcatacaattcactatag

SEQ ID NO: 7218 - DNA, 18 bp, Artificial Sequence
  Synthetic DNA
tgatacgacttacaatag

SEQ ID NO: 7219 - DNA, 18 bp, Artificial Sequence
  Synthetic DNA
ttgtacgactcacaatag

SEQ ID NO: 7220 - DNA, 18 bp, Artificial Sequence
  Synthetic DNA
aaatacgattctctatag

SEQ ID NO: 7221 - DNA, 18 bp, Artificial Sequence
  Synthetic DNA
tattacgccacactatag

SEQ ID NO: 7222 - DNA, 18 bp, Artificial Sequence
  Synthetic DNA
tgatacgactcacttaag

SEQ ID NO: 7223 - DNA, 18 bp, Artificial Sequence
  Synthetic DNA
atatacgagtcactatag

SEQ ID NO: 7224 - DNA, 18 bp, Artificial Sequence
  Synthetic DNA
taaaaagactcaatatag

SEQ ID NO: 7225 - DNA, 18 bp, Artificial Sequence
  Synthetic DNA
taatccgtctcactacag

SEQ ID NO: 7226 - DNA, 18 bp, Artificial Sequence
  Synthetic DNA
taatccgtctcactgtag

SEQ ID NO: 7227 - DNA, 18 bp, Artificial Sequence
  Synthetic DNA
ttatacgaatcactatcg

SEQ ID NO: 7228 - DNA, 18 bp, Artificial Sequence
  Synthetic DNA
taaaacgactcacttttg

SEQ ID NO: 7229 - DNA, 18 bp, Artificial Sequence
  Synthetic DNA
taatacttctcactacag

SEQ ID NO: 7230 - DNA, 18 bp, Artificial Sequence
  Synthetic DNA
taatatgaatcactaaag

SEQ ID NO: 7231 - DNA, 18 bp, Artificial Sequence
  Synthetic DNA
tattacgacccactttag

SEQ ID NO: 7232 - DNA, 18 bp, Artificial Sequence
  Synthetic DNA
taataagactcattttag

SEQ ID NO: 7233 - DNA, 18 bp, Artificial Sequence
  Synthetic DNA
taatactcctcactttag

SEQ ID NO: 7234 - DNA, 18 bp, Artificial Sequence
  Synthetic DNA
taattcatctcactatag

SEQ ID NO: 7235 - DNA, 18 bp, Artificial Sequence
  Synthetic DNA
taattcgactcacaaaag

SEQ ID NO: 7236 - DNA, 18 bp, Artificial Sequence
  Synthetic DNA
taattcgtctctctatag

SEQ ID NO: 7237 - DNA, 18 bp, Artificial Sequence
  Synthetic DNA
taatatgacacacaatag

SEQ ID NO: 7238 - DNA, 18 bp, Artificial Sequence
  Synthetic DNA
aaatatgaatcactatag

SEQ ID NO: 7239 - DNA, 18 bp, Artificial Sequence
  Synthetic DNA
aaatccgactcactaaag

SEQ ID NO: 7240 - DNA, 18 bp, Artificial Sequence
  Synthetic DNA
ttatactagtcactatag

SEQ ID NO: 7241 - DNA, 18 bp, Artificial Sequence
  Synthetic DNA
caatacgaatcactaaag

SEQ ID NO: 7242 - DNA, 18 bp, Artificial Sequence
  Synthetic DNA
taatacgaatcacaacag

SEQ ID NO: 7243 - DNA, 18 bp, Artificial Sequence
  Synthetic DNA
taatacgacccacaattg

SEQ ID NO: 7244 - DNA, 18 bp, Artificial Sequence
  Synthetic DNA
taatacgacttaaaatag

SEQ ID NO: 7245 - DNA, 18 bp, Artificial Sequence
  Synthetic DNA
taatacgattcccaatag

SEQ ID NO: 7246 - DNA, 18 bp, Artificial Sequence
  Synthetic DNA
taatgcgactttctatag

SEQ ID NO: 7247 - DNA, 18 bp, Artificial Sequence
  Synthetic DNA
tattacgcctcaatatag

SEQ ID NO: 7248 - DNA, 18 bp, Artificial Sequence
  Synthetic DNA
agatacgtctcactatag

SEQ ID NO: 7249 - DNA, 18 bp, Artificial Sequence
  Synthetic DNA
atatacgactcactgtag

SEQ ID NO: 7250 - DNA, 18 bp, Artificial Sequence
  Synthetic DNA
taaaacgaatcactatcg

SEQ ID NO: 7251 - DNA, 18 bp, Artificial Sequence
  Synthetic DNA
taaaacgacacgctatag

SEQ ID NO: 7252 - DNA, 18 bp, Artificial Sequence
  Synthetic DNA
taatacgactccatttag

SEQ ID NO: 7253 - DNA, 18 bp, Artificial Sequence
  Synthetic DNA
taatactactcacactag

SEQ ID NO: 7254 - DNA, 18 bp, Artificial Sequence
  Synthetic DNA
taatcctactcactaaag

SEQ ID NO: 7255 - DNA, 18 bp, Artificial Sequence
  Synthetic DNA
taattcgaatcactgtag

SEQ ID NO: 7256 - DNA, 18 bp, Artificial Sequence
  Synthetic DNA
taattcgattcattatag

SEQ ID NO: 7257 - DNA, 18 bp, Artificial Sequence
  Synthetic DNA
tcacacgactcactaaag

SEQ ID NO: 7258 - DNA, 18 bp, Artificial Sequence
  Synthetic DNA
tgatacgacacactttag

SEQ ID NO: 7259 - DNA, 18 bp, Artificial Sequence
  Synthetic DNA
ttataccactaactatag

SEQ ID NO: 7260 - DNA, 18 bp, Artificial Sequence
  Synthetic DNA
aaacacgactcactctag

SEQ ID NO: 7261 - DNA, 18 bp, Artificial Sequence
  Synthetic DNA
aaatacaactcgctatag

SEQ ID NO: 7262 - DNA, 18 bp, Artificial Sequence
  Synthetic DNA
aaatacgaatgactatag

SEQ ID NO: 7263 - DNA, 18 bp, Artificial Sequence
  Synthetic DNA
aaatacgactcaccatgg

SEQ ID NO: 7264 - DNA, 18 bp, Artificial Sequence
  Synthetic DNA
aaatactactcgctatag

SEQ ID NO: 7265 - DNA, 18 bp, Artificial Sequence
  Synthetic DNA
taaaacgacccactatcg

SEQ ID NO: 7266 - DNA, 18 bp, Artificial Sequence
  Synthetic DNA
taacacgactctctatcg

SEQ ID NO: 7267 - DNA, 18 bp, Artificial Sequence
  Synthetic DNA
taacacgattcactatcg

SEQ ID NO: 7268 - DNA, 18 bp, Artificial Sequence
  Synthetic DNA
taagacgtctcactttag

SEQ ID NO: 7269 - DNA, 18 bp, Artificial Sequence
  Synthetic DNA
taataagactgactttag

SEQ ID NO: 7270 - DNA, 18 bp, Artificial Sequence
  Synthetic DNA
taatacaaatcactagag

SEQ ID NO: 7271 - DNA, 18 bp, Artificial Sequence
  Synthetic DNA
taatacgactcgcagtag

SEQ ID NO: 7272 - DNA, 18 bp, Artificial Sequence
  Synthetic DNA
taatacgcctaactaaag

SEQ ID NO: 7273 - DNA, 18 bp, Artificial Sequence
  Synthetic DNA
taatacgcctcatcatag

SEQ ID NO: 7274 - DNA, 18 bp, Artificial Sequence
  Synthetic DNA
taatcacactcactatag

SEQ ID NO: 7275 - DNA, 18 bp, Artificial Sequence
  Synthetic DNA
taatccgattccctatag

SEQ ID NO: 7276 - DNA, 18 bp, Artificial Sequence
  Synthetic DNA
tactacaactccctatag

SEQ ID NO: 7277 - DNA, 18 bp, Artificial Sequence
  Synthetic DNA
tagtaaggctcactatag

SEQ ID NO: 7278 - DNA, 18 bp, Artificial Sequence
  Synthetic DNA
tattacgactgaccatag

SEQ ID NO: 7279 - DNA, 18 bp, Artificial Sequence
  Synthetic DNA
tcatacaactcattatag

SEQ ID NO: 7280 - DNA, 18 bp, Artificial Sequence
  Synthetic DNA
tcatacgactctctatgg

SEQ ID NO: 7281 - DNA, 18 bp, Artificial Sequence
  Synthetic DNA
tcatacgattcaatatag

SEQ ID NO: 7282 - DNA, 18 bp, Artificial Sequence
  Synthetic DNA
tcgtacgactcactattg

SEQ ID NO: 7283 - DNA, 18 bp, Artificial Sequence
  Synthetic DNA
tgacacaactcactatag

SEQ ID NO: 7284 - DNA, 18 bp, Artificial Sequence
  Synthetic DNA
tgatacgatttactatag

SEQ ID NO: 7285 - DNA, 18 bp, Artificial Sequence
  Synthetic DNA
ttatacgactcacgatcg

SEQ ID NO: 7286 - DNA, 18 bp, Artificial Sequence
  Synthetic DNA
aaatacgactaactagag

SEQ ID NO: 7287 - DNA, 18 bp, Artificial Sequence
  Synthetic DNA
aaatacgactcgttatag

SEQ ID NO: 7288 - DNA, 18 bp, Artificial Sequence
  Synthetic DNA
aaatacgagtcagtatag

SEQ ID NO: 7289 - DNA, 18 bp, Artificial Sequence
  Synthetic DNA
caaaacgactccctatag

SEQ ID NO: 7290 - DNA, 18 bp, Artificial Sequence
  Synthetic DNA
caatacgcctaactatag

SEQ ID NO: 7291 - DNA, 18 bp, Artificial Sequence
  Synthetic DNA
gaatacgacccgctatag

SEQ ID NO: 7292 - DNA, 18 bp, Artificial Sequence
  Synthetic DNA
gaatacgagtcactttag

SEQ ID NO: 7293 - DNA, 18 bp, Artificial Sequence
  Synthetic DNA
gaatgcgacacactatag

SEQ ID NO: 7294 - DNA, 18 bp, Artificial Sequence
  Synthetic DNA
gaatgcgactctctatag

SEQ ID NO: 7295 - DNA, 18 bp, Artificial Sequence
  Synthetic DNA
taaaacgacttactagag

SEQ ID NO: 7296 - DNA, 18 bp, Artificial Sequence
  Synthetic DNA
taacaccactccctatag

SEQ ID NO: 7297 - DNA, 18 bp, Artificial Sequence
  Synthetic DNA
taacacgactcactaccg

SEQ ID NO: 7298 - DNA, 18 bp, Artificial Sequence
  Synthetic DNA
taacacgactcagtatcg

SEQ ID NO: 7299 - DNA, 18 bp, Artificial Sequence
  Synthetic DNA
taacccgcctcactatag

SEQ ID NO: 7300 - DNA, 18 bp, Artificial Sequence
  Synthetic DNA
taagaccactctctatag

SEQ ID NO: 7301 - DNA, 18 bp, Artificial Sequence
  Synthetic DNA
taagtccactcactatag

SEQ ID NO: 7302 - DNA, 18 bp, Artificial Sequence
  Synthetic DNA
taatacaacccagtatag

SEQ ID NO: 7303 - DNA, 18 bp, Artificial Sequence
  Synthetic DNA
taatacaacgcaccatag

SEQ ID NO: 7304 - DNA, 18 bp, Artificial Sequence
  Synthetic DNA
taataccacccaccatag

SEQ ID NO: 7305 - DNA, 18 bp, Artificial Sequence
  Synthetic DNA
taataccactcaatatgg

SEQ ID NO: 7306 - DNA, 18 bp, Artificial Sequence
  Synthetic DNA
taatacgaaaccctatag

SEQ ID NO: 7307 - DNA, 18 bp, Artificial Sequence
  Synthetic DNA
taatacgacctactatcg

SEQ ID NO: 7308 - DNA, 18 bp, Artificial Sequence
  Synthetic DNA
taatacgacgcactgttg

SEQ ID NO: 7309 - DNA, 18 bp, Artificial Sequence
  Synthetic DNA
taatacgactcatcacag

SEQ ID NO: 7310 - DNA, 18 bp, Artificial Sequence
  Synthetic DNA
taatacgactccctttgg

SEQ ID NO: 7311 - DNA, 18 bp, Artificial Sequence
  Synthetic DNA
taatacgactccttagag

SEQ ID NO: 7312 - DNA, 18 bp, Artificial Sequence
  Synthetic DNA
taatacgactctctagcg

SEQ ID NO: 7313 - DNA, 18 bp, Artificial Sequence
  Synthetic DNA
taatacgactctttataa

SEQ ID NO: 7314 - DNA, 18 bp, Artificial Sequence
  Synthetic DNA
taatacgacttcctacag

SEQ ID NO: 7315 - DNA, 18 bp, Artificial Sequence
  Synthetic DNA
taatacgagtctcgatag

SEQ ID NO: 7316 - DNA, 18 bp, Artificial Sequence
  Synthetic DNA
taatacgattcaccagag

SEQ ID NO: 7317 - DNA, 18 bp, Artificial Sequence
  Synthetic DNA
taatacgtctccgtatag

SEQ ID NO: 7318 - DNA, 18 bp, Artificial Sequence
  Synthetic DNA
taatagaactgactatag

SEQ ID NO: 7319 - DNA, 18 bp, Artificial Sequence
  Synthetic DNA
taataggactcattatcg

SEQ ID NO: 7320 - DNA, 18 bp, Artificial Sequence
  Synthetic DNA
taataggactctctatcg

SEQ ID NO: 7321 - DNA, 18 bp, Artificial Sequence
  Synthetic DNA
taatatgacccagtatag

SEQ ID NO: 7322 - DNA, 18 bp, Artificial Sequence
  Synthetic DNA
taatatggctaactatag

SEQ ID NO: 7323 - DNA, 18 bp, Artificial Sequence
  Synthetic DNA
taatcagactcacgatag

SEQ ID NO: 7324 - DNA, 18 bp, Artificial Sequence
  Synthetic DNA
taatgcgactaactgtag

SEQ ID NO: 7325 - DNA, 18 bp, Artificial Sequence
  Synthetic DNA
taatgcgactctctatgg

SEQ ID NO: 7326 - DNA, 18 bp, Artificial Sequence
  Synthetic DNA
taatgcgactgactttag

SEQ ID NO: 7327 - DNA, 18 bp, Artificial Sequence
  Synthetic DNA
taatggtactcactatag

SEQ ID NO: 7328 - DNA, 18 bp, Artificial Sequence
  Synthetic DNA
tactacgacccactgtag

SEQ ID NO: 7329 - DNA, 18 bp, Artificial Sequence
  Synthetic DNA
tactacgactcactatta

SEQ ID NO: 7330 - DNA, 18 bp, Artificial Sequence
  Synthetic DNA
tactacgactcacttgag

SEQ ID NO: 7331 - DNA, 18 bp, Artificial Sequence
  Synthetic DNA
tactacgactgactaaag

SEQ ID NO: 7332 - DNA, 18 bp, Artificial Sequence
  Synthetic DNA
tactacgatccactatag

SEQ ID NO: 7333 - DNA, 18 bp, Artificial Sequence
  Synthetic DNA
tactactactcagtatag

SEQ ID NO: 7334 - DNA, 18 bp, Artificial Sequence
  Synthetic DNA
tactccgactaactatag

SEQ ID NO: 7335 - DNA, 18 bp, Artificial Sequence
  Synthetic DNA
tactgcgcctcactatag

SEQ ID NO: 7336 - DNA, 18 bp, Artificial Sequence
  Synthetic DNA
tagcgcgactcactatag

SEQ ID NO: 7337 - DNA, 18 bp, Artificial Sequence
  Synthetic DNA
tagtacgactcaccaaag

SEQ ID NO: 7338 - DNA, 18 bp, Artificial Sequence
  Synthetic DNA
tagtacgactcactactg

SEQ ID NO: 7339 - DNA, 18 bp, Artificial Sequence
  Synthetic DNA
tagtacgactcattatgg

SEQ ID NO: 7340 - DNA, 18 bp, Artificial Sequence
  Synthetic DNA
tagtacgattcagtatag

SEQ ID NO: 7341 - DNA, 18 bp, Artificial Sequence
  Synthetic DNA
tagtgctactcactatag

SEQ ID NO: 7342 - DNA, 18 bp, Artificial Sequence
  Synthetic DNA
tattacgactcactctgg

SEQ ID NO: 7343 - DNA, 18 bp, Artificial Sequence
  Synthetic DNA
tattacgactcgcgatag

SEQ ID NO: 7344 - DNA, 18 bp, Artificial Sequence
  Synthetic DNA
tcagacgactctctatag

SEQ ID NO: 7345 - DNA, 18 bp, Artificial Sequence
  Synthetic DNA
tcatacgactcaatatgg

SEQ ID NO: 7346 - DNA, 18 bp, Artificial Sequence
  Synthetic DNA
tcatacgcctcaatatag

SEQ ID NO: 7347 - DNA, 18 bp, Artificial Sequence
  Synthetic DNA
tcatacggatcactatag

SEQ ID NO: 7348 - DNA, 18 bp, Artificial Sequence
  Synthetic DNA
tcatacggctcacaatag

SEQ ID NO: 7349 - DNA, 18 bp, Artificial Sequence
  Synthetic DNA
tcataggactcacaatag

SEQ ID NO: 7350 - DNA, 18 bp, Artificial Sequence
  Synthetic DNA
tcatgcgaatcactatag

SEQ ID NO: 7351 - DNA, 18 bp, Artificial Sequence
  Synthetic DNA
tcctacgactcactatcg

SEQ ID NO: 7352 - DNA, 18 bp, Artificial Sequence
  Synthetic DNA
tcctatgactcactatag

SEQ ID NO: 7353 - DNA, 18 bp, Artificial Sequence
  Synthetic DNA
tcgtacgactcacaatag

SEQ ID NO: 7354 - DNA, 18 bp, Artificial Sequence
  Synthetic DNA
tgatacgaatcactacag

SEQ ID NO: 7355 - DNA, 18 bp, Artificial Sequence
  Synthetic DNA
tgatacgattcactacag

SEQ ID NO: 7356 - DNA, 18 bp, Artificial Sequence
  Synthetic DNA
ttatacgacgcactgtag

SEQ ID NO: 7357 - DNA, 18 bp, Artificial Sequence
  Synthetic DNA
ttatccgactccctatag

SEQ ID NO: 7358 - DNA, 18 bp, Artificial Sequence
  Synthetic DNA
taattcgaatcactattg

SEQ ID NO: 7359 - DNA, 18 bp, Artificial Sequence
  Synthetic DNA
taatacgattcacaaaag

SEQ ID NO: 7360 - DNA, 18 bp, Artificial Sequence
  Synthetic DNA
cataacgactcactatag

SEQ ID NO: 7361 - DNA, 18 bp, Artificial Sequence
  Synthetic DNA
taatactaatcattatag

SEQ ID NO: 7362 - DNA, 18 bp, Artificial Sequence
  Synthetic DNA
tattccaactcactatag

SEQ ID NO: 7363 - DNA, 18 bp, Artificial Sequence
  Synthetic DNA
taatacgatacactattg

SEQ ID NO: 7364 - DNA, 18 bp, Artificial Sequence
  Synthetic DNA
taattcgacttactattg

SEQ ID NO: 7365 - DNA, 18 bp, Artificial Sequence
  Synthetic DNA
taatacgtctcacattag

SEQ ID NO: 7366 - DNA, 18 bp, Artificial Sequence
  Synthetic DNA
taatacaattcactattg

SEQ ID NO: 7367 - DNA, 18 bp, Artificial Sequence
  Synthetic DNA
cattacgacttactatag

SEQ ID NO: 7368 - DNA, 18 bp, Artificial Sequence
  Synthetic DNA
taaaacgactcacaatgg

SEQ ID NO: 7369 - DNA, 18 bp, Artificial Sequence
  Synthetic DNA
taaaacgattcactatcg

SEQ ID NO: 7370 - DNA, 18 bp, Artificial Sequence
  Synthetic DNA
taatacgacactctatgg

SEQ ID NO: 7371 - DNA, 18 bp, Artificial Sequence
  Synthetic DNA
taatacgattctctacag

SEQ ID NO: 7372 - DNA, 18 bp, Artificial Sequence
  Synthetic DNA
taatactactaaccatag

SEQ ID NO: 7373 - DNA, 18 bp, Artificial Sequence
  Synthetic DNA
ttatacgtctcactatgg

SEQ ID NO: 7374 - DNA, 18 bp, Artificial Sequence
  Synthetic DNA
aaatacgactcacaattg

SEQ ID NO: 7375 - DNA, 18 bp, Artificial Sequence
  Synthetic DNA
ttatacgactcaaaatag

SEQ ID NO: 7376 - DNA, 18 bp, Artificial Sequence
  Synthetic DNA
tattacgactctctttag

SEQ ID NO: 7377 - DNA, 18 bp, Artificial Sequence
  Synthetic DNA
tattactactaactatag

SEQ ID NO: 7378 - DNA, 18 bp, Artificial Sequence
  Synthetic DNA
aaatacgactctgtatag

SEQ ID NO: 7379 - DNA, 18 bp, Artificial Sequence
  Synthetic DNA
taacacgatacactatag

SEQ ID NO: 7380 - DNA, 18 bp, Artificial Sequence
  Synthetic DNA
taatacgactgacttcag

SEQ ID NO: 7381 - DNA, 18 bp, Artificial Sequence
  Synthetic DNA
taatacgacttacgattg

SEQ ID NO: 7382 - DNA, 18 bp, Artificial Sequence
  Synthetic DNA
taatactactcagaatag

SEQ ID NO: 7383 - DNA, 18 bp, Artificial Sequence
  Synthetic DNA
taattagactcactatcg

SEQ ID NO: 7384 - DNA, 18 bp, Artificial Sequence
  Synthetic DNA
taattaggctcactatag

SEQ ID NO: 7385 - DNA, 18 bp, Artificial Sequence
  Synthetic DNA
taattcaagtcactatag

SEQ ID NO: 7386 - DNA, 18 bp, Artificial Sequence
  Synthetic DNA
taattcggatcactatag

SEQ ID NO: 7387 - DNA, 18 bp, Artificial Sequence
  Synthetic DNA
tgatacgactcactatta

SEQ ID NO: 7388 - DNA, 18 bp, Artificial Sequence
  Synthetic DNA
aaatacgatacactatag

SEQ ID NO: 7389 - DNA, 18 bp, Artificial Sequence
  Synthetic DNA
taatacgcctctctaaag

SEQ ID NO: 7390 - DNA, 18 bp, Artificial Sequence
  Synthetic DNA
tagtacgattctctatag

SEQ ID NO: 7391 - DNA, 18 bp, Artificial Sequence
  Synthetic DNA
ttacacgactcactttag

SEQ ID NO: 7392 - DNA, 18 bp, Artificial Sequence
  Synthetic DNA
ttatacgacagactatag

SEQ ID NO: 7393 - DNA, 18 bp, Artificial Sequence
  Synthetic DNA
taatacttctcattatag

SEQ ID NO: 7394 - DNA, 18 bp, Artificial Sequence
  Synthetic DNA
ttatacgacttactattg

SEQ ID NO: 7395 - DNA, 18 bp, Artificial Sequence
  Synthetic DNA
aaatacgactcactttcg

SEQ ID NO: 7396 - DNA, 18 bp, Artificial Sequence
  Synthetic DNA
taataagactcaatattg

SEQ ID NO: 7397 - DNA, 18 bp, Artificial Sequence
  Synthetic DNA
taatacttatcactatag

SEQ ID NO: 7398 - DNA, 18 bp, Artificial Sequence
  Synthetic DNA
taatacgacttcctttag

SEQ ID NO: 7399 - DNA, 18 bp, Artificial Sequence
  Synthetic DNA
tagttcgaatcactatag

SEQ ID NO: 7400 - DNA, 18 bp, Artificial Sequence
  Synthetic DNA
tcataccactctctatag

SEQ ID NO: 7401 - DNA, 18 bp, Artificial Sequence
  Synthetic DNA
tgatactactcactttag

SEQ ID NO: 7402 - DNA, 18 bp, Artificial Sequence
  Synthetic DNA
caatacgactttctatag

SEQ ID NO: 7403 - DNA, 18 bp, Artificial Sequence
  Synthetic DNA
taaaacgagtcaatatag

SEQ ID NO: 7404 - DNA, 18 bp, Artificial Sequence
  Synthetic DNA
taacacgattcattatag

SEQ ID NO: 7405 - DNA, 18 bp, Artificial Sequence
  Synthetic DNA
taactcggctcactatag

SEQ ID NO: 7406 - DNA, 18 bp, Artificial Sequence
  Synthetic DNA
taataccactcactaacg

SEQ ID NO: 7407 - DNA, 18 bp, Artificial Sequence
  Synthetic DNA
taatacgaatcactgtcg

SEQ ID NO: 7408 - DNA, 18 bp, Artificial Sequence
  Synthetic DNA
taatacgaatgactaaag

SEQ ID NO: 7409 - DNA, 18 bp, Artificial Sequence
  Synthetic DNA
taatacgacacacgattg

SEQ ID NO: 7410 - DNA, 18 bp, Artificial Sequence
  Synthetic DNA
taatacgaccgactattg

SEQ ID NO: 7411 - DNA, 18 bp, Artificial Sequence
  Synthetic DNA
taatacgacgctttatag

SEQ ID NO: 7412 - DNA, 18 bp, Artificial Sequence
  Synthetic DNA
taatacgactcactgttc

SEQ ID NO: 7413 - DNA, 18 bp, Artificial Sequence
  Synthetic DNA
taatacgactctttgtag

SEQ ID NO: 7414 - DNA, 18 bp, Artificial Sequence
  Synthetic DNA
taataggattcactatcg

SEQ ID NO: 7415 - DNA, 18 bp, Artificial Sequence
  Synthetic DNA
taatatgtcccactatag

SEQ ID NO: 7416 - DNA, 18 bp, Artificial Sequence
  Synthetic DNA
taatccaacacactatag

SEQ ID NO: 7417 - DNA, 18 bp, Artificial Sequence
  Synthetic DNA
taatgcctctcactatag

SEQ ID NO: 7418 - DNA, 18 bp, Artificial Sequence
  Synthetic DNA
taattcgactcaccgtag

SEQ ID NO: 7419 - DNA, 18 bp, Artificial Sequence
  Synthetic DNA
tactaaggctcactatag

SEQ ID NO: 7420 - DNA, 18 bp, Artificial Sequence
  Synthetic DNA
tactacaacacactatag

SEQ ID NO: 7421 - DNA, 18 bp, Artificial Sequence
  Synthetic DNA
tactaccactcactatcg

SEQ ID NO: 7422 - DNA, 18 bp, Artificial Sequence
  Synthetic DNA
tacttcgactcactgtag

SEQ ID NO: 7423 - DNA, 18 bp, Artificial Sequence
  Synthetic DNA
tattaaggctcactatag

SEQ ID NO: 7424 - DNA, 18 bp, Artificial Sequence
  Synthetic DNA
tcatacaaatcactatag

SEQ ID NO: 7425 - DNA, 18 bp, Artificial Sequence
  Synthetic DNA
tcatacgactcacaatcg

SEQ ID NO: 7426 - DNA, 18 bp, Artificial Sequence
  Synthetic DNA
tcatgcgcctcactatag

SEQ ID NO: 7427 - DNA, 18 bp, Artificial Sequence
  Synthetic DNA
tgatacgactgacaatag

SEQ ID NO: 7428 - DNA, 18 bp, Artificial Sequence
  Synthetic DNA
tggtaagactcactatag

SEQ ID NO: 7429 - DNA, 18 bp, Artificial Sequence
  Synthetic DNA
tgttaagactcactatag

SEQ ID NO: 7430 - DNA, 18 bp, Artificial Sequence
  Synthetic DNA
ttacacgactccctatag

SEQ ID NO: 7431 - DNA, 18 bp, Artificial Sequence
  Synthetic DNA
ttatacgacgcacaatag

SEQ ID NO: 7432 - DNA, 18 bp, Artificial Sequence
  Synthetic DNA
ttatacgactcaataaag

SEQ ID NO: 7433 - DNA, 18 bp, Artificial Sequence
  Synthetic DNA
ttatacgacttattatag

SEQ ID NO: 7434 - DNA, 18 bp, Artificial Sequence
  Synthetic DNA
taataggaatctctatag

SEQ ID NO: 7435 - DNA, 18 bp, Artificial Sequence
  Synthetic DNA
tattatgactcaatatag

SEQ ID NO: 7436 - DNA, 18 bp, Artificial Sequence
  Synthetic DNA
taattcgaatctctatag

SEQ ID NO: 7437 - DNA, 18 bp, Artificial Sequence
  Synthetic DNA
tattacgactaactttag

SEQ ID NO: 7438 - DNA, 18 bp, Artificial Sequence
  Synthetic DNA
tagtacgactctcaatag

SEQ ID NO: 7439 - DNA, 18 bp, Artificial Sequence
  Synthetic DNA
aaatacgactgtctatag

SEQ ID NO: 7440 - DNA, 18 bp, Artificial Sequence
  Synthetic DNA
taataccaatcaatatag

SEQ ID NO: 7441 - DNA, 18 bp, Artificial Sequence
  Synthetic DNA
taataccaatcactaaag

SEQ ID NO: 7442 - DNA, 18 bp, Artificial Sequence
  Synthetic DNA
taatacgaccaacaatag

SEQ ID NO: 7443 - DNA, 18 bp, Artificial Sequence
  Synthetic DNA
taatacgactcattaacg

SEQ ID NO: 7444 - DNA, 18 bp, Artificial Sequence
  Synthetic DNA
taatacttctcacgatag

SEQ ID NO: 7445 - DNA, 18 bp, Artificial Sequence
  Synthetic DNA
taatccgactaactttag

SEQ ID NO: 7446 - DNA, 18 bp, Artificial Sequence
  Synthetic DNA
taattccactaactatag

SEQ ID NO: 7447 - DNA, 18 bp, Artificial Sequence
  Synthetic DNA
taattcgactctctgtag

SEQ ID NO: 7448 - DNA, 18 bp, Artificial Sequence
  Synthetic DNA
tcaaacgactcattatag

SEQ ID NO: 7449 - DNA, 18 bp, Artificial Sequence
  Synthetic DNA
tcatacgtctcactctag

SEQ ID NO: 7450 - DNA, 18 bp, Artificial Sequence
  Synthetic DNA
tgttacgacttactatag

SEQ ID NO: 7451 - DNA, 18 bp, Artificial Sequence
  Synthetic DNA
ttatacgattcactagag

SEQ ID NO: 7452 - DNA, 18 bp, Artificial Sequence
  Synthetic DNA
atatacgactctctatag

SEQ ID NO: 7453 - DNA, 18 bp, Artificial Sequence
  Synthetic DNA
atatacgactccctatag

SEQ ID NO: 7454 - DNA, 18 bp, Artificial Sequence
  Synthetic DNA
taatacgtctcactaagg

SEQ ID NO: 7455 - DNA, 18 bp, Artificial Sequence
  Synthetic DNA
aaatatgactctctatag

SEQ ID NO: 7456 - DNA, 18 bp, Artificial Sequence
  Synthetic DNA
tacaacgactcactttag

SEQ ID NO: 7457 - DNA, 18 bp, Artificial Sequence
  Synthetic DNA
taataagattcaatatag

SEQ ID NO: 7458 - DNA, 18 bp, Artificial Sequence
  Synthetic DNA
taatacgacttactaacg

SEQ ID NO: 7459 - DNA, 18 bp, Artificial Sequence
  Synthetic DNA
taatacgactttgtatag

SEQ ID NO: 7460 - DNA, 18 bp, Artificial Sequence
  Synthetic DNA
taatacgtctcattatgg

SEQ ID NO: 7461 - DNA, 18 bp, Artificial Sequence
  Synthetic DNA
taatatgacaaactatag

SEQ ID NO: 7462 - DNA, 18 bp, Artificial Sequence
  Synthetic DNA
taatccgtatcactatag

SEQ ID NO: 7463 - DNA, 18 bp, Artificial Sequence
  Synthetic DNA
tcttacgactcacaatag

SEQ ID NO: 7464 - DNA, 18 bp, Artificial Sequence
  Synthetic DNA
taatacgactgacattag

SEQ ID NO: 7465 - DNA, 18 bp, Artificial Sequence
  Synthetic DNA
taataggactctctaaag

SEQ ID NO: 7466 - DNA, 18 bp, Artificial Sequence
  Synthetic DNA
caatacgtctcactttag

SEQ ID NO: 7467 - DNA, 18 bp, Artificial Sequence
  Synthetic DNA
taatactacttactaaag

SEQ ID NO: 7468 - DNA, 18 bp, Artificial Sequence
  Synthetic DNA
tattactacttactatag

SEQ ID NO: 7469 - DNA, 18 bp, Artificial Sequence
  Synthetic DNA
taaaacaacacactatag

SEQ ID NO: 7470 - DNA, 18 bp, Artificial Sequence
  Synthetic DNA
tgttacgactcactattg

SEQ ID NO: 7471 - DNA, 18 bp, Artificial Sequence
  Synthetic DNA
tattatgactcactttag

SEQ ID NO: 7472 - DNA, 18 bp, Artificial Sequence
  Synthetic DNA
aaattcgattcactatag

SEQ ID NO: 7473 - DNA, 18 bp, Artificial Sequence
  Synthetic DNA
taatacgattcactaatg

SEQ ID NO: 7474 - DNA, 18 bp, Artificial Sequence
  Synthetic DNA
taatacgactctctcaag

SEQ ID NO: 7475 - DNA, 18 bp, Artificial Sequence
  Synthetic DNA
taatatgactaactttag

SEQ ID NO: 7476 - DNA, 18 bp, Artificial Sequence
  Synthetic DNA
ttataccactcactaaag

SEQ ID NO: 7477 - DNA, 18 bp, Artificial Sequence
  Synthetic DNA
taatactactcacaatgg

SEQ ID NO: 7478 - DNA, 18 bp, Artificial Sequence
  Synthetic DNA
taatccgtctctctatag

SEQ ID NO: 7479 - DNA, 18 bp, Artificial Sequence
  Synthetic DNA
caattcgactcactattg

SEQ ID NO: 7480 - DNA, 18 bp, Artificial Sequence
  Synthetic DNA
tagtactactcactaaag

SEQ ID NO: 7481 - DNA, 18 bp, Artificial Sequence
  Synthetic DNA
ttctacgactcactttag

SEQ ID NO: 7482 - DNA, 18 bp, Artificial Sequence
  Synthetic DNA
acatacgactcaatatag

SEQ ID NO: 7483 - DNA, 18 bp, Artificial Sequence
  Synthetic DNA
agatacgaatcactatag

SEQ ID NO: 7484 - DNA, 18 bp, Artificial Sequence
  Synthetic DNA
taataagtctcaccatag

SEQ ID NO: 7485 - DNA, 18 bp, Artificial Sequence
  Synthetic DNA
taatacgtctccttatag

SEQ ID NO: 7486 - DNA, 18 bp, Artificial Sequence
  Synthetic DNA
taatactacccaatatag

SEQ ID NO: 7487 - DNA, 18 bp, Artificial Sequence
  Synthetic DNA
taatagcactcacaatag

SEQ ID NO: 7488 - DNA, 18 bp, Artificial Sequence
  Synthetic DNA
taatatgacttattatag

SEQ ID NO: 7489 - DNA, 18 bp, Artificial Sequence
  Synthetic DNA
taatccgacttattatag

SEQ ID NO: 7490 - DNA, 18 bp, Artificial Sequence
  Synthetic DNA
taatgcgacacattatag

SEQ ID NO: 7491 - DNA, 18 bp, Artificial Sequence
  Synthetic DNA
tactacgaatctctatag

SEQ ID NO: 7492 - DNA, 18 bp, Artificial Sequence
  Synthetic DNA
tattaagactcagtatag

SEQ ID NO: 7493 - DNA, 18 bp, Artificial Sequence
  Synthetic DNA
tattatgactccctatag

SEQ ID NO: 7494 - DNA, 18 bp, Artificial Sequence
  Synthetic DNA
tcataggtctcactatag

SEQ ID NO: 7495 - DNA, 18 bp, Artificial Sequence
  Synthetic DNA
ttatactactcacgatag

SEQ ID NO: 7496 - DNA, 18 bp, Artificial Sequence
  Synthetic DNA
taatacgactaaccatgg

SEQ ID NO: 7497 - DNA, 18 bp, Artificial Sequence
  Synthetic DNA
taatacgacttacaatcg

SEQ ID NO: 7498 - DNA, 18 bp, Artificial Sequence
  Synthetic DNA
taatactattcactctag

SEQ ID NO: 7499 - DNA, 18 bp, Artificial Sequence
  Synthetic DNA
tactacgacacacaatag

SEQ ID NO: 7500 - DNA, 18 bp, Artificial Sequence
  Synthetic DNA
tagtacaactcacaatag

SEQ ID NO: 7501 - DNA, 18 bp, Artificial Sequence
  Synthetic DNA
ctatacgactcaatatag

SEQ ID NO: 7502 - DNA, 18 bp, Artificial Sequence
  Synthetic DNA
taaaaccactcactatgg

SEQ ID NO: 7503 - DNA, 18 bp, Artificial Sequence
  Synthetic DNA
taataacactcattatag

SEQ ID NO: 7504 - DNA, 18 bp, Artificial Sequence
  Synthetic DNA
taataagacctactatag

SEQ ID NO: 7505 - DNA, 18 bp, Artificial Sequence
  Synthetic DNA
taataagactgactattg

SEQ ID NO: 7506 - DNA, 18 bp, Artificial Sequence
  Synthetic DNA
taataatactcactacag

SEQ ID NO: 7507 - DNA, 18 bp, Artificial Sequence
  Synthetic DNA
taatacaacttaccatag

SEQ ID NO: 7508 - DNA, 18 bp, Artificial Sequence
  Synthetic DNA
taatacgaatgtctatag

SEQ ID NO: 7509 - DNA, 18 bp, Artificial Sequence
  Synthetic DNA
taatacgatttagtatag

SEQ ID NO: 7510 - DNA, 18 bp, Artificial Sequence
  Synthetic DNA
taatacgcttcattatag

SEQ ID NO: 7511 - DNA, 18 bp, Artificial Sequence
  Synthetic DNA
taatacgtcccaccatag

SEQ ID NO: 7512 - DNA, 18 bp, Artificial Sequence
  Synthetic DNA
taatactaatcactatgg

SEQ ID NO: 7513 - DNA, 18 bp, Artificial Sequence
  Synthetic DNA
taatactacacactagag

SEQ ID NO: 7514 - DNA, 18 bp, Artificial Sequence
  Synthetic DNA
taatactactcactactg

SEQ ID NO: 7515 - DNA, 18 bp, Artificial Sequence
  Synthetic DNA
taatccaactcattatag

SEQ ID NO: 7516 - DNA, 18 bp, Artificial Sequence
  Synthetic DNA
taatgcgattcactctag

SEQ ID NO: 7517 - DNA, 18 bp, Artificial Sequence
  Synthetic DNA
taattcgagccactatag

SEQ ID NO: 7518 - DNA, 18 bp, Artificial Sequence
  Synthetic DNA
taattggactcactatgg

SEQ ID NO: 7519 - DNA, 18 bp, Artificial Sequence
  Synthetic DNA
tactgctactcactatag

SEQ ID NO: 7520 - DNA, 18 bp, Artificial Sequence
  Synthetic DNA
tagtacgacaaactatag

SEQ ID NO: 7521 - DNA, 18 bp, Artificial Sequence
  Synthetic DNA
tattacgactccctgtag

SEQ ID NO: 7522 - DNA, 18 bp, Artificial Sequence
  Synthetic DNA
tgatacgacaccctatag

SEQ ID NO: 7523 - DNA, 18 bp, Artificial Sequence
  Synthetic DNA
ttataccagtcactatag

SEQ ID NO: 7524 - DNA, 18 bp, Artificial Sequence
  Synthetic DNA
aaataccacccactatag

SEQ ID NO: 7525 - DNA, 18 bp, Artificial Sequence
  Synthetic DNA
aaataggacccactatag

SEQ ID NO: 7526 - DNA, 18 bp, Artificial Sequence
  Synthetic DNA
caagaagactcactatag

SEQ ID NO: 7527 - DNA, 18 bp, Artificial Sequence
  Synthetic DNA
caatacgaatcagtatag

SEQ ID NO: 7528 - DNA, 18 bp, Artificial Sequence
  Synthetic DNA
caatacgactccctaaag

SEQ ID NO: 7529 - DNA, 18 bp, Artificial Sequence
  Synthetic DNA
caatacggatcactatag

SEQ ID NO: 7530 - DNA, 18 bp, Artificial Sequence
  Synthetic DNA
caatacgtcccactatag

SEQ ID NO: 7531 - DNA, 18 bp, Artificial Sequence
  Synthetic DNA
caatccgactgactatag

SEQ ID NO: 7532 - DNA, 18 bp, Artificial Sequence
  Synthetic DNA
gaacacgacacactatag

SEQ ID NO: 7533 - DNA, 18 bp, Artificial Sequence
  Synthetic DNA
gaatatgtctcactatag

SEQ ID NO: 7534 - DNA, 18 bp, Artificial Sequence
  Synthetic DNA
gcttacgactcactatag

SEQ ID NO: 7535 - DNA, 18 bp, Artificial Sequence
  Synthetic DNA
taaaacgcgtcactatag

SEQ ID NO: 7536 - DNA, 18 bp, Artificial Sequence
  Synthetic DNA
taacacgactcactaacg

SEQ ID NO: 7537 - DNA, 18 bp, Artificial Sequence
  Synthetic DNA
taacccgactcacaatag

SEQ ID NO: 7538 - DNA, 18 bp, Artificial Sequence
  Synthetic DNA
taagacgactctatatag

SEQ ID NO: 7539 - DNA, 18 bp, Artificial Sequence
  Synthetic DNA
taagacgtctcactgtag

SEQ ID NO: 7540 - DNA, 18 bp, Artificial Sequence
  Synthetic DNA
taataaaactgactatag

SEQ ID NO: 7541 - DNA, 18 bp, Artificial Sequence
  Synthetic DNA
taataagactaactctag

SEQ ID NO: 7542 - DNA, 18 bp, Artificial Sequence
  Synthetic DNA
taatacaaatccctatag

SEQ ID NO: 7543 - DNA, 18 bp, Artificial Sequence
  Synthetic DNA
taatacaactcgcaatag

SEQ ID NO: 7544 - DNA, 18 bp, Artificial Sequence
  Synthetic DNA
taataccaatccctatag

SEQ ID NO: 7545 - DNA, 18 bp, Artificial Sequence
  Synthetic DNA
taataccactcagtacag

SEQ ID NO: 7546 - DNA, 18 bp, Artificial Sequence
  Synthetic DNA
taataccagacactatag

SEQ ID NO: 7547 - DNA, 18 bp, Artificial Sequence
  Synthetic DNA
taatacgaccgtctatag

SEQ ID NO: 7548 - DNA, 18 bp, Artificial Sequence
  Synthetic DNA
taatacgactacctctag

SEQ ID NO: 7549 - DNA, 18 bp, Artificial Sequence
  Synthetic DNA
taatacgactcactgcgg

SEQ ID NO: 7550 - DNA, 18 bp, Artificial Sequence
  Synthetic DNA
taatacgactcacttgcg

SEQ ID NO: 7551 - DNA, 18 bp, Artificial Sequence
  Synthetic DNA
taatacgactggctaaag

SEQ ID NO: 7552 - DNA, 18 bp, Artificial Sequence
  Synthetic DNA
taatacgagtcactaagg

SEQ ID NO: 7553 - DNA, 18 bp, Artificial Sequence
  Synthetic DNA
taatacgcccgactatag

SEQ ID NO: 7554 - DNA, 18 bp, Artificial Sequence
  Synthetic DNA
taatacggctcaatctag

SEQ ID NO: 7555 - DNA, 18 bp, Artificial Sequence
  Synthetic DNA
taatactactcagtatcg

SEQ ID NO: 7556 - DNA, 18 bp, Artificial Sequence
  Synthetic DNA
taataggattcactatgg

SEQ ID NO: 7557 - DNA, 18 bp, Artificial Sequence
  Synthetic DNA
taatagggctcgctatag

SEQ ID NO: 7558 - DNA, 18 bp, Artificial Sequence
  Synthetic DNA
taatatgaatcactctag

SEQ ID NO: 7559 - DNA, 18 bp, Artificial Sequence
  Synthetic DNA
taatatgactcactaggg

SEQ ID NO: 7560 - DNA, 18 bp, Artificial Sequence
  Synthetic DNA
taatattactgactatag

SEQ ID NO: 7561 - DNA, 18 bp, Artificial Sequence
  Synthetic DNA
taatccgactcaccttag

SEQ ID NO: 7562 - DNA, 18 bp, Artificial Sequence
  Synthetic DNA
taatgagaatcactatag

SEQ ID NO: 7563 - DNA, 18 bp, Artificial Sequence
  Synthetic DNA
taatgcgactcgctatgg

SEQ ID NO: 7564 - DNA, 18 bp, Artificial Sequence
  Synthetic DNA
taattcgacccgctatag

SEQ ID NO: 7565 - DNA, 18 bp, Artificial Sequence
  Synthetic DNA
tactacgactacctatag

SEQ ID NO: 7566 - DNA, 18 bp, Artificial Sequence
  Synthetic DNA
tactacgactcagaatag

SEQ ID NO: 7567 - DNA, 18 bp, Artificial Sequence
  Synthetic DNA
tactacgattccctatag

SEQ ID NO: 7568 - DNA, 18 bp, Artificial Sequence
  Synthetic DNA
tactacggctcactatgg

SEQ ID NO: 7569 - DNA, 18 bp, Artificial Sequence
  Synthetic DNA
tagtaagactgactatag

SEQ ID NO: 7570 - DNA, 18 bp, Artificial Sequence
  Synthetic DNA
tagtacgactcaatatcg

SEQ ID NO: 7571 - DNA, 18 bp, Artificial Sequence
  Synthetic DNA
tatcacgactcactagag

SEQ ID NO: 7572 - DNA, 18 bp, Artificial Sequence
  Synthetic DNA
tattacgaccgactatag

SEQ ID NO: 7573 - DNA, 18 bp, Artificial Sequence
  Synthetic DNA
tcacacgactcactatgg

SEQ ID NO: 7574 - DNA, 18 bp, Artificial Sequence
  Synthetic DNA
tcacacgactgactatag

SEQ ID NO: 7575 - DNA, 18 bp, Artificial Sequence
  Synthetic DNA
tcatacgacccactgtag

SEQ ID NO: 7576 - DNA, 18 bp, Artificial Sequence
  Synthetic DNA
tcatacgacgcacaatag

SEQ ID NO: 7577 - DNA, 18 bp, Artificial Sequence
  Synthetic DNA
tcatacgacgcactattg

SEQ ID NO: 7578 - DNA, 18 bp, Artificial Sequence
  Synthetic DNA
tcttacgactcaccatag

SEQ ID NO: 7579 - DNA, 18 bp, Artificial Sequence
  Synthetic DNA
tcttacgactcactatgg

SEQ ID NO: 7580 - DNA, 18 bp, Artificial Sequence
  Synthetic DNA
tgagacgacacactatag

SEQ ID NO: 7581 - DNA, 18 bp, Artificial Sequence
  Synthetic DNA
tgatacgactcacgttag

SEQ ID NO: 7582 - DNA, 18 bp, Artificial Sequence
  Synthetic DNA
tgatacggctcactaaag

SEQ ID NO: 7583 - DNA, 18 bp, Artificial Sequence
  Synthetic DNA
tgataggaatcactatag

SEQ ID NO: 7584 - DNA, 18 bp, Artificial Sequence
  Synthetic DNA
tgataggactcactattg

SEQ ID NO: 7585 - DNA, 18 bp, Artificial Sequence
  Synthetic DNA
tgctacgactcactatcg

SEQ ID NO: 7586 - DNA, 18 bp, Artificial Sequence
  Synthetic DNA
tggtacgactcacaatag

SEQ ID NO: 7587 - DNA, 18 bp, Artificial Sequence
  Synthetic DNA
ttagacgacccactatag

SEQ ID NO: 7588 - DNA, 18 bp, Artificial Sequence
  Synthetic DNA
ttatgcggctcactatag

SEQ ID NO: 7589 - DNA, 18 bp, Artificial Sequence
  Synthetic DNA
taaaacgtctcacaatag

SEQ ID NO: 7590 - DNA, 18 bp, Artificial Sequence
  Synthetic DNA
tattacgacactctatag

SEQ ID NO: 7591 - DNA, 18 bp, Artificial Sequence
  Synthetic DNA
taaaacgactcaatttag

SEQ ID NO: 7592 - DNA, 18 bp, Artificial Sequence
  Synthetic DNA
taattctaatcactatag

SEQ ID NO: 7593 - DNA, 18 bp, Artificial Sequence
  Synthetic DNA
tcattcgactcactattg

SEQ ID NO: 7594 - DNA, 18 bp, Artificial Sequence
  Synthetic DNA
caatacgattcactttag

SEQ ID NO: 7595 - DNA, 18 bp, Artificial Sequence
  Synthetic DNA
taatacgaatcagtattg

SEQ ID NO: 7596 - DNA, 18 bp, Artificial Sequence
  Synthetic DNA
taatacgacaccctattg

SEQ ID NO: 7597 - DNA, 18 bp, Artificial Sequence
  Synthetic DNA
taatacgactcagtatta

SEQ ID NO: 7598 - DNA, 18 bp, Artificial Sequence
  Synthetic DNA
tatttcggctcactatag

SEQ ID NO: 7599 - DNA, 18 bp, Artificial Sequence
  Synthetic DNA
aaatactactcactaaag

SEQ ID NO: 7600 - DNA, 18 bp, Artificial Sequence
  Synthetic DNA
aattatgactcactatag

SEQ ID NO: 7601 - DNA, 18 bp, Artificial Sequence
  Synthetic DNA
taatacatctcattatag

SEQ ID NO: 7602 - DNA, 18 bp, Artificial Sequence
  Synthetic DNA
taatacgtttcaatatag

SEQ ID NO: 7603 - DNA, 18 bp, Artificial Sequence
  Synthetic DNA
taatactacttactattg

SEQ ID NO: 7604 - DNA, 18 bp, Artificial Sequence
  Synthetic DNA
taatccgactctctttag

SEQ ID NO: 7605 - DNA, 18 bp, Artificial Sequence
  Synthetic DNA
taatacgactttctaaag

SEQ ID NO: 7606 - DNA, 18 bp, Artificial Sequence
  Synthetic DNA
aaatacgactctctgtag

SEQ ID NO: 7607 - DNA, 18 bp, Artificial Sequence
  Synthetic DNA
taaaacgaattactatag

SEQ ID NO: 7608 - DNA, 18 bp, Artificial Sequence
  Synthetic DNA
taatacgacacacactag

SEQ ID NO: 7609 - DNA, 18 bp, Artificial Sequence
  Synthetic DNA
taatacgacccacttaag

SEQ ID NO: 7610 - DNA, 18 bp, Artificial Sequence
  Synthetic DNA
taatacgagacattatag

SEQ ID NO: 7611 - DNA, 18 bp, Artificial Sequence
  Synthetic DNA
taatacgcctcaatattg

SEQ ID NO: 7612 - DNA, 18 bp, Artificial Sequence
  Synthetic DNA
tagcacgactcactttag

SEQ ID NO: 7613 - DNA, 18 bp, Artificial Sequence
  Synthetic DNA
tagtactattcactatag

SEQ ID NO: 7614 - DNA, 18 bp, Artificial Sequence
  Synthetic DNA
tcatacgactctccatag

SEQ ID NO: 7615 - DNA, 18 bp, Artificial Sequence
  Synthetic DNA
ttatacgacttactagag

SEQ ID NO: 7616 - DNA, 18 bp, Artificial Sequence
  Synthetic DNA
tattacgattcacaatag

SEQ ID NO: 7617 - DNA, 18 bp, Artificial Sequence
  Synthetic DNA
tattacgtctcattatag

SEQ ID NO: 7618 - DNA, 18 bp, Artificial Sequence
  Synthetic DNA
aaataaaactcactatag

SEQ ID NO: 7619 - DNA, 18 bp, Artificial Sequence
  Synthetic DNA
taatacgactcacatgag

SEQ ID NO: 7620 - DNA, 18 bp, Artificial Sequence
  Synthetic DNA
aaatacgacttactattg

SEQ ID NO: 7621 - DNA, 18 bp, Artificial Sequence
  Synthetic DNA
aaatattactcactatag

SEQ ID NO: 7622 - DNA, 18 bp, Artificial Sequence
  Synthetic DNA
taatacgactctatttag

SEQ ID NO: 7623 - DNA, 18 bp, Artificial Sequence
  Synthetic DNA
taatacgactctccttag

SEQ ID NO: 7624 - DNA, 18 bp, Artificial Sequence
  Synthetic DNA
taatacgaattaatatag

SEQ ID NO: 7625 - DNA, 18 bp, Artificial Sequence
  Synthetic DNA
taatacgtctcattatcg

SEQ ID NO: 7626 - DNA, 18 bp, Artificial Sequence
  Synthetic DNA
taatacgtctctctacag

SEQ ID NO: 7627 - DNA, 18 bp, Artificial Sequence
  Synthetic DNA
caatacgactccctttag

SEQ ID NO: 7628 - DNA, 18 bp, Artificial Sequence
  Synthetic DNA
caatacgactgactaaag

SEQ ID NO: 7629 - DNA, 18 bp, Artificial Sequence
  Synthetic DNA
ccatacgattcactatag

SEQ ID NO: 7630 - DNA, 18 bp, Artificial Sequence
  Synthetic DNA
taaaaacactcactatag

SEQ ID NO: 7631 - DNA, 18 bp, Artificial Sequence
  Synthetic DNA
taaaacgagtcactacag

SEQ ID NO: 7632 - DNA, 18 bp, Artificial Sequence
  Synthetic DNA
taacaagattcactatag

SEQ ID NO: 7633 - DNA, 18 bp, Artificial Sequence
  Synthetic DNA
taacacgaatccctatag

SEQ ID NO: 7634 - DNA, 18 bp, Artificial Sequence
  Synthetic DNA
taacacgactcacaagag

SEQ ID NO: 7635 - DNA, 18 bp, Artificial Sequence
  Synthetic DNA
taatacaacgctctatag

SEQ ID NO: 7636 - DNA, 18 bp, Artificial Sequence
  Synthetic DNA
taatacgacacacgttag

SEQ ID NO: 7637 - DNA, 18 bp, Artificial Sequence
  Synthetic DNA
taatacgagtctctacag

SEQ ID NO: 7638 - DNA, 18 bp, Artificial Sequence
  Synthetic DNA
taatacgcaacactatag

SEQ ID NO: 7639 - DNA, 18 bp, Artificial Sequence
  Synthetic DNA
taatacggatcactattg

SEQ ID NO: 7640 - DNA, 18 bp, Artificial Sequence
  Synthetic DNA
taatacgtcgcactttag

SEQ ID NO: 7641 - DNA, 18 bp, Artificial Sequence
  Synthetic DNA
taatacgtctaactctag

SEQ ID NO: 7642 - DNA, 18 bp, Artificial Sequence
  Synthetic DNA
taatactacgcacaatag

SEQ ID NO: 7643 - DNA, 18 bp, Artificial Sequence
  Synthetic DNA
taatccgactaactattg

SEQ ID NO: 7644 - DNA, 18 bp, Artificial Sequence
  Synthetic DNA
taatctgactcaatatag

SEQ ID NO: 7645 - DNA, 18 bp, Artificial Sequence
  Synthetic DNA
taatgcaacacactatag

SEQ ID NO: 7646 - DNA, 18 bp, Artificial Sequence
  Synthetic DNA
taattggactaactatag

SEQ ID NO: 7647 - DNA, 18 bp, Artificial Sequence
  Synthetic DNA
tagtacgactcactatta

SEQ ID NO: 7648 - DNA, 18 bp, Artificial Sequence
  Synthetic DNA
tattagggctcactatag

SEQ ID NO: 7649 - DNA, 18 bp, Artificial Sequence
  Synthetic DNA
tgataagactccctatag

SEQ ID NO: 7650 - DNA, 18 bp, Artificial Sequence
  Synthetic DNA
tgattagactcactatag

SEQ ID NO: 7651 - DNA, 18 bp, Artificial Sequence
  Synthetic DNA
tgttacgactccctatag

SEQ ID NO: 7652 - DNA, 18 bp, Artificial Sequence
  Synthetic DNA
ttatacgactagctatag

SEQ ID NO: 7653 - DNA, 18 bp, Artificial Sequence
  Synthetic DNA
ttatacgagtcactctag

SEQ ID NO: 7654 - DNA, 18 bp, Artificial Sequence
  Synthetic DNA
taatatgtctcactattg

SEQ ID NO: 7655 - DNA, 18 bp, Artificial Sequence
  Synthetic DNA
taatacgattcaaaatag

SEQ ID NO: 7656 - DNA, 18 bp, Artificial Sequence
  Synthetic DNA
tagttcgactcactattg

SEQ ID NO: 7657 - DNA, 18 bp, Artificial Sequence
  Synthetic DNA
tattacgactcacagtag

SEQ ID NO: 7658 - DNA, 18 bp, Artificial Sequence
  Synthetic DNA
ttaaacgactccctatag

SEQ ID NO: 7659 - DNA, 18 bp, Artificial Sequence
  Synthetic DNA
tattacgactcaaaatag

SEQ ID NO: 7660 - DNA, 18 bp, Artificial Sequence
  Synthetic DNA
taaaacgtcacactatag

SEQ ID NO: 7661 - DNA, 18 bp, Artificial Sequence
  Synthetic DNA
aaatacgacccactaaag

SEQ ID NO: 7662 - DNA, 18 bp, Artificial Sequence
  Synthetic DNA
aaatccgaatcactatag

SEQ ID NO: 7663 - DNA, 18 bp, Artificial Sequence
  Synthetic DNA
taacacgcctctctatag

SEQ ID NO: 7664 - DNA, 18 bp, Artificial Sequence
  Synthetic DNA
taatacgactcattgttg

SEQ ID NO: 7665 - DNA, 18 bp, Artificial Sequence
  Synthetic DNA
taatacgtcgcactaaag

SEQ ID NO: 7666 - DNA, 18 bp, Artificial Sequence
  Synthetic DNA
taatcctactcaatatag

SEQ ID NO: 7667 - DNA, 18 bp, Artificial Sequence
  Synthetic DNA
taattcgactcagaatag

SEQ ID NO: 7668 - DNA, 18 bp, Artificial Sequence
  Synthetic DNA
tagtacgtttcactatag

SEQ ID NO: 7669 - DNA, 18 bp, Artificial Sequence
  Synthetic DNA
tattacgactcactgtcg

SEQ ID NO: 7670 - DNA, 18 bp, Artificial Sequence
  Synthetic DNA
ttatacgacttactacag

SEQ ID NO: 7671 - DNA, 18 bp, Artificial Sequence
  Synthetic DNA
taagacgtcacactatag

SEQ ID NO: 7672 - DNA, 18 bp, Artificial Sequence
  Synthetic DNA
taatacgtctagctatag

SEQ ID NO: 7673 - DNA, 18 bp, Artificial Sequence
  Synthetic DNA
taatacgtctcgttatag

SEQ ID NO: 7674 - DNA, 18 bp, Artificial Sequence
  Synthetic DNA
taattcgactaattatag

SEQ ID NO: 7675 - DNA, 18 bp, Artificial Sequence
  Synthetic DNA
tattacgactcaatctag

SEQ ID NO: 7676 - DNA, 18 bp, Artificial Sequence
  Synthetic DNA
tcatacgactcacaaaag

SEQ ID NO: 7677 - DNA, 18 bp, Artificial Sequence
  Synthetic DNA
tataacgactcacaatag

SEQ ID NO: 7678 - DNA, 18 bp, Artificial Sequence
  Synthetic DNA
atatacgactcactctag

SEQ ID NO: 7679 - DNA, 18 bp, Artificial Sequence
  Synthetic DNA
taataaaactcacaatag

SEQ ID NO: 7680 - DNA, 18 bp, Artificial Sequence
  Synthetic DNA
tgaaacgactctctatag

SEQ ID NO: 7681 - DNA, 18 bp, Artificial Sequence
  Synthetic DNA
taataagtctcactattg

SEQ ID NO: 7682 - DNA, 18 bp, Artificial Sequence
  Synthetic DNA
ttataagactcaatatag

SEQ ID NO: 7683 - DNA, 18 bp, Artificial Sequence
  Synthetic DNA
tcatacgactctctaaag

SEQ ID NO: 7684 - DNA, 18 bp, Artificial Sequence
  Synthetic DNA
taatacgtatcactaaag

SEQ ID NO: 7685 - DNA, 18 bp, Artificial Sequence
  Synthetic DNA
tattacgattctctatag

SEQ ID NO: 7686 - DNA, 18 bp, Artificial Sequence
  Synthetic DNA
taatacgacacacaacag

SEQ ID NO: 7687 - DNA, 18 bp, Artificial Sequence
  Synthetic DNA
taaagcgattcactatag

SEQ ID NO: 7688 - DNA, 18 bp, Artificial Sequence
  Synthetic DNA
taatacgactcaatgaag

SEQ ID NO: 7689 - DNA, 18 bp, Artificial Sequence
  Synthetic DNA
taatactacacactgtag

SEQ ID NO: 7690 - DNA, 18 bp, Artificial Sequence
  Synthetic DNA
taatactactcaacatag

SEQ ID NO: 7691 - DNA, 18 bp, Artificial Sequence
  Synthetic DNA
taatactagtcactttag

SEQ ID NO: 7692 - DNA, 18 bp, Artificial Sequence
  Synthetic DNA
taatgcgaatcactattg

SEQ ID NO: 7693 - DNA, 18 bp, Artificial Sequence
  Synthetic DNA
taattcaactgactatag

SEQ ID NO: 7694 - DNA, 18 bp, Artificial Sequence
  Synthetic DNA
taattggacccactatag

SEQ ID NO: 7695 - DNA, 18 bp, Artificial Sequence
  Synthetic DNA
taatttgactccctatag

SEQ ID NO: 7696 - DNA, 18 bp, Artificial Sequence
  Synthetic DNA
tactaagactcactattg

SEQ ID NO: 7697 - DNA, 18 bp, Artificial Sequence
  Synthetic DNA
tagtacgattcactatcg

SEQ ID NO: 7698 - DNA, 18 bp, Artificial Sequence
  Synthetic DNA
tagtatgacacactatag

SEQ ID NO: 7699 - DNA, 18 bp, Artificial Sequence
  Synthetic DNA
tattacgactcacgaaag

SEQ ID NO: 7700 - DNA, 18 bp, Artificial Sequence
  Synthetic DNA
ttataagactcactgtag

SEQ ID NO: 7701 - DNA, 18 bp, Artificial Sequence
  Synthetic DNA
ttatacgtctcacgatag

SEQ ID NO: 7702 - DNA, 18 bp, Artificial Sequence
  Synthetic DNA
taatactactcattattg

SEQ ID NO: 7703 - DNA, 18 bp, Artificial Sequence
  Synthetic DNA
taattttactcactatag

SEQ ID NO: 7704 - DNA, 18 bp, Artificial Sequence
  Synthetic DNA
taaaacgtctcattatag

SEQ ID NO: 7705 - DNA, 18 bp, Artificial Sequence
  Synthetic DNA
taatacaactcaatattg

SEQ ID NO: 7706 - DNA, 18 bp, Artificial Sequence
  Synthetic DNA
taataggaatcacaatag

SEQ ID NO: 7707 - DNA, 18 bp, Artificial Sequence
  Synthetic DNA
taatacgactaaccattg

SEQ ID NO: 7708 - DNA, 18 bp, Artificial Sequence
  Synthetic DNA
taatacgtctcatgatag

SEQ ID NO: 7709 - DNA, 18 bp, Artificial Sequence
  Synthetic DNA
tattacgaataactatag

SEQ ID NO: 7710 - DNA, 18 bp, Artificial Sequence
  Synthetic DNA
aaatacgacacactagag

SEQ ID NO: 7711 - DNA, 18 bp, Artificial Sequence
  Synthetic DNA
aaatacgactcactatta

SEQ ID NO: 7712 - DNA, 18 bp, Artificial Sequence
  Synthetic DNA
aaatactactgactatag

SEQ ID NO: 7713 - DNA, 18 bp, Artificial Sequence
  Synthetic DNA
aaattcgactccctatag

SEQ ID NO: 7714 - DNA, 18 bp, Artificial Sequence
  Synthetic DNA
aattacggctcactatag

SEQ ID NO: 7715 - DNA, 18 bp, Artificial Sequence
  Synthetic DNA
caatacgactcacagtag

SEQ ID NO: 7716 - DNA, 18 bp, Artificial Sequence
  Synthetic DNA
taaaacgagtcaccatag

SEQ ID NO: 7717 - DNA, 18 bp, Artificial Sequence
  Synthetic DNA
taaagcgactcattatag

SEQ ID NO: 7718 - DNA, 18 bp, Artificial Sequence
  Synthetic DNA
taaatcgactccctatag

SEQ ID NO: 7719 - DNA, 18 bp, Artificial Sequence
  Synthetic DNA
taatacgaatctctagag

SEQ ID NO: 7720 - DNA, 18 bp, Artificial Sequence
  Synthetic DNA
taatacgactctcgattg

SEQ ID NO: 7721 - DNA, 18 bp, Artificial Sequence
  Synthetic DNA
taatacgacttacaatgg

SEQ ID NO: 7722 - DNA, 18 bp, Artificial Sequence
  Synthetic DNA
taatacgtcccgctatag

SEQ ID NO: 7723 - DNA, 18 bp, Artificial Sequence
  Synthetic DNA
taatacttctgactatag

SEQ ID NO: 7724 - DNA, 18 bp, Artificial Sequence
  Synthetic DNA
taataggactaactttag

SEQ ID NO: 7725 - DNA, 18 bp, Artificial Sequence
  Synthetic DNA
taattcgagttactatag

SEQ ID NO: 7726 - DNA, 18 bp, Artificial Sequence
  Synthetic DNA
tactaagtctcactatag

SEQ ID NO: 7727 - DNA, 18 bp, Artificial Sequence
  Synthetic DNA
tagtacgactagctatag

SEQ ID NO: 7728 - DNA, 18 bp, Artificial Sequence
  Synthetic DNA
tattaccactcaatatag

SEQ ID NO: 7729 - DNA, 18 bp, Artificial Sequence
  Synthetic DNA
tattacgagtcaatatag

SEQ ID NO: 7730 - DNA, 18 bp, Artificial Sequence
  Synthetic DNA
tgatacaactcactattg

SEQ ID NO: 7731 - DNA, 18 bp, Artificial Sequence
  Synthetic DNA
tgatacgactcgctttag

SEQ ID NO: 7732 - DNA, 18 bp, Artificial Sequence
  Synthetic DNA
tgttacgactcactacag

SEQ ID NO: 7733 - DNA, 18 bp, Artificial Sequence
  Synthetic DNA
ttataccacgcactatag

SEQ ID NO: 7734 - DNA, 18 bp, Artificial Sequence
  Synthetic DNA
ttgcacgactcactatag

SEQ ID NO: 7735 - DNA, 18 bp, Artificial Sequence
  Synthetic DNA
aaaaacgactcactatgg

SEQ ID NO: 7736 - DNA, 18 bp, Artificial Sequence
  Synthetic DNA
aaataagactcgctatag

SEQ ID NO: 7737 - DNA, 18 bp, Artificial Sequence
  Synthetic DNA
aaataccactgactatag

SEQ ID NO: 7738 - DNA, 18 bp, Artificial Sequence
  Synthetic DNA
aaataccagtcactatag

SEQ ID NO: 7739 - DNA, 18 bp, Artificial Sequence
  Synthetic DNA
aaatacgacccacgatag

SEQ ID NO: 7740 - DNA, 18 bp, Artificial Sequence
  Synthetic DNA
aaatacgacgcactattg

SEQ ID NO: 7741 - DNA, 18 bp, Artificial Sequence
  Synthetic DNA
aaatacgactcactgtac

SEQ ID NO: 7742 - DNA, 18 bp, Artificial Sequence
  Synthetic DNA
aaatacgattcactagag

SEQ ID NO: 7743 - DNA, 18 bp, Artificial Sequence
  Synthetic DNA
aactacgactcactatcg

SEQ ID NO: 7744 - DNA, 18 bp, Artificial Sequence
  Synthetic DNA
aactacgactccctatag

SEQ ID NO: 7745 - DNA, 18 bp, Artificial Sequence
  Synthetic DNA
caataagacttactatag

SEQ ID NO: 7746 - DNA, 18 bp, Artificial Sequence
  Synthetic DNA
caataccactcactattg

SEQ ID NO: 7747 - DNA, 18 bp, Artificial Sequence
  Synthetic DNA
caatacgactcatcatag

SEQ ID NO: 7748 - DNA, 18 bp, Artificial Sequence
  Synthetic DNA
cagtacgactctctatag

SEQ ID NO: 7749 - DNA, 18 bp, Artificial Sequence
  Synthetic DNA
cattacgcctcactatag

SEQ ID NO: 7750 - DNA, 18 bp, Artificial Sequence
  Synthetic DNA
ccatacgactcactagag

SEQ ID NO: 7751 - DNA, 18 bp, Artificial Sequence
  Synthetic DNA
gaatactactcactattg

SEQ ID NO: 7752 - DNA, 18 bp, Artificial Sequence
  Synthetic DNA
gaattcgactaactatag

SEQ ID NO: 7753 - DNA, 18 bp, Artificial Sequence
  Synthetic DNA
taaaacgactgactacag

SEQ ID NO: 7754 - DNA, 18 bp, Artificial Sequence
  Synthetic DNA
taaaccgactccctatag

SEQ ID NO: 7755 - DNA, 18 bp, Artificial Sequence
  Synthetic DNA
taacacgacgcacaatag

SEQ ID NO: 7756 - DNA, 18 bp, Artificial Sequence
  Synthetic DNA
taacacgactcagtatgg

SEQ ID NO: 7757 - DNA, 18 bp, Artificial Sequence
  Synthetic DNA
taagactactgactatag

SEQ ID NO: 7758 - DNA, 18 bp, Artificial Sequence
  Synthetic DNA
taaggcgactcacaatag

SEQ ID NO: 7759 - DNA, 18 bp, Artificial Sequence
  Synthetic DNA
taataagaatcactagag

SEQ ID NO: 7760 - DNA, 18 bp, Artificial Sequence
  Synthetic DNA
taatacgaatcacgagag

SEQ ID NO: 7761 - DNA, 18 bp, Artificial Sequence
  Synthetic DNA
taatacgacaaactgtag

SEQ ID NO: 7762 - DNA, 18 bp, Artificial Sequence
  Synthetic DNA
taatacgaccctctacag

SEQ ID NO: 7763 - DNA, 18 bp, Artificial Sequence
  Synthetic DNA
taatacgacctaatatag

SEQ ID NO: 7764 - DNA, 18 bp, Artificial Sequence
  Synthetic DNA
taatacgactctcgacag

SEQ ID NO: 7765 - DNA, 18 bp, Artificial Sequence
  Synthetic DNA
taatacgactgaatgtag

SEQ ID NO: 7766 - DNA, 18 bp, Artificial Sequence
  Synthetic DNA
taatacgagtcattatcg

SEQ ID NO: 7767 - DNA, 18 bp, Artificial Sequence
  Synthetic DNA
taatacgattcaatagag

SEQ ID NO: 7768 - DNA, 18 bp, Artificial Sequence
  Synthetic DNA
taatacgattgaatatag

SEQ ID NO: 7769 - DNA, 18 bp, Artificial Sequence
  Synthetic DNA
taatacgccccactacag

SEQ ID NO: 7770 - DNA, 18 bp, Artificial Sequence
  Synthetic DNA
taatacgccccactgtag

SEQ ID NO: 7771 - DNA, 18 bp, Artificial Sequence
  Synthetic DNA
taatacgcctcattagag

SEQ ID NO: 7772 - DNA, 18 bp, Artificial Sequence
  Synthetic DNA
taatacggcccacaatag

SEQ ID NO: 7773 - DNA, 18 bp, Artificial Sequence
  Synthetic DNA
taatactaatccctatag

SEQ ID NO: 7774 - DNA, 18 bp, Artificial Sequence
  Synthetic DNA
taatactactcactgtcg

SEQ ID NO: 7775 - DNA, 18 bp, Artificial Sequence
  Synthetic DNA
taatatgcctcaccatag

SEQ ID NO: 7776 - DNA, 18 bp, Artificial Sequence
  Synthetic DNA
taatccgaattactatag

SEQ ID NO: 7777 - DNA, 18 bp, Artificial Sequence
  Synthetic DNA
taatccgactgactattg

SEQ ID NO: 7778 - DNA, 18 bp, Artificial Sequence
  Synthetic DNA
taatgcgactcagtacag

SEQ ID NO: 7779 - DNA, 18 bp, Artificial Sequence
  Synthetic DNA
taatgcgagtcacgatag

SEQ ID NO: 7780 - DNA, 18 bp, Artificial Sequence
  Synthetic DNA
taattcggctcactgtag

SEQ ID NO: 7781 - DNA, 18 bp, Artificial Sequence
  Synthetic DNA
tacaacgacccactatag

SEQ ID NO: 7782 - DNA, 18 bp, Artificial Sequence
  Synthetic DNA
tactacgacccactattg

SEQ ID NO: 7783 - DNA, 18 bp, Artificial Sequence
  Synthetic DNA
tactacgactcaccttag

SEQ ID NO: 7784 - DNA, 18 bp, Artificial Sequence
  Synthetic DNA
tactaggactcactattg

SEQ ID NO: 7785 - DNA, 18 bp, Artificial Sequence
  Synthetic DNA
tactgcgacttactatag

SEQ ID NO: 7786 - DNA, 18 bp, Artificial Sequence
  Synthetic DNA
tagtacgactcagaatag

SEQ ID NO: 7787 - DNA, 18 bp, Artificial Sequence
  Synthetic DNA
tagtacgactcgcaatag

SEQ ID NO: 7788 - DNA, 18 bp, Artificial Sequence
  Synthetic DNA
tattacgacgcactatgg

SEQ ID NO: 7789 - DNA, 18 bp, Artificial Sequence
  Synthetic DNA
tattacgactcaccatgg

SEQ ID NO: 7790 - DNA, 18 bp, Artificial Sequence
  Synthetic DNA
tcatacaagtcactatag

SEQ ID NO: 7791 - DNA, 18 bp, Artificial Sequence
  Synthetic DNA
tcatacgattgactatag

SEQ ID NO: 7792 - DNA, 18 bp, Artificial Sequence
  Synthetic DNA
tcatacgtctcactagag

SEQ ID NO: 7793 - DNA, 18 bp, Artificial Sequence
  Synthetic DNA
tcttccgactcactatag

SEQ ID NO: 7794 - DNA, 18 bp, Artificial Sequence
  Synthetic DNA
tgatacgactccctttag

SEQ ID NO: 7795 - DNA, 18 bp, Artificial Sequence
  Synthetic DNA
tggtacgactcactaaag

SEQ ID NO: 7796 - DNA, 18 bp, Artificial Sequence
  Synthetic DNA
ttctacgactcagtatag

SEQ ID NO: 7797 - DNA, 18 bp, Artificial Sequence
  Synthetic DNA
taataagactctctttag

SEQ ID NO: 7798 - DNA, 18 bp, Artificial Sequence
  Synthetic DNA
taaattgactcactatag

SEQ ID NO: 7799 - DNA, 18 bp, Artificial Sequence
  Synthetic DNA
taaaacgacacactttag

SEQ ID NO: 7800 - DNA, 18 bp, Artificial Sequence
  Synthetic DNA
taattcaactctctatag

SEQ ID NO: 7801 - DNA, 18 bp, Artificial Sequence
  Synthetic DNA
ttctacgactcactaaag

SEQ ID NO: 7802 - DNA, 18 bp, Artificial Sequence
  Synthetic DNA
caatacgactcaatttag

SEQ ID NO: 7803 - DNA, 18 bp, Artificial Sequence
  Synthetic DNA
caatacgtatcactatag

SEQ ID NO: 7804 - DNA, 18 bp, Artificial Sequence
  Synthetic DNA
taatacggctctcaatag

SEQ ID NO: 7805 - DNA, 18 bp, Artificial Sequence
  Synthetic DNA
ttaaatgactcactatag

SEQ ID NO: 7806 - DNA, 18 bp, Artificial Sequence
  Synthetic DNA
taatgcgtctctctatag

SEQ ID NO: 7807 - DNA, 18 bp, Artificial Sequence
  Synthetic DNA
acaaacgactcactatag

SEQ ID NO: 7808 - DNA, 18 bp, Artificial Sequence
  Synthetic DNA
tattatgactcactatcg

SEQ ID NO: 7809 - DNA, 18 bp, Artificial Sequence
  Synthetic DNA
ttatacgactatctatag

SEQ ID NO: 7810 - DNA, 18 bp, Artificial Sequence
  Synthetic DNA
taatacgaatcacttttg

SEQ ID NO: 7811 - DNA, 18 bp, Artificial Sequence
  Synthetic DNA
tattatgtctcactatag

SEQ ID NO: 7812 - DNA, 18 bp, Artificial Sequence
  Synthetic DNA
taaaactagtcactatag

SEQ ID NO: 7813 - DNA, 18 bp, Artificial Sequence
  Synthetic DNA
taataccacaccctatag

SEQ ID NO: 7814 - DNA, 18 bp, Artificial Sequence
  Synthetic DNA
taatacgaatcaaaatag

SEQ ID NO: 7815 - DNA, 18 bp, Artificial Sequence
  Synthetic DNA
taatacgacacactttgg

SEQ ID NO: 7816 - DNA, 18 bp, Artificial Sequence
  Synthetic DNA
tactacgactcagtattg

SEQ ID NO: 7817 - DNA, 18 bp, Artificial Sequence
  Synthetic DNA
ttatacgactcacgttag

SEQ ID NO: 7818 - DNA, 18 bp, Artificial Sequence
  Synthetic DNA
taataatactctctatag

SEQ ID NO: 7819 - DNA, 18 bp, Artificial Sequence
  Synthetic DNA
ttatacgtctcaatatag

SEQ ID NO: 7820 - DNA, 18 bp, Artificial Sequence
  Synthetic DNA
taatacgactctttttag

SEQ ID NO: 7821 - DNA, 18 bp, Artificial Sequence
  Synthetic DNA
taatacgactaacaaaag

SEQ ID NO: 7822 - DNA, 18 bp, Artificial Sequence
  Synthetic DNA
caatacgacttactattg

SEQ ID NO: 7823 - DNA, 18 bp, Artificial Sequence
  Synthetic DNA
taataatactcacaatag

SEQ ID NO: 7824 - DNA, 18 bp, Artificial Sequence
  Synthetic DNA
taatacgaaatactatag

SEQ ID NO: 7825 - DNA, 18 bp, Artificial Sequence
  Synthetic DNA
taatacgagtctctttag

SEQ ID NO: 7826 - DNA, 18 bp, Artificial Sequence
  Synthetic DNA
tagaacgactcactaaag

SEQ ID NO: 7827 - DNA, 18 bp, Artificial Sequence
  Synthetic DNA
tattccgattcactatag

SEQ ID NO: 7828 - DNA, 18 bp, Artificial Sequence
  Synthetic DNA
ttaaacgacccactatag

SEQ ID NO: 7829 - DNA, 18 bp, Artificial Sequence
  Synthetic DNA
ttatacaactcactagag

SEQ ID NO: 7830 - DNA, 18 bp, Artificial Sequence
  Synthetic DNA
aaatacgattccctatag

SEQ ID NO: 7831 - DNA, 18 bp, Artificial Sequence
  Synthetic DNA
aaatacgattgactatag

SEQ ID NO: 7832 - DNA, 18 bp, Artificial Sequence
  Synthetic DNA
caatcagactcactatag

SEQ ID NO: 7833 - DNA, 18 bp, Artificial Sequence
  Synthetic DNA
taacacgactcagtattg

SEQ ID NO: 7834 - DNA, 18 bp, Artificial Sequence
  Synthetic DNA
taataagaatcactgtag

SEQ ID NO: 7835 - DNA, 18 bp, Artificial Sequence
  Synthetic DNA
taataagaccctctatag

SEQ ID NO: 7836 - DNA, 18 bp, Artificial Sequence
  Synthetic DNA
taatacgactcaatctgg

SEQ ID NO: 7837 - DNA, 18 bp, Artificial Sequence
  Synthetic DNA
taatacgactcatgattg

SEQ ID NO: 7838 - DNA, 18 bp, Artificial Sequence
  Synthetic DNA
taatacgatgcactaaag

SEQ ID NO: 7839 - DNA, 18 bp, Artificial Sequence
  Synthetic DNA
taatacggttcactctag

SEQ ID NO: 7840 - DNA, 18 bp, Artificial Sequence
  Synthetic DNA
taatgccactcactttag

SEQ ID NO: 7841 - DNA, 18 bp, Artificial Sequence
  Synthetic DNA
taatgcgacttactatcg

SEQ ID NO: 7842 - DNA, 18 bp, Artificial Sequence
  Synthetic DNA
taattcgacacacgatag

SEQ ID NO: 7843 - DNA, 18 bp, Artificial Sequence
  Synthetic DNA
taattcgactaactatgg

SEQ ID NO: 7844 - DNA, 18 bp, Artificial Sequence
  Synthetic DNA
taattcgactcattctag

SEQ ID NO: 7845 - DNA, 18 bp, Artificial Sequence
  Synthetic DNA
tagtacgactatctatag

SEQ ID NO: 7846 - DNA, 18 bp, Artificial Sequence
  Synthetic DNA
tattacaagtcactatag

SEQ ID NO: 7847 - DNA, 18 bp, Artificial Sequence
  Synthetic DNA
tattacgatgcactatag

SEQ ID NO: 7848 - DNA, 18 bp, Artificial Sequence
  Synthetic DNA
tatttcgacgcactatag

SEQ ID NO: 7849 - DNA, 18 bp, Artificial Sequence
  Synthetic DNA
tcaaacgactcactacag

SEQ ID NO: 7850 - DNA, 18 bp, Artificial Sequence
  Synthetic DNA
tccttcgactcactatag

SEQ ID NO: 7851 - DNA, 18 bp, Artificial Sequence
  Synthetic DNA
aaatatgactcattatag

SEQ ID NO: 7852 - DNA, 18 bp, Artificial Sequence
  Synthetic DNA
taaaacaactctctatag

SEQ ID NO: 7853 - DNA, 18 bp, Artificial Sequence
  Synthetic DNA
tagtacgactctctaaag

SEQ ID NO: 7854 - DNA, 18 bp, Artificial Sequence
  Synthetic DNA
tcatttgactcactatag

SEQ ID NO: 7855 - DNA, 18 bp, Artificial Sequence
  Synthetic DNA
taatacgcctctctattg

SEQ ID NO: 7856 - DNA, 18 bp, Artificial Sequence
  Synthetic DNA
aattacgactcactctag

SEQ ID NO: 7857 - DNA, 18 bp, Artificial Sequence
  Synthetic DNA
caatacaactcactaaag

SEQ ID NO: 7858 - DNA, 18 bp, Artificial Sequence
  Synthetic DNA
taataagattcactgtag

SEQ ID NO: 7859 - DNA, 18 bp, Artificial Sequence
  Synthetic DNA
taatacaacacgctatag

SEQ ID NO: 7860 - DNA, 18 bp, Artificial Sequence
  Synthetic DNA
taatacgaatctctatcg

SEQ ID NO: 7861 - DNA, 18 bp, Artificial Sequence
  Synthetic DNA
taatacgactcagtaagg

SEQ ID NO: 7862 - DNA, 18 bp, Artificial Sequence
  Synthetic DNA
taatacgatccactttag

SEQ ID NO: 7863 - DNA, 18 bp, Artificial Sequence
  Synthetic DNA
tacaatgactcactatag

SEQ ID NO: 7864 - DNA, 18 bp, Artificial Sequence
  Synthetic DNA
tactccgtctcactatag

SEQ ID NO: 7865 - DNA, 18 bp, Artificial Sequence
  Synthetic DNA
tattacaactccctatag

SEQ ID NO: 7866 - DNA, 18 bp, Artificial Sequence
  Synthetic DNA
tccaacgactcactatag

SEQ ID NO: 7867 - DNA, 18 bp, Artificial Sequence
  Synthetic DNA
taattcgacacacaatag

SEQ ID NO: 7868 - DNA, 18 bp, Artificial Sequence
  Synthetic DNA
taattcgtctcacaatag

SEQ ID NO: 7869 - DNA, 18 bp, Artificial Sequence
  Synthetic DNA
taatacgacttattttag

SEQ ID NO: 7870 - DNA, 18 bp, Artificial Sequence
  Synthetic DNA
aaatacgactcaccttag

SEQ ID NO: 7871 - DNA, 18 bp, Artificial Sequence
  Synthetic DNA
aaatactactcaatatag

SEQ ID NO: 7872 - DNA, 18 bp, Artificial Sequence
  Synthetic DNA
taatgcgacacactattg

SEQ ID NO: 7873 - DNA, 18 bp, Artificial Sequence
  Synthetic DNA
taattcgactaaatatag

SEQ ID NO: 7874 - DNA, 18 bp, Artificial Sequence
  Synthetic DNA
tcaaacgtctcactatag

SEQ ID NO: 7875 - DNA, 18 bp, Artificial Sequence
  Synthetic DNA
taataccactcacaattg

SEQ ID NO: 7876 - DNA, 18 bp, Artificial Sequence
  Synthetic DNA
taatactcctcacaatag

SEQ ID NO: 7877 - DNA, 18 bp, Artificial Sequence
  Synthetic DNA
tattacgactccttatag

SEQ ID NO: 7878 - DNA, 18 bp, Artificial Sequence
  Synthetic DNA
taattctactctctatag

SEQ ID NO: 7879 - DNA, 18 bp, Artificial Sequence
  Synthetic DNA
ttatacgtctcacaatag

SEQ ID NO: 7880 - DNA, 18 bp, Artificial Sequence
  Synthetic DNA
taatacgacacactgaag

SEQ ID NO: 7881 - DNA, 18 bp, Artificial Sequence
  Synthetic DNA
taattcgactcaatttag

SEQ ID NO: 7882 - DNA, 18 bp, Artificial Sequence
  Synthetic DNA
taattcaactcattatag

SEQ ID NO: 7883 - DNA, 18 bp, Artificial Sequence
  Synthetic DNA
aaattagactcactatag

SEQ ID NO: 7884 - DNA, 18 bp, Artificial Sequence
  Synthetic DNA
tattaagactctctatag

SEQ ID NO: 7885 - DNA, 18 bp, Artificial Sequence
  Synthetic DNA
taatacgtctcattttag

SEQ ID NO: 7886 - DNA, 18 bp, Artificial Sequence
  Synthetic DNA
tattattactcactatag

SEQ ID NO: 7887 - DNA, 18 bp, Artificial Sequence
  Synthetic DNA
ttataagtctcactatag

SEQ ID NO: 7888 - DNA, 18 bp, Artificial Sequence
  Synthetic DNA
taatactattcactttag

SEQ ID NO: 7889 - DNA, 18 bp, Artificial Sequence
  Synthetic DNA
caatacgactctctatcg

SEQ ID NO: 7890 - DNA, 18 bp, Artificial Sequence
  Synthetic DNA
caatatgactcactttag

SEQ ID NO: 7891 - DNA, 18 bp, Artificial Sequence
  Synthetic DNA
taatacgacacaatatcg

SEQ ID NO: 7892 - DNA, 18 bp, Artificial Sequence
  Synthetic DNA
taatacgactcattcttg

SEQ ID NO: 7893 - DNA, 18 bp, Artificial Sequence
  Synthetic DNA
taatgcaactaactatag

SEQ ID NO: 7894 - DNA, 18 bp, Artificial Sequence
  Synthetic DNA
taattcgactcacaacag

SEQ ID NO: 7895 - DNA, 18 bp, Artificial Sequence
  Synthetic DNA
tagtacgtatcactatag

SEQ ID NO: 7896 - DNA, 18 bp, Artificial Sequence
  Synthetic DNA
tattccgactaactatag

SEQ ID NO: 7897 - DNA, 18 bp, Artificial Sequence
  Synthetic DNA
ttgtactactcactatag

SEQ ID NO: 7898 - DNA, 18 bp, Artificial Sequence
  Synthetic DNA
taaaacgattctctatag

SEQ ID NO: 7899 - DNA, 18 bp, Artificial Sequence
  Synthetic DNA
taataagacacactattg

SEQ ID NO: 7900 - DNA, 18 bp, Artificial Sequence
  Synthetic DNA
taacaagactcactattg

SEQ ID NO: 7901 - DNA, 18 bp, Artificial Sequence
  Synthetic DNA
taattcgaatcattatag

SEQ ID NO: 7902 - DNA, 18 bp, Artificial Sequence
  Synthetic DNA
tattacgactcactatta

SEQ ID NO: 7903 - DNA, 18 bp, Artificial Sequence
  Synthetic DNA
ttataccactcaatatag

SEQ ID NO: 7904 - DNA, 18 bp, Artificial Sequence
  Synthetic DNA
taaaacgaatcaatatag

SEQ ID NO: 7905 - DNA, 18 bp, Artificial Sequence
  Synthetic DNA
taatacgactctgtttag

SEQ ID NO: 7906 - DNA, 18 bp, Artificial Sequence
  Synthetic DNA
aaatacgacccattatag

SEQ ID NO: 7907 - DNA, 18 bp, Artificial Sequence
  Synthetic DNA
aaatacgactcagaatag

SEQ ID NO: 7908 - DNA, 18 bp, Artificial Sequence
  Synthetic DNA
aagtacgactcactacag

SEQ ID NO: 7909 - DNA, 18 bp, Artificial Sequence
  Synthetic DNA
caatacgtctcgctatag

SEQ ID NO: 7910 - DNA, 18 bp, Artificial Sequence
  Synthetic DNA
taaaacgccacactatag

SEQ ID NO: 7911 - DNA, 18 bp, Artificial Sequence
  Synthetic DNA
taacactacccactatag

SEQ ID NO: 7912 - DNA, 18 bp, Artificial Sequence
  Synthetic DNA
taataagacccactattg

SEQ ID NO: 7913 - DNA, 18 bp, Artificial Sequence
  Synthetic DNA
taataccacacactacag

SEQ ID NO: 7914 - DNA, 18 bp, Artificial Sequence
  Synthetic DNA
taatacgaaacactacag

SEQ ID NO: 7915 - DNA, 18 bp, Artificial Sequence
  Synthetic DNA
taatacgactcaaactag

SEQ ID NO: 7916 - DNA, 18 bp, Artificial Sequence
  Synthetic DNA
taatacgattcattagag

SEQ ID NO: 7917 - DNA, 18 bp, Artificial Sequence
  Synthetic DNA
taatacgattccctctag

SEQ ID NO: 7918 - DNA, 18 bp, Artificial Sequence
  Synthetic DNA
taatccgaatcactaaag

SEQ ID NO: 7919 - DNA, 18 bp, Artificial Sequence
  Synthetic DNA
taatgcgaatcaatatag

SEQ ID NO: 7920 - DNA, 18 bp, Artificial Sequence
  Synthetic DNA
taattcgacttagtatag

SEQ ID NO: 7921 - DNA, 18 bp, Artificial Sequence
  Synthetic DNA
taattcgtctcactatgg

SEQ ID NO: 7922 - DNA, 18 bp, Artificial Sequence
  Synthetic DNA
tactacgcctctctatag

SEQ ID NO: 7923 - DNA, 18 bp, Artificial Sequence
  Synthetic DNA
tactaggacttactatag

SEQ ID NO: 7924 - DNA, 18 bp, Artificial Sequence
  Synthetic DNA
tattacgcctccctatag

SEQ ID NO: 7925 - DNA, 18 bp, Artificial Sequence
  Synthetic DNA
tcatacgactccctaaag

SEQ ID NO: 7926 - DNA, 18 bp, Artificial Sequence
  Synthetic DNA
aaacacgactcactatcg

SEQ ID NO: 7927 - DNA, 18 bp, Artificial Sequence
  Synthetic DNA
aaagaggactcactatag

SEQ ID NO: 7928 - DNA, 18 bp, Artificial Sequence
  Synthetic DNA
aaatacgactgagtatag

SEQ ID NO: 7929 - DNA, 18 bp, Artificial Sequence
  Synthetic DNA
aaatacggcacactatag

SEQ ID NO: 7930 - DNA, 18 bp, Artificial Sequence
  Synthetic DNA
aaatcggactcactatag

SEQ ID NO: 7931 - DNA, 18 bp, Artificial Sequence
  Synthetic DNA
caataagaatcactatag

SEQ ID NO: 7932 - DNA, 18 bp, Artificial Sequence
  Synthetic DNA
caatacgacacactacag

SEQ ID NO: 7933 - DNA, 18 bp, Artificial Sequence
  Synthetic DNA
caatacgacccactttag

SEQ ID NO: 7934 - DNA, 18 bp, Artificial Sequence
  Synthetic DNA
caatacgactaaccatag

SEQ ID NO: 7935 - DNA, 18 bp, Artificial Sequence
  Synthetic DNA
ccatacgactaactatag

SEQ ID NO: 7936 - DNA, 18 bp, Artificial Sequence
  Synthetic DNA
gaaaccgactcactatag

SEQ ID NO: 7937 - DNA, 18 bp, Artificial Sequence
  Synthetic DNA
gaatacgattcacaatag

SEQ ID NO: 7938 - DNA, 18 bp, Artificial Sequence
  Synthetic DNA
gaatacgtctcacaatag

SEQ ID NO: 7939 - DNA, 18 bp, Artificial Sequence
  Synthetic DNA
ggatacgactcaatatag

SEQ ID NO: 7940 - DNA, 18 bp, Artificial Sequence
  Synthetic DNA
taaaacgactcaatatcg

SEQ ID NO: 7941 - DNA, 18 bp, Artificial Sequence
  Synthetic DNA
taacaagaatcactatag

SEQ ID NO: 7942 - DNA, 18 bp, Artificial Sequence
  Synthetic DNA
taacacgactcaatctag

SEQ ID NO: 7943 - DNA, 18 bp, Artificial Sequence
  Synthetic DNA
taacacggctcacaatag

SEQ ID NO: 7944 - DNA, 18 bp, Artificial Sequence
  Synthetic DNA
taacacggctcactacag

SEQ ID NO: 7945 - DNA, 18 bp, Artificial Sequence
  Synthetic DNA
taagacgactcaccattg

SEQ ID NO: 7946 - DNA, 18 bp, Artificial Sequence
  Synthetic DNA
taataacgctcactatag

SEQ ID NO: 7947 - DNA, 18 bp, Artificial Sequence
  Synthetic DNA
taataagactcaacatag

SEQ ID NO: 7948 - DNA, 18 bp, Artificial Sequence
  Synthetic DNA
taataagactctctagag

SEQ ID NO: 7949 - DNA, 18 bp, Artificial Sequence
  Synthetic DNA
taataccagttactatag

SEQ ID NO: 7950 - DNA, 18 bp, Artificial Sequence
  Synthetic DNA
taatacgacccgctatcg

SEQ ID NO: 7951 - DNA, 18 bp, Artificial Sequence
  Synthetic DNA
taatacgacgcattaaag

SEQ ID NO: 7952 - DNA, 18 bp, Artificial Sequence
  Synthetic DNA
taatacgactcacacgag

SEQ ID NO: 7953 - DNA, 18 bp, Artificial Sequence
  Synthetic DNA
taatacgactcattctgg

SEQ ID NO: 7954 - DNA, 18 bp, Artificial Sequence
  Synthetic DNA
taatacgactccatagag

SEQ ID NO: 7955 - DNA, 18 bp, Artificial Sequence
  Synthetic DNA
taatacgagccactgtag

SEQ ID NO: 7956 - DNA, 18 bp, Artificial Sequence
  Synthetic DNA
taatacgattcacgattg

SEQ ID NO: 7957 - DNA, 18 bp, Artificial Sequence
  Synthetic DNA
taatacgattcactgtcg

SEQ ID NO: 7958 - DNA, 18 bp, Artificial Sequence
  Synthetic DNA
taatacgattccgtatag

SEQ ID NO: 7959 - DNA, 18 bp, Artificial Sequence
  Synthetic DNA
taatacgccacagtatag

SEQ ID NO: 7960 - DNA, 18 bp, Artificial Sequence
  Synthetic DNA
taatactgctcactagag

SEQ ID NO: 7961 - DNA, 18 bp, Artificial Sequence
  Synthetic DNA
taatagaacttactatag

SEQ ID NO: 7962 - DNA, 18 bp, Artificial Sequence
  Synthetic DNA
taataggactcaacatag

SEQ ID NO: 7963 - DNA, 18 bp, Artificial Sequence
  Synthetic DNA
taataggacttactatcg

SEQ ID NO: 7964 - DNA, 18 bp, Artificial Sequence
  Synthetic DNA
taatatgacacactagag

SEQ ID NO: 7965 - DNA, 18 bp, Artificial Sequence
  Synthetic DNA
taatatgactcatgatag

SEQ ID NO: 7966 - DNA, 18 bp, Artificial Sequence
  Synthetic DNA
taatatgcctccctatag

SEQ ID NO: 7967 - DNA, 18 bp, Artificial Sequence
  Synthetic DNA
taatatggctcaccatag

SEQ ID NO: 7968 - DNA, 18 bp, Artificial Sequence
  Synthetic DNA
taatccgaatcactgtag

SEQ ID NO: 7969 - DNA, 18 bp, Artificial Sequence
  Synthetic DNA
taatccgactgaatatag

SEQ ID NO: 7970 - DNA, 18 bp, Artificial Sequence
  Synthetic DNA
taatgcacctcactatag

SEQ ID NO: 7971 - DNA, 18 bp, Artificial Sequence
  Synthetic DNA
taatgcgacccgctatag

SEQ ID NO: 7972 - DNA, 18 bp, Artificial Sequence
  Synthetic DNA
taatgcgactgactaaag

SEQ ID NO: 7973 - DNA, 18 bp, Artificial Sequence
  Synthetic DNA
taatgcgagtcactgtag

SEQ ID NO: 7974 - DNA, 18 bp, Artificial Sequence
  Synthetic DNA
taattcaactcacgatag

SEQ ID NO: 7975 - DNA, 18 bp, Artificial Sequence
  Synthetic DNA
taattcgactaactagag

SEQ ID NO: 7976 - DNA, 18 bp, Artificial Sequence
  Synthetic DNA
tactacgacacactacag

SEQ ID NO: 7977 - DNA, 18 bp, Artificial Sequence
  Synthetic DNA
tactacgacccactacag

SEQ ID NO: 7978 - DNA, 18 bp, Artificial Sequence
  Synthetic DNA
tactacgacgcactaaag

SEQ ID NO: 7979 - DNA, 18 bp, Artificial Sequence
  Synthetic DNA
tactacgattcactgtag

SEQ ID NO: 7980 - DNA, 18 bp, Artificial Sequence
  Synthetic DNA
tagcacgactcactgtag

SEQ ID NO: 7981 - DNA, 18 bp, Artificial Sequence
  Synthetic DNA
taggacgactcactttag

SEQ ID NO: 7982 - DNA, 18 bp, Artificial Sequence
  Synthetic DNA
tagtaccactcagtatag

SEQ ID NO: 7983 - DNA, 18 bp, Artificial Sequence
  Synthetic DNA
tagtacgactaaatatag

SEQ ID NO: 7984 - DNA, 18 bp, Artificial Sequence
  Synthetic DNA
tagtacgactcacactag

SEQ ID NO: 7985 - DNA, 18 bp, Artificial Sequence
  Synthetic DNA
tagtacgacttactatcg

SEQ ID NO: 7986 - DNA, 18 bp, Artificial Sequence
  Synthetic DNA
tagtacgacttcctatag

SEQ ID NO: 7987 - DNA, 18 bp, Artificial Sequence
  Synthetic DNA
tagtacggatcactatag

SEQ ID NO: 7988 - DNA, 18 bp, Artificial Sequence
  Synthetic DNA
tcatacaactcactatcg

SEQ ID NO: 7989 - DNA, 18 bp, Artificial Sequence
  Synthetic DNA
tcatacgactaactatcg

SEQ ID NO: 7990 - DNA, 18 bp, Artificial Sequence
  Synthetic DNA
tcatacgcctcacaatag

SEQ ID NO: 7991 - DNA, 18 bp, Artificial Sequence
  Synthetic DNA
tcatactactcactatcg

SEQ ID NO: 7992 - DNA, 18 bp, Artificial Sequence
  Synthetic DNA
tcataggactcactttag

SEQ ID NO: 7993 - DNA, 18 bp, Artificial Sequence
  Synthetic DNA
tcctacgactcattatag

SEQ ID NO: 7994 - DNA, 18 bp, Artificial Sequence
  Synthetic DNA
tgatacaacgcactatag

SEQ ID NO: 7995 - DNA, 18 bp, Artificial Sequence
  Synthetic DNA
tgatacgacgcacaatag

SEQ ID NO: 7996 - DNA, 18 bp, Artificial Sequence
  Synthetic DNA
ttataagacgcactatag

SEQ ID NO: 7997 - DNA, 18 bp, Artificial Sequence
  Synthetic DNA
ttatacgacccactagag

SEQ ID NO: 7998 - DNA, 18 bp, Artificial Sequence
  Synthetic DNA
ttatacgactcacgctag

SEQ ID NO: 7999 - DNA, 18 bp, Artificial Sequence
  Synthetic DNA
taatacgacacactaatg

SEQ ID NO: 8000 - DNA, 18 bp, Artificial Sequence
  Synthetic DNA
taatatgtctcactttag

SEQ ID NO: 8001 - DNA, 18 bp, Artificial Sequence
  Synthetic DNA
ttatacaactcactattg

SEQ ID NO: 8002 - DNA, 18 bp, Artificial Sequence
  Synthetic DNA
tattccgactctctatag

SEQ ID NO: 8003 - DNA, 18 bp, Artificial Sequence
  Synthetic DNA
taatacatctcactattg

SEQ ID NO: 8004 - DNA, 18 bp, Artificial Sequence
  Synthetic DNA
caatacgactctcaatag

SEQ ID NO: 8005 - DNA, 18 bp, Artificial Sequence
  Synthetic DNA
tcatacgacacacaatag

SEQ ID NO: 8006 - DNA, 18 bp, Artificial Sequence
  Synthetic DNA
ttataccattcactatag

SEQ ID NO: 8007 - DNA, 18 bp, Artificial Sequence
  Synthetic DNA
taaaacgactctttatag

SEQ ID NO: 8008 - DNA, 18 bp, Artificial Sequence
  Synthetic DNA
taatacgatactctatag

SEQ ID NO: 8009 - DNA, 18 bp, Artificial Sequence
  Synthetic DNA
taaaaaaactcactatag

SEQ ID NO: 8010 - DNA, 18 bp, Artificial Sequence
  Synthetic DNA
tattaccacacactatag

SEQ ID NO: 8011 - DNA, 18 bp, Artificial Sequence
  Synthetic DNA
tattacgactcgcaatag

SEQ ID NO: 8012 - DNA, 18 bp, Artificial Sequence
  Synthetic DNA
tcatacgtcacactatag

SEQ ID NO: 8013 - DNA, 18 bp, Artificial Sequence
  Synthetic DNA
tgatacgtatcactatag

SEQ ID NO: 8014 - DNA, 18 bp, Artificial Sequence
  Synthetic DNA
ttattcgactgactatag

SEQ ID NO: 8015 - DNA, 18 bp, Artificial Sequence
  Synthetic DNA
aaatacgaattactatag

SEQ ID NO: 8016 - DNA, 18 bp, Artificial Sequence
  Synthetic DNA
taatacgacacagtattg

SEQ ID NO: 8017 - DNA, 18 bp, Artificial Sequence
  Synthetic DNA
taatacgagtaactaaag

SEQ ID NO: 8018 - DNA, 18 bp, Artificial Sequence
  Synthetic DNA
taatacgatgcactttag

SEQ ID NO: 8019 - DNA, 18 bp, Artificial Sequence
  Synthetic DNA
taatacgtctctctagag

SEQ ID NO: 8020 - DNA, 18 bp, Artificial Sequence
  Synthetic DNA
taattcgactgactattg

SEQ ID NO: 8021 - DNA, 18 bp, Artificial Sequence
  Synthetic DNA
taattcgattcgctatag

SEQ ID NO: 8022 - DNA, 18 bp, Artificial Sequence
  Synthetic DNA
taaaacgactctctatcg

SEQ ID NO: 8023 - DNA, 18 bp, Artificial Sequence
  Synthetic DNA
taactcgactcactttag

SEQ ID NO: 8024 - DNA, 18 bp, Artificial Sequence
  Synthetic DNA
taatacaactaacaatag

SEQ ID NO: 8025 - DNA, 18 bp, Artificial Sequence
  Synthetic DNA
taatactactcgctttag

SEQ ID NO: 8026 - DNA, 18 bp, Artificial Sequence
  Synthetic DNA
taattcgaatcactttag

SEQ ID NO: 8027 - DNA, 18 bp, Artificial Sequence
  Synthetic DNA
ttatacgagtcactattg

SEQ ID NO: 8028 - DNA, 18 bp, Artificial Sequence
  Synthetic DNA
tattactactcaccatag

SEQ ID NO: 8029 - DNA, 18 bp, Artificial Sequence
  Synthetic DNA
taattcgattcactttag

SEQ ID NO: 8030 - DNA, 18 bp, Artificial Sequence
  Synthetic DNA
tattacgactcattttag

SEQ ID NO: 8031 - DNA, 18 bp, Artificial Sequence
  Synthetic DNA
tattaccactcactttag

SEQ ID NO: 8032 - DNA, 18 bp, Artificial Sequence
  Synthetic DNA
tattacgattcactatcg

SEQ ID NO: 8033 - DNA, 18 bp, Artificial Sequence
  Synthetic DNA
taacacatctcactatag

SEQ ID NO: 8034 - DNA, 18 bp, Artificial Sequence
  Synthetic DNA
taatacatctcactgtag

SEQ ID NO: 8035 - DNA, 18 bp, Artificial Sequence
  Synthetic DNA
taatacgacacactaacg

SEQ ID NO: 8036 - DNA, 18 bp, Artificial Sequence
  Synthetic DNA
taatacgattcaccattg

SEQ ID NO: 8037 - DNA, 18 bp, Artificial Sequence
  Synthetic DNA
taaaaggactaactatag

SEQ ID NO: 8038 - DNA, 18 bp, Artificial Sequence
  Synthetic DNA
taaaaggagtcactatag

SEQ ID NO: 8039 - DNA, 18 bp, Artificial Sequence
  Synthetic DNA
taagaagactcactattg

SEQ ID NO: 8040 - DNA, 18 bp, Artificial Sequence
  Synthetic DNA
taatacacctcattatag

SEQ ID NO: 8041 - DNA, 18 bp, Artificial Sequence
  Synthetic DNA
taataccactaaatatag

SEQ ID NO: 8042 - DNA, 18 bp, Artificial Sequence
  Synthetic DNA
taatacgactgattttag

SEQ ID NO: 8043 - DNA, 18 bp, Artificial Sequence
  Synthetic DNA
taatacgtttgactatag

SEQ ID NO: 8044 - DNA, 18 bp, Artificial Sequence
  Synthetic DNA
taatactaatcactgtag

SEQ ID NO: 8045 - DNA, 18 bp, Artificial Sequence
  Synthetic DNA
taatactactgaatatag

SEQ ID NO: 8046 - DNA, 18 bp, Artificial Sequence
  Synthetic DNA
taatccgactccatatag

SEQ ID NO: 8047 - DNA, 18 bp, Artificial Sequence
  Synthetic DNA
taatccgtctgactatag

SEQ ID NO: 8048 - DNA, 18 bp, Artificial Sequence
  Synthetic DNA
taattcgaatcagtatag

SEQ ID NO: 8049 - DNA, 18 bp, Artificial Sequence
  Synthetic DNA
tattactactcacgatag

SEQ ID NO: 8050 - DNA, 18 bp, Artificial Sequence
  Synthetic DNA
tcatacgactcacgctag

SEQ ID NO: 8051 - DNA, 18 bp, Artificial Sequence
  Synthetic DNA
tcatacgactcactttgg

SEQ ID NO: 8052 - DNA, 18 bp, Artificial Sequence
  Synthetic DNA
tgatacaactcactacag

SEQ ID NO: 8053 - DNA, 18 bp, Artificial Sequence
  Synthetic DNA
taattcgactcacaattg

SEQ ID NO: 8054 - DNA, 18 bp, Artificial Sequence
  Synthetic DNA
ttatacgtatcactatag

SEQ ID NO: 8055 - DNA, 18 bp, Artificial Sequence
  Synthetic DNA
taaaccgtctcactatag

SEQ ID NO: 8056 - DNA, 18 bp, Artificial Sequence
  Synthetic DNA
taatatgaataactatag

SEQ ID NO: 8057 - DNA, 18 bp, Artificial Sequence
  Synthetic DNA
aaatacgactctctatcg

SEQ ID NO: 8058 - DNA, 18 bp, Artificial Sequence
  Synthetic DNA
taatacgactctccacag

SEQ ID NO: 8059 - DNA, 18 bp, Artificial Sequence
  Synthetic DNA
taatacgattcactttcg

SEQ ID NO: 8060 - DNA, 18 bp, Artificial Sequence
  Synthetic DNA
taatacttctcactatgg

SEQ ID NO: 8061 - DNA, 18 bp, Artificial Sequence
  Synthetic DNA
taatcagactcactttag

SEQ ID NO: 8062 - DNA, 18 bp, Artificial Sequence
  Synthetic DNA
taattcgactcaccatgg

SEQ ID NO: 8063 - DNA, 18 bp, Artificial Sequence
  Synthetic DNA
taccacgactcactattg

SEQ ID NO: 8064 - DNA, 18 bp, Artificial Sequence
  Synthetic DNA
tactacgtctaactatag

SEQ ID NO: 8065 - DNA, 18 bp, Artificial Sequence
  Synthetic DNA
taatacgactatctttag

SEQ ID NO: 8066 - DNA, 18 bp, Artificial Sequence
  Synthetic DNA
atattcgactcactatag

SEQ ID NO: 8067 - DNA, 18 bp, Artificial Sequence
  Synthetic DNA
taatacgactttcaatag

SEQ ID NO: 8068 - DNA, 18 bp, Artificial Sequence
  Synthetic DNA
taatacgactagctaaag

SEQ ID NO: 8069 - DNA, 18 bp, Artificial Sequence
  Synthetic DNA
tactaagactcactttag

SEQ ID NO: 8070 - DNA, 18 bp, Artificial Sequence
  Synthetic DNA
tactacgactaacaatag

SEQ ID NO: 8071 - DNA, 18 bp, Artificial Sequence
  Synthetic DNA
tactacgattcactattg

SEQ ID NO: 8072 - DNA, 18 bp, Artificial Sequence
  Synthetic DNA
ttatactactcactgtag

SEQ ID NO: 8073 - DNA, 18 bp, Artificial Sequence
  Synthetic DNA
tactacaactctctatag

SEQ ID NO: 8074 - DNA, 18 bp, Artificial Sequence
  Synthetic DNA
ttatacgactcagaatag

SEQ ID NO: 8075 - DNA, 18 bp, Artificial Sequence
  Synthetic DNA
aaatactactcattatag

SEQ ID NO: 8076 - DNA, 18 bp, Artificial Sequence
  Synthetic DNA
taatacgaatcattaaag

SEQ ID NO: 8077 - DNA, 18 bp, Artificial Sequence
  Synthetic DNA
taatacgaattactttag

SEQ ID NO: 8078 - DNA, 18 bp, Artificial Sequence
  Synthetic DNA
taattcaaatcactatag

SEQ ID NO: 8079 - DNA, 18 bp, Artificial Sequence
  Synthetic DNA
tattacgatttactatag

SEQ ID NO: 8080 - DNA, 18 bp, Artificial Sequence
  Synthetic DNA
cattactactcactatag

SEQ ID NO: 8081 - DNA, 18 bp, Artificial Sequence
  Synthetic DNA
taatacgactgtcaatag

SEQ ID NO: 8082 - DNA, 18 bp, Artificial Sequence
  Synthetic DNA
taatacaactctgtatag

SEQ ID NO: 8083 - DNA, 18 bp, Artificial Sequence
  Synthetic DNA
taattggacacactatag

SEQ ID NO: 8084 - DNA, 18 bp, Artificial Sequence
  Synthetic DNA
tactacgacacactaaag

SEQ ID NO: 8085 - DNA, 18 bp, Artificial Sequence
  Synthetic DNA
ttatacgattgactatag

SEQ ID NO: 8086 - DNA, 18 bp, Artificial Sequence
  Synthetic DNA
aactacgactcactttag

SEQ ID NO: 8087 - DNA, 18 bp, Artificial Sequence
  Synthetic DNA
taatacgcctctctttag

SEQ ID NO: 8088 - DNA, 18 bp, Artificial Sequence
  Synthetic DNA
aaataccacacactatag

SEQ ID NO: 8089 - DNA, 18 bp, Artificial Sequence
  Synthetic DNA
aaatacgactcacgattg

SEQ ID NO: 8090 - DNA, 18 bp, Artificial Sequence
  Synthetic DNA
agataccactcactatag

SEQ ID NO: 8091 - DNA, 18 bp, Artificial Sequence
  Synthetic DNA
caaaacgacccactatag

SEQ ID NO: 8092 - DNA, 18 bp, Artificial Sequence
  Synthetic DNA
caaaacgactcattatag

SEQ ID NO: 8093 - DNA, 18 bp, Artificial Sequence
  Synthetic DNA
caatacaactcactattg

SEQ ID NO: 8094 - DNA, 18 bp, Artificial Sequence
  Synthetic DNA
taaaaccactaactatag

SEQ ID NO: 8095 - DNA, 18 bp, Artificial Sequence
  Synthetic DNA
taacacgtctcactatgg

SEQ ID NO: 8096 - DNA, 18 bp, Artificial Sequence
  Synthetic DNA
taataagactcacaatgg

SEQ ID NO: 8097 - DNA, 18 bp, Artificial Sequence
  Synthetic DNA
taatacaactcaatacag

SEQ ID NO: 8098 - DNA, 18 bp, Artificial Sequence
  Synthetic DNA
taataccaaacactatag

SEQ ID NO: 8099 - DNA, 18 bp, Artificial Sequence
  Synthetic DNA
taatacgaaccactattg

SEQ ID NO: 8100 - DNA, 18 bp, Artificial Sequence
  Synthetic DNA
taatacgaccacctatag

SEQ ID NO: 8101 - DNA, 18 bp, Artificial Sequence
  Synthetic DNA
taatacgattcattatgg

SEQ ID NO: 8102 - DNA, 18 bp, Artificial Sequence
  Synthetic DNA
taatacggctctctctag

SEQ ID NO: 8103 - DNA, 18 bp, Artificial Sequence
  Synthetic DNA
taatacgtccccctatag

SEQ ID NO: 8104 - DNA, 18 bp, Artificial Sequence
  Synthetic DNA
taatactactgtctatag

SEQ ID NO: 8105 - DNA, 18 bp, Artificial Sequence
  Synthetic DNA
taatactacttactatgg

SEQ ID NO: 8106 - DNA, 18 bp, Artificial Sequence
  Synthetic DNA
taatatgtctcactctag

SEQ ID NO: 8107 - DNA, 18 bp, Artificial Sequence
  Synthetic DNA
taatccgactaactaaag

SEQ ID NO: 8108 - DNA, 18 bp, Artificial Sequence
  Synthetic DNA
taatgcatctcactatag

SEQ ID NO: 8109 - DNA, 18 bp, Artificial Sequence
  Synthetic DNA
taatgctactcacaatag

SEQ ID NO: 8110 - DNA, 18 bp, Artificial Sequence
  Synthetic DNA
tactacgactcactaacg

SEQ ID NO: 8111 - DNA, 18 bp, Artificial Sequence
  Synthetic DNA
tagtaagacttactatag

SEQ ID NO: 8112 - DNA, 18 bp, Artificial Sequence
  Synthetic DNA
tagtacggctcactattg

SEQ ID NO: 8113 - DNA, 18 bp, Artificial Sequence
  Synthetic DNA
tattacgactcacgacag

SEQ ID NO: 8114 - DNA, 18 bp, Artificial Sequence
  Synthetic DNA
tattccgactcaatatag

SEQ ID NO: 8115 - DNA, 18 bp, Artificial Sequence
  Synthetic DNA
tcatacgagtctctatag

SEQ ID NO: 8116 - DNA, 18 bp, Artificial Sequence
  Synthetic DNA
tgatacgtgtcactatag

SEQ ID NO: 8117 - DNA, 18 bp, Artificial Sequence
  Synthetic DNA
tgctacgtctcactatag

SEQ ID NO: 8118 - DNA, 18 bp, Artificial Sequence
  Synthetic DNA
ttatacgactaaatatag

SEQ ID NO: 8119 - DNA, 18 bp, Artificial Sequence
  Synthetic DNA
aaaaacgactcactagag

SEQ ID NO: 8120 - DNA, 18 bp, Artificial Sequence
  Synthetic DNA
aaacccgactcactatag

SEQ ID NO: 8121 - DNA, 18 bp, Artificial Sequence
  Synthetic DNA
aaatacgagtcactatgg

SEQ ID NO: 8122 - DNA, 18 bp, Artificial Sequence
  Synthetic DNA
aaatacgagtcactctag

SEQ ID NO: 8123 - DNA, 18 bp, Artificial Sequence
  Synthetic DNA
acatacgacgcactatag

SEQ ID NO: 8124 - DNA, 18 bp, Artificial Sequence
  Synthetic DNA
agatacgactccctatag

SEQ ID NO: 8125 - DNA, 18 bp, Artificial Sequence
  Synthetic DNA
caaaacgacgcactatag

SEQ ID NO: 8126 - DNA, 18 bp, Artificial Sequence
  Synthetic DNA
caatacgactgattatag

SEQ ID NO: 8127 - DNA, 18 bp, Artificial Sequence
  Synthetic DNA
caatacgcctcgctatag

SEQ ID NO: 8128 - DNA, 18 bp, Artificial Sequence
  Synthetic DNA
caatacggctcacaatag

SEQ ID NO: 8129 - DNA, 18 bp, Artificial Sequence
  Synthetic DNA
caatccgactcactttag

SEQ ID NO: 8130 - DNA, 18 bp, Artificial Sequence
  Synthetic DNA
cagtacgactcaatatag

SEQ ID NO: 8131 - DNA, 18 bp, Artificial Sequence
  Synthetic DNA
gaataccactcagtatag

SEQ ID NO: 8132 - DNA, 18 bp, Artificial Sequence
  Synthetic DNA
gaatactactctctatag

SEQ ID NO: 8133 - DNA, 18 bp, Artificial Sequence
  Synthetic DNA
taaaacgacccgctatag

SEQ ID NO: 8134 - DNA, 18 bp, Artificial Sequence
  Synthetic DNA
taaaacgactcaccacag

SEQ ID NO: 8135 - DNA, 18 bp, Artificial Sequence
  Synthetic DNA
taaaccgactcgctatag

SEQ ID NO: 8136 - DNA, 18 bp, Artificial Sequence
  Synthetic DNA
taacacgacacactctag

SEQ ID NO: 8137 - DNA, 18 bp, Artificial Sequence
  Synthetic DNA
taacacgacccattatag

SEQ ID NO: 8138 - DNA, 18 bp, Artificial Sequence
  Synthetic DNA
taacacgagccactatag

SEQ ID NO: 8139 - DNA, 18 bp, Artificial Sequence
  Synthetic DNA
taacgcgacgcactatag

SEQ ID NO: 8140 - DNA, 18 bp, Artificial Sequence
  Synthetic DNA
taactcgactcactagag

SEQ ID NO: 8141 - DNA, 18 bp, Artificial Sequence
  Synthetic DNA
taagacgaatcactttag

SEQ ID NO: 8142 - DNA, 18 bp, Artificial Sequence
  Synthetic DNA
taagatgactcacaatag

SEQ ID NO: 8143 - DNA, 18 bp, Artificial Sequence
  Synthetic DNA
taataagaatgactatag

SEQ ID NO: 8144 - DNA, 18 bp, Artificial Sequence
  Synthetic DNA
taatacaactcgctagag

SEQ ID NO: 8145 - DNA, 18 bp, Artificial Sequence
  Synthetic DNA
taataccactcagaatag

SEQ ID NO: 8146 - DNA, 18 bp, Artificial Sequence
  Synthetic DNA
taatacgaagcactattg

SEQ ID NO: 8147 - DNA, 18 bp, Artificial Sequence
  Synthetic DNA
taatacgacgcaatttag

SEQ ID NO: 8148 - DNA, 18 bp, Artificial Sequence
  Synthetic DNA
taatacgactaacgacag

SEQ ID NO: 8149 - DNA, 18 bp, Artificial Sequence
  Synthetic DNA
taatacgactcacaatta

SEQ ID NO: 8150 - DNA, 18 bp, Artificial Sequence
  Synthetic DNA
taatacgactctccagag

SEQ ID NO: 8151 - DNA, 18 bp, Artificial Sequence
  Synthetic DNA
taatacgactgacaatcg

SEQ ID NO: 8152 - DNA, 18 bp, Artificial Sequence
  Synthetic DNA
taatacgactgagcatag

SEQ ID NO: 8153 - DNA, 18 bp, Artificial Sequence
  Synthetic DNA
taatacgagtaactattg

SEQ ID NO: 8154 - DNA, 18 bp, Artificial Sequence
  Synthetic DNA
taatacgagtcacaagag

SEQ ID NO: 8155 - DNA, 18 bp, Artificial Sequence
  Synthetic DNA
taatacgagtccatatag

SEQ ID NO: 8156 - DNA, 18 bp, Artificial Sequence
  Synthetic DNA
taatacgagttactatgg

SEQ ID NO: 8157 - DNA, 18 bp, Artificial Sequence
  Synthetic DNA
taatacgattcgctagag

SEQ ID NO: 8158 - DNA, 18 bp, Artificial Sequence
  Synthetic DNA
taatacgccccaatatag

SEQ ID NO: 8159 - DNA, 18 bp, Artificial Sequence
  Synthetic DNA
taatacgcctgactaaag

SEQ ID NO: 8160 - DNA, 18 bp, Artificial Sequence
  Synthetic DNA
taatactactcagtacag

SEQ ID NO: 8161 - DNA, 18 bp, Artificial Sequence
  Synthetic DNA
taatactactcatgatag

SEQ ID NO: 8162 - DNA, 18 bp, Artificial Sequence
  Synthetic DNA
taatactacttcctatag

SEQ ID NO: 8163 - DNA, 18 bp, Artificial Sequence
  Synthetic DNA
taatagaactcacgatag

SEQ ID NO: 8164 - DNA, 18 bp, Artificial Sequence
  Synthetic DNA
taataggactcacaagag

SEQ ID NO: 8165 - DNA, 18 bp, Artificial Sequence
  Synthetic DNA
taataggcctcactattg

SEQ ID NO: 8166 - DNA, 18 bp, Artificial Sequence
  Synthetic DNA
taatatgactgaatatag

SEQ ID NO: 8167 - DNA, 18 bp, Artificial Sequence
  Synthetic DNA
taatatgagttactatag

SEQ ID NO: 8168 - DNA, 18 bp, Artificial Sequence
  Synthetic DNA
taatatggctctctatag

SEQ ID NO: 8169 - DNA, 18 bp, Artificial Sequence
  Synthetic DNA
taatattactcactatgg

SEQ ID NO: 8170 - DNA, 18 bp, Artificial Sequence
  Synthetic DNA
taatccaagtcactatag

SEQ ID NO: 8171 - DNA, 18 bp, Artificial Sequence
  Synthetic DNA
taatcccactcactacag

SEQ ID NO: 8172 - DNA, 18 bp, Artificial Sequence
  Synthetic DNA
taatccgactcagtaaag

SEQ ID NO: 8173 - DNA, 18 bp, Artificial Sequence
  Synthetic DNA
taatcggattcactatag

SEQ ID NO: 8174 - DNA, 18 bp, Artificial Sequence
  Synthetic DNA
taatgcgagtcactttag

SEQ ID NO: 8175 - DNA, 18 bp, Artificial Sequence
  Synthetic DNA
taattcgtctcacgatag

SEQ ID NO: 8176 - DNA, 18 bp, Artificial Sequence
  Synthetic DNA
tactacgacgcactatcg

SEQ ID NO: 8177 - DNA, 18 bp, Artificial Sequence
  Synthetic DNA
tactacgactaactacag

SEQ ID NO: 8178 - DNA, 18 bp, Artificial Sequence
  Synthetic DNA
tactacgactcactctcg

SEQ ID NO: 8179 - DNA, 18 bp, Artificial Sequence
  Synthetic DNA
tactacgagtcactttag

SEQ ID NO: 8180 - DNA, 18 bp, Artificial Sequence
  Synthetic DNA
tactaggactcaccatag

SEQ ID NO: 8181 - DNA, 18 bp, Artificial Sequence
  Synthetic DNA
tagaacgactcaccatag

SEQ ID NO: 8182 - DNA, 18 bp, Artificial Sequence
  Synthetic DNA
tagaacgactccctatag

SEQ ID NO: 8183 - DNA, 18 bp, Artificial Sequence
  Synthetic DNA
tagaccgactcactatag

SEQ ID NO: 8184 - DNA, 18 bp, Artificial Sequence
  Synthetic DNA
tagtacgaatcactatcg

SEQ ID NO: 8185 - DNA, 18 bp, Artificial Sequence
  Synthetic DNA
tagtacgactccatatag

SEQ ID NO: 8186 - DNA, 18 bp, Artificial Sequence
  Synthetic DNA
tagtacgactgacaatag

SEQ ID NO: 8187 - DNA, 18 bp, Artificial Sequence
  Synthetic DNA
tagtactacccactatag

SEQ ID NO: 8188 - DNA, 18 bp, Artificial Sequence
  Synthetic DNA
tatgacggctcactatag

SEQ ID NO: 8189 - DNA, 18 bp, Artificial Sequence
  Synthetic DNA
tattaggcctcactatag

SEQ ID NO: 8190 - DNA, 18 bp, Artificial Sequence
  Synthetic DNA
tcatacgactcaatacag

SEQ ID NO: 8191 - DNA, 18 bp, Artificial Sequence
  Synthetic DNA
tcatatgactcattatag

SEQ ID NO: 8192 - DNA, 18 bp, Artificial Sequence
  Synthetic DNA
tgatacaactcactatcg

SEQ ID NO: 8193 - DNA, 18 bp, Artificial Sequence
  Synthetic DNA
tgatacaactcactctag

SEQ ID NO: 8194 - DNA, 18 bp, Artificial Sequence
  Synthetic DNA
tgctacgaatcactatag

SEQ ID NO: 8195 - DNA, 18 bp, Artificial Sequence
  Synthetic DNA
ttctacgactcactctag

SEQ ID NO: 8196 - DNA, 18 bp, Artificial Sequence
  Synthetic DNA
taaaacgactcacttaag

SEQ ID NO: 8197 - DNA, 18 bp, Artificial Sequence
  Synthetic DNA
tattacgaatcactattg

SEQ ID NO: 8198 - DNA, 18 bp, Artificial Sequence
  Synthetic DNA
tattacgacacaatatag

SEQ ID NO: 8199 - DNA, 18 bp, Artificial Sequence
  Synthetic DNA
taatacgtctctctctag

SEQ ID NO: 8200 - DNA, 18 bp, Artificial Sequence
  Synthetic DNA
taatacgacacacaaaag

SEQ ID NO: 8201 - DNA, 18 bp, Artificial Sequence
  Synthetic DNA
tattaccactcactaaag

SEQ ID NO: 8202 - DNA, 18 bp, Artificial Sequence
  Synthetic DNA
ttataagactctctatag

SEQ ID NO: 8203 - DNA, 18 bp, Artificial Sequence
  Synthetic DNA
caatacgacacactttag

SEQ ID NO: 8204 - DNA, 18 bp, Artificial Sequence
  Synthetic DNA
tcatacgtatcactatag

SEQ ID NO: 8205 - DNA, 18 bp, Artificial Sequence
  Synthetic DNA
ttatacgaatccctatag

SEQ ID NO: 8206 - DNA, 18 bp, Artificial Sequence
  Synthetic DNA
taatacgtctcacaacag

SEQ ID NO: 8207 - DNA, 18 bp, Artificial Sequence
  Synthetic DNA
aataacgactcactatag

SEQ ID NO: 8208 - DNA, 18 bp, Artificial Sequence
  Synthetic DNA
taataagaatcactttag

SEQ ID NO: 8209 - DNA, 18 bp, Artificial Sequence
  Synthetic DNA
ttatactactcattatag

SEQ ID NO: 8210 - DNA, 18 bp, Artificial Sequence
  Synthetic DNA
aaatccaactcactatag

SEQ ID NO: 8211 - DNA, 18 bp, Artificial Sequence
  Synthetic DNA
taaaacgactcattacag

SEQ ID NO: 8212 - DNA, 18 bp, Artificial Sequence
  Synthetic DNA
taatacagctcactttag

SEQ ID NO: 8213 - DNA, 18 bp, Artificial Sequence
  Synthetic DNA
taatacgagtctctattg

SEQ ID NO: 8214 - DNA, 18 bp, Artificial Sequence
  Synthetic DNA
taatacgattgtctatag

SEQ ID NO: 8215 - DNA, 18 bp, Artificial Sequence
  Synthetic DNA
taatacgtctcaatctag

SEQ ID NO: 8216 - DNA, 18 bp, Artificial Sequence
  Synthetic DNA
taatacgtctgactaaag

SEQ ID NO: 8217 - DNA, 18 bp, Artificial Sequence
  Synthetic DNA
taatactaatcaccatag

SEQ ID NO: 8218 - DNA, 18 bp, Artificial Sequence
  Synthetic DNA
taatactacaccctatag

SEQ ID NO: 8219 - DNA, 18 bp, Artificial Sequence
  Synthetic DNA
tacttcgactcacaatag

SEQ ID NO: 8220 - DNA, 18 bp, Artificial Sequence
  Synthetic DNA
tagtacgaatctctatag

SEQ ID NO: 8221 - DNA, 18 bp, Artificial Sequence
  Synthetic DNA
tcattcgactcactctag

SEQ ID NO: 8222 - DNA, 18 bp, Artificial Sequence
  Synthetic DNA
ttatacgaccctctatag

SEQ ID NO: 8223 - DNA, 18 bp, Artificial Sequence
  Synthetic DNA
ttatccgactaactatag

SEQ ID NO: 8224 - DNA, 18 bp, Artificial Sequence
  Synthetic DNA
ttatattactcactatag

SEQ ID NO: 8225 - DNA, 18 bp, Artificial Sequence
  Synthetic DNA
taatacaacacattatag

SEQ ID NO: 8226 - DNA, 18 bp, Artificial Sequence
  Synthetic DNA
taatacgattaactaaag

SEQ ID NO: 8227 - DNA, 18 bp, Artificial Sequence
  Synthetic DNA
taattcgacccactttag

SEQ ID NO: 8228 - DNA, 18 bp, Artificial Sequence
  Synthetic DNA
tactacgactctctattg

SEQ ID NO: 8229 - DNA, 18 bp, Artificial Sequence
  Synthetic DNA
taacacgtctcacaatag

SEQ ID NO: 8230 - DNA, 18 bp, Artificial Sequence
  Synthetic DNA
taatacgactcaaaaaag

SEQ ID NO: 8231 - DNA, 18 bp, Artificial Sequence
  Synthetic DNA
tattacaacacactatag

SEQ ID NO: 8232 - DNA, 18 bp, Artificial Sequence
  Synthetic DNA
atatccgactcactatag

SEQ ID NO: 8233 - DNA, 18 bp, Artificial Sequence
  Synthetic DNA
ttatactaatcactatag

SEQ ID NO: 8234 - DNA, 18 bp, Artificial Sequence
  Synthetic DNA
caattcgactcattatag

SEQ ID NO: 8235 - DNA, 18 bp, Artificial Sequence
  Synthetic DNA
taatacgacatactgtag

SEQ ID NO: 8236 - DNA, 18 bp, Artificial Sequence
  Synthetic DNA
taatacgatccactattg

SEQ ID NO: 8237 - DNA, 18 bp, Artificial Sequence
  Synthetic DNA
taatacgattcactactg

SEQ ID NO: 8238 - DNA, 18 bp, Artificial Sequence
  Synthetic DNA
taatactactcactcttg

SEQ ID NO: 8239 - DNA, 18 bp, Artificial Sequence
  Synthetic DNA
ttctacgactcaatatag

SEQ ID NO: 8240 - DNA, 18 bp, Artificial Sequence
  Synthetic DNA
aaaaacgacccactatag

SEQ ID NO: 8241 - DNA, 18 bp, Artificial Sequence
  Synthetic DNA
aaatacgactcacaatcg

SEQ ID NO: 8242 - DNA, 18 bp, Artificial Sequence
  Synthetic DNA
aaatacgacttactacag

SEQ ID NO: 8243 - DNA, 18 bp, Artificial Sequence
  Synthetic DNA
caattcgaatcactatag

SEQ ID NO: 8244 - DNA, 18 bp, Artificial Sequence
  Synthetic DNA
taatacaaatcactatgg

SEQ ID NO: 8245 - DNA, 18 bp, Artificial Sequence
  Synthetic DNA
taataccactctctatgg

SEQ ID NO: 8246 - DNA, 18 bp, Artificial Sequence
  Synthetic DNA
taataccattcaatatag

SEQ ID NO: 8247 - DNA, 18 bp, Artificial Sequence
  Synthetic DNA
taatacctcttactatag

SEQ ID NO: 8248 - DNA, 18 bp, Artificial Sequence
  Synthetic DNA
taatacgacgaactattg

SEQ ID NO: 8249 - DNA, 18 bp, Artificial Sequence
  Synthetic DNA
taatacgactccttattg

SEQ ID NO: 8250 - DNA, 18 bp, Artificial Sequence
  Synthetic DNA
taatacgattcgcaatag

SEQ ID NO: 8251 - DNA, 18 bp, Artificial Sequence
  Synthetic DNA
taatacgcgtcactattg

SEQ ID NO: 8252 - DNA, 18 bp, Artificial Sequence
  Synthetic DNA
taatactagtcactaaag

SEQ ID NO: 8253 - DNA, 18 bp, Artificial Sequence
  Synthetic DNA
taataggactcaatacag

SEQ ID NO: 8254 - DNA, 18 bp, Artificial Sequence
  Synthetic DNA
taataggtctccctatag

SEQ ID NO: 8255 - DNA, 18 bp, Artificial Sequence
  Synthetic DNA
taattcggctaactatag

SEQ ID NO: 8256 - DNA, 18 bp, Artificial Sequence
  Synthetic DNA
tactcagactcactatag

SEQ ID NO: 8257 - DNA, 18 bp, Artificial Sequence
  Synthetic DNA
tagtactactcactatcg

SEQ ID NO: 8258 - DNA, 18 bp, Artificial Sequence
  Synthetic DNA
tattacaactcactatgg

SEQ ID NO: 8259 - DNA, 18 bp, Artificial Sequence
  Synthetic DNA
tattacgactggctatag

SEQ ID NO: 8260 - DNA, 18 bp, Artificial Sequence
  Synthetic DNA
tattacgagtaactatag

SEQ ID NO: 8261 - DNA, 18 bp, Artificial Sequence
  Synthetic DNA
ttatacgactgaccatag

SEQ ID NO: 8262 - DNA, 18 bp, Artificial Sequence
  Synthetic DNA
tcattcgactctctatag

SEQ ID NO: 8263 - DNA, 18 bp, Artificial Sequence
  Synthetic DNA
ttatacgtctctctatag

SEQ ID NO: 8264 - DNA, 18 bp, Artificial Sequence
  Synthetic DNA
taaaacgtcttactatag

SEQ ID NO: 8265 - DNA, 18 bp, Artificial Sequence
  Synthetic DNA
ttatacgactctgtatag

SEQ ID NO: 8266 - DNA, 18 bp, Artificial Sequence
  Synthetic DNA
taatatgacttactattg

SEQ ID NO: 8267 - DNA, 18 bp, Artificial Sequence
  Synthetic DNA
aaatacaaatcactatag

SEQ ID NO: 8268 - DNA, 18 bp, Artificial Sequence
  Synthetic DNA
caatacgaatcactttag

SEQ ID NO: 8269 - DNA, 18 bp, Artificial Sequence
  Synthetic DNA
taatacgacttattctag

SEQ ID NO: 8270 - DNA, 18 bp, Artificial Sequence
  Synthetic DNA
taatacgctacactatag

SEQ ID NO: 8271 - DNA, 18 bp, Artificial Sequence
  Synthetic DNA
taatatgactccctaaag

SEQ ID NO: 8272 - DNA, 18 bp, Artificial Sequence
  Synthetic DNA
taatccgactcattttag

SEQ ID NO: 8273 - DNA, 18 bp, Artificial Sequence
  Synthetic DNA
tacttccactcactatag

SEQ ID NO: 8274 - DNA, 18 bp, Artificial Sequence
  Synthetic DNA
tattacgacacaccatag

SEQ ID NO: 8275 - DNA, 18 bp, Artificial Sequence
  Synthetic DNA
ttattcgagtcactatag

SEQ ID NO: 8276 - DNA, 18 bp, Artificial Sequence
  Synthetic DNA
ttatacgacacactaaag

SEQ ID NO: 8277 - DNA, 18 bp, Artificial Sequence
  Synthetic DNA
taatacgtctccctttag

SEQ ID NO: 8278 - DNA, 18 bp, Artificial Sequence
  Synthetic DNA
taattcgactaactaaag

SEQ ID NO: 8279 - DNA, 18 bp, Artificial Sequence
  Synthetic DNA
tatcacgactcactaaag

SEQ ID NO: 8280 - DNA, 18 bp, Artificial Sequence
  Synthetic DNA
taatatgactcactaatg

SEQ ID NO: 8281 - DNA, 18 bp, Artificial Sequence
  Synthetic DNA
aaataccactcactttag

SEQ ID NO: 8282 - DNA, 18 bp, Artificial Sequence
  Synthetic DNA
taatacctttcactatag

SEQ ID NO: 8283 - DNA, 18 bp, Artificial Sequence
  Synthetic DNA
taatacgaatcaccattg

SEQ ID NO: 8284 - DNA, 18 bp, Artificial Sequence
  Synthetic DNA
taatacgacccacaaaag

SEQ ID NO: 8285 - DNA, 18 bp, Artificial Sequence
  Synthetic DNA
tagtactactcactattg

SEQ ID NO: 8286 - DNA, 18 bp, Artificial Sequence
  Synthetic DNA
taatacaactctcaatag

SEQ ID NO: 8287 - DNA, 18 bp, Artificial Sequence
  Synthetic DNA
taattcgacacactattg

SEQ ID NO: 8288 - DNA, 18 bp, Artificial Sequence
  Synthetic DNA
taatatgaatcactttag

SEQ ID NO: 8289 - DNA, 18 bp, Artificial Sequence
  Synthetic DNA
taatgcgacacactttag

SEQ ID NO: 8290 - DNA, 18 bp, Artificial Sequence
  Synthetic DNA
aaatacgacacagtatag

SEQ ID NO: 8291 - DNA, 18 bp, Artificial Sequence
  Synthetic DNA
taatacgtatcagtatag

SEQ ID NO: 8292 - DNA, 18 bp, Artificial Sequence
  Synthetic DNA
taatactacttattatag

SEQ ID NO: 8293 - DNA, 18 bp, Artificial Sequence
  Synthetic DNA
taatgcgactctatatag

SEQ ID NO: 8294 - DNA, 18 bp, Artificial Sequence
  Synthetic DNA
taattccactcaatatag

SEQ ID NO: 8295 - DNA, 18 bp, Artificial Sequence
  Synthetic DNA
taattcgtctgactatag

SEQ ID NO: 8296 - DNA, 18 bp, Artificial Sequence
  Synthetic DNA
tacaacgacacactatag

SEQ ID NO: 8297 - DNA, 18 bp, Artificial Sequence
  Synthetic DNA
tattacgactccatatag

SEQ ID NO: 8298 - DNA, 18 bp, Artificial Sequence
  Synthetic DNA
tattacgactgactacag

SEQ ID NO: 8299 - DNA, 18 bp, Artificial Sequence
  Synthetic DNA
tcttacgacacactatag

SEQ ID NO: 8300 - DNA, 18 bp, Artificial Sequence
  Synthetic DNA
ttatacgactcattagag

SEQ ID NO: 8301 - DNA, 18 bp, Artificial Sequence
  Synthetic DNA
taataggactcacattag

SEQ ID NO: 8302 - DNA, 18 bp, Artificial Sequence
  Synthetic DNA
tattacgactcactttcg

SEQ ID NO: 8303 - DNA, 18 bp, Artificial Sequence
  Synthetic DNA
tcatacgacacactaaag

SEQ ID NO: 8304 - DNA, 18 bp, Artificial Sequence
  Synthetic DNA
ttatacgaataactatag

SEQ ID NO: 8305 - DNA, 18 bp, Artificial Sequence
  Synthetic DNA
acatacgacacactatag

SEQ ID NO: 8306 - DNA, 18 bp, Artificial Sequence
  Synthetic DNA
taatacgactaaccaaag

SEQ ID NO: 8307 - DNA, 18 bp, Artificial Sequence
  Synthetic DNA
tcatacgactcaatattg

SEQ ID NO: 8308 - DNA, 18 bp, Artificial Sequence
  Synthetic DNA
ttataccaatcactatag

SEQ ID NO: 8309 - DNA, 18 bp, Artificial Sequence
  Synthetic DNA
ttatatgacttactatag

SEQ ID NO: 8310 - DNA, 18 bp, Artificial Sequence
  Synthetic DNA
aaatcctactcactatag

SEQ ID NO: 8311 - DNA, 18 bp, Artificial Sequence
  Synthetic DNA
caatacgactcaatattg

SEQ ID NO: 8312 - DNA, 18 bp, Artificial Sequence
  Synthetic DNA
caattggactcactatag

SEQ ID NO: 8313 - DNA, 18 bp, Artificial Sequence
  Synthetic DNA
gaatacatctcactatag

SEQ ID NO: 8314 - DNA, 18 bp, Artificial Sequence
  Synthetic DNA
taaaacgaataactatag

SEQ ID NO: 8315 - DNA, 18 bp, Artificial Sequence
  Synthetic DNA
taaaacgtgtcactatag

SEQ ID NO: 8316 - DNA, 18 bp, Artificial Sequence
  Synthetic DNA
taaatcgactgactatag

SEQ ID NO: 8317 - DNA, 18 bp, Artificial Sequence
  Synthetic DNA
taacataactcactatag

SEQ ID NO: 8318 - DNA, 18 bp, Artificial Sequence
  Synthetic DNA
taactccactcactatag

SEQ ID NO: 8319 - DNA, 18 bp, Artificial Sequence
  Synthetic DNA
taataagtctcactagag

SEQ ID NO: 8320 - DNA, 18 bp, Artificial Sequence
  Synthetic DNA
taatacaacacactatgg

SEQ ID NO: 8321 - DNA, 18 bp, Artificial Sequence
  Synthetic DNA
taatacgacatactacag

SEQ ID NO: 8322 - DNA, 18 bp, Artificial Sequence
  Synthetic DNA
taatacgatttactatcg

SEQ ID NO: 8323 - DNA, 18 bp, Artificial Sequence
  Synthetic DNA
taatacggcttaatatag

SEQ ID NO: 8324 - DNA, 18 bp, Artificial Sequence
  Synthetic DNA
taataggaatcaatatag

SEQ ID NO: 8325 - DNA, 18 bp, Artificial Sequence
  Synthetic DNA
taatatgacctactatag

SEQ ID NO: 8326 - DNA, 18 bp, Artificial Sequence
  Synthetic DNA
taatatgactgactttag

SEQ ID NO: 8327 - DNA, 18 bp, Artificial Sequence
  Synthetic DNA
taatccgacccactattg

SEQ ID NO: 8328 - DNA, 18 bp, Artificial Sequence
  Synthetic DNA
taattcgactcagtttag

SEQ ID NO: 8329 - DNA, 18 bp, Artificial Sequence
  Synthetic DNA
taattcgactccatatag

SEQ ID NO: 8330 - DNA, 18 bp, Artificial Sequence
  Synthetic DNA
tcatatgactcaatatag

SEQ ID NO: 8331 - DNA, 18 bp, Artificial Sequence
  Synthetic DNA
tcctacgactctctatag

SEQ ID NO: 8332 - DNA, 18 bp, Artificial Sequence
  Synthetic DNA
tgataagactcactatcg

SEQ ID NO: 8333 - DNA, 18 bp, Artificial Sequence
  Synthetic DNA
ttatacgacttactatgg

SEQ ID NO: 8334 - DNA, 18 bp, Artificial Sequence
  Synthetic DNA
ttatgcgacttactatag

SEQ ID NO: 8335 - DNA, 18 bp, Artificial Sequence
  Synthetic DNA
atatacgactcactagag

SEQ ID NO: 8336 - DNA, 18 bp, Artificial Sequence
  Synthetic DNA
caacacgactcattatag

SEQ ID NO: 8337 - DNA, 18 bp, Artificial Sequence
  Synthetic DNA
caatacgaataactatag

SEQ ID NO: 8338 - DNA, 18 bp, Artificial Sequence
  Synthetic DNA
caatacgacgccctatag

SEQ ID NO: 8339 - DNA, 18 bp, Artificial Sequence
  Synthetic DNA
caatgcgaatcactatag

SEQ ID NO: 8340 - DNA, 18 bp, Artificial Sequence
  Synthetic DNA
ccatacgactcgctatag

SEQ ID NO: 8341 - DNA, 18 bp, Artificial Sequence
  Synthetic DNA
gcatacgactcacaatag

SEQ ID NO: 8342 - DNA, 18 bp, Artificial Sequence
  Synthetic DNA
gtatacgacacactatag

SEQ ID NO: 8343 - DNA, 18 bp, Artificial Sequence
  Synthetic DNA
gtatacgagtcactatag

SEQ ID NO: 8344 - DNA, 18 bp, Artificial Sequence
  Synthetic DNA
taaaaccactcactatcg

SEQ ID NO: 8345 - DNA, 18 bp, Artificial Sequence
  Synthetic DNA
taaaaggcctcactatag

SEQ ID NO: 8346 - DNA, 18 bp, Artificial Sequence
  Synthetic DNA
taacacaactcactatcg

SEQ ID NO: 8347 - DNA, 18 bp, Artificial Sequence
  Synthetic DNA
taagaagactcattatag

SEQ ID NO: 8348 - DNA, 18 bp, Artificial Sequence
  Synthetic DNA
taataagactccgtatag

SEQ ID NO: 8349 - DNA, 18 bp, Artificial Sequence
  Synthetic DNA
taataatactcactatcg

SEQ ID NO: 8350 - DNA, 18 bp, Artificial Sequence
  Synthetic DNA
taatacaactaactctag

SEQ ID NO: 8351 - DNA, 18 bp, Artificial Sequence
  Synthetic DNA
taatacaactcacgctag

SEQ ID NO: 8352 - DNA, 18 bp, Artificial Sequence
  Synthetic DNA
taatacaactgaatatag

SEQ ID NO: 8353 - DNA, 18 bp, Artificial Sequence
  Synthetic DNA
taatacagcttactatag

SEQ ID NO: 8354 - DNA, 18 bp, Artificial Sequence
  Synthetic DNA
taataccaatcactatcg

SEQ ID NO: 8355 - DNA, 18 bp, Artificial Sequence
  Synthetic DNA
taataccactcactggag

SEQ ID NO: 8356 - DNA, 18 bp, Artificial Sequence
  Synthetic DNA
taataccagtcactttag

SEQ ID NO: 8357 - DNA, 18 bp, Artificial Sequence
  Synthetic DNA
taatacccctcactattg

SEQ ID NO: 8358 - DNA, 18 bp, Artificial Sequence
  Synthetic DNA
taatacgacacactgcag

SEQ ID NO: 8359 - DNA, 18 bp, Artificial Sequence
  Synthetic DNA
taatacgactccttatgg

SEQ ID NO: 8360 - DNA, 18 bp, Artificial Sequence
  Synthetic DNA
taatacgacttagaatag

SEQ ID NO: 8361 - DNA, 18 bp, Artificial Sequence
  Synthetic DNA
taatacgagtcaccttag

SEQ ID NO: 8362 - DNA, 18 bp, Artificial Sequence
  Synthetic DNA
taatacggctcacgttag

SEQ ID NO: 8363 - DNA, 18 bp, Artificial Sequence
  Synthetic DNA
taatacggctcactgaag

SEQ ID NO: 8364 - DNA, 18 bp, Artificial Sequence
  Synthetic DNA
taatacggctcagtacag

SEQ ID NO: 8365 - DNA, 18 bp, Artificial Sequence
  Synthetic DNA
taatacgtctcaccgtag

SEQ ID NO: 8366 - DNA, 18 bp, Artificial Sequence
  Synthetic DNA
taataggaatcactatcg

SEQ ID NO: 8367 - DNA, 18 bp, Artificial Sequence
  Synthetic DNA
taatccgactctctagag

SEQ ID NO: 8368 - DNA, 18 bp, Artificial Sequence
  Synthetic DNA
taatctgactcagtatag

SEQ ID NO: 8369 - DNA, 18 bp, Artificial Sequence
  Synthetic DNA
taatgcgacccactatgg

SEQ ID NO: 8370 - DNA, 18 bp, Artificial Sequence
  Synthetic DNA
taatgcgactcagtttag

SEQ ID NO: 8371 - DNA, 18 bp, Artificial Sequence
  Synthetic DNA
taatgcgactcattgtag

SEQ ID NO: 8372 - DNA, 18 bp, Artificial Sequence
  Synthetic DNA
taatgctacttactatag

SEQ ID NO: 8373 - DNA, 18 bp, Artificial Sequence
  Synthetic DNA
taatgggactcattatag

SEQ ID NO: 8374 - DNA, 18 bp, Artificial Sequence
  Synthetic DNA
taattagactcactagag

SEQ ID NO: 8375 - DNA, 18 bp, Artificial Sequence
  Synthetic DNA
tactacgactctcgatag

SEQ ID NO: 8376 - DNA, 18 bp, Artificial Sequence
  Synthetic DNA
tacttcgactcagtatag

SEQ ID NO: 8377 - DNA, 18 bp, Artificial Sequence
  Synthetic DNA
tagtacgactcactttcg

SEQ ID NO: 8378 - DNA, 18 bp, Artificial Sequence
  Synthetic DNA
tagtacgactctccatag

SEQ ID NO: 8379 - DNA, 18 bp, Artificial Sequence
  Synthetic DNA
tagtacgattccctatag

SEQ ID NO: 8380 - DNA, 18 bp, Artificial Sequence
  Synthetic DNA
tattacgactcactagcg

SEQ ID NO: 8381 - DNA, 18 bp, Artificial Sequence
  Synthetic DNA
tattacggctcactatgg

SEQ ID NO: 8382 - DNA, 18 bp, Artificial Sequence
  Synthetic DNA
tattacggctgactatag

SEQ ID NO: 8383 - DNA, 18 bp, Artificial Sequence
  Synthetic DNA
tattccgactcactagag

SEQ ID NO: 8384 - DNA, 18 bp, Artificial Sequence
  Synthetic DNA
tcatacgactaacaatag

SEQ ID NO: 8385 - DNA, 18 bp, Artificial Sequence
  Synthetic DNA
tgatacaactcagtatag

SEQ ID NO: 8386 - DNA, 18 bp, Artificial Sequence
  Synthetic DNA
tgatacggctcacgatag

SEQ ID NO: 8387 - DNA, 18 bp, Artificial Sequence
  Synthetic DNA
tgatccgactcactatcg

SEQ ID NO: 8388 - DNA, 18 bp, Artificial Sequence
  Synthetic DNA
tggtaccactcactatag

SEQ ID NO: 8389 - DNA, 18 bp, Artificial Sequence
  Synthetic DNA
tattacaacttactatag

SEQ ID NO: 8390 - DNA, 18 bp, Artificial Sequence
  Synthetic DNA
taatacgacacataatag

SEQ ID NO: 8391 - DNA, 18 bp, Artificial Sequence
  Synthetic DNA
taatactactccctattg

SEQ ID NO: 8392 - DNA, 18 bp, Artificial Sequence
  Synthetic DNA
ttatgcgactctctatag

SEQ ID NO: 8393 - DNA, 18 bp, Artificial Sequence
  Synthetic DNA
taatactactcacaattg

SEQ ID NO: 8394 - DNA, 18 bp, Artificial Sequence
  Synthetic DNA
aaatacaattcactatag

SEQ ID NO: 8395 - DNA, 18 bp, Artificial Sequence
  Synthetic DNA
taaagcgactctctatag

SEQ ID NO: 8396 - DNA, 18 bp, Artificial Sequence
  Synthetic DNA
taatacgtcccactattg

SEQ ID NO: 8397 - DNA, 18 bp, Artificial Sequence
  Synthetic DNA
taatttgactcaccatag

SEQ ID NO: 8398 - DNA, 18 bp, Artificial Sequence
  Synthetic DNA
tagtacgactctctttag

SEQ ID NO: 8399 - DNA, 18 bp, Artificial Sequence
  Synthetic DNA
taatacgaatcacaattg

SEQ ID NO: 8400 - DNA, 18 bp, Artificial Sequence
  Synthetic DNA
atataggactcactatag

SEQ ID NO: 8401 - DNA, 18 bp, Artificial Sequence
  Synthetic DNA
taataagactgtctatag

SEQ ID NO: 8402 - DNA, 18 bp, Artificial Sequence
  Synthetic DNA
taataatactcaatatag

SEQ ID NO: 8403 - DNA, 18 bp, Artificial Sequence
  Synthetic DNA
taatacgacttaccattg

SEQ ID NO: 8404 - DNA, 18 bp, Artificial Sequence
  Synthetic DNA
taatacgagtctctaaag

SEQ ID NO: 8405 - DNA, 18 bp, Artificial Sequence
  Synthetic DNA
taatacgatacaatatag

SEQ ID NO: 8406 - DNA, 18 bp, Artificial Sequence
  Synthetic DNA
taatacgtttaactatag

SEQ ID NO: 8407 - DNA, 18 bp, Artificial Sequence
  Synthetic DNA
taatactagtctctatag

SEQ ID NO: 8408 - DNA, 18 bp, Artificial Sequence
  Synthetic DNA
tagaacgacacactatag

SEQ ID NO: 8409 - DNA, 18 bp, Artificial Sequence
  Synthetic DNA
tcataagactcactattg

SEQ ID NO: 8410 - DNA, 18 bp, Artificial Sequence
  Synthetic DNA
tcatacgtctcaccatag

SEQ ID NO: 8411 - DNA, 18 bp, Artificial Sequence
  Synthetic DNA
taataagtctctctatag

SEQ ID NO: 8412 - DNA, 18 bp, Artificial Sequence
  Synthetic DNA
taatacaactaactattg

SEQ ID NO: 8413 - DNA, 18 bp, Artificial Sequence
  Synthetic DNA
taatacgacacaatttag

SEQ ID NO: 8414 - DNA, 18 bp, Artificial Sequence
  Synthetic DNA
taaaactattcactatag

SEQ ID NO: 8415 - DNA, 18 bp, Artificial Sequence
  Synthetic DNA
taatacgactaattattg

SEQ ID NO: 8416 - DNA, 18 bp, Artificial Sequence
  Synthetic DNA
taatacgactcatactag

SEQ ID NO: 8417 - DNA, 18 bp, Artificial Sequence
  Synthetic DNA
ttatacgactcccaatag

SEQ ID NO: 8418 - DNA, 18 bp, Artificial Sequence
  Synthetic DNA
aaatacgtcgcactatag

SEQ ID NO: 8419 - DNA, 18 bp, Artificial Sequence
  Synthetic DNA
ctacacgactcactatag

SEQ ID NO: 8420 - DNA, 18 bp, Artificial Sequence
  Synthetic DNA
taaaagggctcactatag

SEQ ID NO: 8421 - DNA, 18 bp, Artificial Sequence
  Synthetic DNA
taacacgtcccactatag

SEQ ID NO: 8422 - DNA, 18 bp, Artificial Sequence
  Synthetic DNA
taataccaattactatag

SEQ ID NO: 8423 - DNA, 18 bp, Artificial Sequence
  Synthetic DNA
taatacgactaagaatag

SEQ ID NO: 8424 - DNA, 18 bp, Artificial Sequence
  Synthetic DNA
taatacgactatgtatag

SEQ ID NO: 8425 - DNA, 18 bp, Artificial Sequence
  Synthetic DNA
taatacgactctctctcg

SEQ ID NO: 8426 - DNA, 18 bp, Artificial Sequence
  Synthetic DNA
taatacgagtctttatag

SEQ ID NO: 8427 - DNA, 18 bp, Artificial Sequence
  Synthetic DNA
taatacgtctaactatcg

SEQ ID NO: 8428 - DNA, 18 bp, Artificial Sequence
  Synthetic DNA
taatactactcactccag

SEQ ID NO: 8429 - DNA, 18 bp, Artificial Sequence
  Synthetic DNA
taatgccacttactatag

SEQ ID NO: 8430 - DNA, 18 bp, Artificial Sequence
  Synthetic DNA
taattctactcactatgg

SEQ ID NO: 8431 - DNA, 18 bp, Artificial Sequence
  Synthetic DNA
tactaagcctcactatag

SEQ ID NO: 8432 - DNA, 18 bp, Artificial Sequence
  Synthetic DNA
tagtatgactcactattg

SEQ ID NO: 8433 - DNA, 18 bp, Artificial Sequence
  Synthetic DNA
tatcacgactcagtatag

SEQ ID NO: 8434 - DNA, 18 bp, Artificial Sequence
  Synthetic DNA
tattaggactcaatatag

SEQ ID NO: 8435 - DNA, 18 bp, Artificial Sequence
  Synthetic DNA
tattccgacttactatag

SEQ ID NO: 8436 - DNA, 18 bp, Artificial Sequence
  Synthetic DNA
tcataagactctctatag

SEQ ID NO: 8437 - DNA, 18 bp, Artificial Sequence
  Synthetic DNA
tcatatgaatcactatag

SEQ ID NO: 8438 - DNA, 18 bp, Artificial Sequence
  Synthetic DNA
tgatacgactaactaaag

SEQ ID NO: 8439 - DNA, 18 bp, Artificial Sequence
  Synthetic DNA
tgatacgactcataatag

SEQ ID NO: 8440 - DNA, 18 bp, Artificial Sequence
  Synthetic DNA
ttagacgactcactttag

SEQ ID NO: 8441 - DNA, 18 bp, Artificial Sequence
  Synthetic DNA
taattcgactcaatattg

SEQ ID NO: 8442 - DNA, 18 bp, Artificial Sequence
  Synthetic DNA
taaaacgattcaccatag

SEQ ID NO: 8443 - DNA, 18 bp, Artificial Sequence
  Synthetic DNA
tattccgactcacaatag

SEQ ID NO: 8444 - DNA, 18 bp, Artificial Sequence
  Synthetic DNA
acatgcgactcactatag

SEQ ID NO: 8445 - DNA, 18 bp, Artificial Sequence
  Synthetic DNA
taatacaacccacaatag

SEQ ID NO: 8446 - DNA, 18 bp, Artificial Sequence
  Synthetic DNA
taatactacccactattg

SEQ ID NO: 8447 - DNA, 18 bp, Artificial Sequence
  Synthetic DNA
taatataattcactatag

SEQ ID NO: 8448 - DNA, 18 bp, Artificial Sequence
  Synthetic DNA
tatcacgacacactatag

SEQ ID NO: 8449 - DNA, 18 bp, Artificial Sequence
  Synthetic DNA
tattactagtcactatag

SEQ ID NO: 8450 - DNA, 18 bp, Artificial Sequence
  Synthetic DNA
taatacgatttactattg

SEQ ID NO: 8451 - DNA, 18 bp, Artificial Sequence
  Synthetic DNA
taaaactactcactttag

SEQ ID NO: 8452 - DNA, 18 bp, Artificial Sequence
  Synthetic DNA
taatacttctcactaaag

SEQ ID NO: 8453 - DNA, 18 bp, Artificial Sequence
  Synthetic DNA
tattacgtctcaatatag

SEQ ID NO: 8454 - DNA, 18 bp, Artificial Sequence
  Synthetic DNA
taaaactcctcactatag

SEQ ID NO: 8455 - DNA, 18 bp, Artificial Sequence
  Synthetic DNA
taataagactcactaacg

SEQ ID NO: 8456 - DNA, 18 bp, Artificial Sequence
  Synthetic DNA
taatacgactaattaaag

SEQ ID NO: 8457 - DNA, 18 bp, Artificial Sequence
  Synthetic DNA
taatactactccctttag

SEQ ID NO: 8458 - DNA, 18 bp, Artificial Sequence
  Synthetic DNA
tataacgactcaatatag

SEQ ID NO: 8459 - DNA, 18 bp, Artificial Sequence
  Synthetic DNA
tatttcgacccactatag

SEQ ID NO: 8460 - DNA, 18 bp, Artificial Sequence
  Synthetic DNA
tcatacgtctctctatag

SEQ ID NO: 8461 - DNA, 18 bp, Artificial Sequence
  Synthetic DNA
taatacgtatcactttag

SEQ ID NO: 8462 - DNA, 18 bp, Artificial Sequence
  Synthetic DNA
taatactacttaatatag

SEQ ID NO: 8463 - DNA, 18 bp, Artificial Sequence
  Synthetic DNA
tattacaaatcactatag

SEQ ID NO: 8464 - DNA, 18 bp, Artificial Sequence
  Synthetic DNA
taatactaatcactattg

SEQ ID NO: 8465 - DNA, 18 bp, Artificial Sequence
  Synthetic DNA
tattacgactctttatag

SEQ ID NO: 8466 - DNA, 18 bp, Artificial Sequence
  Synthetic DNA
tattacgaatctctatag

SEQ ID NO: 8467 - DNA, 18 bp, Artificial Sequence
  Synthetic DNA
taatactactctctattg

SEQ ID NO: 8468 - DNA, 18 bp, Artificial Sequence
  Synthetic DNA
tattacgactcaatttag

SEQ ID NO: 8469 - DNA, 18 bp, Artificial Sequence
  Synthetic DNA
atatacgactcaatatag

SEQ ID NO: 8470 - DNA, 18 bp, Artificial Sequence
  Synthetic DNA
taatactattcactaaag

SEQ ID NO: 8471 - DNA, 18 bp, Artificial Sequence
  Synthetic DNA
tagtacgactcacattag

SEQ ID NO: 8472 - DNA, 18 bp, Artificial Sequence
  Synthetic DNA
taatacgattccctattg

SEQ ID NO: 8473 - DNA, 18 bp, Artificial Sequence
  Synthetic DNA
tacaacgattcactatag

SEQ ID NO: 8474 - DNA, 18 bp, Artificial Sequence
  Synthetic DNA
ttatacgaatcaccatag

SEQ ID NO: 8475 - DNA, 18 bp, Artificial Sequence
  Synthetic DNA
ttatacgactcaatatgg

SEQ ID NO: 8476 - DNA, 18 bp, Artificial Sequence
  Synthetic DNA
aaacacaactcactatag

SEQ ID NO: 8477 - DNA, 18 bp, Artificial Sequence
  Synthetic DNA
aaatacacctcactatag

SEQ ID NO: 8478 - DNA, 18 bp, Artificial Sequence
  Synthetic DNA
aaatacgacctactatag

SEQ ID NO: 8479 - DNA, 18 bp, Artificial Sequence
  Synthetic DNA
taaaacgactcattatcg

SEQ ID NO: 8480 - DNA, 18 bp, Artificial Sequence
  Synthetic DNA
taatacaacccattatag

SEQ ID NO: 8481 - DNA, 18 bp, Artificial Sequence
  Synthetic DNA
taatacaactccttatag

SEQ ID NO: 8482 - DNA, 18 bp, Artificial Sequence
  Synthetic DNA
taatacgaatcaatatgg

SEQ ID NO: 8483 - DNA, 18 bp, Artificial Sequence
  Synthetic DNA
taatacgacttgctaaag

SEQ ID NO: 8484 - DNA, 18 bp, Artificial Sequence
  Synthetic DNA
taatacgattcacgaaag

SEQ ID NO: 8485 - DNA, 18 bp, Artificial Sequence
  Synthetic DNA
taatacgtgtcactacag

SEQ ID NO: 8486 - DNA, 18 bp, Artificial Sequence
  Synthetic DNA
taatactgctgactatag

SEQ ID NO: 8487 - DNA, 18 bp, Artificial Sequence
  Synthetic DNA
taatatgacacactctag

SEQ ID NO: 8488 - DNA, 18 bp, Artificial Sequence
  Synthetic DNA
taatttgactaactatag

SEQ ID NO: 8489 - DNA, 18 bp, Artificial Sequence
  Synthetic DNA
tacaacgactcattatag

SEQ ID NO: 8490 - DNA, 18 bp, Artificial Sequence
  Synthetic DNA
tactacgaatcattatag

SEQ ID NO: 8491 - DNA, 18 bp, Artificial Sequence
  Synthetic DNA
tactacgattcattatag

SEQ ID NO: 8492 - DNA, 18 bp, Artificial Sequence
  Synthetic DNA
tactactactaactatag

SEQ ID NO: 8493 - DNA, 18 bp, Artificial Sequence
  Synthetic DNA
tagtacgactcaataaag

SEQ ID NO: 8494 - DNA, 18 bp, Artificial Sequence
  Synthetic DNA
tattatgacgcactatag

SEQ ID NO: 8495 - DNA, 18 bp, Artificial Sequence
  Synthetic DNA
tcatacgaatcactttag

SEQ ID NO: 8496 - DNA, 18 bp, Artificial Sequence
  Synthetic DNA
aaacaagactcactatag

SEQ ID NO: 8497 - DNA, 18 bp, Artificial Sequence
  Synthetic DNA
aaatacgactcactaccg

SEQ ID NO: 8498 - DNA, 18 bp, Artificial Sequence
  Synthetic DNA
aaatacgactcagtacag

SEQ ID NO: 8499 - DNA, 18 bp, Artificial Sequence
  Synthetic DNA
aaatccgcctcactatag

SEQ ID NO: 8500 - DNA, 18 bp, Artificial Sequence
  Synthetic DNA
acataccactcactatag

SEQ ID NO: 8501 - DNA, 18 bp, Artificial Sequence
  Synthetic DNA
caatacaactcaatatag

SEQ ID NO: 8502 - DNA, 18 bp, Artificial Sequence
  Synthetic DNA
caatacgactcccaatag

SEQ ID NO: 8503 - DNA, 18 bp, Artificial Sequence
  Synthetic DNA
caatacgactcgatatag

SEQ ID NO: 8504 - DNA, 18 bp, Artificial Sequence
  Synthetic DNA
caatacggctcactatgg

SEQ ID NO: 8505 - DNA, 18 bp, Artificial Sequence
  Synthetic DNA
caatacgtcgcactatag

SEQ ID NO: 8506 - DNA, 18 bp, Artificial Sequence
  Synthetic DNA
cactacgactcactattg

SEQ ID NO: 8507 - DNA, 18 bp, Artificial Sequence
  Synthetic DNA
gcatacgactctctatag

SEQ ID NO: 8508 - DNA, 18 bp, Artificial Sequence
  Synthetic DNA
taaaacgactaactagag

SEQ ID NO: 8509 - DNA, 18 bp, Artificial Sequence
  Synthetic DNA
taacacgacacactacag

SEQ ID NO: 8510 - DNA, 18 bp, Artificial Sequence
  Synthetic DNA
taacacggctcactaaag

SEQ ID NO: 8511 - DNA, 18 bp, Artificial Sequence
  Synthetic DNA
taacacgtctgactatag

SEQ ID NO: 8512 - DNA, 18 bp, Artificial Sequence
  Synthetic DNA
taagacgactaactttag

SEQ ID NO: 8513 - DNA, 18 bp, Artificial Sequence
  Synthetic DNA
taagacgactcataatag

SEQ ID NO: 8514 - DNA, 18 bp, Artificial Sequence
  Synthetic DNA
taagacgagtctctatag

SEQ ID NO: 8515 - DNA, 18 bp, Artificial Sequence
  Synthetic DNA
taagacggctcactattg

SEQ ID NO: 8516 - DNA, 18 bp, Artificial Sequence
  Synthetic DNA
taagacgtctcagtatag

SEQ ID NO: 8517 - DNA, 18 bp, Artificial Sequence
  Synthetic DNA
taagactactcaatatag

SEQ ID NO: 8518 - DNA, 18 bp, Artificial Sequence
  Synthetic DNA
taagatcactcactatag

SEQ ID NO: 8519 - DNA, 18 bp, Artificial Sequence
  Synthetic DNA
taagatgaatcactatag

SEQ ID NO: 8520 - DNA, 18 bp, Artificial Sequence
  Synthetic DNA
taagctgactcactatag

SEQ ID NO: 8521 - DNA, 18 bp, Artificial Sequence
  Synthetic DNA
taataaggctcattatag

SEQ ID NO: 8522 - DNA, 18 bp, Artificial Sequence
  Synthetic DNA
taataccacttactagag

SEQ ID NO: 8523 - DNA, 18 bp, Artificial Sequence
  Synthetic DNA
taataccattcaccatag

SEQ ID NO: 8524 - DNA, 18 bp, Artificial Sequence
  Synthetic DNA
taataccatttactatag

SEQ ID NO: 8525 - DNA, 18 bp, Artificial Sequence
  Synthetic DNA
taatacgaatcaatacag

SEQ ID NO: 8526 - DNA, 18 bp, Artificial Sequence
  Synthetic DNA
taatacgaatcaccagag

SEQ ID NO: 8527 - DNA, 18 bp, Artificial Sequence
  Synthetic DNA
taatacgacgcaataaag

SEQ ID NO: 8528 - DNA, 18 bp, Artificial Sequence
  Synthetic DNA
taatacgactcattctcg

SEQ ID NO: 8529 - DNA, 18 bp, Artificial Sequence
  Synthetic DNA
taatacgactccctactg

SEQ ID NO: 8530 - DNA, 18 bp, Artificial Sequence
  Synthetic DNA
taatacgactggcaatag

SEQ ID NO: 8531 - DNA, 18 bp, Artificial Sequence
  Synthetic DNA
taatacgactgtctgtag

SEQ ID NO: 8532 - DNA, 18 bp, Artificial Sequence
  Synthetic DNA
taatacgagacgctatag

SEQ ID NO: 8533 - DNA, 18 bp, Artificial Sequence
  Synthetic DNA
taatacgagccattatag

SEQ ID NO: 8534 - DNA, 18 bp, Artificial Sequence
  Synthetic DNA
taatacgattcactaccg

SEQ ID NO: 8535 - DNA, 18 bp, Artificial Sequence
  Synthetic DNA
taatacgattcgcgatag

SEQ ID NO: 8536 - DNA, 18 bp, Artificial Sequence
  Synthetic DNA
taatacgcttcaccatag

SEQ ID NO: 8537 - DNA, 18 bp, Artificial Sequence
  Synthetic DNA
taatactacgcactattg

SEQ ID NO: 8538 - DNA, 18 bp, Artificial Sequence
  Synthetic DNA
taatactactccctatcg

SEQ ID NO: 8539 - DNA, 18 bp, Artificial Sequence
  Synthetic DNA
taatactagtaactatag

SEQ ID NO: 8540 - DNA, 18 bp, Artificial Sequence
  Synthetic DNA
taatatcactcactctag

SEQ ID NO: 8541 - DNA, 18 bp, Artificial Sequence
  Synthetic DNA
taatatgactcattgtag

SEQ ID NO: 8542 - DNA, 18 bp, Artificial Sequence
  Synthetic DNA
taatatgagtcaccatag

SEQ ID NO: 8543 - DNA, 18 bp, Artificial Sequence
  Synthetic DNA
taatccggcttactatag

SEQ ID NO: 8544 - DNA, 18 bp, Artificial Sequence
  Synthetic DNA
taatgcgaccaactatag

SEQ ID NO: 8545 - DNA, 18 bp, Artificial Sequence
  Synthetic DNA
taatgcgactcactaggg

SEQ ID NO: 8546 - DNA, 18 bp, Artificial Sequence
  Synthetic DNA
tacaaagactcactatag

SEQ ID NO: 8547 - DNA, 18 bp, Artificial Sequence
  Synthetic DNA
taccatgactcactatag

SEQ ID NO: 8548 - DNA, 18 bp, Artificial Sequence
  Synthetic DNA
tactacaacccactatag

SEQ ID NO: 8549 - DNA, 18 bp, Artificial Sequence
  Synthetic DNA
tacttcgactcactctag

SEQ ID NO: 8550 - DNA, 18 bp, Artificial Sequence
  Synthetic DNA
tagaacgactgactatag

SEQ ID NO: 8551 - DNA, 18 bp, Artificial Sequence
  Synthetic DNA
tagtacgactcactcttg

SEQ ID NO: 8552 - DNA, 18 bp, Artificial Sequence
  Synthetic DNA
tatgacgactctctatag

SEQ ID NO: 8553 - DNA, 18 bp, Artificial Sequence
  Synthetic DNA
tattacgactgaatatag

SEQ ID NO: 8554 - DNA, 18 bp, Artificial Sequence
  Synthetic DNA
tcatacaactcacgatag

SEQ ID NO: 8555 - DNA, 18 bp, Artificial Sequence
  Synthetic DNA
tcatacgactcactccag

SEQ ID NO: 8556 - DNA, 18 bp, Artificial Sequence
  Synthetic DNA
tcatacgccccactatag

SEQ ID NO: 8557 - DNA, 18 bp, Artificial Sequence
  Synthetic DNA
tgataaaactcactatag

SEQ ID NO: 8558 - DNA, 18 bp, Artificial Sequence
  Synthetic DNA
tgataagactcaccatag

SEQ ID NO: 8559 - DNA, 18 bp, Artificial Sequence
  Synthetic DNA
tgatacgactcacagtag

SEQ ID NO: 8560 - DNA, 18 bp, Artificial Sequence
  Synthetic DNA
tgatacgagttactatag

SEQ ID NO: 8561 - DNA, 18 bp, Artificial Sequence
  Synthetic DNA
tgatacgattcattatag

SEQ ID NO: 8562 - DNA, 18 bp, Artificial Sequence
  Synthetic DNA
tgctacgattcactatag

SEQ ID NO: 8563 - DNA, 18 bp, Artificial Sequence
  Synthetic DNA
ttagacgactaactatag

SEQ ID NO: 8564 - DNA, 18 bp, Artificial Sequence
  Synthetic DNA
tattacgactcacaattg

SEQ ID NO: 8565 - DNA, 18 bp, Artificial Sequence
  Synthetic DNA
aaatatgtctcactatag

SEQ ID NO: 8566 - DNA, 18 bp, Artificial Sequence
  Synthetic DNA
taataccactcaatttag

SEQ ID NO: 8567 - DNA, 18 bp, Artificial Sequence
  Synthetic DNA
taatacgactcagattag

SEQ ID NO: 8568 - DNA, 18 bp, Artificial Sequence
  Synthetic DNA
taatacgcctcattattg

SEQ ID NO: 8569 - DNA, 18 bp, Artificial Sequence
  Synthetic DNA
taatactaaacactatag

SEQ ID NO: 8570 - DNA, 18 bp, Artificial Sequence
  Synthetic DNA
tactacgacacactattg

SEQ ID NO: 8571 - DNA, 18 bp, Artificial Sequence
  Synthetic DNA
tcatacgcttcactatag

SEQ ID NO: 8572 - DNA, 18 bp, Artificial Sequence
  Synthetic DNA
ttattcgacccactatag

SEQ ID NO: 8573 - DNA, 18 bp, Artificial Sequence
  Synthetic DNA
taatacttctcactattg

SEQ ID NO: 8574 - DNA, 18 bp, Artificial Sequence
  Synthetic DNA
tacaacgactcacaatag

SEQ ID NO: 8575 - DNA, 18 bp, Artificial Sequence
  Synthetic DNA
tattacgactctctgtag

SEQ ID NO: 8576 - DNA, 18 bp, Artificial Sequence
  Synthetic DNA
tattacgatacactatag

SEQ ID NO: 8577 - DNA, 18 bp, Artificial Sequence
  Synthetic DNA
taaaacgactcacaatcg

SEQ ID NO: 8578 - DNA, 18 bp, Artificial Sequence
  Synthetic DNA
taatacgactaaatattg

SEQ ID NO: 8579 - DNA, 18 bp, Artificial Sequence
  Synthetic DNA
taatacgactctcttgag

SEQ ID NO: 8580 - DNA, 18 bp, Artificial Sequence
  Synthetic DNA
tattacgaatcattatag

SEQ ID NO: 8581 - DNA, 18 bp, Artificial Sequence
  Synthetic DNA
taatacgactctcaattg

SEQ ID NO: 8582 - DNA, 18 bp, Artificial Sequence
  Synthetic DNA
aaataagactaactatag

SEQ ID NO: 8583 - DNA, 18 bp, Artificial Sequence
  Synthetic DNA
caatacgcctcactttag

SEQ ID NO: 8584 - DNA, 18 bp, Artificial Sequence
  Synthetic DNA
taaatcgactcactatgg

SEQ ID NO: 8585 - DNA, 18 bp, Artificial Sequence
  Synthetic DNA
taatacgacactctacag

SEQ ID NO: 8586 - DNA, 18 bp, Artificial Sequence
  Synthetic DNA
taatgcgactcattattg

SEQ ID NO: 8587 - DNA, 18 bp, Artificial Sequence
  Synthetic DNA
taattcgactcacagtag

SEQ ID NO: 8588 - DNA, 18 bp, Artificial Sequence
  Synthetic DNA
taattcgacttactatcg

SEQ ID NO: 8589 - DNA, 18 bp, Artificial Sequence
  Synthetic DNA
taatttgactcaatatag

SEQ ID NO: 8590 - DNA, 18 bp, Artificial Sequence
  Synthetic DNA
ttatacgactcattatgg

SEQ ID NO: 8591 - DNA, 18 bp, Artificial Sequence
  Synthetic DNA
taattcgactcataatag

SEQ ID NO: 8592 - DNA, 18 bp, Artificial Sequence
  Synthetic DNA
taatacgacatacaatag

SEQ ID NO: 8593 - DNA, 18 bp, Artificial Sequence
  Synthetic DNA
taatatcactcactaaag

SEQ ID NO: 8594 - DNA, 18 bp, Artificial Sequence
  Synthetic DNA
tactttgactcactatag

SEQ ID NO: 8595 - DNA, 18 bp, Artificial Sequence
  Synthetic DNA
tattacgacttattatag

SEQ ID NO: 8596 - DNA, 18 bp, Artificial Sequence
  Synthetic DNA
ttatacgactgactttag

SEQ ID NO: 8597 - DNA, 18 bp, Artificial Sequence
  Synthetic DNA
aaacacgaatcactatag

SEQ ID NO: 8598 - DNA, 18 bp, Artificial Sequence
  Synthetic DNA
aaatacgactcactctgg

SEQ ID NO: 8599 - DNA, 18 bp, Artificial Sequence
  Synthetic DNA
cgatacgactcactttag

SEQ ID NO: 8600 - DNA, 18 bp, Artificial Sequence
  Synthetic DNA
gtatacgactcacaatag

SEQ ID NO: 8601 - DNA, 18 bp, Artificial Sequence
  Synthetic DNA
taaaacgactaactatcg

SEQ ID NO: 8602 - DNA, 18 bp, Artificial Sequence
  Synthetic DNA
taaaacgactcacgattg

SEQ ID NO: 8603 - DNA, 18 bp, Artificial Sequence
  Synthetic DNA
taaaacgacttaccatag

SEQ ID NO: 8604 - DNA, 18 bp, Artificial Sequence
  Synthetic DNA
taaaacgattcactacag

SEQ ID NO: 8605 - DNA, 18 bp, Artificial Sequence
  Synthetic DNA
taataagacacactatcg

SEQ ID NO: 8606 - DNA, 18 bp, Artificial Sequence
  Synthetic DNA
taatacgaatctctatgg

SEQ ID NO: 8607 - DNA, 18 bp, Artificial Sequence
  Synthetic DNA
taatacgactcgtcatag

SEQ ID NO: 8608 - DNA, 18 bp, Artificial Sequence
  Synthetic DNA
taatacgactctatgtag

SEQ ID NO: 8609 - DNA, 18 bp, Artificial Sequence
  Synthetic DNA
taatacgacttccaatag

SEQ ID NO: 8610 - DNA, 18 bp, Artificial Sequence
  Synthetic DNA
taatacgattaattatag

SEQ ID NO: 8611 - DNA, 18 bp, Artificial Sequence
  Synthetic DNA
taatactaatcgctatag

SEQ ID NO: 8612 - DNA, 18 bp, Artificial Sequence
  Synthetic DNA
taatatgaatcgctatag

SEQ ID NO: 8613 - DNA, 18 bp, Artificial Sequence
  Synthetic DNA
taatatgagtctctatag

SEQ ID NO: 8614 - DNA, 18 bp, Artificial Sequence
  Synthetic DNA
taatcccacttactatag

SEQ ID NO: 8615 - DNA, 18 bp, Artificial Sequence
  Synthetic DNA
tactacgacttaatatag

SEQ ID NO: 8616 - DNA, 18 bp, Artificial Sequence
  Synthetic DNA
tattacgactaactacag

SEQ ID NO: 8617 - DNA, 18 bp, Artificial Sequence
  Synthetic DNA
tattacgactaactgtag

SEQ ID NO: 8618 - DNA, 18 bp, Artificial Sequence
  Synthetic DNA
tcaaacgactaactatag

SEQ ID NO: 8619 - DNA, 18 bp, Artificial Sequence
  Synthetic DNA
tcatactactcaccatag

SEQ ID NO: 8620 - DNA, 18 bp, Artificial Sequence
  Synthetic DNA
tcttacgattcactatag

SEQ ID NO: 8621 - DNA, 18 bp, Artificial Sequence
  Synthetic DNA
tgatacgactctctctag

SEQ ID NO: 8622 - DNA, 18 bp, Artificial Sequence
  Synthetic DNA
tgattcgaatcactatag

SEQ ID NO: 8623 - DNA, 18 bp, Artificial Sequence
  Synthetic DNA
ttatacgactcagcatag

SEQ ID NO: 8624 - DNA, 18 bp, Artificial Sequence
  Synthetic DNA
taaaaagactcattatag

SEQ ID NO: 8625 - DNA, 18 bp, Artificial Sequence
  Synthetic DNA
taatactactaacaatag

SEQ ID NO: 8626 - DNA, 18 bp, Artificial Sequence
  Synthetic DNA
aaattcgactcacaatag

SEQ ID NO: 8627 - DNA, 18 bp, Artificial Sequence
  Synthetic DNA
taatacgattcacttaag

SEQ ID NO: 8628 - DNA, 18 bp, Artificial Sequence
  Synthetic DNA
tattacgacacactttag

SEQ ID NO: 8629 - DNA, 18 bp, Artificial Sequence
  Synthetic DNA
aaatccgactcacaatag

SEQ ID NO: 8630 - DNA, 18 bp, Artificial Sequence
  Synthetic DNA
taacactactctctatag

SEQ ID NO: 8631 - DNA, 18 bp, Artificial Sequence
  Synthetic DNA
taatacgactcgcaaaag

SEQ ID NO: 8632 - DNA, 18 bp, Artificial Sequence
  Synthetic DNA
taatacgactgaatttag

SEQ ID NO: 8633 - DNA, 18 bp, Artificial Sequence
  Synthetic DNA
taatacgccacactattg

SEQ ID NO: 8634 - DNA, 18 bp, Artificial Sequence
  Synthetic DNA
taatactactcaccttag

SEQ ID NO: 8635 - DNA, 18 bp, Artificial Sequence
  Synthetic DNA
taatatgactcaataaag

SEQ ID NO: 8636 - DNA, 18 bp, Artificial Sequence
  Synthetic DNA
tagtacgacacactttag

SEQ ID NO: 8637 - DNA, 18 bp, Artificial Sequence
  Synthetic DNA
ttattcgactcacgatag

SEQ ID NO: 8638 - DNA, 18 bp, Artificial Sequence
  Synthetic DNA
taaaacgactcacattag

SEQ ID NO: 8639 - DNA, 18 bp, Artificial Sequence
  Synthetic DNA
tattacttctcactatag

SEQ ID NO: 8640 - DNA, 18 bp, Artificial Sequence
  Synthetic DNA
taattcgaatcacaatag

SEQ ID NO: 8641 - DNA, 18 bp, Artificial Sequence
  Synthetic DNA
tcaaacgactcactattg

SEQ ID NO: 8642 - DNA, 18 bp, Artificial Sequence
  Synthetic DNA
caatacgtctcacaatag

SEQ ID NO: 8643 - DNA, 18 bp, Artificial Sequence
  Synthetic DNA
taataagtatcactatag

SEQ ID NO: 8644 - DNA, 18 bp, Artificial Sequence
  Synthetic DNA
ttatacggctcactttag

SEQ ID NO: 8645 - DNA, 18 bp, Artificial Sequence
  Synthetic DNA
ttcaacgactcactatag

SEQ ID NO: 8646 - DNA, 18 bp, Artificial Sequence
  Synthetic DNA
taatacgtctccctattg

SEQ ID NO: 8647 - DNA, 18 bp, Artificial Sequence
  Synthetic DNA
tatttcgactctctatag

SEQ ID NO: 8648 - DNA, 18 bp, Artificial Sequence
  Synthetic DNA
taatacatctcaccatag

SEQ ID NO: 8649 - DNA, 18 bp, Artificial Sequence
  Synthetic DNA
taatacgaatcataatag

SEQ ID NO: 8650 - DNA, 18 bp, Artificial Sequence
  Synthetic DNA
taatacgtatcattatag

SEQ ID NO: 8651 - DNA, 18 bp, Artificial Sequence
  Synthetic DNA
tcatatgtctcactatag

SEQ ID NO: 8652 - DNA, 18 bp, Artificial Sequence
  Synthetic DNA
aaatactactcactacag

SEQ ID NO: 8653 - DNA, 18 bp, Artificial Sequence
  Synthetic DNA
taatacgattcacagtag

SEQ ID NO: 8654 - DNA, 18 bp, Artificial Sequence
  Synthetic DNA
taatatcactcacaatag

SEQ ID NO: 8655 - DNA, 18 bp, Artificial Sequence
  Synthetic DNA
taatatgactcaccattg

SEQ ID NO: 8656 - DNA, 18 bp, Artificial Sequence
  Synthetic DNA
taattcgaatcactatgg

SEQ ID NO: 8657 - DNA, 18 bp, Artificial Sequence
  Synthetic DNA
tacttcgactcactacag

SEQ ID NO: 8658 - DNA, 18 bp, Artificial Sequence
  Synthetic DNA
tataacggctcactatag

SEQ ID NO: 8659 - DNA, 18 bp, Artificial Sequence
  Synthetic DNA
tcatacgacacactctag

SEQ ID NO: 8660 - DNA, 18 bp, Artificial Sequence
  Synthetic DNA
tcatacgacacattatag

SEQ ID NO: 8661 - DNA, 18 bp, Artificial Sequence
  Synthetic DNA
taaaacgactaaccatag

SEQ ID NO: 8662 - DNA, 18 bp, Artificial Sequence
  Synthetic DNA
taaaacggcttactatag

SEQ ID NO: 8663 - DNA, 18 bp, Artificial Sequence
  Synthetic DNA
taaaatgactcactacag

SEQ ID NO: 8664 - DNA, 18 bp, Artificial Sequence
  Synthetic DNA
taacacgtctcactatcg

SEQ ID NO: 8665 - DNA, 18 bp, Artificial Sequence
  Synthetic DNA
taataagaattactatag

SEQ ID NO: 8666 - DNA, 18 bp, Artificial Sequence
  Synthetic DNA
taatacaactcaatctag

SEQ ID NO: 8667 - DNA, 18 bp, Artificial Sequence
  Synthetic DNA
taatacgactcacctcag

SEQ ID NO: 8668 - DNA, 18 bp, Artificial Sequence
  Synthetic DNA
taatacgagtcacattag

SEQ ID NO: 8669 - DNA, 18 bp, Artificial Sequence
  Synthetic DNA
taatacgcctcataatag

SEQ ID NO: 8670 - DNA, 18 bp, Artificial Sequence
  Synthetic DNA
taatacgtctcaatgtag

SEQ ID NO: 8671 - DNA, 18 bp, Artificial Sequence
  Synthetic DNA
taatacgtctcacaagag

SEQ ID NO: 8672 - DNA, 18 bp, Artificial Sequence
  Synthetic DNA
taatatgaatcaatatag

SEQ ID NO: 8673 - DNA, 18 bp, Artificial Sequence
  Synthetic DNA
taattcaactcactatgg

SEQ ID NO: 8674 - DNA, 18 bp, Artificial Sequence
  Synthetic DNA
tactacgactcaaaatag

SEQ ID NO: 8675 - DNA, 18 bp, Artificial Sequence
  Synthetic DNA
tattaagactcactatcg

SEQ ID NO: 8676 - DNA, 18 bp, Artificial Sequence
  Synthetic DNA
tcatacagctcactatag

SEQ ID NO: 8677 - DNA, 18 bp, Artificial Sequence
  Synthetic DNA
tgataagattcactatag

SEQ ID NO: 8678 - DNA, 18 bp, Artificial Sequence
  Synthetic DNA
tgatacgactcacactag

SEQ ID NO: 8679 - DNA, 18 bp, Artificial Sequence
  Synthetic DNA
aaacacgacccactatag

SEQ ID NO: 8680 - DNA, 18 bp, Artificial Sequence
  Synthetic DNA
aaatacgactcattacag

SEQ ID NO: 8681 - DNA, 18 bp, Artificial Sequence
  Synthetic DNA
aaatacgagtcactgtag

SEQ ID NO: 8682 - DNA, 18 bp, Artificial Sequence
  Synthetic DNA
caataccactcacaatag

SEQ ID NO: 8683 - DNA, 18 bp, Artificial Sequence
  Synthetic DNA
caatacgactcacgatgg

SEQ ID NO: 8684 - DNA, 18 bp, Artificial Sequence
  Synthetic DNA
gaataagactcacaatag

SEQ ID NO: 8685 - DNA, 18 bp, Artificial Sequence
  Synthetic DNA
gaatacgaatcactttag

SEQ ID NO: 8686 - DNA, 18 bp, Artificial Sequence
  Synthetic DNA
taaaacgaatcactgtag

SEQ ID NO: 8687 - DNA, 18 bp, Artificial Sequence
  Synthetic DNA
taaaacgactcactagcg

SEQ ID NO: 8688 - DNA, 18 bp, Artificial Sequence
  Synthetic DNA
taaagcgactgactatag

SEQ ID NO: 8689 - DNA, 18 bp, Artificial Sequence
  Synthetic DNA
taaagcgagtcactatag

SEQ ID NO: 8690 - DNA, 18 bp, Artificial Sequence
  Synthetic DNA
taacacgactcatgatag

SEQ ID NO: 8691 - DNA, 18 bp, Artificial Sequence
  Synthetic DNA
taacacgactctgtatag

SEQ ID NO: 8692 - DNA, 18 bp, Artificial Sequence
  Synthetic DNA
taacacggctcactctag

SEQ ID NO: 8693 - DNA, 18 bp, Artificial Sequence
  Synthetic DNA
taacatgactcactgtag

SEQ ID NO: 8694 - DNA, 18 bp, Artificial Sequence
  Synthetic DNA
taagacgactcattctag

SEQ ID NO: 8695 - DNA, 18 bp, Artificial Sequence
  Synthetic DNA
taagaggattcactatag

SEQ ID NO: 8696 - DNA, 18 bp, Artificial Sequence
  Synthetic DNA
taatacaactgactattg

SEQ ID NO: 8697 - DNA, 18 bp, Artificial Sequence
  Synthetic DNA
taataccactcacagtag

SEQ ID NO: 8698 - DNA, 18 bp, Artificial Sequence
  Synthetic DNA
taataccactcagtaaag

SEQ ID NO: 8699 - DNA, 18 bp, Artificial Sequence
  Synthetic DNA
taatacctctcgctatag

SEQ ID NO: 8700 - DNA, 18 bp, Artificial Sequence
  Synthetic DNA
taatacgactcaccagtg

SEQ ID NO: 8701 - DNA, 18 bp, Artificial Sequence
  Synthetic DNA
taatacgacttactagtg

SEQ ID NO: 8702 - DNA, 18 bp, Artificial Sequence
  Synthetic DNA
taatacgccttactctag

SEQ ID NO: 8703 - DNA, 18 bp, Artificial Sequence
  Synthetic DNA
taatactaccgactatag

SEQ ID NO: 8704 - DNA, 18 bp, Artificial Sequence
  Synthetic DNA
taatactacgcactaaag

SEQ ID NO: 8705 - DNA, 18 bp, Artificial Sequence
  Synthetic DNA
taatactacgcattatag

SEQ ID NO: 8706 - DNA, 18 bp, Artificial Sequence
  Synthetic DNA
taataggcgtcactatag

SEQ ID NO: 8707 - DNA, 18 bp, Artificial Sequence
  Synthetic DNA
taatatgactgacaatag

SEQ ID NO: 8708 - DNA, 18 bp, Artificial Sequence
  Synthetic DNA
taatatgactgactattg

SEQ ID NO: 8709 - DNA, 18 bp, Artificial Sequence
  Synthetic DNA
taatccgaatccctatag

SEQ ID NO: 8710 - DNA, 18 bp, Artificial Sequence
  Synthetic DNA
taatgagacccactatag

SEQ ID NO: 8711 - DNA, 18 bp, Artificial Sequence
  Synthetic DNA
taatgcgactcacaagag

SEQ ID NO: 8712 - DNA, 18 bp, Artificial Sequence
  Synthetic DNA
taatgcggctctctatag

SEQ ID NO: 8713 - DNA, 18 bp, Artificial Sequence
  Synthetic DNA
taatgggattcactatag

SEQ ID NO: 8714 - DNA, 18 bp, Artificial Sequence
  Synthetic DNA
taattcgactcactcgag

SEQ ID NO: 8715 - DNA, 18 bp, Artificial Sequence
  Synthetic DNA
taatttgactgactatag

SEQ ID NO: 8716 - DNA, 18 bp, Artificial Sequence
  Synthetic DNA
tactaacactcactatag

SEQ ID NO: 8717 - DNA, 18 bp, Artificial Sequence
  Synthetic DNA
tactaccactctctatag

SEQ ID NO: 8718 - DNA, 18 bp, Artificial Sequence
  Synthetic DNA
tactacgactctctagag

SEQ ID NO: 8719 - DNA, 18 bp, Artificial Sequence
  Synthetic DNA
tactacgcctcattatag

SEQ ID NO: 8720 - DNA, 18 bp, Artificial Sequence
  Synthetic DNA
tacttcgactcacgatag

SEQ ID NO: 8721 - DNA, 18 bp, Artificial Sequence
  Synthetic DNA
tagtaaaactcactatag

SEQ ID NO: 8722 - DNA, 18 bp, Artificial Sequence
  Synthetic DNA
tagtaccactctctatag

SEQ ID NO: 8723 - DNA, 18 bp, Artificial Sequence
  Synthetic DNA
tagtacgattcactctag

SEQ ID NO: 8724 - DNA, 18 bp, Artificial Sequence
  Synthetic DNA
tagtacggctcacaatag

SEQ ID NO: 8725 - DNA, 18 bp, Artificial Sequence
  Synthetic DNA
tagtatgacttactatag

SEQ ID NO: 8726 - DNA, 18 bp, Artificial Sequence
  Synthetic DNA
tagtatgagtcactatag

SEQ ID NO: 8727 - DNA, 18 bp, Artificial Sequence
  Synthetic DNA
tattacgactcaccgtag

SEQ ID NO: 8728 - DNA, 18 bp, Artificial Sequence
  Synthetic DNA
tattacgactcagtatcg

SEQ ID NO: 8729 - DNA, 18 bp, Artificial Sequence
  Synthetic DNA
tattacgactgactagag

SEQ ID NO: 8730 - DNA, 18 bp, Artificial Sequence
  Synthetic DNA
tcatacaacgcactatag

SEQ ID NO: 8731 - DNA, 18 bp, Artificial Sequence
  Synthetic DNA
tcatacgactcacaatgg

SEQ ID NO: 8732 - DNA, 18 bp, Artificial Sequence
  Synthetic DNA
tcatacgccttactatag

SEQ ID NO: 8733 - DNA, 18 bp, Artificial Sequence
  Synthetic DNA
tcatacggctcactgtag

SEQ ID NO: 8734 - DNA, 18 bp, Artificial Sequence
  Synthetic DNA
tcatatgactcactaaag

SEQ ID NO: 8735 - DNA, 18 bp, Artificial Sequence
  Synthetic DNA
tgaaacgacccactatag

SEQ ID NO: 8736 - DNA, 18 bp, Artificial Sequence
  Synthetic DNA
tgatacgcctcattatag

SEQ ID NO: 8737 - DNA, 18 bp, Artificial Sequence
  Synthetic DNA
tgatacgtctcaccatag

SEQ ID NO: 8738 - DNA, 18 bp, Artificial Sequence
  Synthetic DNA
tgctacgactcgctatag

SEQ ID NO: 8739 - DNA, 18 bp, Artificial Sequence
  Synthetic DNA
ttatacgactcagtatgg

SEQ ID NO: 8740 - DNA, 18 bp, Artificial Sequence
  Synthetic DNA
ttatatgagtcactatag

SEQ ID NO: 8741 - DNA, 18 bp, Artificial Sequence
  Synthetic DNA
ttgtacgactcaccatag

SEQ ID NO: 8742 - DNA, 18 bp, Artificial Sequence
  Synthetic DNA
taatatgactcacaattg

SEQ ID NO: 8743 - DNA, 18 bp, Artificial Sequence
  Synthetic DNA
taattcgacttactttag

SEQ ID NO: 8744 - DNA, 18 bp, Artificial Sequence
  Synthetic DNA
ttatacgaatcactattg

SEQ ID NO: 8745 - DNA, 18 bp, Artificial Sequence
  Synthetic DNA
taatacgattcacaattg

SEQ ID NO: 8746 - DNA, 18 bp, Artificial Sequence
  Synthetic DNA
ttatacaacacactatag

SEQ ID NO: 8747 - DNA, 18 bp, Artificial Sequence
  Synthetic DNA
taatacgatacacaatag

SEQ ID NO: 8748 - DNA, 18 bp, Artificial Sequence
  Synthetic DNA
ttatacgtctccctatag

SEQ ID NO: 8749 - DNA, 18 bp, Artificial Sequence
  Synthetic DNA
taataagaatcactattg

SEQ ID NO: 8750 - DNA, 18 bp, Artificial Sequence
  Synthetic DNA
taatacgactaattttag

SEQ ID NO: 8751 - DNA, 18 bp, Artificial Sequence
  Synthetic DNA
taatatgactcattaaag

SEQ ID NO: 8752 - DNA, 18 bp, Artificial Sequence
  Synthetic DNA
taatccgattcactttag

SEQ ID NO: 8753 - DNA, 18 bp, Artificial Sequence
  Synthetic DNA
taatccgtctcactattg

SEQ ID NO: 8754 - DNA, 18 bp, Artificial Sequence
  Synthetic DNA
tattacgactcacaatcg

SEQ ID NO: 8755 - DNA, 18 bp, Artificial Sequence
  Synthetic DNA
taaaacgactctctttag

SEQ ID NO: 8756 - DNA, 18 bp, Artificial Sequence
  Synthetic DNA
taatattactcactttag

SEQ ID NO: 8757 - DNA, 18 bp, Artificial Sequence
  Synthetic DNA
ttatacgagtctctatag

SEQ ID NO: 8758 - DNA, 18 bp, Artificial Sequence
  Synthetic DNA
taatacaactttctatag

SEQ ID NO: 8759 - DNA, 18 bp, Artificial Sequence
  Synthetic DNA
ttaaacgactcattatag

SEQ ID NO: 8760 - DNA, 18 bp, Artificial Sequence
  Synthetic DNA
taaaacgactcaccttag

SEQ ID NO: 8761 - DNA, 18 bp, Artificial Sequence
  Synthetic DNA
taataagactcacaacag

SEQ ID NO: 8762 - DNA, 18 bp, Artificial Sequence
  Synthetic DNA
taatactacctactatag

SEQ ID NO: 8763 - DNA, 18 bp, Artificial Sequence
  Synthetic DNA
tcttacaactcactatag

SEQ ID NO: 8764 - DNA, 18 bp, Artificial Sequence
  Synthetic DNA
tgatacgattcactattg

SEQ ID NO: 8765 - DNA, 18 bp, Artificial Sequence
  Synthetic DNA
ttgtacaactcactatag

SEQ ID NO: 8766 - DNA, 18 bp, Artificial Sequence
  Synthetic DNA
taatacgactcacaaatg

SEQ ID NO: 8767 - DNA, 18 bp, Artificial Sequence
  Synthetic DNA
aaatacgaatcactaaag

SEQ ID NO: 8768 - DNA, 18 bp, Artificial Sequence
  Synthetic DNA
taaaatgactcacaatag

SEQ ID NO: 8769 - DNA, 18 bp, Artificial Sequence
  Synthetic DNA
tatttcgactcaatatag

SEQ ID NO: 8770 - DNA, 18 bp, Artificial Sequence
  Synthetic DNA
tattatgactctctatag

SEQ ID NO: 8771 - DNA, 18 bp, Artificial Sequence
  Synthetic DNA
taatacgtttctctatag

SEQ ID NO: 8772 - DNA, 18 bp, Artificial Sequence
  Synthetic DNA
taatactactcaataaag

SEQ ID NO: 8773 - DNA, 18 bp, Artificial Sequence
  Synthetic DNA
taattcgacacaatatag

SEQ ID NO: 8774 - DNA, 18 bp, Artificial Sequence
  Synthetic DNA
tattacgcctctctatag

SEQ ID NO: 8775 - DNA, 18 bp, Artificial Sequence
  Synthetic DNA
tattacggctcattatag

SEQ ID NO: 8776 - DNA, 18 bp, Artificial Sequence
  Synthetic DNA
tcatacgtcttactatag

SEQ ID NO: 8777 - DNA, 18 bp, Artificial Sequence
  Synthetic DNA
taaaacggctcaatatag

SEQ ID NO: 8778 - DNA, 18 bp, Artificial Sequence
  Synthetic DNA
taaaccaactcactatag

SEQ ID NO: 8779 - DNA, 18 bp, Artificial Sequence
  Synthetic DNA
taataagcctctctatag

SEQ ID NO: 8780 - DNA, 18 bp, Artificial Sequence
  Synthetic DNA
taatacaacgcactttag

SEQ ID NO: 8781 - DNA, 18 bp, Artificial Sequence
  Synthetic DNA
taatacgaataactgtag

SEQ ID NO: 8782 - DNA, 18 bp, Artificial Sequence
  Synthetic DNA
taatacgacaaactacag

SEQ ID NO: 8783 - DNA, 18 bp, Artificial Sequence
  Synthetic DNA
taatacgacgatctatag

SEQ ID NO: 8784 - DNA, 18 bp, Artificial Sequence
  Synthetic DNA
taatacgactaactcaag

SEQ ID NO: 8785 - DNA, 18 bp, Artificial Sequence
  Synthetic DNA
taatacgacttaccaaag

SEQ ID NO: 8786 - DNA, 18 bp, Artificial Sequence
  Synthetic DNA
taatacgacttagtaaag

SEQ ID NO: 8787 - DNA, 18 bp, Artificial Sequence
  Synthetic DNA
taatacgcctcaaaatag

SEQ ID NO: 8788 - DNA, 18 bp, Artificial Sequence
  Synthetic DNA
taatacggcaaactatag

SEQ ID NO: 8789 - DNA, 18 bp, Artificial Sequence
  Synthetic DNA
taatacggcatactatag

SEQ ID NO: 8790 - DNA, 18 bp, Artificial Sequence
  Synthetic DNA
taatacgtcttactacag

SEQ ID NO: 8791 - DNA, 18 bp, Artificial Sequence
  Synthetic DNA
taatatgactcagtattg

SEQ ID NO: 8792 - DNA, 18 bp, Artificial Sequence
  Synthetic DNA
taattcgagacactatag

SEQ ID NO: 8793 - DNA, 18 bp, Artificial Sequence
  Synthetic DNA
tactacgacttacaatag

SEQ ID NO: 8794 - DNA, 18 bp, Artificial Sequence
  Synthetic DNA
tagtactactcactttag

SEQ ID NO: 8795 - DNA, 18 bp, Artificial Sequence
  Synthetic DNA
tgatacgactctctatcg

SEQ ID NO: 8796 - DNA, 18 bp, Artificial Sequence
  Synthetic DNA
tgattcgactaactatag

SEQ ID NO: 8797 - DNA, 18 bp, Artificial Sequence
  Synthetic DNA
ttgtacggctcactatag

SEQ ID NO: 8798 - DNA, 18 bp, Artificial Sequence
  Synthetic DNA
tattaagtctcactatag

SEQ ID NO: 8799 - DNA, 18 bp, Artificial Sequence
  Synthetic DNA
taatactactcacaaaag

SEQ ID NO: 8800 - DNA, 18 bp, Artificial Sequence
  Synthetic DNA
tattacgacacactattg

SEQ ID NO: 8801 - DNA, 18 bp, Artificial Sequence
  Synthetic DNA
taatacaactaactttag

SEQ ID NO: 8802 - DNA, 18 bp, Artificial Sequence
  Synthetic DNA
taattcgactaactattg

SEQ ID NO: 8803 - DNA, 18 bp, Artificial Sequence
  Synthetic DNA
tagtacgactctctattg

SEQ ID NO: 8804 - DNA, 18 bp, Artificial Sequence
  Synthetic DNA
taatatgtctctctatag

SEQ ID NO: 8805 - DNA, 18 bp, Artificial Sequence
  Synthetic DNA
taatacgactaacttttg

SEQ ID NO: 8806 - DNA, 18 bp, Artificial Sequence
  Synthetic DNA
taatatgacacactaaag

SEQ ID NO: 8807 - DNA, 18 bp, Artificial Sequence
  Synthetic DNA
aaatacgacagactatag

SEQ ID NO: 8808 - DNA, 18 bp, Artificial Sequence
  Synthetic DNA
taataagattcattatag

SEQ ID NO: 8809 - DNA, 18 bp, Artificial Sequence
  Synthetic DNA
taatacaacacactatcg

SEQ ID NO: 8810 - DNA, 18 bp, Artificial Sequence
  Synthetic DNA
taatacaactcacttgag

SEQ ID NO: 8811 - DNA, 18 bp, Artificial Sequence
  Synthetic DNA
taatacggatcactaaag

SEQ ID NO: 8812 - DNA, 18 bp, Artificial Sequence
  Synthetic DNA
tattacgtcgcactatag

SEQ ID NO: 8813 - DNA, 18 bp, Artificial Sequence
  Synthetic DNA
tcatacgactatctatag

SEQ ID NO: 8814 - DNA, 18 bp, Artificial Sequence
  Synthetic DNA
ttatacgactgactattg

SEQ ID NO: 8815 - DNA, 18 bp, Artificial Sequence
  Synthetic DNA
taaaacgtcccactatag

SEQ ID NO: 8816 - DNA, 18 bp, Artificial Sequence
  Synthetic DNA
ttactcgactcactatag

SEQ ID NO: 8817 - DNA, 18 bp, Artificial Sequence
  Synthetic DNA
taatacgtctctatatag

SEQ ID NO: 8818 - DNA, 18 bp, Artificial Sequence
  Synthetic DNA
aatttcgactcactatag

SEQ ID NO: 8819 - DNA, 18 bp, Artificial Sequence
  Synthetic DNA
ttatatgactctctatag

SEQ ID NO: 8820 - DNA, 18 bp, Artificial Sequence
  Synthetic DNA
taatacgtctcacaaaag

SEQ ID NO: 8821 - DNA, 18 bp, Artificial Sequence
  Synthetic DNA
taattctactcactaaag

SEQ ID NO: 8822 - DNA, 18 bp, Artificial Sequence
  Synthetic DNA
tcatacgaatcactattg

SEQ ID NO: 8823 - DNA, 18 bp, Artificial Sequence
  Synthetic DNA
caatacgactcactaatg

SEQ ID NO: 8824 - DNA, 18 bp, Artificial Sequence
  Synthetic DNA
taatatgactcaccttag

SEQ ID NO: 8825 - DNA, 18 bp, Artificial Sequence
  Synthetic DNA
taaaacgcctcattatag

SEQ ID NO: 8826 - DNA, 18 bp, Artificial Sequence
  Synthetic DNA
taataccactcccaatag

SEQ ID NO: 8827 - DNA, 18 bp, Artificial Sequence
  Synthetic DNA
taatacgtctcgcaatag

SEQ ID NO: 8828 - DNA, 18 bp, Artificial Sequence
  Synthetic DNA
tattacgacacagtatag

SEQ ID NO: 8829 - DNA, 18 bp, Artificial Sequence
  Synthetic DNA
aaatacgaatcaccatag

SEQ ID NO: 8830 - DNA, 18 bp, Artificial Sequence
  Synthetic DNA
gaattcgactcactaaag

SEQ ID NO: 8831 - DNA, 18 bp, Artificial Sequence
  Synthetic DNA
taaaacgactagctatag

SEQ ID NO: 8832 - DNA, 18 bp, Artificial Sequence
  Synthetic DNA
taaaacgactcattatgg

SEQ ID NO: 8833 - DNA, 18 bp, Artificial Sequence
  Synthetic DNA
taagacgtctcattatag

SEQ ID NO: 8834 - DNA, 18 bp, Artificial Sequence
  Synthetic DNA
taatacaactccctaaag

SEQ ID NO: 8835 - DNA, 18 bp, Artificial Sequence
  Synthetic DNA
taatacgactcgaaatag

SEQ ID NO: 8836 - DNA, 18 bp, Artificial Sequence
  Synthetic DNA
taatacgactctttacag

SEQ ID NO: 8837 - DNA, 18 bp, Artificial Sequence
  Synthetic DNA
taatactactcacttgag

SEQ ID NO: 8838 - DNA, 18 bp, Artificial Sequence
  Synthetic DNA
taatgctactcactagag

SEQ ID NO: 8839 - DNA, 18 bp, Artificial Sequence
  Synthetic DNA
taccacgacacactatag

SEQ ID NO: 8840 - DNA, 18 bp, Artificial Sequence
  Synthetic DNA
tactacgacatactatag

SEQ ID NO: 8841 - DNA, 18 bp, Artificial Sequence
  Synthetic DNA
tagtacgactcaatttag

SEQ ID NO: 8842 - DNA, 18 bp, Artificial Sequence
  Synthetic DNA
tagtacgactcattaaag

SEQ ID NO: 8843 - DNA, 18 bp, Artificial Sequence
  Synthetic DNA
tatttcgactcagtatag

SEQ ID NO: 8844 - DNA, 18 bp, Artificial Sequence
  Synthetic DNA
tcaaacgacttactatag

SEQ ID NO: 8845 - DNA, 18 bp, Artificial Sequence
  Synthetic DNA
tgatacgtctaactatag

SEQ ID NO: 8846 - DNA, 18 bp, Artificial Sequence
  Synthetic DNA
aaatacagctcactatag

SEQ ID NO: 8847 - DNA, 18 bp, Artificial Sequence
  Synthetic DNA
agatacgactcattatag

SEQ ID NO: 8848 - DNA, 18 bp, Artificial Sequence
  Synthetic DNA
caatacgacccactattg

SEQ ID NO: 8849 - DNA, 18 bp, Artificial Sequence
  Synthetic DNA
caatacgacttgctatag

SEQ ID NO: 8850 - DNA, 18 bp, Artificial Sequence
  Synthetic DNA
caatactactcactacag

SEQ ID NO: 8851 - DNA, 18 bp, Artificial Sequence
  Synthetic DNA
caatattactcactatag

SEQ ID NO: 8852 - DNA, 18 bp, Artificial Sequence
  Synthetic DNA
ccatacgtctcactatag

SEQ ID NO: 8853 - DNA, 18 bp, Artificial Sequence
  Synthetic DNA
gaatacgaatccctatag

SEQ ID NO: 8854 - DNA, 18 bp, Artificial Sequence
  Synthetic DNA
taaaacgacacagtatag

SEQ ID NO: 8855 - DNA, 18 bp, Artificial Sequence
  Synthetic DNA
taaaacgcctccctatag

SEQ ID NO: 8856 - DNA, 18 bp, Artificial Sequence
  Synthetic DNA
taaagccactcactatag

SEQ ID NO: 8857 - DNA, 18 bp, Artificial Sequence
  Synthetic DNA
taacaagactccctatag

SEQ ID NO: 8858 - DNA, 18 bp, Artificial Sequence
  Synthetic DNA
taacaccactcactatcg

SEQ ID NO: 8859 - DNA, 18 bp, Artificial Sequence
  Synthetic DNA
taacccgactcactaaag

SEQ ID NO: 8860 - DNA, 18 bp, Artificial Sequence
  Synthetic DNA
taagacgcctctctatag

SEQ ID NO: 8861 - DNA, 18 bp, Artificial Sequence
  Synthetic DNA
taaggcgacacactatag

SEQ ID NO: 8862 - DNA, 18 bp, Artificial Sequence
  Synthetic DNA
taataacactcactctag

SEQ ID NO: 8863 - DNA, 18 bp, Artificial Sequence
  Synthetic DNA
taatacaacttagtatag

SEQ ID NO: 8864 - DNA, 18 bp, Artificial Sequence
  Synthetic DNA
taatacaacttgctatag

SEQ ID NO: 8865 - DNA, 18 bp, Artificial Sequence
  Synthetic DNA
taatacgaataacgatag

SEQ ID NO: 8866 - DNA, 18 bp, Artificial Sequence
  Synthetic DNA
taatacgaatcgttatag

SEQ ID NO: 8867 - DNA, 18 bp, Artificial Sequence
  Synthetic DNA
taatacgaatgactacag

SEQ ID NO: 8868 - DNA, 18 bp, Artificial Sequence
  Synthetic DNA
taatacgacctcctatag

SEQ ID NO: 8869 - DNA, 18 bp, Artificial Sequence
  Synthetic DNA
taatacgactcacaacgg

SEQ ID NO: 8870 - DNA, 18 bp, Artificial Sequence
  Synthetic DNA
taatacgactcattagtg

SEQ ID NO: 8871 - DNA, 18 bp, Artificial Sequence
  Synthetic DNA
taatacgactccctcaag

SEQ ID NO: 8872 - DNA, 18 bp, Artificial Sequence
  Synthetic DNA
taatacgacttaatgtag

SEQ ID NO: 8873 - DNA, 18 bp, Artificial Sequence
  Synthetic DNA
taatacgagtcattctag

SEQ ID NO: 8874 - DNA, 18 bp, Artificial Sequence
  Synthetic DNA
taatacgatggactatag

SEQ ID NO: 8875 - DNA, 18 bp, Artificial Sequence
  Synthetic DNA
taatacgattcacgttag

SEQ ID NO: 8876 - DNA, 18 bp, Artificial Sequence
  Synthetic DNA
taatacgattgactaaag

SEQ ID NO: 8877 - DNA, 18 bp, Artificial Sequence
  Synthetic DNA
taatacgattgattatag

SEQ ID NO: 8878 - DNA, 18 bp, Artificial Sequence
  Synthetic DNA
taatacgccgcacaatag

SEQ ID NO: 8879 - DNA, 18 bp, Artificial Sequence
  Synthetic DNA
taatacgcctctctctag

SEQ ID NO: 8880 - DNA, 18 bp, Artificial Sequence
  Synthetic DNA
taatacggcacaccatag

SEQ ID NO: 8881 - DNA, 18 bp, Artificial Sequence
  Synthetic DNA
taatactaatcagtatag

SEQ ID NO: 8882 - DNA, 18 bp, Artificial Sequence
  Synthetic DNA
taataggattcactctag

SEQ ID NO: 8883 - DNA, 18 bp, Artificial Sequence
  Synthetic DNA
taatatgactcagaatag

SEQ ID NO: 8884 - DNA, 18 bp, Artificial Sequence
  Synthetic DNA
taatatgagtcactacag

SEQ ID NO: 8885 - DNA, 18 bp, Artificial Sequence
  Synthetic DNA
taatccgacccaccatag

SEQ ID NO: 8886 - DNA, 18 bp, Artificial Sequence
  Synthetic DNA
taatcgaactcactatag

SEQ ID NO: 8887 - DNA, 18 bp, Artificial Sequence
  Synthetic DNA
taatgcgaaccactatag

SEQ ID NO: 8888 - DNA, 18 bp, Artificial Sequence
  Synthetic DNA
taatgcgaatgactatag

SEQ ID NO: 8889 - DNA, 18 bp, Artificial Sequence
  Synthetic DNA
tagtacgactcagtattg

SEQ ID NO: 8890 - DNA, 18 bp, Artificial Sequence
  Synthetic DNA
tagtacgcctcactattg

SEQ ID NO: 8891 - DNA, 18 bp, Artificial Sequence
  Synthetic DNA
tagtacgtctcaccatag

SEQ ID NO: 8892 - DNA, 18 bp, Artificial Sequence
  Synthetic DNA
tcatacgactcaccaaag

SEQ ID NO: 8893 - DNA, 18 bp, Artificial Sequence
  Synthetic DNA
tcatacgactcactggag

SEQ ID NO: 8894 - DNA, 18 bp, Artificial Sequence
  Synthetic DNA
tcatacgactcatcatag

SEQ ID NO: 8895 - DNA, 18 bp, Artificial Sequence
  Synthetic DNA
tcatacgactccgtatag

SEQ ID NO: 8896 - DNA, 18 bp, Artificial Sequence
  Synthetic DNA
tcatccgactcaatatag

SEQ ID NO: 8897 - DNA, 18 bp, Artificial Sequence
  Synthetic DNA
tcattcgactaactatag

SEQ ID NO: 8898 - DNA, 18 bp, Artificial Sequence
  Synthetic DNA
tgatacgattcaccatag

SEQ ID NO: 8899 - DNA, 18 bp, Artificial Sequence
  Synthetic DNA
tgatagtactcactatag

SEQ ID NO: 8900 - DNA, 18 bp, Artificial Sequence
  Synthetic DNA
tggaacgactcactatag

SEQ ID NO: 8901 - DNA, 18 bp, Artificial Sequence
  Synthetic DNA
ttagacgaatcactatag

SEQ ID NO: 8902 - DNA, 18 bp, Artificial Sequence
  Synthetic DNA
ttatacgatgcactatag

SEQ ID NO: 8903 - DNA, 18 bp, Artificial Sequence
  Synthetic DNA
ttatatgacacactatag

SEQ ID NO: 8904 - DNA, 18 bp, Artificial Sequence
  Synthetic DNA
taatatgactctcaatag

SEQ ID NO: 8905 - DNA, 18 bp, Artificial Sequence
  Synthetic DNA
taatacttcacactatag

SEQ ID NO: 8906 - DNA, 18 bp, Artificial Sequence
  Synthetic DNA
taattctactcactattg

SEQ ID NO: 8907 - DNA, 18 bp, Artificial Sequence
  Synthetic DNA
taacacgtttcactatag

SEQ ID NO: 8908 - DNA, 18 bp, Artificial Sequence
  Synthetic DNA
taatacgaccctctttag

SEQ ID NO: 8909 - DNA, 18 bp, Artificial Sequence
  Synthetic DNA
taatactacaaactatag

SEQ ID NO: 8910 - DNA, 18 bp, Artificial Sequence
  Synthetic DNA
tattacgattgactatag

SEQ ID NO: 8911 - DNA, 18 bp, Artificial Sequence
  Synthetic DNA
taattcgattcactattg

SEQ ID NO: 8912 - DNA, 18 bp, Artificial Sequence
  Synthetic DNA
taatacgactcttaatag

SEQ ID NO: 8913 - DNA, 18 bp, Artificial Sequence
  Synthetic DNA
taataagtctcattatag

SEQ ID NO: 8914 - DNA, 18 bp, Artificial Sequence
  Synthetic DNA
taatacgacatgctatag

SEQ ID NO: 8915 - DNA, 18 bp, Artificial Sequence
  Synthetic DNA
taatacgacccacttttg

SEQ ID NO: 8916 - DNA, 18 bp, Artificial Sequence
  Synthetic DNA
taatatgatttactatag

SEQ ID NO: 8917 - DNA, 18 bp, Artificial Sequence
  Synthetic DNA
tagaacgactcactattg

SEQ ID NO: 8918 - DNA, 18 bp, Artificial Sequence
  Synthetic DNA
tattacggatcactatag

SEQ ID NO: 8919 - DNA, 18 bp, Artificial Sequence
  Synthetic DNA
ttctacgacacactatag

SEQ ID NO: 8920 - DNA, 18 bp, Artificial Sequence
  Synthetic DNA
ttattcgactcaatatag

SEQ ID NO: 8921 - DNA, 18 bp, Artificial Sequence
  Synthetic DNA
ctatacgactctctatag

SEQ ID NO: 8922 - DNA, 18 bp, Artificial Sequence
  Synthetic DNA
taaaaccactcactattg

SEQ ID NO: 8923 - DNA, 18 bp, Artificial Sequence
  Synthetic DNA
ttatacctctcactatag

SEQ ID NO: 8924 - DNA, 18 bp, Artificial Sequence
  Synthetic DNA
aaatacatctcactatag

SEQ ID NO: 8925 - DNA, 18 bp, Artificial Sequence
  Synthetic DNA
taataagattcacaatag

SEQ ID NO: 8926 - DNA, 18 bp, Artificial Sequence
  Synthetic DNA
taatacgattcataatag

SEQ ID NO: 8927 - DNA, 18 bp, Artificial Sequence
  Synthetic DNA
taatactactaattatag

SEQ ID NO: 8928 - DNA, 18 bp, Artificial Sequence
  Synthetic DNA
ttatacgacttaccatag

SEQ ID NO: 8929 - DNA, 18 bp, Artificial Sequence
  Synthetic DNA
ttattcgactccctatag

SEQ ID NO: 8930 - DNA, 18 bp, Artificial Sequence
  Synthetic DNA
aaatacgactcactcttg

SEQ ID NO: 8931 - DNA, 18 bp, Artificial Sequence
  Synthetic DNA
aaatatgactcaccatag

SEQ ID NO: 8932 - DNA, 18 bp, Artificial Sequence
  Synthetic DNA
aattacgaatcactatag

SEQ ID NO: 8933 - DNA, 18 bp, Artificial Sequence
  Synthetic DNA
caatacgactcattttag

SEQ ID NO: 8934 - DNA, 18 bp, Artificial Sequence
  Synthetic DNA
taatacaaatcaccatag

SEQ ID NO: 8935 - DNA, 18 bp, Artificial Sequence
  Synthetic DNA
taatacgacttactcttg

SEQ ID NO: 8936 - DNA, 18 bp, Artificial Sequence
  Synthetic DNA
taatacgatccacaatag

SEQ ID NO: 8937 - DNA, 18 bp, Artificial Sequence
  Synthetic DNA
taatactactccctacag

SEQ ID NO: 8938 - DNA, 18 bp, Artificial Sequence
  Synthetic DNA
taatccaactcaatatag

SEQ ID NO: 8939 - DNA, 18 bp, Artificial Sequence
  Synthetic DNA
taatgcgattcactgtag

SEQ ID NO: 8940 - DNA, 18 bp, Artificial Sequence
  Synthetic DNA
tactacgtctcactatgg

SEQ ID NO: 8941 - DNA, 18 bp, Artificial Sequence
  Synthetic DNA
tattaagactcaccatag

SEQ ID NO: 8942 - DNA, 18 bp, Artificial Sequence
  Synthetic DNA
ttgtacgactcattatag

SEQ ID NO: 8943 - DNA, 18 bp, Artificial Sequence
  Synthetic DNA
taaaacgactctctattg

SEQ ID NO: 8944 - DNA, 18 bp, Artificial Sequence
  Synthetic DNA
taaatctactcactatag

SEQ ID NO: 8945 - DNA, 18 bp, Artificial Sequence
  Synthetic DNA
ttatactgctcactatag

SEQ ID NO: 8946 - DNA, 18 bp, Artificial Sequence
  Synthetic DNA
taatacgactcattaatg

SEQ ID NO: 8947 - DNA, 18 bp, Artificial Sequence
  Synthetic DNA
aaatactacacactatag

SEQ ID NO: 8948 - DNA, 18 bp, Artificial Sequence
  Synthetic DNA
taaaacgacttaatatag

SEQ ID NO: 8949 - DNA, 18 bp, Artificial Sequence
  Synthetic DNA
taaaacggctctctatag

SEQ ID NO: 8950 - DNA, 18 bp, Artificial Sequence
  Synthetic DNA
taacacgactctttatag

SEQ ID NO: 8951 - DNA, 18 bp, Artificial Sequence
  Synthetic DNA
taatacaaaacactatag

SEQ ID NO: 8952 - DNA, 18 bp, Artificial Sequence
  Synthetic DNA
taatacaacttactatcg

SEQ ID NO: 8953 - DNA, 18 bp, Artificial Sequence
  Synthetic DNA
taataccactctccatag

SEQ ID NO: 8954 - DNA, 18 bp, Artificial Sequence
  Synthetic DNA
tgaaatgactcactatag

SEQ ID NO: 8955 - DNA, 18 bp, Artificial Sequence
  Synthetic DNA
tgattcgactctctatag

SEQ ID NO: 8956 - DNA, 18 bp, Artificial Sequence
  Synthetic DNA
ttatacgactcaccacag

SEQ ID NO: 8957 - DNA, 18 bp, Artificial Sequence
  Synthetic DNA
ttatatgactcactatgg

SEQ ID NO: 8958 - DNA, 18 bp, Artificial Sequence
  Synthetic DNA
taatactacacactattg

SEQ ID NO: 8959 - DNA, 18 bp, Artificial Sequence
  Synthetic DNA
tattacatctcactatag

SEQ ID NO: 8960 - DNA, 18 bp, Artificial Sequence
  Synthetic DNA
caatacgtcacactatag

SEQ ID NO: 8961 - DNA, 18 bp, Artificial Sequence
  Synthetic DNA
taatacgactctatacag

SEQ ID NO: 8962 - DNA, 18 bp, Artificial Sequence
  Synthetic DNA
taatacgtctgactttag

SEQ ID NO: 8963 - DNA, 18 bp, Artificial Sequence
  Synthetic DNA
taatccgactcactaatg

SEQ ID NO: 8964 - DNA, 18 bp, Artificial Sequence
  Synthetic DNA
taatgcttctcactatag

SEQ ID NO: 8965 - DNA, 18 bp, Artificial Sequence
  Synthetic DNA
tcaaactactcactatag

SEQ ID NO: 8966 - DNA, 18 bp, Artificial Sequence
  Synthetic DNA
tgaaacgacacactatag

SEQ ID NO: 8967 - DNA, 18 bp, Artificial Sequence
  Synthetic DNA
taatacgactctcattag

SEQ ID NO: 8968 - DNA, 18 bp, Artificial Sequence
  Synthetic DNA
taatacgtttcactattg

SEQ ID NO: 8969 - DNA, 18 bp, Artificial Sequence
  Synthetic DNA
tattacgacacactatgg

SEQ ID NO: 8970 - DNA, 18 bp, Artificial Sequence
  Synthetic DNA
ttaaacgacttactatag

SEQ ID NO: 8971 - DNA, 18 bp, Artificial Sequence
  Synthetic DNA
caatacgtctctctatag

SEQ ID NO: 8972 - DNA, 18 bp, Artificial Sequence
  Synthetic DNA
aagtacgactcaatatag

SEQ ID NO: 8973 - DNA, 18 bp, Artificial Sequence
  Synthetic DNA
taaaacgacttactatcg

SEQ ID NO: 8974 - DNA, 18 bp, Artificial Sequence
  Synthetic DNA
taaaaggattcactatag

SEQ ID NO: 8975 - DNA, 18 bp, Artificial Sequence
  Synthetic DNA
taagacgactcacaacag

SEQ ID NO: 8976 - DNA, 18 bp, Artificial Sequence
  Synthetic DNA
taataagcctcattatag

SEQ ID NO: 8977 - DNA, 18 bp, Artificial Sequence
  Synthetic DNA
taatacaaatcactctag

SEQ ID NO: 8978 - DNA, 18 bp, Artificial Sequence
  Synthetic DNA
taatacaacccactaaag

SEQ ID NO: 8979 - DNA, 18 bp, Artificial Sequence
  Synthetic DNA
taatacaactcgttatag

SEQ ID NO: 8980 - DNA, 18 bp, Artificial Sequence
  Synthetic DNA
taatacaagtcactacag

SEQ ID NO: 8981 - DNA, 18 bp, Artificial Sequence
  Synthetic DNA
taatacgaccaactaaag

SEQ ID NO: 8982 - DNA, 18 bp, Artificial Sequence
  Synthetic DNA
taatacgacttaatacag

SEQ ID NO: 8983 - DNA, 18 bp, Artificial Sequence
  Synthetic DNA
taatactactctgtatag

SEQ ID NO: 8984 - DNA, 18 bp, Artificial Sequence
  Synthetic DNA
taatatgaatcactacag

SEQ ID NO: 8985 - DNA, 18 bp, Artificial Sequence
  Synthetic DNA
taatgcgacactctatag

SEQ ID NO: 8986 - DNA, 18 bp, Artificial Sequence
  Synthetic DNA
taatgcgactcaatgtag

SEQ ID NO: 8987 - DNA, 18 bp, Artificial Sequence
  Synthetic DNA
taattctactcactacag

SEQ ID NO: 8988 - DNA, 18 bp, Artificial Sequence
  Synthetic DNA
tagtacaactctctatag

SEQ ID NO: 8989 - DNA, 18 bp, Artificial Sequence
  Synthetic DNA
tattaccactccctatag

SEQ ID NO: 8990 - DNA, 18 bp, Artificial Sequence
  Synthetic DNA
tattacgactagctatag

SEQ ID NO: 8991 - DNA, 18 bp, Artificial Sequence
  Synthetic DNA
tattacgactcattctag

SEQ ID NO: 8992 - DNA, 18 bp, Artificial Sequence
  Synthetic DNA
ttatacgattcagtatag

SEQ ID NO: 8993 - DNA, 18 bp, Artificial Sequence
  Synthetic DNA
aaatacgagtcaccatag

SEQ ID NO: 8994 - DNA, 18 bp, Artificial Sequence
  Synthetic DNA
aactacgactaactatag

SEQ ID NO: 8995 - DNA, 18 bp, Artificial Sequence
  Synthetic DNA
aactacgactcaatatag

SEQ ID NO: 8996 - DNA, 18 bp, Artificial Sequence
  Synthetic DNA
agatacgacccactatag

SEQ ID NO: 8997 - DNA, 18 bp, Artificial Sequence
  Synthetic DNA
caatacgaatcacaatag

SEQ ID NO: 8998 - DNA, 18 bp, Artificial Sequence
  Synthetic DNA
caatacgactcacgattg

SEQ ID NO: 8999 - DNA, 18 bp, Artificial Sequence
  Synthetic DNA
caatacgtctcacgatag

SEQ ID NO: 9000 - DNA, 18 bp, Artificial Sequence
  Synthetic DNA
cgatacgtctcactatag

SEQ ID NO: 9001 - DNA, 18 bp, Artificial Sequence
  Synthetic DNA
cgatactactcactatag

SEQ ID NO: 9002 - DNA, 18 bp, Artificial Sequence
  Synthetic DNA
taacacgacacactatgg

SEQ ID NO: 9003 - DNA, 18 bp, Artificial Sequence
  Synthetic DNA
taacacgactcaatattg

SEQ ID NO: 9004 - DNA, 18 bp, Artificial Sequence
  Synthetic DNA
taacacgactctctagag

SEQ ID NO: 9005 - DNA, 18 bp, Artificial Sequence
  Synthetic DNA
taacccgagtcactatag

SEQ ID NO: 9006 - DNA, 18 bp, Artificial Sequence
  Synthetic DNA
taagacgacacaccatag

SEQ ID NO: 9007 - DNA, 18 bp, Artificial Sequence
  Synthetic DNA
taataagacgcactttag

SEQ ID NO: 9008 - DNA, 18 bp, Artificial Sequence
  Synthetic DNA
taataagactcaccctag

SEQ ID NO: 9009 - DNA, 18 bp, Artificial Sequence
  Synthetic DNA
taataagactcattatgg

SEQ ID NO: 9010 - DNA, 18 bp, Artificial Sequence
  Synthetic DNA
taatacaactcagtatcg

SEQ ID NO: 9011 - DNA, 18 bp, Artificial Sequence
  Synthetic DNA
taatacaactcagtctag

SEQ ID NO: 9012 - DNA, 18 bp, Artificial Sequence
  Synthetic DNA
taatacacctcacaatag

SEQ ID NO: 9013 - DNA, 18 bp, Artificial Sequence
  Synthetic DNA
taatacacctcactacag

SEQ ID NO: 9014 - DNA, 18 bp, Artificial Sequence
  Synthetic DNA
taataccactcagtctag

SEQ ID NO: 9015 - DNA, 18 bp, Artificial Sequence
  Synthetic DNA
taataccacttacgatag

SEQ ID NO: 9016 - DNA, 18 bp, Artificial Sequence
  Synthetic DNA
taatacccctcactaaag

SEQ ID NO: 9017 - DNA, 18 bp, Artificial Sequence
  Synthetic DNA
taatacctctcacgatag

SEQ ID NO: 9018 - DNA, 18 bp, Artificial Sequence
  Synthetic DNA
taatacctctcactgtag

SEQ ID NO: 9019 - DNA, 18 bp, Artificial Sequence
  Synthetic DNA
taatacgaatctcgatag

SEQ ID NO: 9020 - DNA, 18 bp, Artificial Sequence
  Synthetic DNA
taatacgaatctgtatag

SEQ ID NO: 9021 - DNA, 18 bp, Artificial Sequence
  Synthetic DNA
taatacgacaccctagag

SEQ ID NO: 9022 - DNA, 18 bp, Artificial Sequence
  Synthetic DNA
taatacgaccaaatatag

SEQ ID NO: 9023 - DNA, 18 bp, Artificial Sequence
  Synthetic DNA
taatacgacccactgttg

SEQ ID NO: 9024 - DNA, 18 bp, Artificial Sequence
  Synthetic DNA
taatacgacccagaatag

SEQ ID NO: 9025 - DNA, 18 bp, Artificial Sequence
  Synthetic DNA
taatacgactaagcatag

SEQ ID NO: 9026 - DNA, 18 bp, Artificial Sequence
  Synthetic DNA
taatacgactcaccgttg

SEQ ID NO: 9027 - DNA, 18 bp, Artificial Sequence
  Synthetic DNA
taatacgactcaccttcg

SEQ ID NO: 9028 - DNA, 18 bp, Artificial Sequence
  Synthetic DNA
taatacgacttacgttag

SEQ ID NO: 9029 - DNA, 18 bp, Artificial Sequence
  Synthetic DNA
taatacgattccctatcg

SEQ ID NO: 9030 - DNA, 18 bp, Artificial Sequence
  Synthetic DNA
taatacgcctcacaacag

SEQ ID NO: 9031 - DNA, 18 bp, Artificial Sequence
  Synthetic DNA
taatacggctgattatag

SEQ ID NO: 9032 - DNA, 18 bp, Artificial Sequence
  Synthetic DNA
taatactaatcactatcg

SEQ ID NO: 9033 - DNA, 18 bp, Artificial Sequence
  Synthetic DNA
taatactactcaccatcg

SEQ ID NO: 9034 - DNA, 18 bp, Artificial Sequence
  Synthetic DNA
taatactacttacgatag

SEQ ID NO: 9035 - DNA, 18 bp, Artificial Sequence
  Synthetic DNA
taatactagtccctatag

SEQ ID NO: 9036 - DNA, 18 bp, Artificial Sequence
  Synthetic DNA
taatatggctcattatag

SEQ ID NO: 9037 - DNA, 18 bp, Artificial Sequence
  Synthetic DNA
taatccgacttactatcg

SEQ ID NO: 9038 - DNA, 18 bp, Artificial Sequence
  Synthetic DNA
taatgccactcaatatag

SEQ ID NO: 9039 - DNA, 18 bp, Artificial Sequence
  Synthetic DNA
taatgcgattcactacag

SEQ ID NO: 9040 - DNA, 18 bp, Artificial Sequence
  Synthetic DNA
taatgctactcactacag

SEQ ID NO: 9041 - DNA, 18 bp, Artificial Sequence
  Synthetic DNA
taattcgactgaccatag

SEQ ID NO: 9042 - DNA, 18 bp, Artificial Sequence
  Synthetic DNA
tactacgtctcagtatag

SEQ ID NO: 9043 - DNA, 18 bp, Artificial Sequence
  Synthetic DNA
tacttcgaatcactatag

SEQ ID NO: 9044 - DNA, 18 bp, Artificial Sequence
  Synthetic DNA
tagaaccactcactatag

SEQ ID NO: 9045 - DNA, 18 bp, Artificial Sequence
  Synthetic DNA
tagcacgaatcactatag

SEQ ID NO: 9046 - DNA, 18 bp, Artificial Sequence
  Synthetic DNA
tagtacgactcatcatag

SEQ ID NO: 9047 - DNA, 18 bp, Artificial Sequence
  Synthetic DNA
tagtacgatttactatag

SEQ ID NO: 9048 - DNA, 18 bp, Artificial Sequence
  Synthetic DNA
tagtatgaatcactatag

SEQ ID NO: 9049 - DNA, 18 bp, Artificial Sequence
  Synthetic DNA
tagtgagactcactatag

SEQ ID NO: 9050 - DNA, 18 bp, Artificial Sequence
  Synthetic DNA
tgatacgactcactaagg

SEQ ID NO: 9051 - DNA, 18 bp, Artificial Sequence
  Synthetic DNA
ttagacgacacactatag

SEQ ID NO: 9052 - DNA, 18 bp, Artificial Sequence
  Synthetic DNA
ttagacgactcacaatag

SEQ ID NO: 9053 - DNA, 18 bp, Artificial Sequence
  Synthetic DNA
ttttacgattcactatag

SEQ ID NO: 9054 - DNA, 18 bp, Artificial Sequence
  Synthetic DNA
ttgttcgactcactatag

SEQ ID NO: 9055 - DNA, 18 bp, Artificial Sequence
  Synthetic DNA
aaatacgactccctattg

SEQ ID NO: 9056 - DNA, 18 bp, Artificial Sequence
  Synthetic DNA
aaattcgacccactatag

SEQ ID NO: 9057 - DNA, 18 bp, Artificial Sequence
  Synthetic DNA
atatacgcctcactatag

SEQ ID NO: 9058 - DNA, 18 bp, Artificial Sequence
  Synthetic DNA
taaagcgacttactatag

SEQ ID NO: 9059 - DNA, 18 bp, Artificial Sequence
  Synthetic DNA
taataagaatcattatag

SEQ ID NO: 9060 - DNA, 18 bp, Artificial Sequence
  Synthetic DNA
taataagatacactatag

SEQ ID NO: 9061 - DNA, 18 bp, Artificial Sequence
  Synthetic DNA
taataccacacattatag

SEQ ID NO: 9062 - DNA, 18 bp, Artificial Sequence
  Synthetic DNA
tattacgagtcactttag

SEQ ID NO: 9063 - DNA, 18 bp, Artificial Sequence
  Synthetic DNA
ttaaaccactcactatag

SEQ ID NO: 9064 - DNA, 18 bp, Artificial Sequence
  Synthetic DNA
ttaaactactcactatag

SEQ ID NO: 9065 - DNA, 18 bp, Artificial Sequence
  Synthetic DNA
aaaaacgactcacaatag

SEQ ID NO: 9066 - DNA, 18 bp, Artificial Sequence
  Synthetic DNA
tacttcgactcactttag

SEQ ID NO: 9067 - DNA, 18 bp, Artificial Sequence
  Synthetic DNA
aaatacgactctctttag

SEQ ID NO: 9068 - DNA, 18 bp, Artificial Sequence
  Synthetic DNA
ttatacgagtcactttag

SEQ ID NO: 9069 - DNA, 18 bp, Artificial Sequence
  Synthetic DNA
tataaccactcactatag

SEQ ID NO: 9070 - DNA, 18 bp, Artificial Sequence
  Synthetic DNA
tatttcgattcactatag

SEQ ID NO: 9071 - DNA, 18 bp, Artificial Sequence
  Synthetic DNA
taacatgattcactatag

SEQ ID NO: 9072 - DNA, 18 bp, Artificial Sequence
  Synthetic DNA
taataagtctcaatatag

SEQ ID NO: 9073 - DNA, 18 bp, Artificial Sequence
  Synthetic DNA
taatacaactaattatag

SEQ ID NO: 9074 - DNA, 18 bp, Artificial Sequence
  Synthetic DNA
tcaaacgactctctatag

SEQ ID NO: 9075 - DNA, 18 bp, Artificial Sequence
  Synthetic DNA
taaaacgacttactattg

SEQ ID NO: 9076 - DNA, 18 bp, Artificial Sequence
  Synthetic DNA
ttttacgacttactatag

SEQ ID NO: 9077 - DNA, 18 bp, Artificial Sequence
  Synthetic DNA
taatacgattcacattag

SEQ ID NO: 9078 - DNA, 18 bp, Artificial Sequence
  Synthetic DNA
taataagacacactttag

SEQ ID NO: 9079 - DNA, 18 bp, Artificial Sequence
  Synthetic DNA
taatacaacacactttag

SEQ ID NO: 9080 - DNA, 18 bp, Artificial Sequence
  Synthetic DNA
aaaaacgtctcactatag

SEQ ID NO: 9081 - DNA, 18 bp, Artificial Sequence
  Synthetic DNA
ttatacgactcaccaaag

SEQ ID NO: 9082 - DNA, 18 bp, Artificial Sequence
  Synthetic DNA
aaatacgtctcaccatag

SEQ ID NO: 9083 - DNA, 18 bp, Artificial Sequence
  Synthetic DNA
taatatgaatcactattg

SEQ ID NO: 9084 - DNA, 18 bp, Artificial Sequence
  Synthetic DNA
taatatgactttctatag

SEQ ID NO: 9085 - DNA, 18 bp, Artificial Sequence
  Synthetic DNA
aaagacaactcactatag

SEQ ID NO: 9086 - DNA, 18 bp, Artificial Sequence
  Synthetic DNA
aaatacgactgacaatag

SEQ ID NO: 9087 - DNA, 18 bp, Artificial Sequence
  Synthetic DNA
caaaacgaatcactatag

SEQ ID NO: 9088 - DNA, 18 bp, Artificial Sequence
  Synthetic DNA
caataggactcactaaag

SEQ ID NO: 9089 - DNA, 18 bp, Artificial Sequence
  Synthetic DNA
taaaacgacccactctag

SEQ ID NO: 9090 - DNA, 18 bp, Artificial Sequence
  Synthetic DNA
taataaaactcattatag

SEQ ID NO: 9091 - DNA, 18 bp, Artificial Sequence
  Synthetic DNA
taatacaaccaactatag

SEQ ID NO: 9092 - DNA, 18 bp, Artificial Sequence
  Synthetic DNA
taatacgacactgtatag

SEQ ID NO: 9093 - DNA, 18 bp, Artificial Sequence
  Synthetic DNA
taatacggttcactaaag

SEQ ID NO: 9094 - DNA, 18 bp, Artificial Sequence
  Synthetic DNA
tagtaagactcacaatag

SEQ ID NO: 9095 - DNA, 18 bp, Artificial Sequence
  Synthetic DNA
tattagtactcactatag

SEQ ID NO: 9096 - DNA, 18 bp, Artificial Sequence
  Synthetic DNA
tcataagacttactatag

SEQ ID NO: 9097 - DNA, 18 bp, Artificial Sequence
  Synthetic DNA
tcatactacacactatag

SEQ ID NO: 9098 - DNA, 18 bp, Artificial Sequence
  Synthetic DNA
ttacaccactcactatag

SEQ ID NO: 9099 - DNA, 18 bp, Artificial Sequence
  Synthetic DNA
ttatacgactaacgatag

SEQ ID NO: 9100 - DNA, 18 bp, Artificial Sequence
  Synthetic DNA
ttatacgactcaccatgg

SEQ ID NO: 9101 - DNA, 18 bp, Artificial Sequence
  Synthetic DNA
taatacttctctctatag

SEQ ID NO: 9102 - DNA, 18 bp, Artificial Sequence
  Synthetic DNA
ttatactattcactatag

SEQ ID NO: 9103 - DNA, 18 bp, Artificial Sequence
  Synthetic DNA
taattcgattcactaaag

SEQ ID NO: 9104 - DNA, 18 bp, Artificial Sequence
  Synthetic DNA
aattacgactctctatag

SEQ ID NO: 9105 - DNA, 18 bp, Artificial Sequence
  Synthetic DNA
taatacgtcacactaaag

SEQ ID NO: 9106 - DNA, 18 bp, Artificial Sequence
  Synthetic DNA
taatacgtctctttatag

SEQ ID NO: 9107 - DNA, 18 bp, Artificial Sequence
  Synthetic DNA
aaattcgacacactatag

SEQ ID NO: 9108 - DNA, 18 bp, Artificial Sequence
  Synthetic DNA
taaaccgaatcactatag

SEQ ID NO: 9109 - DNA, 18 bp, Artificial Sequence
  Synthetic DNA
taacccgactcactattg

SEQ ID NO: 9110 - DNA, 18 bp, Artificial Sequence
  Synthetic DNA
taatgcgtctcattatag

SEQ ID NO: 9111 - DNA, 18 bp, Artificial Sequence
  Synthetic DNA
tattacaactaactatag

SEQ ID NO: 9112 - DNA, 18 bp, Artificial Sequence
  Synthetic DNA
tcatacgattcactaaag

SEQ ID NO: 9113 - DNA, 18 bp, Artificial Sequence
  Synthetic DNA
taatacgtttcattatag

SEQ ID NO: 9114 - DNA, 18 bp, Artificial Sequence
  Synthetic DNA
tattacgactaactaaag

SEQ ID NO: 9115 - DNA, 18 bp, Artificial Sequence
  Synthetic DNA
ttatacgacttaatatag

SEQ ID NO: 9116 - DNA, 18 bp, Artificial Sequence
  Synthetic DNA
aaatacgacacactattg

SEQ ID NO: 9117 - DNA, 18 bp, Artificial Sequence
  Synthetic DNA
tagtacgtctcactaaag

SEQ ID NO: 9118 - DNA, 18 bp, Artificial Sequence
  Synthetic DNA
taatacgtattactatag

SEQ ID NO: 9119 - DNA, 18 bp, Artificial Sequence
  Synthetic DNA
tatcacgacttactatag

SEQ ID NO: 9120 - DNA, 18 bp, Artificial Sequence
  Synthetic DNA
tgatacttctcactatag

SEQ ID NO: 9121 - DNA, 18 bp, Artificial Sequence
  Synthetic DNA
taaaaccactcactctag

SEQ ID NO: 9122 - DNA, 18 bp, Artificial Sequence
  Synthetic DNA
taaaactactcactatcg

SEQ ID NO: 9123 - DNA, 18 bp, Artificial Sequence
  Synthetic DNA
taacaagactcaccatag

SEQ ID NO: 9124 - DNA, 18 bp, Artificial Sequence
  Synthetic DNA
taacactacacactatag

SEQ ID NO: 9125 - DNA, 18 bp, Artificial Sequence
  Synthetic DNA
taataccacacaatatag

SEQ ID NO: 9126 - DNA, 18 bp, Artificial Sequence
  Synthetic DNA
taatacgaaacattatag

SEQ ID NO: 9127 - DNA, 18 bp, Artificial Sequence
  Synthetic DNA
taatacgactaacactag

SEQ ID NO: 9128 - DNA, 18 bp, Artificial Sequence
  Synthetic DNA
taatactactcaatctag

SEQ ID NO: 9129 - DNA, 18 bp, Artificial Sequence
  Synthetic DNA
tacaactactcactatag

SEQ ID NO: 9130 - DNA, 18 bp, Artificial Sequence
  Synthetic DNA
tattacgaatcaatatag

SEQ ID NO: 9131 - DNA, 18 bp, Artificial Sequence
  Synthetic DNA
aagtactactcactatag

SEQ ID NO: 9132 - DNA, 18 bp, Artificial Sequence
  Synthetic DNA
caattcgacttactatag

SEQ ID NO: 9133 - DNA, 18 bp, Artificial Sequence
  Synthetic DNA
taaaacgactcaatgtag

SEQ ID NO: 9134 - DNA, 18 bp, Artificial Sequence
  Synthetic DNA
taataccattcgctatag

SEQ ID NO: 9135 - DNA, 18 bp, Artificial Sequence
  Synthetic DNA
taatacgatacaccatag

SEQ ID NO: 9136 - DNA, 18 bp, Artificial Sequence
  Synthetic DNA
taatacgcctcaatacag

SEQ ID NO: 9137 - DNA, 18 bp, Artificial Sequence
  Synthetic DNA
taatatgattccctatag

SEQ ID NO: 9138 - DNA, 18 bp, Artificial Sequence
  Synthetic DNA
taatccgacttactattg

SEQ ID NO: 9139 - DNA, 18 bp, Artificial Sequence
  Synthetic DNA
tagtactgctcactatag

SEQ ID NO: 9140 - DNA, 18 bp, Artificial Sequence
  Synthetic DNA
tattacgactaactatcg

SEQ ID NO: 9141 - DNA, 18 bp, Artificial Sequence
  Synthetic DNA
tcatactactcacaatag

SEQ ID NO: 9142 - DNA, 18 bp, Artificial Sequence
  Synthetic DNA
ttataccactccctatag

SEQ ID NO: 9143 - DNA, 18 bp, Artificial Sequence
  Synthetic DNA
aaataggagtcactatag

SEQ ID NO: 9144 - DNA, 18 bp, Artificial Sequence
  Synthetic DNA
aaattcgacgcactatag

SEQ ID NO: 9145 - DNA, 18 bp, Artificial Sequence
  Synthetic DNA
aactacgacttactatag

SEQ ID NO: 9146 - DNA, 18 bp, Artificial Sequence
  Synthetic DNA
aagtacgactaactatag

SEQ ID NO: 9147 - DNA, 18 bp, Artificial Sequence
  Synthetic DNA
caagactactcactatag

SEQ ID NO: 9148 - DNA, 18 bp, Artificial Sequence
  Synthetic DNA
caatacgaatgactatag

SEQ ID NO: 9149 - DNA, 18 bp, Artificial Sequence
  Synthetic DNA
caatacgactgactttag

SEQ ID NO: 9150 - DNA, 18 bp, Artificial Sequence
  Synthetic DNA
caatacgtctcactagag

SEQ ID NO: 9151 - DNA, 18 bp, Artificial Sequence
  Synthetic DNA
caatactattcactatag

SEQ ID NO: 9152 - DNA, 18 bp, Artificial Sequence
  Synthetic DNA
caatgcgactcattatag

SEQ ID NO: 9153 - DNA, 18 bp, Artificial Sequence
  Synthetic DNA
caattcgagtcactatag

SEQ ID NO: 9154 - DNA, 18 bp, Artificial Sequence
  Synthetic DNA
gaatacgactcaatttag

SEQ ID NO: 9155 - DNA, 18 bp, Artificial Sequence
  Synthetic DNA
gaatactactcactttag

SEQ ID NO: 9156 - DNA, 18 bp, Artificial Sequence
  Synthetic DNA
gtatacgacttactatag

SEQ ID NO: 9157 - DNA, 18 bp, Artificial Sequence
  Synthetic DNA
taacaaggctcactatag

SEQ ID NO: 9158 - DNA, 18 bp, Artificial Sequence
  Synthetic DNA
taacaggactcactacag

SEQ ID NO: 9159 - DNA, 18 bp, Artificial Sequence
  Synthetic DNA
taagacgaatcagtatag

SEQ ID NO: 9160 - DNA, 18 bp, Artificial Sequence
  Synthetic DNA
taagacgactgactattg

SEQ ID NO: 9161 - DNA, 18 bp, Artificial Sequence
  Synthetic DNA
taatacaaaccactatag

SEQ ID NO: 9162 - DNA, 18 bp, Artificial Sequence
  Synthetic DNA
taatacaactccatatag

SEQ ID NO: 9163 - DNA, 18 bp, Artificial Sequence
  Synthetic DNA
taatacgacgcattttag

SEQ ID NO: 9164 - DNA, 18 bp, Artificial Sequence
  Synthetic DNA
taatacgactccatgtag

SEQ ID NO: 9165 - DNA, 18 bp, Artificial Sequence
  Synthetic DNA
taatacgattaactgtag

SEQ ID NO: 9166 - DNA, 18 bp, Artificial Sequence
  Synthetic DNA
taatacggcacactacag

SEQ ID NO: 9167 - DNA, 18 bp, Artificial Sequence
  Synthetic DNA
taatacggctcacagtag

SEQ ID NO: 9168 - DNA, 18 bp, Artificial Sequence
  Synthetic DNA
taatacgtctcactctcg

SEQ ID NO: 9169 - DNA, 18 bp, Artificial Sequence
  Synthetic DNA
taatacgtctggctatag

SEQ ID NO: 9170 - DNA, 18 bp, Artificial Sequence
  Synthetic DNA
taatactactaactctag

SEQ ID NO: 9171 - DNA, 18 bp, Artificial Sequence
  Synthetic DNA
taataggacagactatag

SEQ ID NO: 9172 - DNA, 18 bp, Artificial Sequence
  Synthetic DNA
taataggagtcactacag

SEQ ID NO: 9173 - DNA, 18 bp, Artificial Sequence
  Synthetic DNA
taatatgactcaacatag

SEQ ID NO: 9174 - DNA, 18 bp, Artificial Sequence
  Synthetic DNA
taatatgacttaatatag

SEQ ID NO: 9175 - DNA, 18 bp, Artificial Sequence
  Synthetic DNA
taatgcgattcaatatag

SEQ ID NO: 9176 - DNA, 18 bp, Artificial Sequence
  Synthetic DNA
taatgcgattcactatgg

SEQ ID NO: 9177 - DNA, 18 bp, Artificial Sequence
  Synthetic DNA
taattcgacagactatag

SEQ ID NO: 9178 - DNA, 18 bp, Artificial Sequence
  Synthetic DNA
taattcgacgccctatag

SEQ ID NO: 9179 - DNA, 18 bp, Artificial Sequence
  Synthetic DNA
tactacgactcacagtag

SEQ ID NO: 9180 - DNA, 18 bp, Artificial Sequence
  Synthetic DNA
tactacgactcactaccg

SEQ ID NO: 9181 - DNA, 18 bp, Artificial Sequence
  Synthetic DNA
tactatgactcaccatag

SEQ ID NO: 9182 - DNA, 18 bp, Artificial Sequence
  Synthetic DNA
tagtccgaatcactatag

SEQ ID NO: 9183 - DNA, 18 bp, Artificial Sequence
  Synthetic DNA
tagtccgactcactattg

SEQ ID NO: 9184 - DNA, 18 bp, Artificial Sequence
  Synthetic DNA
tagtcctactcactatag

SEQ ID NO: 9185 - DNA, 18 bp, Artificial Sequence
  Synthetic DNA
tatgacgaatcactatag

SEQ ID NO: 9186 - DNA, 18 bp, Artificial Sequence
  Synthetic DNA
tatgacgacttactatag

SEQ ID NO: 9187 - DNA, 18 bp, Artificial Sequence
  Synthetic DNA
tattacgactcagcatag

SEQ ID NO: 9188 - DNA, 18 bp, Artificial Sequence
  Synthetic DNA
tattatgactgactatag

SEQ ID NO: 9189 - DNA, 18 bp, Artificial Sequence
  Synthetic DNA
tattccgacgcactatag

SEQ ID NO: 9190 - DNA, 18 bp, Artificial Sequence
  Synthetic DNA
tattgcgagtcactatag

SEQ ID NO: 9191 - DNA, 18 bp, Artificial Sequence
  Synthetic DNA
tcacacgactcattatag

SEQ ID NO: 9192 - DNA, 18 bp, Artificial Sequence
  Synthetic DNA
tcataccacccactatag

SEQ ID NO: 9193 - DNA, 18 bp, Artificial Sequence
  Synthetic DNA
tcatacgactctcgatag

SEQ ID NO: 9194 - DNA, 18 bp, Artificial Sequence
  Synthetic DNA
tcatacggctcaccatag

SEQ ID NO: 9195 - DNA, 18 bp, Artificial Sequence
  Synthetic DNA
tgagacaactcactatag

SEQ ID NO: 9196 - DNA, 18 bp, Artificial Sequence
  Synthetic DNA
tgataagactctctatag

SEQ ID NO: 9197 - DNA, 18 bp, Artificial Sequence
  Synthetic DNA
tgatacaactcaatatag

SEQ ID NO: 9198 - DNA, 18 bp, Artificial Sequence
  Synthetic DNA
tgatacgactgtctatag

SEQ ID NO: 9199 - DNA, 18 bp, Artificial Sequence
  Synthetic DNA
ttatacgaatcacgatag

SEQ ID NO: 9200 - DNA, 18 bp, Artificial Sequence
  Synthetic DNA
ttatacgactaactgtag

SEQ ID NO: 9201 - DNA, 18 bp, Artificial Sequence
  Synthetic DNA
ttatacggctcactctag

SEQ ID NO: 9202 - DNA, 18 bp, Artificial Sequence
  Synthetic DNA
ttatacgaatctctatag

SEQ ID NO: 9203 - DNA, 18 bp, Artificial Sequence
  Synthetic DNA
aaattcgactcactaaag

SEQ ID NO: 9204 - DNA, 18 bp, Artificial Sequence
  Synthetic DNA
ttatacgacttactaaag

SEQ ID NO: 9205 - DNA, 18 bp, Artificial Sequence
  Synthetic DNA
tgatacgactctctttag

SEQ ID NO: 9206 - DNA, 18 bp, Artificial Sequence
  Synthetic DNA
ttatacgattctctatag

SEQ ID NO: 9207 - DNA, 18 bp, Artificial Sequence
  Synthetic DNA
taatacgcttctctatag

SEQ ID NO: 9208 - DNA, 18 bp, Artificial Sequence
  Synthetic DNA
ttatacgactctatatag

SEQ ID NO: 9209 - DNA, 18 bp, Artificial Sequence
  Synthetic DNA
ttatacgattcactaaag

SEQ ID NO: 9210 - DNA, 18 bp, Artificial Sequence
  Synthetic DNA
taaaacgactcataatag

SEQ ID NO: 9211 - DNA, 18 bp, Artificial Sequence
  Synthetic DNA
taatacaaatcactaaag

SEQ ID NO: 9212 - DNA, 18 bp, Artificial Sequence
  Synthetic DNA
caattcgactcaatatag

SEQ ID NO: 9213 - DNA, 18 bp, Artificial Sequence
  Synthetic DNA
taataagaatctctatag

SEQ ID NO: 9214 - DNA, 18 bp, Artificial Sequence
  Synthetic DNA
taataccattcactttag

SEQ ID NO: 9215 - DNA, 18 bp, Artificial Sequence
  Synthetic DNA
taatacgaatcaatttag

SEQ ID NO: 9216 - DNA, 18 bp, Artificial Sequence
  Synthetic DNA
tactacgattctctatag

SEQ ID NO: 9217 - DNA, 18 bp, Artificial Sequence
  Synthetic DNA
tattacgactccctaaag

SEQ ID NO: 9218 - DNA, 18 bp, Artificial Sequence
  Synthetic DNA
ttatacgacttactatcg

SEQ ID NO: 9219 - DNA, 18 bp, Artificial Sequence
  Synthetic DNA
taatacgacattctatag

SEQ ID NO: 9220 - DNA, 18 bp, Artificial Sequence
  Synthetic DNA
tattacgaccctctatag

SEQ ID NO: 9221 - DNA, 18 bp, Artificial Sequence
  Synthetic DNA
ttaaacgactcaatatag

SEQ ID NO: 9222 - DNA, 18 bp, Artificial Sequence
  Synthetic DNA
taatacgactcacataag

SEQ ID NO: 9223 - DNA, 18 bp, Artificial Sequence
  Synthetic DNA
aaatacgtttcactatag

SEQ ID NO: 9224 - DNA, 18 bp, Artificial Sequence
  Synthetic DNA
taatactattctctatag

SEQ ID NO: 9225 - DNA, 18 bp, Artificial Sequence
  Synthetic DNA
tattacgactctccatag

SEQ ID NO: 9226 - DNA, 18 bp, Artificial Sequence
  Synthetic DNA
tatttcgactaactatag

SEQ ID NO: 9227 - DNA, 18 bp, Artificial Sequence
  Synthetic DNA
taataagacacacaatag

SEQ ID NO: 9228 - DNA, 18 bp, Artificial Sequence
  Synthetic DNA
taataccactcacttttg

SEQ ID NO: 9229 - DNA, 18 bp, Artificial Sequence
  Synthetic DNA
aaatacggctcattatag

SEQ ID NO: 9230 - DNA, 18 bp, Artificial Sequence
  Synthetic DNA
caatacgacatactatag

SEQ ID NO: 9231 - DNA, 18 bp, Artificial Sequence
  Synthetic DNA
caatacgactctctctag

SEQ ID NO: 9232 - DNA, 18 bp, Artificial Sequence
  Synthetic DNA
caattcgactcagtatag

SEQ ID NO: 9233 - DNA, 18 bp, Artificial Sequence
  Synthetic DNA
gtttacgactcactatag

SEQ ID NO: 9234 - DNA, 18 bp, Artificial Sequence
  Synthetic DNA
taacacctctcactatag

SEQ ID NO: 9235 - DNA, 18 bp, Artificial Sequence
  Synthetic DNA
taacacgactaacaatag

SEQ ID NO: 9236 - DNA, 18 bp, Artificial Sequence
  Synthetic DNA
taactcaactcactatag

SEQ ID NO: 9237 - DNA, 18 bp, Artificial Sequence
  Synthetic DNA
taataagattcactacag

SEQ ID NO: 9238 - DNA, 18 bp, Artificial Sequence
  Synthetic DNA
taatacaactctctgtag

SEQ ID NO: 9239 - DNA, 18 bp, Artificial Sequence
  Synthetic DNA
taatacacctcactttag

SEQ ID NO: 9240 - DNA, 18 bp, Artificial Sequence
  Synthetic DNA
taatacgactcaatttgg

SEQ ID NO: 9241 - DNA, 18 bp, Artificial Sequence
  Synthetic DNA
taatacgagtcaccattg

SEQ ID NO: 9242 - DNA, 18 bp, Artificial Sequence
  Synthetic DNA
taatacgatcctctatag

SEQ ID NO: 9243 - DNA, 18 bp, Artificial Sequence
  Synthetic DNA
taatacgatttaccatag

SEQ ID NO: 9244 - DNA, 18 bp, Artificial Sequence
  Synthetic DNA
taatacttctcactagag

SEQ ID NO: 9245 - DNA, 18 bp, Artificial Sequence
  Synthetic DNA
taattcgaaccactatag

SEQ ID NO: 9246 - DNA, 18 bp, Artificial Sequence
  Synthetic DNA
taattcgccacactatag

SEQ ID NO: 9247 - DNA, 18 bp, Artificial Sequence
  Synthetic DNA
tactacaactcactaaag

SEQ ID NO: 9248 - DNA, 18 bp, Artificial Sequence
  Synthetic DNA
tattacagctcactatag

SEQ ID NO: 9249 - DNA, 18 bp, Artificial Sequence
  Synthetic DNA
tattacgtctcactagag

SEQ ID NO: 9250 - DNA, 18 bp, Artificial Sequence
  Synthetic DNA
tcacacgattcactatag

SEQ ID NO: 9251 - DNA, 18 bp, Artificial Sequence
  Synthetic DNA
tcatacgacacactagag

SEQ ID NO: 9252 - DNA, 18 bp, Artificial Sequence
  Synthetic DNA
tcatacgactcactcaag

SEQ ID NO: 9253 - DNA, 18 bp, Artificial Sequence
  Synthetic DNA
ttatacgagtcgctatag

SEQ ID NO: 9254 - DNA, 18 bp, Artificial Sequence
  Synthetic DNA
ttatacgatccactatag

SEQ ID NO: 9255 - DNA, 18 bp, Artificial Sequence
  Synthetic DNA
ttatacggctaactatag

SEQ ID NO: 9256 - DNA, 18 bp, Artificial Sequence
  Synthetic DNA
aaatacgtctcacaatag

SEQ ID NO: 9257 - DNA, 18 bp, Artificial Sequence
  Synthetic DNA
taatacgattctttatag

SEQ ID NO: 9258 - DNA, 18 bp, Artificial Sequence
  Synthetic DNA
aaatacgactatctatag

SEQ ID NO: 9259 - DNA, 18 bp, Artificial Sequence
  Synthetic DNA
taaaaagaatcactatag

SEQ ID NO: 9260 - DNA, 18 bp, Artificial Sequence
  Synthetic DNA
taatacgattaactttag

SEQ ID NO: 9261 - DNA, 18 bp, Artificial Sequence
  Synthetic DNA
tgatacgtcttactatag

SEQ ID NO: 9262 - DNA, 18 bp, Artificial Sequence
  Synthetic DNA
taatacgactaacaattg

SEQ ID NO: 9263 - DNA, 18 bp, Artificial Sequence
  Synthetic DNA
tattacgtctaactatag

SEQ ID NO: 9264 - DNA, 18 bp, Artificial Sequence
  Synthetic DNA
ttatacgaatcattatag

SEQ ID NO: 9265 - DNA, 18 bp, Artificial Sequence
  Synthetic DNA
ttatacgcctctctatag

SEQ ID NO: 9266 - DNA, 18 bp, Artificial Sequence
  Synthetic DNA
atatacgactaactatag

SEQ ID NO: 9267 - DNA, 18 bp, Artificial Sequence
  Synthetic DNA
taatacaactcaataaag

SEQ ID NO: 9268 - DNA, 18 bp, Artificial Sequence
  Synthetic DNA
taattcgtcttactatag

SEQ ID NO: 9269 - DNA, 18 bp, Artificial Sequence
  Synthetic DNA
aaatacttctcactatag

SEQ ID NO: 9270 - DNA, 18 bp, Artificial Sequence
  Synthetic DNA
taatacgactcaataatg

SEQ ID NO: 9271 - DNA, 18 bp, Artificial Sequence
  Synthetic DNA
taattcgtctcattatag

SEQ ID NO: 9272 - DNA, 18 bp, Artificial Sequence
  Synthetic DNA
tattccgactcactttag

SEQ ID NO: 9273 - DNA, 18 bp, Artificial Sequence
  Synthetic DNA
taataagacatactatag

SEQ ID NO: 9274 - DNA, 18 bp, Artificial Sequence
  Synthetic DNA
aaacacgactcacaatag

SEQ ID NO: 9275 - DNA, 18 bp, Artificial Sequence
  Synthetic DNA
taatacgactcattttcg

SEQ ID NO: 9276 - DNA, 18 bp, Artificial Sequence
  Synthetic DNA
taatacgccatactatag

SEQ ID NO: 9277 - DNA, 18 bp, Artificial Sequence
  Synthetic DNA
taatacgtataactatag

SEQ ID NO: 9278 - DNA, 18 bp, Artificial Sequence
  Synthetic DNA
taatacgtctcattctag

SEQ ID NO: 9279 - DNA, 18 bp, Artificial Sequence
  Synthetic DNA
taatttaactcactatag

SEQ ID NO: 9280 - DNA, 18 bp, Artificial Sequence
  Synthetic DNA
tactatgactcactattg

SEQ ID NO: 9281 - DNA, 18 bp, Artificial Sequence
  Synthetic DNA
tactatgactcactttag

SEQ ID NO: 9282 - DNA, 18 bp, Artificial Sequence
  Synthetic DNA
tattaccattcactatag

SEQ ID NO: 9283 - DNA, 18 bp, Artificial Sequence
  Synthetic DNA
tatttcgactcactatgg

SEQ ID NO: 9284 - DNA, 18 bp, Artificial Sequence
  Synthetic DNA
ttatacggctcacaatag

SEQ ID NO: 9285 - DNA, 18 bp, Artificial Sequence
  Synthetic DNA
ttatatgactcagtatag

SEQ ID NO: 9286 - DNA, 18 bp, Artificial Sequence
  Synthetic DNA
aaatacgactcagtaaag

SEQ ID NO: 9287 - DNA, 18 bp, Artificial Sequence
  Synthetic DNA
aattacgactccctatag

SEQ ID NO: 9288 - DNA, 18 bp, Artificial Sequence
  Synthetic DNA
taaaactactcactctag

SEQ ID NO: 9289 - DNA, 18 bp, Artificial Sequence
  Synthetic DNA
taactcgactcactgtag

SEQ ID NO: 9290 - DNA, 18 bp, Artificial Sequence
  Synthetic DNA
taataagacacactacag

SEQ ID NO: 9291 - DNA, 18 bp, Artificial Sequence
  Synthetic DNA
taataaggctcactaaag

SEQ ID NO: 9292 - DNA, 18 bp, Artificial Sequence
  Synthetic DNA
taatacaactctctatgg

SEQ ID NO: 9293 - DNA, 18 bp, Artificial Sequence
  Synthetic DNA
taataccactccctttag

SEQ ID NO: 9294 - DNA, 18 bp, Artificial Sequence
  Synthetic DNA
taatacgactcattcaag

SEQ ID NO: 9295 - DNA, 18 bp, Artificial Sequence
  Synthetic DNA
taatacgatacagtatag

SEQ ID NO: 9296 - DNA, 18 bp, Artificial Sequence
  Synthetic DNA
taatacggtacactatag

SEQ ID NO: 9297 - DNA, 18 bp, Artificial Sequence
  Synthetic DNA
taataggactctatatag

SEQ ID NO: 9298 - DNA, 18 bp, Artificial Sequence
  Synthetic DNA
tagtacaactcaatatag

SEQ ID NO: 9299 - DNA, 18 bp, Artificial Sequence
  Synthetic DNA
tattaagactccctatag

SEQ ID NO: 9300 - DNA, 18 bp, Artificial Sequence
  Synthetic DNA
tattacgaatcactgtag

SEQ ID NO: 9301 - DNA, 18 bp, Artificial Sequence
  Synthetic DNA
tcatacgaatcactaaag

SEQ ID NO: 9302 - DNA, 18 bp, Artificial Sequence
  Synthetic DNA
tgatacgacaaactatag

SEQ ID NO: 9303 - DNA, 18 bp, Artificial Sequence
  Synthetic DNA
ttctatgactcactatag

SEQ ID NO: 9304 - DNA, 18 bp, Artificial Sequence
  Synthetic DNA
aaagacgactcacaatag

SEQ ID NO: 9305 - DNA, 18 bp, Artificial Sequence
  Synthetic DNA
aaatacgacttactgtag

SEQ ID NO: 9306 - DNA, 18 bp, Artificial Sequence
  Synthetic DNA
aaatacggcttactatag

SEQ ID NO: 9307 - DNA, 18 bp, Artificial Sequence
  Synthetic DNA
caaaacgactgactatag

SEQ ID NO: 9308 - DNA, 18 bp, Artificial Sequence
  Synthetic DNA
caataagactcactaaag

SEQ ID NO: 9309 - DNA, 18 bp, Artificial Sequence
  Synthetic DNA
caataccactcactaaag

SEQ ID NO: 9310 - DNA, 18 bp, Artificial Sequence
  Synthetic DNA
caatagggctcactatag

SEQ ID NO: 9311 - DNA, 18 bp, Artificial Sequence
  Synthetic DNA
ccataagactcactatag

SEQ ID NO: 9312 - DNA, 18 bp, Artificial Sequence
  Synthetic DNA
gaaaacgactcactaaag

SEQ ID NO: 9313 - DNA, 18 bp, Artificial Sequence
  Synthetic DNA
gaatacgactctctaaag

SEQ ID NO: 9314 - DNA, 18 bp, Artificial Sequence
  Synthetic DNA
taaaacgacgcactctag

SEQ ID NO: 9315 - DNA, 18 bp, Artificial Sequence
  Synthetic DNA
taacacgattcactctag

SEQ ID NO: 9316 - DNA, 18 bp, Artificial Sequence
  Synthetic DNA
taacacgtctcactagag

SEQ ID NO: 9317 - DNA, 18 bp, Artificial Sequence
  Synthetic DNA
taagatgacacactatag

SEQ ID NO: 9318 - DNA, 18 bp, Artificial Sequence
  Synthetic DNA
taataagactccctagag

SEQ ID NO: 9319 - DNA, 18 bp, Artificial Sequence
  Synthetic DNA
taataagactcgcaatag

SEQ ID NO: 9320 - DNA, 18 bp, Artificial Sequence
  Synthetic DNA
taatacaactaaccatag

SEQ ID NO: 9321 - DNA, 18 bp, Artificial Sequence
  Synthetic DNA
taatacaattcactatgg

SEQ ID NO: 9322 - DNA, 18 bp, Artificial Sequence
  Synthetic DNA
taatacaccacactatag

SEQ ID NO: 9323 - DNA, 18 bp, Artificial Sequence
  Synthetic DNA
taatacagctccctatag

SEQ ID NO: 9324 - DNA, 18 bp, Artificial Sequence
  Synthetic DNA
taataccaccaactatag

SEQ ID NO: 9325 - DNA, 18 bp, Artificial Sequence
  Synthetic DNA
taatacgacacactctgg

SEQ ID NO: 9326 - DNA, 18 bp, Artificial Sequence
  Synthetic DNA
taatacgactcattaccg

SEQ ID NO: 9327 - DNA, 18 bp, Artificial Sequence
  Synthetic DNA
taatacgactgaataaag

SEQ ID NO: 9328 - DNA, 18 bp, Artificial Sequence
  Synthetic DNA
taatacggctgactaaag

SEQ ID NO: 9329 - DNA, 18 bp, Artificial Sequence
  Synthetic DNA
taatacgtctcactaggg

SEQ ID NO: 9330 - DNA, 18 bp, Artificial Sequence
  Synthetic DNA
taatactacgctctatag

SEQ ID NO: 9331 - DNA, 18 bp, Artificial Sequence
  Synthetic DNA
taatactactcgctctag

SEQ ID NO: 9332 - DNA, 18 bp, Artificial Sequence
  Synthetic DNA
taatactattcactatgg

SEQ ID NO: 9333 - DNA, 18 bp, Artificial Sequence
  Synthetic DNA
taatatgactcagtatgg

SEQ ID NO: 9334 - DNA, 18 bp, Artificial Sequence
  Synthetic DNA
taatatgcctcagtatag

SEQ ID NO: 9335 - DNA, 18 bp, Artificial Sequence
  Synthetic DNA
taatatgccttactatag

SEQ ID NO: 9336 - DNA, 18 bp, Artificial Sequence
  Synthetic DNA
taatcagactcaccatag

SEQ ID NO: 9337 - DNA, 18 bp, Artificial Sequence
  Synthetic DNA
taatccgactcacttcag

SEQ ID NO: 9338 - DNA, 18 bp, Artificial Sequence
  Synthetic DNA
taatccgattgactatag

SEQ ID NO: 9339 - DNA, 18 bp, Artificial Sequence
  Synthetic DNA
taatgctactccctatag

SEQ ID NO: 9340 - DNA, 18 bp, Artificial Sequence
  Synthetic DNA
taattcgacccactatcg

SEQ ID NO: 9341 - DNA, 18 bp, Artificial Sequence
  Synthetic DNA
taattcgagtcactatcg

SEQ ID NO: 9342 - DNA, 18 bp, Artificial Sequence
  Synthetic DNA
taattcgtcgcactatag

SEQ ID NO: 9343 - DNA, 18 bp, Artificial Sequence
  Synthetic DNA
tactacaactcactacag

SEQ ID NO: 9344 - DNA, 18 bp, Artificial Sequence
  Synthetic DNA
tactacgacacgctatag

SEQ ID NO: 9345 - DNA, 18 bp, Artificial Sequence
  Synthetic DNA
tactacggcttactatag

SEQ ID NO: 9346 - DNA, 18 bp, Artificial Sequence
  Synthetic DNA
tagtaagacacactatag

SEQ ID NO: 9347 - DNA, 18 bp, Artificial Sequence
  Synthetic DNA
tagtaagactcactattg

SEQ ID NO: 9348 - DNA, 18 bp, Artificial Sequence
  Synthetic DNA
tagtaccactcgctatag

SEQ ID NO: 9349 - DNA, 18 bp, Artificial Sequence
  Synthetic DNA
tagtacgaataactatag

SEQ ID NO: 9350 - DNA, 18 bp, Artificial Sequence
  Synthetic DNA
tagtactaatcactatag

SEQ ID NO: 9351 - DNA, 18 bp, Artificial Sequence
  Synthetic DNA
tattacaactgactatag

SEQ ID NO: 9352 - DNA, 18 bp, Artificial Sequence
  Synthetic DNA
tattacgaatcacgatag

SEQ ID NO: 9353 - DNA, 18 bp, Artificial Sequence
  Synthetic DNA
tcatacgactaactctag

SEQ ID NO: 9354 - DNA, 18 bp, Artificial Sequence
  Synthetic DNA
tcatacgactcgcaatag

SEQ ID NO: 9355 - DNA, 18 bp, Artificial Sequence
  Synthetic DNA
tcatatgactcaccatag

SEQ ID NO: 9356 - DNA, 18 bp, Artificial Sequence
  Synthetic DNA
tgagacgactcacaatag

SEQ ID NO: 9357 - DNA, 18 bp, Artificial Sequence
  Synthetic DNA
tgatacgactcaccacag

SEQ ID NO: 9358 - DNA, 18 bp, Artificial Sequence
  Synthetic DNA
tgatacggctcaccatag

SEQ ID NO: 9359 - DNA, 18 bp, Artificial Sequence
  Synthetic DNA
ttatacgacccactatcg

SEQ ID NO: 9360 - DNA, 18 bp, Artificial Sequence
  Synthetic DNA
ttatacgacgcgctatag

SEQ ID NO: 9361 - DNA, 18 bp, Artificial Sequence
  Synthetic DNA
ttatacgtctaactatag

SEQ ID NO: 9362 - DNA, 18 bp, Artificial Sequence
  Synthetic DNA
aaaaacgactctctatag

SEQ ID NO: 9363 - DNA, 18 bp, Artificial Sequence
  Synthetic DNA
aaatactattcactatag

SEQ ID NO: 9364 - DNA, 18 bp, Artificial Sequence
  Synthetic DNA
taataagattcactttag

SEQ ID NO: 9365 - DNA, 18 bp, Artificial Sequence
  Synthetic DNA
taatacgactctccattg

SEQ ID NO: 9366 - DNA, 18 bp, Artificial Sequence
  Synthetic DNA
taatacgtctcatcatag

SEQ ID NO: 9367 - DNA, 18 bp, Artificial Sequence
  Synthetic DNA
tcatacgacttactattg

SEQ ID NO: 9368 - DNA, 18 bp, Artificial Sequence
  Synthetic DNA
taaaatgtctcactatag

SEQ ID NO: 9369 - DNA, 18 bp, Artificial Sequence
  Synthetic DNA
taatacaactcattaaag

SEQ ID NO: 9370 - DNA, 18 bp, Artificial Sequence
  Synthetic DNA
tattacgacatactatag

SEQ ID NO: 9371 - DNA, 18 bp, Artificial Sequence
  Synthetic DNA
taactcgactcacaatag

SEQ ID NO: 9372 - DNA, 18 bp, Artificial Sequence
  Synthetic DNA
taatcccactcactaaag

SEQ ID NO: 9373 - DNA, 18 bp, Artificial Sequence
  Synthetic DNA
tcatacgactctcaatag

SEQ ID NO: 9374 - DNA, 18 bp, Artificial Sequence
  Synthetic DNA
tgtaacgactcactatag

SEQ ID NO: 9375 - DNA, 18 bp, Artificial Sequence
  Synthetic DNA
tattacgattcactttag

SEQ ID NO: 9376 - DNA, 18 bp, Artificial Sequence
  Synthetic DNA
taatacaactcacattag

SEQ ID NO: 9377 - DNA, 18 bp, Artificial Sequence
  Synthetic DNA
taatacgactctcactag

SEQ ID NO: 9378 - DNA, 18 bp, Artificial Sequence
  Synthetic DNA
tattacgtctcagtatag

SEQ ID NO: 9379 - DNA, 18 bp, Artificial Sequence
  Synthetic DNA
ttatacgacacactacag

SEQ ID NO: 9380 - DNA, 18 bp, Artificial Sequence
  Synthetic DNA
caatacgtctcaccatag

SEQ ID NO: 9381 - DNA, 18 bp, Artificial Sequence
  Synthetic DNA
caatacgtgtcactatag

SEQ ID NO: 9382 - DNA, 18 bp, Artificial Sequence
  Synthetic DNA
taaaacgtctgactatag

SEQ ID NO: 9383 - DNA, 18 bp, Artificial Sequence
  Synthetic DNA
taacacgtctaactatag

SEQ ID NO: 9384 - DNA, 18 bp, Artificial Sequence
  Synthetic DNA
taataagattaactatag

SEQ ID NO: 9385 - DNA, 18 bp, Artificial Sequence
  Synthetic DNA
taatacgattcactaacg

SEQ ID NO: 9386 - DNA, 18 bp, Artificial Sequence
  Synthetic DNA
taataggacactctatag

SEQ ID NO: 9387 - DNA, 18 bp, Artificial Sequence
  Synthetic DNA
taattcgtctccctatag

SEQ ID NO: 9388 - DNA, 18 bp, Artificial Sequence
  Synthetic DNA
taatttcactcactatag

SEQ ID NO: 9389 - DNA, 18 bp, Artificial Sequence
  Synthetic DNA
tagtacgacttactattg

SEQ ID NO: 9390 - DNA, 18 bp, Artificial Sequence
  Synthetic DNA
tattaagacccactatag

SEQ ID NO: 9391 - DNA, 18 bp, Artificial Sequence
  Synthetic DNA
tcacacgtctcactatag

SEQ ID NO: 9392 - DNA, 18 bp, Artificial Sequence
  Synthetic DNA
tgaaacgaatcactatag

SEQ ID NO: 9393 - DNA, 18 bp, Artificial Sequence
  Synthetic DNA
tgatacgactaactttag

SEQ ID NO: 9394 - DNA, 18 bp, Artificial Sequence
  Synthetic DNA
tgattcaactcactatag

SEQ ID NO: 9395 - DNA, 18 bp, Artificial Sequence
  Synthetic DNA
taatacatctcactttag

SEQ ID NO: 9396 - DNA, 18 bp, Artificial Sequence
  Synthetic DNA
taatactactcacttcag

SEQ ID NO: 9397 - DNA, 18 bp, Artificial Sequence
  Synthetic DNA
aattacgattcactatag

SEQ ID NO: 9398 - DNA, 18 bp, Artificial Sequence
  Synthetic DNA
taaaacgactcagtattg

SEQ ID NO: 9399 - DNA, 18 bp, Artificial Sequence
  Synthetic DNA
taacacgactaactttag

SEQ ID NO: 9400 - DNA, 18 bp, Artificial Sequence
  Synthetic DNA
taatacgagtctcaatag

SEQ ID NO: 9401 - DNA, 18 bp, Artificial Sequence
  Synthetic DNA
taattcgactcattatcg

SEQ ID NO: 9402 - DNA, 18 bp, Artificial Sequence
  Synthetic DNA
tatcactactcactatag

SEQ ID NO: 9403 - DNA, 18 bp, Artificial Sequence
  Synthetic DNA
tcaaacgactcacaatag

SEQ ID NO: 9404 - DNA, 18 bp, Artificial Sequence
  Synthetic DNA
tgatacgacacactattg

SEQ ID NO: 9405 - DNA, 18 bp, Artificial Sequence
  Synthetic DNA
ttatacgactcattgtag

SEQ ID NO: 9406 - DNA, 18 bp, Artificial Sequence
  Synthetic DNA
ttatactactcactttag

SEQ ID NO: 9407 - DNA, 18 bp, Artificial Sequence
  Synthetic DNA
taattcgactctctttag

SEQ ID NO: 9408 - DNA, 18 bp, Artificial Sequence
  Synthetic DNA
aaataagacacactatag

SEQ ID NO: 9409 - DNA, 18 bp, Artificial Sequence
  Synthetic DNA
taatacgacacaccattg

SEQ ID NO: 9410 - DNA, 18 bp, Artificial Sequence
  Synthetic DNA
taatacgattcacttcag

SEQ ID NO: 9411 - DNA, 18 bp, Artificial Sequence
  Synthetic DNA
tcataagactcactttag

SEQ ID NO: 9412 - DNA, 18 bp, Artificial Sequence
  Synthetic DNA
ttatatgtctcactatag

SEQ ID NO: 9413 - DNA, 18 bp, Artificial Sequence
  Synthetic DNA
aaatatgactcactttag

SEQ ID NO: 9414 - DNA, 18 bp, Artificial Sequence
  Synthetic DNA
tattacgattaactatag

SEQ ID NO: 9415 - DNA, 18 bp, Artificial Sequence
  Synthetic DNA
taatacgacacacttttg

SEQ ID NO: 9416 - DNA, 18 bp, Artificial Sequence
  Synthetic DNA
tattacaactctctatag

SEQ ID NO: 9417 - DNA, 18 bp, Artificial Sequence
  Synthetic DNA
taatacaactcacaaaag

SEQ ID NO: 9418 - DNA, 18 bp, Artificial Sequence
  Synthetic DNA
aaatacgactcataatag

SEQ ID NO: 9419 - DNA, 18 bp, Artificial Sequence
  Synthetic DNA
tattatgactcactaaag

SEQ ID NO: 9420 - DNA, 18 bp, Artificial Sequence
  Synthetic DNA
taatacgactcaatgttg

SEQ ID NO: 9421 - DNA, 18 bp, Artificial Sequence
  Synthetic DNA
taatatgactcaatctag

SEQ ID NO: 9422 - DNA, 18 bp, Artificial Sequence
  Synthetic DNA
tagttcaactcactatag

SEQ ID NO: 9423 - DNA, 18 bp, Artificial Sequence
  Synthetic DNA
tattactactcactacag

SEQ ID NO: 9424 - DNA, 18 bp, Artificial Sequence
  Synthetic DNA
taacacgtcttactatag

SEQ ID NO: 9425 - DNA, 18 bp, Artificial Sequence
  Synthetic DNA
taatacgtctcacagtag

SEQ ID NO: 9426 - DNA, 18 bp, Artificial Sequence
  Synthetic DNA
taatacgtctcaccttag

SEQ ID NO: 9427 - DNA, 18 bp, Artificial Sequence
  Synthetic DNA
taatacttctcaatatag

SEQ ID NO: 9428 - DNA, 18 bp, Artificial Sequence
  Synthetic DNA
aatcacgactcactatag

SEQ ID NO: 9429 - DNA, 18 bp, Artificial Sequence
  Synthetic DNA
caatacgacacattatag

SEQ ID NO: 9430 - DNA, 18 bp, Artificial Sequence
  Synthetic DNA
taaaacgacacactatcg

SEQ ID NO: 9431 - DNA, 18 bp, Artificial Sequence
  Synthetic DNA
taaaacgtctcactatgg

SEQ ID NO: 9432 - DNA, 18 bp, Artificial Sequence
  Synthetic DNA
taaaaggaatcactatag

SEQ ID NO: 9433 - DNA, 18 bp, Artificial Sequence
  Synthetic DNA
taactcgacttactatag

SEQ ID NO: 9434 - DNA, 18 bp, Artificial Sequence
  Synthetic DNA
taatacaacttactgtag

SEQ ID NO: 9435 - DNA, 18 bp, Artificial Sequence
  Synthetic DNA
taatacgacacacgaaag

SEQ ID NO: 9436 - DNA, 18 bp, Artificial Sequence
  Synthetic DNA
taatacgactatctacag

SEQ ID NO: 9437 - DNA, 18 bp, Artificial Sequence
  Synthetic DNA
taatacgactcctaatag

SEQ ID NO: 9438 - DNA, 18 bp, Artificial Sequence
  Synthetic DNA
taatacgattcaatctag

SEQ ID NO: 9439 - DNA, 18 bp, Artificial Sequence
  Synthetic DNA
taatacgtctcacttgag

SEQ ID NO: 9440 - DNA, 18 bp, Artificial Sequence
  Synthetic DNA
taatactcctctctatag

SEQ ID NO: 9441 - DNA, 18 bp, Artificial Sequence
  Synthetic DNA
taatcctactaactatag

SEQ ID NO: 9442 - DNA, 18 bp, Artificial Sequence
  Synthetic DNA
taatgctactcactatcg

SEQ ID NO: 9443 - DNA, 18 bp, Artificial Sequence
  Synthetic DNA
taattcagctcactatag

SEQ ID NO: 9444 - DNA, 18 bp, Artificial Sequence
  Synthetic DNA
taattcgagtcacaatag

SEQ ID NO: 9445 - DNA, 18 bp, Artificial Sequence
  Synthetic DNA
tacaacgactcactaaag

SEQ ID NO: 9446 - DNA, 18 bp, Artificial Sequence
  Synthetic DNA
tcttacgcctcactatag

SEQ ID NO: 9447 - DNA, 18 bp, Artificial Sequence
  Synthetic DNA
aaaaacgagtcactatag

SEQ ID NO: 9448 - DNA, 18 bp, Artificial Sequence
  Synthetic DNA
aaagacgactctctatag

SEQ ID NO: 9449 - DNA, 18 bp, Artificial Sequence
  Synthetic DNA
aaataaggctcactatag

SEQ ID NO: 9450 - DNA, 18 bp, Artificial Sequence
  Synthetic DNA
aaatacgactcacttgag

SEQ ID NO: 9451 - DNA, 18 bp, Artificial Sequence
  Synthetic DNA
caacacgaatcactatag

SEQ ID NO: 9452 - DNA, 18 bp, Artificial Sequence
  Synthetic DNA
caatacgtctcactctag

SEQ ID NO: 9453 - DNA, 18 bp, Artificial Sequence
  Synthetic DNA
caatagtactcactatag

SEQ ID NO: 9454 - DNA, 18 bp, Artificial Sequence
  Synthetic DNA
caatatgactcactaaag

SEQ ID NO: 9455 - DNA, 18 bp, Artificial Sequence
  Synthetic DNA
cactacgactccctatag

SEQ ID NO: 9456 - DNA, 18 bp, Artificial Sequence
  Synthetic DNA
taaaacgagtcgctatag

SEQ ID NO: 9457 - DNA, 18 bp, Artificial Sequence
  Synthetic DNA
taaaaggactcattatag

SEQ ID NO: 9458 - DNA, 18 bp, Artificial Sequence
  Synthetic DNA
taaaccgacgcactatag

SEQ ID NO: 9459 - DNA, 18 bp, Artificial Sequence
  Synthetic DNA
taaaccgactaactatag

SEQ ID NO: 9460 - DNA, 18 bp, Artificial Sequence
  Synthetic DNA
taacacgactgactgtag

SEQ ID NO: 9461 - DNA, 18 bp, Artificial Sequence
  Synthetic DNA
taagacaactcactatcg

SEQ ID NO: 9462 - DNA, 18 bp, Artificial Sequence
  Synthetic DNA
taagacgattcattatag

SEQ ID NO: 9463 - DNA, 18 bp, Artificial Sequence
  Synthetic DNA
taagacggcacactatag

SEQ ID NO: 9464 - DNA, 18 bp, Artificial Sequence
  Synthetic DNA
taagacgtctcactatgg

SEQ ID NO: 9465 - DNA, 18 bp, Artificial Sequence
  Synthetic DNA
taagactactcacaatag

SEQ ID NO: 9466 - DNA, 18 bp, Artificial Sequence
  Synthetic DNA
taataacactcacaatag

SEQ ID NO: 9467 - DNA, 18 bp, Artificial Sequence
  Synthetic DNA
taatacaactcattatgg

SEQ ID NO: 9468 - DNA, 18 bp, Artificial Sequence
  Synthetic DNA
taatacagctcactatgg

SEQ ID NO: 9469 - DNA, 18 bp, Artificial Sequence
  Synthetic DNA
taataccactcaccacag

SEQ ID NO: 9470 - DNA, 18 bp, Artificial Sequence
  Synthetic DNA
taatacgaaacgctatag

SEQ ID NO: 9471 - DNA, 18 bp, Artificial Sequence
  Synthetic DNA
taatacgaccctctgtag

SEQ ID NO: 9472 - DNA, 18 bp, Artificial Sequence
  Synthetic DNA
taatacgactcacaagcg

SEQ ID NO: 9473 - DNA, 18 bp, Artificial Sequence
  Synthetic DNA
taatacgactcacagcag

SEQ ID NO: 9474 - DNA, 18 bp, Artificial Sequence
  Synthetic DNA
taatacgactcatgttag

SEQ ID NO: 9475 - DNA, 18 bp, Artificial Sequence
  Synthetic DNA
taatacgacttatcatag

SEQ ID NO: 9476 - DNA, 18 bp, Artificial Sequence
  Synthetic DNA
taatacgagtaaatatag

SEQ ID NO: 9477 - DNA, 18 bp, Artificial Sequence
  Synthetic DNA
taatacgatacactatcg

SEQ ID NO: 9478 - DNA, 18 bp, Artificial Sequence
  Synthetic DNA
taatacggatcacaatag

SEQ ID NO: 9479 - DNA, 18 bp, Artificial Sequence
  Synthetic DNA
taatacgtcccagtatag

SEQ ID NO: 9480 - DNA, 18 bp, Artificial Sequence
  Synthetic DNA
taatactacccactatgg

SEQ ID NO: 9481 - DNA, 18 bp, Artificial Sequence
  Synthetic DNA
taatactactcacgattg

SEQ ID NO: 9482 - DNA, 18 bp, Artificial Sequence
  Synthetic DNA
taatactgctcaccatag

SEQ ID NO: 9483 - DNA, 18 bp, Artificial Sequence
  Synthetic DNA
taataggaattactatag

SEQ ID NO: 9484 - DNA, 18 bp, Artificial Sequence
  Synthetic DNA
taataggactcaatatcg

SEQ ID NO: 9485 - DNA, 18 bp, Artificial Sequence
  Synthetic DNA
taataggagtcactaaag

SEQ ID NO: 9486 - DNA, 18 bp, Artificial Sequence
  Synthetic DNA
taatattactcactatcg

SEQ ID NO: 9487 - DNA, 18 bp, Artificial Sequence
  Synthetic DNA
taatcccactcactgtag

SEQ ID NO: 9488 - DNA, 18 bp, Artificial Sequence
  Synthetic DNA
taatccgagtcactttag

SEQ ID NO: 9489 - DNA, 18 bp, Artificial Sequence
  Synthetic DNA
taatgcaattcactatag

SEQ ID NO: 9490 - DNA, 18 bp, Artificial Sequence
  Synthetic DNA
taatgcgacccactttag

SEQ ID NO: 9491 - DNA, 18 bp, Artificial Sequence
  Synthetic DNA
taatgcgactcacgattg

SEQ ID NO: 9492 - DNA, 18 bp, Artificial Sequence
  Synthetic DNA
taatgctaatcactatag

SEQ ID NO: 9493 - DNA, 18 bp, Artificial Sequence
  Synthetic DNA
taattcgcctccctatag

SEQ ID NO: 9494 - DNA, 18 bp, Artificial Sequence
  Synthetic DNA
tacagcgactcactatag

SEQ ID NO: 9495 - DNA, 18 bp, Artificial Sequence
  Synthetic DNA
tactacgacagactatag

SEQ ID NO: 9496 - DNA, 18 bp, Artificial Sequence
  Synthetic DNA
tactacgcctcaccatag

SEQ ID NO: 9497 - DNA, 18 bp, Artificial Sequence
  Synthetic DNA
tactatgactcacaatag

SEQ ID NO: 9498 - DNA, 18 bp, Artificial Sequence
  Synthetic DNA
tacttctactcactatag

SEQ ID NO: 9499 - DNA, 18 bp, Artificial Sequence
  Synthetic DNA
tagtacctctcactatag

SEQ ID NO: 9500 - DNA, 18 bp, Artificial Sequence
  Synthetic DNA
tagtactactcaccatag

SEQ ID NO: 9501 - DNA, 18 bp, Artificial Sequence
  Synthetic DNA
tattgcgactcactatgg

SEQ ID NO: 9502 - DNA, 18 bp, Artificial Sequence
  Synthetic DNA
tcataagactcaatatag

SEQ ID NO: 9503 - DNA, 18 bp, Artificial Sequence
  Synthetic DNA
tcatacgaatcactacag

SEQ ID NO: 9504 - DNA, 18 bp, Artificial Sequence
  Synthetic DNA
tgatactaatcactatag

SEQ ID NO: 9505 - DNA, 18 bp, Artificial Sequence
  Synthetic DNA
ttatacgacgcaatatag

SEQ ID NO: 9506 - DNA, 18 bp, Artificial Sequence
  Synthetic DNA
ttatacgactgactgtag

SEQ ID NO: 9507 - DNA, 18 bp, Artificial Sequence
  Synthetic DNA
taatacgactctctaatg

SEQ ID NO: 9508 - DNA, 18 bp, Artificial Sequence
  Synthetic DNA
taatacgattctctttag

SEQ ID NO: 9509 - DNA, 18 bp, Artificial Sequence
  Synthetic DNA
tattacgactctctattg

SEQ ID NO: 9510 - DNA, 18 bp, Artificial Sequence
  Synthetic DNA
aaatacgactcacttaag

SEQ ID NO: 9511 - DNA, 18 bp, Artificial Sequence
  Synthetic DNA
taacacgactctcaatag

SEQ ID NO: 9512 - DNA, 18 bp, Artificial Sequence
  Synthetic DNA
taataagtcacactatag

SEQ ID NO: 9513 - DNA, 18 bp, Artificial Sequence
  Synthetic DNA
taatacgaaacacaatag

SEQ ID NO: 9514 - DNA, 18 bp, Artificial Sequence
  Synthetic DNA
taatacaactcattttag

SEQ ID NO: 9515 - DNA, 18 bp, Artificial Sequence
  Synthetic DNA
taatactattcacaatag

SEQ ID NO: 9516 - DNA, 18 bp, Artificial Sequence
  Synthetic DNA
ttatacaactcacaatag

SEQ ID NO: 9517 - DNA, 18 bp, Artificial Sequence
  Synthetic DNA
ttatacgactaactaaag

SEQ ID NO: 9518 - DNA, 18 bp, Artificial Sequence
  Synthetic DNA
aaataggaatcactatag

SEQ ID NO: 9519 - DNA, 18 bp, Artificial Sequence
  Synthetic DNA
taacacaactaactatag

SEQ ID NO: 9520 - DNA, 18 bp, Artificial Sequence
  Synthetic DNA
taactcgacacactatag

SEQ ID NO: 9521 - DNA, 18 bp, Artificial Sequence
  Synthetic DNA
taatacgactaactttcg

SEQ ID NO: 9522 - DNA, 18 bp, Artificial Sequence
  Synthetic DNA
taatacgacttactttgg

SEQ ID NO: 9523 - DNA, 18 bp, Artificial Sequence
  Synthetic DNA
taatacgattcgctaaag

SEQ ID NO: 9524 - DNA, 18 bp, Artificial Sequence
  Synthetic DNA
taatactattcaatatag

SEQ ID NO: 9525 - DNA, 18 bp, Artificial Sequence
  Synthetic DNA
taatatgacatactatag

SEQ ID NO: 9526 - DNA, 18 bp, Artificial Sequence
  Synthetic DNA
taatgcgacacactaaag

SEQ ID NO: 9527 - DNA, 18 bp, Artificial Sequence
  Synthetic DNA
tagtacgtctctctatag

SEQ ID NO: 9528 - DNA, 18 bp, Artificial Sequence
  Synthetic DNA
tattaccaatcactatag

SEQ ID NO: 9529 - DNA, 18 bp, Artificial Sequence
  Synthetic DNA
tattacgacccactaaag

SEQ ID NO: 9530 - DNA, 18 bp, Artificial Sequence
  Synthetic DNA
ttataccacacactatag

SEQ ID NO: 9531 - DNA, 18 bp, Artificial Sequence
  Synthetic DNA
tattacgactttctatag

SEQ ID NO: 9532 - DNA, 18 bp, Artificial Sequence
  Synthetic DNA
aaatacgactaactattg

SEQ ID NO: 9533 - DNA, 18 bp, Artificial Sequence
  Synthetic DNA
aaatacgtctaactatag

SEQ ID NO: 9534 - DNA, 18 bp, Artificial Sequence
  Synthetic DNA
taaaacaaatcactatag

SEQ ID NO: 9535 - DNA, 18 bp, Artificial Sequence
  Synthetic DNA
taatactacacactacag

SEQ ID NO: 9536 - DNA, 18 bp, Artificial Sequence
  Synthetic DNA
tactacgactcacaaaag

SEQ ID NO: 9537 - DNA, 18 bp, Artificial Sequence
  Synthetic DNA
aaatacgaatcactctag

SEQ ID NO: 9538 - DNA, 18 bp, Artificial Sequence
  Synthetic DNA
taaaaccaatcactatag

SEQ ID NO: 9539 - DNA, 18 bp, Artificial Sequence
  Synthetic DNA
taaaacgactgacaatag

SEQ ID NO: 9540 - DNA, 18 bp, Artificial Sequence
  Synthetic DNA
taacacgactcaaaatag

SEQ ID NO: 9541 - DNA, 18 bp, Artificial Sequence
  Synthetic DNA
taacacgactcattatcg

SEQ ID NO: 9542 - DNA, 18 bp, Artificial Sequence
  Synthetic DNA
taatacaacacagtatag

SEQ ID NO: 9543 - DNA, 18 bp, Artificial Sequence
  Synthetic DNA
taatacgacacacagtag

SEQ ID NO: 9544 - DNA, 18 bp, Artificial Sequence
  Synthetic DNA
taatacgatagactatag

SEQ ID NO: 9545 - DNA, 18 bp, Artificial Sequence
  Synthetic DNA
taatacgattgaccatag

SEQ ID NO: 9546 - DNA, 18 bp, Artificial Sequence
  Synthetic DNA
taatgcgaatcacaatag

SEQ ID NO: 9547 - DNA, 18 bp, Artificial Sequence
  Synthetic DNA
taattcgacccactattg

SEQ ID NO: 9548 - DNA, 18 bp, Artificial Sequence
  Synthetic DNA
taattcgtctcagtatag

SEQ ID NO: 9549 - DNA, 18 bp, Artificial Sequence
  Synthetic DNA
tactatgattcactatag

SEQ ID NO: 9550 - DNA, 18 bp, Artificial Sequence
  Synthetic DNA
tattacgaatcaccatag

SEQ ID NO: 9551 - DNA, 18 bp, Artificial Sequence
  Synthetic DNA
tattacgacccactctag

SEQ ID NO: 9552 - DNA, 18 bp, Artificial Sequence
  Synthetic DNA
tattacgacctactatag

SEQ ID NO: 9553 - DNA, 18 bp, Artificial Sequence
  Synthetic DNA
tcatatgactcgctatag

SEQ ID NO: 9554 - DNA, 18 bp, Artificial Sequence
  Synthetic DNA
taatacgacacacaattg

SEQ ID NO: 9555 - DNA, 18 bp, Artificial Sequence
  Synthetic DNA
taatacgaatcacattag

SEQ ID NO: 9556 - DNA, 18 bp, Artificial Sequence
  Synthetic DNA
aaataatactcactatag

SEQ ID NO: 9557 - DNA, 18 bp, Artificial Sequence
  Synthetic DNA
aaatactaatcactatag

SEQ ID NO: 9558 - DNA, 18 bp, Artificial Sequence
  Synthetic DNA
taaaacgacacactctag

SEQ ID NO: 9559 - DNA, 18 bp, Artificial Sequence
  Synthetic DNA
taatacgactgacttttg

SEQ ID NO: 9560 - DNA, 18 bp, Artificial Sequence
  Synthetic DNA
taatacgtctcactagtg

SEQ ID NO: 9561 - DNA, 18 bp, Artificial Sequence
  Synthetic DNA
taatttgaatcactatag

SEQ ID NO: 9562 - DNA, 18 bp, Artificial Sequence
  Synthetic DNA
tagtacgattcactattg

SEQ ID NO: 9563 - DNA, 18 bp, Artificial Sequence
  Synthetic DNA
ttataccactcattatag

SEQ ID NO: 9564 - DNA, 18 bp, Artificial Sequence
  Synthetic DNA
ttatacgattcactacag

SEQ ID NO: 9565 - DNA, 18 bp, Artificial Sequence
  Synthetic DNA
ttctacgactctctatag

SEQ ID NO: 9566 - DNA, 18 bp, Artificial Sequence
  Synthetic DNA
ttatacgactcataatag

SEQ ID NO: 9567 - DNA, 18 bp, Artificial Sequence
  Synthetic DNA
taatacgacttacttttg

SEQ ID NO: 9568 - DNA, 18 bp, Artificial Sequence
  Synthetic DNA
taaaccgactctctatag

SEQ ID NO: 9569 - DNA, 18 bp, Artificial Sequence
  Synthetic DNA
taatacctctcacaatag

SEQ ID NO: 9570 - DNA, 18 bp, Artificial Sequence
  Synthetic DNA
taatacgacatactaaag

SEQ ID NO: 9571 - DNA, 18 bp, Artificial Sequence
  Synthetic DNA
tgatacatctcactatag

SEQ ID NO: 9572 - DNA, 18 bp, Artificial Sequence
  Synthetic DNA
aattactactcactatag

SEQ ID NO: 9573 - DNA, 18 bp, Artificial Sequence
  Synthetic DNA
tattacgacttactaaag

SEQ ID NO: 9574 - DNA, 18 bp, Artificial Sequence
  Synthetic DNA
taatacaactcacaattg

SEQ ID NO: 9575 - DNA, 18 bp, Artificial Sequence
  Synthetic DNA
taatactactctcaatag

SEQ ID NO: 9576 - DNA, 18 bp, Artificial Sequence
  Synthetic DNA
ttattcgacacactatag

SEQ ID NO: 9577 - DNA, 18 bp, Artificial Sequence
  Synthetic DNA
ttatacgaatcactttag

SEQ ID NO: 9578 - DNA, 18 bp, Artificial Sequence
  Synthetic DNA
tattaagattcactatag

SEQ ID NO: 9579 - DNA, 18 bp, Artificial Sequence
  Synthetic DNA
ttatacgacacaccatag

SEQ ID NO: 9580 - DNA, 18 bp, Artificial Sequence
  Synthetic DNA
taaaacgacacaatatag

SEQ ID NO: 9581 - DNA, 18 bp, Artificial Sequence
  Synthetic DNA
taacacgacttactaaag

SEQ ID NO: 9582 - DNA, 18 bp, Artificial Sequence
  Synthetic DNA
tattacgtctcactgtag

SEQ ID NO: 9583 - DNA, 18 bp, Artificial Sequence
  Synthetic DNA
ttatacgagtcactaaag

SEQ ID NO: 9584 - DNA, 18 bp, Artificial Sequence
  Synthetic DNA
ttatacgcctaactatag

SEQ ID NO: 9585 - DNA, 18 bp, Artificial Sequence
  Synthetic DNA
taaaaccactcactaaag

SEQ ID NO: 9586 - DNA, 18 bp, Artificial Sequence
  Synthetic DNA
taaaacgactcgttatag

SEQ ID NO: 9587 - DNA, 18 bp, Artificial Sequence
  Synthetic DNA
taacacgtatcactatag

SEQ ID NO: 9588 - DNA, 18 bp, Artificial Sequence
  Synthetic DNA
taatacgaataactatcg

SEQ ID NO: 9589 - DNA, 18 bp, Artificial Sequence
  Synthetic DNA
taatacgacccaatttag

SEQ ID NO: 9590 - DNA, 18 bp, Artificial Sequence
  Synthetic DNA
taatacgacccattttag

SEQ ID NO: 9591 - DNA, 18 bp, Artificial Sequence
  Synthetic DNA
taatacgactaaacatag

SEQ ID NO: 9592 - DNA, 18 bp, Artificial Sequence
  Synthetic DNA
taatacgcctctttatag

SEQ ID NO: 9593 - DNA, 18 bp, Artificial Sequence
  Synthetic DNA
taatacgtctaactacag

SEQ ID NO: 9594 - DNA, 18 bp, Artificial Sequence
  Synthetic DNA
taatactacacgctatag

SEQ ID NO: 9595 - DNA, 18 bp, Artificial Sequence
  Synthetic DNA
taatagggctcactattg

SEQ ID NO: 9596 - DNA, 18 bp, Artificial Sequence
  Synthetic DNA
taatattaatcactatag

SEQ ID NO: 9597 - DNA, 18 bp, Artificial Sequence
  Synthetic DNA
taatccgactcacaattg

SEQ ID NO: 9598 - DNA, 18 bp, Artificial Sequence
  Synthetic DNA
taattcgactctctagag

SEQ ID NO: 9599 - DNA, 18 bp, Artificial Sequence
  Synthetic DNA
tactacgactcataatag

SEQ ID NO: 9600 - DNA, 18 bp, Artificial Sequence
  Synthetic DNA
tagtacgcctcactttag

SEQ ID NO: 9601 - DNA, 18 bp, Artificial Sequence
  Synthetic DNA
tagtaggactcactttag

SEQ ID NO: 9602 - DNA, 18 bp, Artificial Sequence
  Synthetic DNA
tattacgcctcattatag

SEQ ID NO: 9603 - DNA, 18 bp, Artificial Sequence
  Synthetic DNA
tcaagcgactcactatag

SEQ ID NO: 9604 - DNA, 18 bp, Artificial Sequence
  Synthetic DNA
tgatacaacttactatag

SEQ ID NO: 9605 - DNA, 18 bp, Artificial Sequence
  Synthetic DNA
aaatacggctaactatag

SEQ ID NO: 9606 - DNA, 18 bp, Artificial Sequence
  Synthetic DNA
aaatacggctcactaaag

SEQ ID NO: 9607 - DNA, 18 bp, Artificial Sequence
  Synthetic DNA
aagtacgacccactatag

SEQ ID NO: 9608 - DNA, 18 bp, Artificial Sequence
  Synthetic DNA
caatacgaatcaatatag

SEQ ID NO: 9609 - DNA, 18 bp, Artificial Sequence
  Synthetic DNA
caatacgactcattatcg

SEQ ID NO: 9610 - DNA, 18 bp, Artificial Sequence
  Synthetic DNA
caatacgccacactatag

SEQ ID NO: 9611 - DNA, 18 bp, Artificial Sequence
  Synthetic DNA
ctatacggctcactatag

SEQ ID NO: 9612 - DNA, 18 bp, Artificial Sequence
  Synthetic DNA
taacaagactcactagag

SEQ ID NO: 9613 - DNA, 18 bp, Artificial Sequence
  Synthetic DNA
taacacgaattactatag

SEQ ID NO: 9614 - DNA, 18 bp, Artificial Sequence
  Synthetic DNA
taacactactccctatag

SEQ ID NO: 9615 - DNA, 18 bp, Artificial Sequence
  Synthetic DNA
taaccccactcactatag

SEQ ID NO: 9616 - DNA, 18 bp, Artificial Sequence
  Synthetic DNA
taactcgactcactatgg

SEQ ID NO: 9617 - DNA, 18 bp, Artificial Sequence
  Synthetic DNA
taagacgtctcactaaag

SEQ ID NO: 9618 - DNA, 18 bp, Artificial Sequence
  Synthetic DNA
taagaggactcactatcg

SEQ ID NO: 9619 - DNA, 18 bp, Artificial Sequence
  Synthetic DNA
taagccgactcacaatag

SEQ ID NO: 9620 - DNA, 18 bp, Artificial Sequence
  Synthetic DNA
taataaaactccctatag

SEQ ID NO: 9621 - DNA, 18 bp, Artificial Sequence
  Synthetic DNA
taataagacttactacag

SEQ ID NO: 9622 - DNA, 18 bp, Artificial Sequence
  Synthetic DNA
taataagattcactagag

SEQ ID NO: 9623 - DNA, 18 bp, Artificial Sequence
  Synthetic DNA
taataagattcgctatag

SEQ ID NO: 9624 - DNA, 18 bp, Artificial Sequence
  Synthetic DNA
taatacccctcactacag

SEQ ID NO: 9625 - DNA, 18 bp, Artificial Sequence
  Synthetic DNA
taatacgaatccccatag

SEQ ID NO: 9626 - DNA, 18 bp, Artificial Sequence
  Synthetic DNA
taatacgactctctggag

SEQ ID NO: 9627 - DNA, 18 bp, Artificial Sequence
  Synthetic DNA
taatacgactgattctag

SEQ ID NO: 9628 - DNA, 18 bp, Artificial Sequence
  Synthetic DNA
taatacgagtcaccctag

SEQ ID NO: 9629 - DNA, 18 bp, Artificial Sequence
  Synthetic DNA
taatacgagtctccatag

SEQ ID NO: 9630 - DNA, 18 bp, Artificial Sequence
  Synthetic DNA
taatacgtcctactatag

SEQ ID NO: 9631 - DNA, 18 bp, Artificial Sequence
  Synthetic DNA
taatacgtctccctagag

SEQ ID NO: 9632 - DNA, 18 bp, Artificial Sequence
  Synthetic DNA
taataggaatcactacag

SEQ ID NO: 9633 - DNA, 18 bp, Artificial Sequence
  Synthetic DNA
taataggagtctctatag

SEQ ID NO: 9634 - DNA, 18 bp, Artificial Sequence
  Synthetic DNA
taataggattcattatag

SEQ ID NO: 9635 - DNA, 18 bp, Artificial Sequence
  Synthetic DNA
taatagtcctcactatag

SEQ ID NO: 9636 - DNA, 18 bp, Artificial Sequence
  Synthetic DNA
taatagtgctcactatag

SEQ ID NO: 9637 - DNA, 18 bp, Artificial Sequence
  Synthetic DNA
taatataactcactatgg

SEQ ID NO: 9638 - DNA, 18 bp, Artificial Sequence
  Synthetic DNA
taatatgactccctatcg

SEQ ID NO: 9639 - DNA, 18 bp, Artificial Sequence
  Synthetic DNA
taatatggctcactaaag

SEQ ID NO: 9640 - DNA, 18 bp, Artificial Sequence
  Synthetic DNA
taatatgtctcactagag

SEQ ID NO: 9641 - DNA, 18 bp, Artificial Sequence
  Synthetic DNA
taatattactcagtatag

SEQ ID NO: 9642 - DNA, 18 bp, Artificial Sequence
  Synthetic DNA
taatcccactcactttag

SEQ ID NO: 9643 - DNA, 18 bp, Artificial Sequence
  Synthetic DNA
taatccgaatcgctatag

SEQ ID NO: 9644 - DNA, 18 bp, Artificial Sequence
  Synthetic DNA
taattagactcactatgg

SEQ ID NO: 9645 - DNA, 18 bp, Artificial Sequence
  Synthetic DNA
taattccactgactatag

SEQ ID NO: 9646 - DNA, 18 bp, Artificial Sequence
  Synthetic DNA
taattcgacccacaatag

SEQ ID NO: 9647 - DNA, 18 bp, Artificial Sequence
  Synthetic DNA
taattcgacccactgtag

SEQ ID NO: 9648 - DNA, 18 bp, Artificial Sequence
  Synthetic DNA
taccacgactgactatag

SEQ ID NO: 9649 - DNA, 18 bp, Artificial Sequence
  Synthetic DNA
tacgactactcactatag

SEQ ID NO: 9650 - DNA, 18 bp, Artificial Sequence
  Synthetic DNA
tactacgaatcactatgg

SEQ ID NO: 9651 - DNA, 18 bp, Artificial Sequence
  Synthetic DNA
tactacgactcagtttag

SEQ ID NO: 9652 - DNA, 18 bp, Artificial Sequence
  Synthetic DNA
tacttcgactcaccatag

SEQ ID NO: 9653 - DNA, 18 bp, Artificial Sequence
  Synthetic DNA
tagaacgactcactgtag

SEQ ID NO: 9654 - DNA, 18 bp, Artificial Sequence
  Synthetic DNA
tattacgactcaggatag

SEQ ID NO: 9655 - DNA, 18 bp, Artificial Sequence
  Synthetic DNA
tcatacacctcactatag

SEQ ID NO: 9656 - DNA, 18 bp, Artificial Sequence
  Synthetic DNA
tcatactactccctatag

SEQ ID NO: 9657 - DNA, 18 bp, Artificial Sequence
  Synthetic DNA
tcctacgactcactattg

SEQ ID NO: 9658 - DNA, 18 bp, Artificial Sequence
  Synthetic DNA
tgaaacgcctcactatag

SEQ ID NO: 9659 - DNA, 18 bp, Artificial Sequence
  Synthetic DNA
tgatacgaccctctatag

SEQ ID NO: 9660 - DNA, 18 bp, Artificial Sequence
  Synthetic DNA
ttatacgactcaccagag

SEQ ID NO: 9661 - DNA, 18 bp, Artificial Sequence
  Synthetic DNA
taatacgactctttattg

SEQ ID NO: 9662 - DNA, 18 bp, Artificial Sequence
  Synthetic DNA
taatacatctcactaaag

SEQ ID NO: 9663 - DNA, 18 bp, Artificial Sequence
  Synthetic DNA
taatacgactcaaaattg

SEQ ID NO: 9664 - DNA, 18 bp, Artificial Sequence
  Synthetic DNA
taatacgaatcacttaag

SEQ ID NO: 9665 - DNA, 18 bp, Artificial Sequence
  Synthetic DNA
taatacgaattactaaag

SEQ ID NO: 9666 - DNA, 18 bp, Artificial Sequence
  Synthetic DNA
tgttacgactctctatag

SEQ ID NO: 9667 - DNA, 18 bp, Artificial Sequence
  Synthetic DNA
taatactacacacaatag

SEQ ID NO: 9668 - DNA, 18 bp, Artificial Sequence
  Synthetic DNA
caatacgactaactttag

SEQ ID NO: 9669 - DNA, 18 bp, Artificial Sequence
  Synthetic DNA
taaaacggctcactaaag

SEQ ID NO: 9670 - DNA, 18 bp, Artificial Sequence
  Synthetic DNA
taatacgactcacctaag

SEQ ID NO: 9671 - DNA, 18 bp, Artificial Sequence
  Synthetic DNA
taatatgactctctattg

SEQ ID NO: 9672 - DNA, 18 bp, Artificial Sequence
  Synthetic DNA
tattacgattcactattg

SEQ ID NO: 9673 - DNA, 18 bp, Artificial Sequence
  Synthetic DNA
taatacgacactttatag

SEQ ID NO: 9674 - DNA, 18 bp, Artificial Sequence
  Synthetic DNA
aaatacgactcacattag

SEQ ID NO: 9675 - DNA, 18 bp, Artificial Sequence
  Synthetic DNA
tattacgacaccctatag

SEQ ID NO: 9676 - DNA, 18 bp, Artificial Sequence
  Synthetic DNA
tcatacgtctcactttag

SEQ ID NO: 9677 - DNA, 18 bp, Artificial Sequence
  Synthetic DNA
ttatacgacacactatcg

SEQ ID NO: 9678 - DNA, 18 bp, Artificial Sequence
  Synthetic DNA
ttattcgactcactatgg

SEQ ID NO: 9679 - DNA, 18 bp, Artificial Sequence
  Synthetic DNA
taacattactcactatag

SEQ ID NO: 9680 - DNA, 18 bp, Artificial Sequence
  Synthetic DNA
taataagtctcactgtag

SEQ ID NO: 9681 - DNA, 18 bp, Artificial Sequence
  Synthetic DNA
taataccgctcactattg

SEQ ID NO: 9682 - DNA, 18 bp, Artificial Sequence
  Synthetic DNA
taatacgacccattattg

SEQ ID NO: 9683 - DNA, 18 bp, Artificial Sequence
  Synthetic DNA
taatacgactacctttag

SEQ ID NO: 9684 - DNA, 18 bp, Artificial Sequence
  Synthetic DNA
taatacgactctatatcg

SEQ ID NO: 9685 - DNA, 18 bp, Artificial Sequence
  Synthetic DNA
taatacgacttagtattg

SEQ ID NO: 9686 - DNA, 18 bp, Artificial Sequence
  Synthetic DNA
taatacgattgactttag

SEQ ID NO: 9687 - DNA, 18 bp, Artificial Sequence
  Synthetic DNA
taatactactctctatgg

SEQ ID NO: 9688 - DNA, 18 bp, Artificial Sequence
  Synthetic DNA
taatatgacacaccatag

SEQ ID NO: 9689 - DNA, 18 bp, Artificial Sequence
  Synthetic DNA
taatatgattcgctatag

SEQ ID NO: 9690 - DNA, 18 bp, Artificial Sequence
  Synthetic DNA
tcaatcgactcactatag

SEQ ID NO: 9691 - DNA, 18 bp, Artificial Sequence
  Synthetic DNA
ttatacaagtcactatag

SEQ ID NO: 9692 - DNA, 18 bp, Artificial Sequence
  Synthetic DNA
taataagactcacaattg

SEQ ID NO: 9693 - DNA, 18 bp, Artificial Sequence
  Synthetic DNA
atacacgactcactatag

SEQ ID NO: 9694 - DNA, 18 bp, Artificial Sequence
  Synthetic DNA
taatacgatacattatag

SEQ ID NO: 9695 - DNA, 18 bp, Artificial Sequence
  Synthetic DNA
taatacgattcattattg

SEQ ID NO: 9696 - DNA, 18 bp, Artificial Sequence
  Synthetic DNA
aaataagactctctatag

SEQ ID NO: 9697 - DNA, 18 bp, Artificial Sequence
  Synthetic DNA
aagaacgactcactatag

SEQ ID NO: 9698 - DNA, 18 bp, Artificial Sequence
  Synthetic DNA
caatacgtttcactatag

SEQ ID NO: 9699 - DNA, 18 bp, Artificial Sequence
  Synthetic DNA
taaaacgaatcactaaag

SEQ ID NO: 9700 - DNA, 18 bp, Artificial Sequence
  Synthetic DNA
taatacgacagacaatag

SEQ ID NO: 9701 - DNA, 18 bp, Artificial Sequence
  Synthetic DNA
taatacgtctgacaatag

SEQ ID NO: 9702 - DNA, 18 bp, Artificial Sequence
  Synthetic DNA
taatacgtttcgctatag

SEQ ID NO: 9703 - DNA, 18 bp, Artificial Sequence
  Synthetic DNA
tatcacgactcattatag

SEQ ID NO: 9704 - DNA, 18 bp, Artificial Sequence
  Synthetic DNA
tattgtgactcactatag

SEQ ID NO: 9705 - DNA, 18 bp, Artificial Sequence
  Synthetic DNA
ttatacacctcactatag

SEQ ID NO: 9706 - DNA, 18 bp, Artificial Sequence
  Synthetic DNA
ttatacgactctctttag

SEQ ID NO: 9707 - DNA, 18 bp, Artificial Sequence
  Synthetic DNA
taaaaagactaactatag

SEQ ID NO: 9708 - DNA, 18 bp, Artificial Sequence
  Synthetic DNA
tagtacgactcattattg

SEQ ID NO: 9709 - DNA, 18 bp, Artificial Sequence
  Synthetic DNA
taaaacaactcacaatag

SEQ ID NO: 9710 - DNA, 18 bp, Artificial Sequence
  Synthetic DNA
aattacgactcacaatag

SEQ ID NO: 9711 - DNA, 18 bp, Artificial Sequence
  Synthetic DNA
taatacgattctctaaag

SEQ ID NO: 9712 - DNA, 18 bp, Artificial Sequence
  Synthetic DNA
taatacaacacactaaag

SEQ ID NO: 9713 - DNA, 18 bp, Artificial Sequence
  Synthetic DNA
ttatacgaaacactatag

SEQ ID NO: 9714 - DNA, 18 bp, Artificial Sequence
  Synthetic DNA
taatgcgactctcaatag

SEQ ID NO: 9715 - DNA, 18 bp, Artificial Sequence
  Synthetic DNA
taatacgtctaaccatag

SEQ ID NO: 9716 - DNA, 18 bp, Artificial Sequence
  Synthetic DNA
taatatgaatctctatag

SEQ ID NO: 9717 - DNA, 18 bp, Artificial Sequence
  Synthetic DNA
taattcacctcactatag

SEQ ID NO: 9718 - DNA, 18 bp, Artificial Sequence
  Synthetic DNA
tataacgacttactatag

SEQ ID NO: 9719 - DNA, 18 bp, Artificial Sequence
  Synthetic DNA
tgatacgacttactttag

SEQ ID NO: 9720 - DNA, 18 bp, Artificial Sequence
  Synthetic DNA
aaattcgactcattatag

SEQ ID NO: 9721 - DNA, 18 bp, Artificial Sequence
  Synthetic DNA
caatacgactcacaaaag

SEQ ID NO: 9722 - DNA, 18 bp, Artificial Sequence
  Synthetic DNA
caatactactcactaaag

SEQ ID NO: 9723 - DNA, 18 bp, Artificial Sequence
  Synthetic DNA
taacacgacacacaatag

SEQ ID NO: 9724 - DNA, 18 bp, Artificial Sequence
  Synthetic DNA
taatacgacaaattatag

SEQ ID NO: 9725 - DNA, 18 bp, Artificial Sequence
  Synthetic DNA
taatacgagtcacaaaag

SEQ ID NO: 9726 - DNA, 18 bp, Artificial Sequence
  Synthetic DNA
taattagactaactatag

SEQ ID NO: 9727 - DNA, 18 bp, Artificial Sequence
  Synthetic DNA
tagtacgtctcactttag

SEQ ID NO: 9728 - DNA, 18 bp, Artificial Sequence
  Synthetic DNA
tcatacgattcactttag

SEQ ID NO: 9729 - DNA, 18 bp, Artificial Sequence
  Synthetic DNA
ttctacaactcactatag

SEQ ID NO: 9730 - DNA, 18 bp, Artificial Sequence
  Synthetic DNA
aaaaacgactcagtatag

SEQ ID NO: 9731 - DNA, 18 bp, Artificial Sequence
  Synthetic DNA
aaataacactcactatag

SEQ ID NO: 9732 - DNA, 18 bp, Artificial Sequence
  Synthetic DNA
aaataagactcaatatag

SEQ ID NO: 9733 - DNA, 18 bp, Artificial Sequence
  Synthetic DNA
acatatgactcactatag

SEQ ID NO: 9734 - DNA, 18 bp, Artificial Sequence
  Synthetic DNA
taatacaactcacaacag

SEQ ID NO: 9735 - DNA, 18 bp, Artificial Sequence
  Synthetic DNA
taatacgaccatctatag

SEQ ID NO: 9736 - DNA, 18 bp, Artificial Sequence
  Synthetic DNA
taatacgactaccaatag

SEQ ID NO: 9737 - DNA, 18 bp, Artificial Sequence
  Synthetic DNA
taatacgtctcacgattg

SEQ ID NO: 9738 - DNA, 18 bp, Artificial Sequence
  Synthetic DNA
taataggatacactatag

SEQ ID NO: 9739 - DNA, 18 bp, Artificial Sequence
  Synthetic DNA
taatataacttactatag

SEQ ID NO: 9740 - DNA, 18 bp, Artificial Sequence
  Synthetic DNA
taatatgacttactatcg

SEQ ID NO: 9741 - DNA, 18 bp, Artificial Sequence
  Synthetic DNA
taattcgactcaatagag

SEQ ID NO: 9742 - DNA, 18 bp, Artificial Sequence
  Synthetic DNA
taattggacttactatag

SEQ ID NO: 9743 - DNA, 18 bp, Artificial Sequence
  Synthetic DNA
tactacaactaactatag

SEQ ID NO: 9744 - DNA, 18 bp, Artificial Sequence
  Synthetic DNA
ttatacgactcacaagag

SEQ ID NO: 9745 - DNA, 18 bp, Artificial Sequence
  Synthetic DNA
ttatacgattcaccatag

SEQ ID NO: 9746 - DNA, 18 bp, Artificial Sequence
  Synthetic DNA
aaatacgactgattatag

SEQ ID NO: 9747 - DNA, 18 bp, Artificial Sequence
  Synthetic DNA
aaatatgactcactctag

SEQ ID NO: 9748 - DNA, 18 bp, Artificial Sequence
  Synthetic DNA
aaccacgactcactatag

SEQ ID NO: 9749 - DNA, 18 bp, Artificial Sequence
  Synthetic DNA
caatacgacacactagag

SEQ ID NO: 9750 - DNA, 18 bp, Artificial Sequence
  Synthetic DNA
caatacgaccctctatag

SEQ ID NO: 9751 - DNA, 18 bp, Artificial Sequence
  Synthetic DNA
caatacgcctcactaaag

SEQ ID NO: 9752 - DNA, 18 bp, Artificial Sequence
  Synthetic DNA
gaatacgcctcactatcg

SEQ ID NO: 9753 - DNA, 18 bp, Artificial Sequence
  Synthetic DNA
gaatatgactcacaatag

SEQ ID NO: 9754 - DNA, 18 bp, Artificial Sequence
  Synthetic DNA
gattacgactccctatag

SEQ ID NO: 9755 - DNA, 18 bp, Artificial Sequence
  Synthetic DNA
taaaccgacacactatag

SEQ ID NO: 9756 - DNA, 18 bp, Artificial Sequence
  Synthetic DNA
taaaccgactcactatgg

SEQ ID NO: 9757 - DNA, 18 bp, Artificial Sequence
  Synthetic DNA
taacacgacacaatatag

SEQ ID NO: 9758 - DNA, 18 bp, Artificial Sequence
  Synthetic DNA
taacacgactcactctcg

SEQ ID NO: 9759 - DNA, 18 bp, Artificial Sequence
  Synthetic DNA
taacacgcctcattatag

SEQ ID NO: 9760 - DNA, 18 bp, Artificial Sequence
  Synthetic DNA
taacccgactcactatcg

SEQ ID NO: 9761 - DNA, 18 bp, Artificial Sequence
  Synthetic DNA
taagatgactcaatatag

SEQ ID NO: 9762 - DNA, 18 bp, Artificial Sequence
  Synthetic DNA
taataacaatcactatag

SEQ ID NO: 9763 - DNA, 18 bp, Artificial Sequence
  Synthetic DNA
taataagacacacgatag

SEQ ID NO: 9764 - DNA, 18 bp, Artificial Sequence
  Synthetic DNA
taataagagtcattatag

SEQ ID NO: 9765 - DNA, 18 bp, Artificial Sequence
  Synthetic DNA
taataaggctctctatag

SEQ ID NO: 9766 - DNA, 18 bp, Artificial Sequence
  Synthetic DNA
taatacaactcacagtag

SEQ ID NO: 9767 - DNA, 18 bp, Artificial Sequence
  Synthetic DNA
taatacaactccctacag

SEQ ID NO: 9768 - DNA, 18 bp, Artificial Sequence
  Synthetic DNA
taatacgaaacactgtag

SEQ ID NO: 9769 - DNA, 18 bp, Artificial Sequence
  Synthetic DNA
taatacgaccaactacag

SEQ ID NO: 9770 - DNA, 18 bp, Artificial Sequence
  Synthetic DNA
taatacgactcagaatcg

SEQ ID NO: 9771 - DNA, 18 bp, Artificial Sequence
  Synthetic DNA
taatacgccttactatgg

SEQ ID NO: 9772 - DNA, 18 bp, Artificial Sequence
  Synthetic DNA
taatacggctaaatatag

SEQ ID NO: 9773 - DNA, 18 bp, Artificial Sequence
  Synthetic DNA
taataggactcccaatag

SEQ ID NO: 9774 - DNA, 18 bp, Artificial Sequence
  Synthetic DNA
taatatcactcattatag

SEQ ID NO: 9775 - DNA, 18 bp, Artificial Sequence
  Synthetic DNA
taattcgactcattagag

SEQ ID NO: 9776 - DNA, 18 bp, Artificial Sequence
  Synthetic DNA
taattcgagtaactatag

SEQ ID NO: 9777 - DNA, 18 bp, Artificial Sequence
  Synthetic DNA
tactacgactcactcaag

SEQ ID NO: 9778 - DNA, 18 bp, Artificial Sequence
  Synthetic DNA
tactatgactcactaaag

SEQ ID NO: 9779 - DNA, 18 bp, Artificial Sequence
  Synthetic DNA
tagcacgattcactatag

SEQ ID NO: 9780 - DNA, 18 bp, Artificial Sequence
  Synthetic DNA
tagcccgactcactatag

SEQ ID NO: 9781 - DNA, 18 bp, Artificial Sequence
  Synthetic DNA
tagtaccactcactatcg

SEQ ID NO: 9782 - DNA, 18 bp, Artificial Sequence
  Synthetic DNA
tagtacgacttacaatag

SEQ ID NO: 9783 - DNA, 18 bp, Artificial Sequence
  Synthetic DNA
tagtgcgtctcactatag

SEQ ID NO: 9784 - DNA, 18 bp, Artificial Sequence
  Synthetic DNA
tattacgacccactatgg

SEQ ID NO: 9785 - DNA, 18 bp, Artificial Sequence
  Synthetic DNA
tattacgactccctagag

SEQ ID NO: 9786 - DNA, 18 bp, Artificial Sequence
  Synthetic DNA
tcataggacttactatag

SEQ ID NO: 9787 - DNA, 18 bp, Artificial Sequence
  Synthetic DNA
tcttaccactcactatag

SEQ ID NO: 9788 - DNA, 18 bp, Artificial Sequence
  Synthetic DNA
tgataccactcactacag

SEQ ID NO: 9789 - DNA, 18 bp, Artificial Sequence
  Synthetic DNA
tgatacgactcattagag

SEQ ID NO: 9790 - DNA, 18 bp, Artificial Sequence
  Synthetic DNA
tgatacgactcccaatag

SEQ ID NO: 9791 - DNA, 18 bp, Artificial Sequence
  Synthetic DNA
tgctacgactcattatag

SEQ ID NO: 9792 - DNA, 18 bp, Artificial Sequence
  Synthetic DNA
ttatactactcactattg

SEQ ID NO: 9793 - DNA, 18 bp, Artificial Sequence
  Synthetic DNA
aattacgactcactattg

SEQ ID NO: 9794 - DNA, 18 bp, Artificial Sequence
  Synthetic DNA
taattcgactatctatag

SEQ ID NO: 9795 - DNA, 18 bp, Artificial Sequence
  Synthetic DNA
aaatacgaatcactattg

SEQ ID NO: 9796 - DNA, 18 bp, Artificial Sequence
  Synthetic DNA
taaaacgactcaatattg

SEQ ID NO: 9797 - DNA, 18 bp, Artificial Sequence
  Synthetic DNA
taattcgacttactaaag

SEQ ID NO: 9798 - DNA, 18 bp, Artificial Sequence
  Synthetic DNA
atatacgaatcactatag

SEQ ID NO: 9799 - DNA, 18 bp, Artificial Sequence
  Synthetic DNA
tattacgaatcacaatag

SEQ ID NO: 9800 - DNA, 18 bp, Artificial Sequence
  Synthetic DNA
tatttcgacacactatag

SEQ ID NO: 9801 - DNA, 18 bp, Artificial Sequence
  Synthetic DNA
aaatacggctcactattg

SEQ ID NO: 9802 - DNA, 18 bp, Artificial Sequence
  Synthetic DNA
taaaatgactcaatatag

SEQ ID NO: 9803 - DNA, 18 bp, Artificial Sequence
  Synthetic DNA
taatactaatctctatag

SEQ ID NO: 9804 - DNA, 18 bp, Artificial Sequence
  Synthetic DNA
taaaactactcactattg

SEQ ID NO: 9805 - DNA, 18 bp, Artificial Sequence
  Synthetic DNA
tattacgactcataatag

SEQ ID NO: 9806 - DNA, 18 bp, Artificial Sequence
  Synthetic DNA
taattcgaatcactctag

SEQ ID NO: 9807 - DNA, 18 bp, Artificial Sequence
  Synthetic DNA
tagtacgactcactaatg

SEQ ID NO: 9808 - DNA, 18 bp, Artificial Sequence
  Synthetic DNA
tataacgactcagtatag

SEQ ID NO: 9809 - DNA, 18 bp, Artificial Sequence
  Synthetic DNA
tattacgactcatcatag

SEQ ID NO: 9810 - DNA, 18 bp, Artificial Sequence
  Synthetic DNA
tattacgcctcacaatag

SEQ ID NO: 9811 - DNA, 18 bp, Artificial Sequence
  Synthetic DNA
tattaggacacactatag

SEQ ID NO: 9812 - DNA, 18 bp, Artificial Sequence
  Synthetic DNA
tgattcgactcattatag

SEQ ID NO: 9813 - DNA, 18 bp, Artificial Sequence
  Synthetic DNA
taatacgactaacttaag

SEQ ID NO: 9814 - DNA, 18 bp, Artificial Sequence
  Synthetic DNA
taatatgacttactaaag

SEQ ID NO: 9815 - DNA, 18 bp, Artificial Sequence
  Synthetic DNA
taaaacgactcaaaatag

SEQ ID NO: 9816 - DNA, 18 bp, Artificial Sequence
  Synthetic DNA
taatacgacttaataaag

SEQ ID NO: 9817 - DNA, 18 bp, Artificial Sequence
  Synthetic DNA
aaaaacgactcactatcg

SEQ ID NO: 9818 - DNA, 18 bp, Artificial Sequence
  Synthetic DNA
aaataggacacactatag

SEQ ID NO: 9819 - DNA, 18 bp, Artificial Sequence
  Synthetic DNA
taatacaacttaatatag

SEQ ID NO: 9820 - DNA, 18 bp, Artificial Sequence
  Synthetic DNA
taatacgactcataatgg

SEQ ID NO: 9821 - DNA, 18 bp, Artificial Sequence
  Synthetic DNA
taatgcgaatctctatag

SEQ ID NO: 9822 - DNA, 18 bp, Artificial Sequence
  Synthetic DNA
taattcgacacactacag

SEQ ID NO: 9823 - DNA, 18 bp, Artificial Sequence
  Synthetic DNA
tactatgacttactatag

SEQ ID NO: 9824 - DNA, 18 bp, Artificial Sequence
  Synthetic DNA
tattaccgctcactatag

SEQ ID NO: 9825 - DNA, 18 bp, Artificial Sequence
  Synthetic DNA
tcataagtctcactatag

SEQ ID NO: 9826 - DNA, 18 bp, Artificial Sequence
  Synthetic DNA
ttaaacgactcacaatag

SEQ ID NO: 9827 - DNA, 18 bp, Artificial Sequence
  Synthetic DNA
ttttactactcactatag

SEQ ID NO: 9828 - DNA, 18 bp, Artificial Sequence
  Synthetic DNA
ttttacgactctctatag

SEQ ID NO: 9829 - DNA, 18 bp, Artificial Sequence
  Synthetic DNA
taatacgaatctcaatag

SEQ ID NO: 9830 - DNA, 18 bp, Artificial Sequence
  Synthetic DNA
taatacgactaacttcag

SEQ ID NO: 9831 - DNA, 18 bp, Artificial Sequence
  Synthetic DNA
taatccttctcactatag

SEQ ID NO: 9832 - DNA, 18 bp, Artificial Sequence
  Synthetic DNA
ttatacgactcattattg

SEQ ID NO: 9833 - DNA, 18 bp, Artificial Sequence
  Synthetic DNA
taaaacgattcattatag

SEQ ID NO: 9834 - DNA, 18 bp, Artificial Sequence
  Synthetic DNA
tcatacgactcacattag

SEQ ID NO: 9835 - DNA, 18 bp, Artificial Sequence
  Synthetic DNA
tactacgactcacaattg

SEQ ID NO: 9836 - DNA, 18 bp, Artificial Sequence
  Synthetic DNA
ttatactactctctatag

SEQ ID NO: 9837 - DNA, 18 bp, Artificial Sequence
  Synthetic DNA
taatacgaatctctaaag

SEQ ID NO: 9838 - DNA, 18 bp, Artificial Sequence
  Synthetic DNA
taattcgactaacaatag

SEQ ID NO: 9839 - DNA, 18 bp, Artificial Sequence
  Synthetic DNA
taaatcgaatcactatag

SEQ ID NO: 9840 - DNA, 18 bp, Artificial Sequence
  Synthetic DNA
taatacgagacactttag

SEQ ID NO: 9841 - DNA, 18 bp, Artificial Sequence
  Synthetic DNA
taatccgattcacaatag

SEQ ID NO: 9842 - DNA, 18 bp, Artificial Sequence
  Synthetic DNA
taatgcgacacacaatag

SEQ ID NO: 9843 - DNA, 18 bp, Artificial Sequence
  Synthetic DNA
ttgtacgactcactaaag

SEQ ID NO: 9844 - DNA, 18 bp, Artificial Sequence
  Synthetic DNA
taatacttctcactttag

SEQ ID NO: 9845 - DNA, 18 bp, Artificial Sequence
  Synthetic DNA
aaattcgactaactatag

SEQ ID NO: 9846 - DNA, 18 bp, Artificial Sequence
  Synthetic DNA
taaaactactcactatgg

SEQ ID NO: 9847 - DNA, 18 bp, Artificial Sequence
  Synthetic DNA
taataccattcattatag

SEQ ID NO: 9848 - DNA, 18 bp, Artificial Sequence
  Synthetic DNA
taatacgactcccagtag

SEQ ID NO: 9849 - DNA, 18 bp, Artificial Sequence
  Synthetic DNA
taatacgagtcaaaatag

SEQ ID NO: 9850 - DNA, 18 bp, Artificial Sequence
  Synthetic DNA
taataggacacactttag

SEQ ID NO: 9851 - DNA, 18 bp, Artificial Sequence
  Synthetic DNA
taattcgcctcattatag

SEQ ID NO: 9852 - DNA, 18 bp, Artificial Sequence
  Synthetic DNA
tactacgacttactattg

SEQ ID NO: 9853 - DNA, 18 bp, Artificial Sequence
  Synthetic DNA
aaatacgactgactaaag

SEQ ID NO: 9854 - DNA, 18 bp, Artificial Sequence
  Synthetic DNA
aaatacgagtcaatatag

SEQ ID NO: 9855 - DNA, 18 bp, Artificial Sequence
  Synthetic DNA
aaatacgcctcaatatag

SEQ ID NO: 9856 - DNA, 18 bp, Artificial Sequence
  Synthetic DNA
aaatacggctcactttag

SEQ ID NO: 9857 - DNA, 18 bp, Artificial Sequence
  Synthetic DNA
aagtacgactcgctatag

SEQ ID NO: 9858 - DNA, 18 bp, Artificial Sequence
  Synthetic DNA
caataaaactcactatag

SEQ ID NO: 9859 - DNA, 18 bp, Artificial Sequence
  Synthetic DNA
caatacgaatcgctatag

SEQ ID NO: 9860 - DNA, 18 bp, Artificial Sequence
  Synthetic DNA
caatacgacttacaatag

SEQ ID NO: 9861 - DNA, 18 bp, Artificial Sequence
  Synthetic DNA
caatacgtctcactacag

SEQ ID NO: 9862 - DNA, 18 bp, Artificial Sequence
  Synthetic DNA
caattcggctcactatag

SEQ ID NO: 9863 - DNA, 18 bp, Artificial Sequence
  Synthetic DNA
cattacgactccctatag

SEQ ID NO: 9864 - DNA, 18 bp, Artificial Sequence
  Synthetic DNA
gaataagacacactatag

SEQ ID NO: 9865 - DNA, 18 bp, Artificial Sequence
  Synthetic DNA
taacacgacacagtatag

SEQ ID NO: 9866 - DNA, 18 bp, Artificial Sequence
  Synthetic DNA
taacccgactcactttag

SEQ ID NO: 9867 - DNA, 18 bp, Artificial Sequence
  Synthetic DNA
taataagactgactacag

SEQ ID NO: 9868 - DNA, 18 bp, Artificial Sequence
  Synthetic DNA
taataaggatcactatag

SEQ ID NO: 9869 - DNA, 18 bp, Artificial Sequence
  Synthetic DNA
taatacaaatcgctatag

SEQ ID NO: 9870 - DNA, 18 bp, Artificial Sequence
  Synthetic DNA
taataccacacactatgg

SEQ ID NO: 9871 - DNA, 18 bp, Artificial Sequence
  Synthetic DNA
taataccacgcattatag

SEQ ID NO: 9872 - DNA, 18 bp, Artificial Sequence
  Synthetic DNA
taatacgacccactaacg

SEQ ID NO: 9873 - DNA, 18 bp, Artificial Sequence
  Synthetic DNA
taatacgactctcgaaag

SEQ ID NO: 9874 - DNA, 18 bp, Artificial Sequence
  Synthetic DNA
taatacgagtcaacatag

SEQ ID NO: 9875 - DNA, 18 bp, Artificial Sequence
  Synthetic DNA
taatacgattgacaatag

SEQ ID NO: 9876 - DNA, 18 bp, Artificial Sequence
  Synthetic DNA
taatacgcctaactacag

SEQ ID NO: 9877 - DNA, 18 bp, Artificial Sequence
  Synthetic DNA
taatacggctcaatatcg

SEQ ID NO: 9878 - DNA, 18 bp, Artificial Sequence
  Synthetic DNA
taatactactccctgtag

SEQ ID NO: 9879 - DNA, 18 bp, Artificial Sequence
  Synthetic DNA
taatactcctcagtatag

SEQ ID NO: 9880 - DNA, 18 bp, Artificial Sequence
  Synthetic DNA
taatatgactcagtaaag

SEQ ID NO: 9881 - DNA, 18 bp, Artificial Sequence
  Synthetic DNA
taatcctactccctatag

SEQ ID NO: 9882 - DNA, 18 bp, Artificial Sequence
  Synthetic DNA
taatctgactcacaatag

SEQ ID NO: 9883 - DNA, 18 bp, Artificial Sequence
  Synthetic DNA
taatgcgactcaacatag

SEQ ID NO: 9884 - DNA, 18 bp, Artificial Sequence
  Synthetic DNA
taatgcgattccctatag

SEQ ID NO: 9885 - DNA, 18 bp, Artificial Sequence
  Synthetic DNA
tactacgacccactaaag

SEQ ID NO: 9886 - DNA, 18 bp, Artificial Sequence
  Synthetic DNA
tactacgactcacaacag

SEQ ID NO: 9887 - DNA, 18 bp, Artificial Sequence
  Synthetic DNA
tactacgactctctatcg

SEQ ID NO: 9888 - DNA, 18 bp, Artificial Sequence
  Synthetic DNA
tagtacgactcactgaag

SEQ ID NO: 9889 - DNA, 18 bp, Artificial Sequence
  Synthetic DNA
tagtactcctcactatag

SEQ ID NO: 9890 - DNA, 18 bp, Artificial Sequence
  Synthetic DNA
tagtatgactaactatag

SEQ ID NO: 9891 - DNA, 18 bp, Artificial Sequence
  Synthetic DNA
tagtatgactgactatag

SEQ ID NO: 9892 - DNA, 18 bp, Artificial Sequence
  Synthetic DNA
tattatgactcgctatag

SEQ ID NO: 9893 - DNA, 18 bp, Artificial Sequence
  Synthetic DNA
tcatacgactcaatatcg

SEQ ID NO: 9894 - DNA, 18 bp, Artificial Sequence
  Synthetic DNA
tcatgcaactcactatag

SEQ ID NO: 9895 - DNA, 18 bp, Artificial Sequence
  Synthetic DNA
tgataagactcaatatag

SEQ ID NO: 9896 - DNA, 18 bp, Artificial Sequence
  Synthetic DNA
tgatacgactcatcatag

SEQ ID NO: 9897 - DNA, 18 bp, Artificial Sequence
  Synthetic DNA
tgttaccactcactatag

SEQ ID NO: 9898 - DNA, 18 bp, Artificial Sequence
  Synthetic DNA
ttatacgagtcactatcg

SEQ ID NO: 9899 - DNA, 18 bp, Artificial Sequence
  Synthetic DNA
ttatacggcccactatag

SEQ ID NO: 9900 - DNA, 18 bp, Artificial Sequence
  Synthetic DNA
ttatacggctcaatatag

SEQ ID NO: 9901 - DNA, 18 bp, Artificial Sequence
  Synthetic DNA
ttatcccactcactatag

SEQ ID NO: 9902 - DNA, 18 bp, Artificial Sequence
  Synthetic DNA
ttatccgacccactatag

SEQ ID NO: 9903 - DNA, 18 bp, Artificial Sequence
  Synthetic DNA
cattacgactcactattg

SEQ ID NO: 9904 - DNA, 18 bp, Artificial Sequence
  Synthetic DNA
taaaacgattcactattg

SEQ ID NO: 9905 - DNA, 18 bp, Artificial Sequence
  Synthetic DNA
taatacgattcattttag

SEQ ID NO: 9906 - DNA, 18 bp, Artificial Sequence
  Synthetic DNA
taataagactaactattg

SEQ ID NO: 9907 - DNA, 18 bp, Artificial Sequence
  Synthetic DNA
taatacgactctcaatgg

SEQ ID NO: 9908 - DNA, 18 bp, Artificial Sequence
  Synthetic DNA
taatatgtctcaatatag

SEQ ID NO: 9909 - DNA, 18 bp, Artificial Sequence
  Synthetic DNA
taatacgtatcaccatag

SEQ ID NO: 9910 - DNA, 18 bp, Artificial Sequence
  Synthetic DNA
taatacgtcacactacag

SEQ ID NO: 9911 - DNA, 18 bp, Artificial Sequence
  Synthetic DNA
taattcgattcaatatag

SEQ ID NO: 9912 - DNA, 18 bp, Artificial Sequence
  Synthetic DNA
taatactacacactttag

SEQ ID NO: 9913 - DNA, 18 bp, Artificial Sequence
  Synthetic DNA
tattacgactctcaatag

SEQ ID NO: 9914 - DNA, 18 bp, Artificial Sequence
  Synthetic DNA
taatatgactctctttag

SEQ ID NO: 9915 - DNA, 18 bp, Artificial Sequence
  Synthetic DNA
taatacgactcaattaag

SEQ ID NO: 9916 - DNA, 18 bp, Artificial Sequence
  Synthetic DNA
tataactactcactatag

SEQ ID NO: 9917 - DNA, 18 bp, Artificial Sequence
  Synthetic DNA
taatactactaactaaag

SEQ ID NO: 9918 - DNA, 18 bp, Artificial Sequence
  Synthetic DNA
taatatgactcattttag

SEQ ID NO: 9919 - DNA, 18 bp, Artificial Sequence
  Synthetic DNA
taattcgacacattatag

SEQ ID NO: 9920 - DNA, 18 bp, Artificial Sequence
  Synthetic DNA
tattgcgacttactatag

SEQ ID NO: 9921 - DNA, 18 bp, Artificial Sequence
  Synthetic DNA
ttatacgactgtctatag

SEQ ID NO: 9922 - DNA, 18 bp, Artificial Sequence
  Synthetic DNA
aaatacgacttaccatag

SEQ ID NO: 9923 - DNA, 18 bp, Artificial Sequence
  Synthetic DNA
aaatacgattcactctag

SEQ ID NO: 9924 - DNA, 18 bp, Artificial Sequence
  Synthetic DNA
taataccactcataatag

SEQ ID NO: 9925 - DNA, 18 bp, Artificial Sequence
  Synthetic DNA
taatacgaaacactctag

SEQ ID NO: 9926 - DNA, 18 bp, Artificial Sequence
  Synthetic DNA
taatacgacacactgttg

SEQ ID NO: 9927 - DNA, 18 bp, Artificial Sequence
  Synthetic DNA
taatacgacagactttag

SEQ ID NO: 9928 - DNA, 18 bp, Artificial Sequence
  Synthetic DNA
taatacgcctcacaaaag

SEQ ID NO: 9929 - DNA, 18 bp, Artificial Sequence
  Synthetic DNA
taatacgtctccctatcg

SEQ ID NO: 9930 - DNA, 18 bp, Artificial Sequence
  Synthetic DNA
taatactactcgcaatag

SEQ ID NO: 9931 - DNA, 18 bp, Artificial Sequence
  Synthetic DNA
taatactagtcattatag

SEQ ID NO: 9932 - DNA, 18 bp, Artificial Sequence
  Synthetic DNA
taatactattcactatcg

SEQ ID NO: 9933 - DNA, 18 bp, Artificial Sequence
  Synthetic DNA
taatatcacacactatag

SEQ ID NO: 9934 - DNA, 18 bp, Artificial Sequence
  Synthetic DNA
taatgagactcacaatag

SEQ ID NO: 9935 - DNA, 18 bp, Artificial Sequence
  Synthetic DNA
tatcacgactcgctatag

SEQ ID NO: 9936 - DNA, 18 bp, Artificial Sequence
  Synthetic DNA
tattacgaatcactacag

SEQ ID NO: 9937 - DNA, 18 bp, Artificial Sequence
  Synthetic DNA
tattacgactcaccacag

SEQ ID NO: 9938 - DNA, 18 bp, Artificial Sequence
  Synthetic DNA
tcatacgactcaataaag

SEQ ID NO: 9939 - DNA, 18 bp, Artificial Sequence
  Synthetic DNA
tcatacgtctcgctatag

SEQ ID NO: 9940 - DNA, 18 bp, Artificial Sequence
  Synthetic DNA
tgatacaactcactaaag

SEQ ID NO: 9941 - DNA, 18 bp, Artificial Sequence
  Synthetic DNA
ttaaacgactgactatag

SEQ ID NO: 9942 - DNA, 18 bp, Artificial Sequence
  Synthetic DNA
taattcgacactctatag

SEQ ID NO: 9943 - DNA, 18 bp, Artificial Sequence
  Synthetic DNA
taatacaactcataatag

SEQ ID NO: 9944 - DNA, 18 bp, Artificial Sequence
  Synthetic DNA
taatacgacttacaattg

SEQ ID NO: 9945 - DNA, 18 bp, Artificial Sequence
  Synthetic DNA
aaatacgactcattaaag

SEQ ID NO: 9946 - DNA, 18 bp, Artificial Sequence
  Synthetic DNA
agatactactcactatag

SEQ ID NO: 9947 - DNA, 18 bp, Artificial Sequence
  Synthetic DNA
taatacaattcattatag

SEQ ID NO: 9948 - DNA, 18 bp, Artificial Sequence
  Synthetic DNA
taatacgacacaccttag

SEQ ID NO: 9949 - DNA, 18 bp, Artificial Sequence
  Synthetic DNA
taatacgtctctctatgg

SEQ ID NO: 9950 - DNA, 18 bp, Artificial Sequence
  Synthetic DNA
taatacgtttcactatcg

SEQ ID NO: 9951 - DNA, 18 bp, Artificial Sequence
  Synthetic DNA
taattcaacttactatag

SEQ ID NO: 9952 - DNA, 18 bp, Artificial Sequence
  Synthetic DNA
tattacctctcactatag

SEQ ID NO: 9953 - DNA, 18 bp, Artificial Sequence
  Synthetic DNA
taatactactctctttag

SEQ ID NO: 9954 - DNA, 18 bp, Artificial Sequence
  Synthetic DNA
tactacgactctctttag

SEQ ID NO: 9955 - DNA, 18 bp, Artificial Sequence
  Synthetic DNA
ttatcctactcactatag

SEQ ID NO: 9956 - DNA, 18 bp, Artificial Sequence
  Synthetic DNA
tattacaattcactatag

SEQ ID NO: 9957 - DNA, 18 bp, Artificial Sequence
  Synthetic DNA
ttaaacgattcactatag

SEQ ID NO: 9958 - DNA, 18 bp, Artificial Sequence
  Synthetic DNA
aaatacgactctctattg

SEQ ID NO: 9959 - DNA, 18 bp, Artificial Sequence
  Synthetic DNA
taaaacgattcacaatag

SEQ ID NO: 9960 - DNA, 18 bp, Artificial Sequence
  Synthetic DNA
aactacgactcactaaag

SEQ ID NO: 9961 - DNA, 18 bp, Artificial Sequence
  Synthetic DNA
taataagactcactatta

SEQ ID NO: 9962 - DNA, 18 bp, Artificial Sequence
  Synthetic DNA
taatacaacttactttag

SEQ ID NO: 9963 - DNA, 18 bp, Artificial Sequence
  Synthetic DNA
taatacgacatattatag

SEQ ID NO: 9964 - DNA, 18 bp, Artificial Sequence
  Synthetic DNA
tagtactactcacaatag

SEQ ID NO: 9965 - DNA, 18 bp, Artificial Sequence
  Synthetic DNA
tattacgtctgactatag

SEQ ID NO: 9966 - DNA, 18 bp, Artificial Sequence
  Synthetic DNA
aaatacgactttctatag

SEQ ID NO: 9967 - DNA, 18 bp, Artificial Sequence
  Synthetic DNA
taatacgtctcgctttag

SEQ ID NO: 9968 - DNA, 18 bp, Artificial Sequence
  Synthetic DNA
taatactactcaatttag

SEQ ID NO: 9969 - DNA, 18 bp, Artificial Sequence
  Synthetic DNA
tagtacgactcacaaaag

SEQ ID NO: 9970 - DNA, 18 bp, Artificial Sequence
  Synthetic DNA
ttacacgtctcactatag

SEQ ID NO: 9971 - DNA, 18 bp, Artificial Sequence
  Synthetic DNA
ttatacgactaacaatag

SEQ ID NO: 9972 - DNA, 18 bp, Artificial Sequence
  Synthetic DNA
gattacgactcactttag

SEQ ID NO: 9973 - DNA, 18 bp, Artificial Sequence
  Synthetic DNA
taacatgacacactatag

SEQ ID NO: 9974 - DNA, 18 bp, Artificial Sequence
  Synthetic DNA
taataagactctctacag

SEQ ID NO: 9975 - DNA, 18 bp, Artificial Sequence
  Synthetic DNA
taatacgactaacaatcg

SEQ ID NO: 9976 - DNA, 18 bp, Artificial Sequence
  Synthetic DNA
taatacgactccataaag

SEQ ID NO: 9977 - DNA, 18 bp, Artificial Sequence
  Synthetic DNA
taatactactcactaacg

SEQ ID NO: 9978 - DNA, 18 bp, Artificial Sequence
  Synthetic DNA
taataggtctcaatatag

SEQ ID NO: 9979 - DNA, 18 bp, Artificial Sequence
  Synthetic DNA
tactacacctcactatag

SEQ ID NO: 9980 - DNA, 18 bp, Artificial Sequence
  Synthetic DNA
tagtacaacacactatag

SEQ ID NO: 9981 - DNA, 18 bp, Artificial Sequence
  Synthetic DNA
tcattccactcactatag

SEQ ID NO: 9982 - DNA, 18 bp, Artificial Sequence
  Synthetic DNA
ttatacgaatgactatag

SEQ ID NO: 9983 - DNA, 18 bp, Artificial Sequence
  Synthetic DNA
aaatacgactccatatag

SEQ ID NO: 9984 - DNA, 18 bp, Artificial Sequence
  Synthetic DNA
aaatacgcctcgctatag

SEQ ID NO: 9985 - DNA, 18 bp, Artificial Sequence
  Synthetic DNA
aaatgcgactcaatatag

SEQ ID NO: 9986 - DNA, 18 bp, Artificial Sequence
  Synthetic DNA
aagtacgactcaccatag

SEQ ID NO: 9987 - DNA, 18 bp, Artificial Sequence
  Synthetic DNA
caatacgaatcactgtag

SEQ ID NO: 9988 - DNA, 18 bp, Artificial Sequence
  Synthetic DNA
caatgcgactcaatatag

SEQ ID NO: 9989 - DNA, 18 bp, Artificial Sequence
  Synthetic DNA
gaatacgaataactatag

SEQ ID NO: 9990 - DNA, 18 bp, Artificial Sequence
  Synthetic DNA
taaaacgaagcactatag

SEQ ID NO: 9991 - DNA, 18 bp, Artificial Sequence
  Synthetic DNA
taacacgacgctctatag

SEQ ID NO: 9992 - DNA, 18 bp, Artificial Sequence
  Synthetic DNA
taacacgactaattatag

SEQ ID NO: 9993 - DNA, 18 bp, Artificial Sequence
  Synthetic DNA
taacacgtgtcactatag

SEQ ID NO: 9994 - DNA, 18 bp, Artificial Sequence
  Synthetic DNA
taacactactcactatgg

SEQ ID NO: 9995 - DNA, 18 bp, Artificial Sequence
  Synthetic DNA
taacgagactcactatag

SEQ ID NO: 9996 - DNA, 18 bp, Artificial Sequence
  Synthetic DNA
taataagcctcaccatag

SEQ ID NO: 9997 - DNA, 18 bp, Artificial Sequence
  Synthetic DNA
taataccactcactcaag

SEQ ID NO: 9998 - DNA, 18 bp, Artificial Sequence
  Synthetic DNA
taataccactctctgtag

SEQ ID NO: 9999 - DNA, 18 bp, Artificial Sequence
  Synthetic DNA
taataccacttcctatag

SEQ ID NO: 10000 - DNA, 18 bp, Artificial Sequence
  Synthetic DNA
taatacctcgcactatag

SEQ ID NO: 10001 - DNA, 18 bp, Artificial Sequence
  Synthetic DNA
taatacgaatcagtctag

SEQ ID NO: 10002 - DNA, 18 bp, Artificial Sequence
  Synthetic DNA
taatacgacatactctag

SEQ ID NO: 10003 - DNA, 18 bp, Artificial Sequence
  Synthetic DNA
taatacgactaattagag

SEQ ID NO: 10004 - DNA, 18 bp, Artificial Sequence
  Synthetic DNA
taatacgactcaccatta

SEQ ID NO: 10005 - DNA, 18 bp, Artificial Sequence
  Synthetic DNA
taatacgactccatatcg

SEQ ID NO: 10006 - DNA, 18 bp, Artificial Sequence
  Synthetic DNA
taatacgatgcactattg

SEQ ID NO: 10007 - DNA, 18 bp, Artificial Sequence
  Synthetic DNA
taatacgccttaatatag

SEQ ID NO: 10008 - DNA, 18 bp, Artificial Sequence
  Synthetic DNA
taatacgccttgctatag

SEQ ID NO: 10009 - DNA, 18 bp, Artificial Sequence
  Synthetic DNA
taatacgcgacactatag

SEQ ID NO: 10010 - DNA, 18 bp, Artificial Sequence
  Synthetic DNA
taatacgcttcactatgg

SEQ ID NO: 10011 - DNA, 18 bp, Artificial Sequence
  Synthetic DNA
taatacgtatcactatcg

SEQ ID NO: 10012 - DNA, 18 bp, Artificial Sequence
  Synthetic DNA
taatactacttactgtag

SEQ ID NO: 10013 - DNA, 18 bp, Artificial Sequence
  Synthetic DNA
taataggacccactttag

SEQ ID NO: 10014 - DNA, 18 bp, Artificial Sequence
  Synthetic DNA
taatccaactcaccatag

SEQ ID NO: 10015 - DNA, 18 bp, Artificial Sequence
  Synthetic DNA
taatccgacacactatgg

SEQ ID NO: 10016 - DNA, 18 bp, Artificial Sequence
  Synthetic DNA
taatccgacacattatag

SEQ ID NO: 10017 - DNA, 18 bp, Artificial Sequence
  Synthetic DNA
taatgagactcattatag

SEQ ID NO: 10018 - DNA, 18 bp, Artificial Sequence
  Synthetic DNA
taatgccacacactatag

SEQ ID NO: 10019 - DNA, 18 bp, Artificial Sequence
  Synthetic DNA
taatgcgacttactctag

SEQ ID NO: 10020 - DNA, 18 bp, Artificial Sequence
  Synthetic DNA
taattcgagtccctatag

SEQ ID NO: 10021 - DNA, 18 bp, Artificial Sequence
  Synthetic DNA
tactaagactcactaaag

SEQ ID NO: 10022 - DNA, 18 bp, Artificial Sequence
  Synthetic DNA
tagtacgactaactttag

SEQ ID NO: 10023 - DNA, 18 bp, Artificial Sequence
  Synthetic DNA
tagtacgactccttatag

SEQ ID NO: 10024 - DNA, 18 bp, Artificial Sequence
  Synthetic DNA
tagtacgactgactaaag

SEQ ID NO: 10025 - DNA, 18 bp, Artificial Sequence
  Synthetic DNA
tagtacgtctgactatag

SEQ ID NO: 10026 - DNA, 18 bp, Artificial Sequence
  Synthetic DNA
tagtatgactcaccatag

SEQ ID NO: 10027 - DNA, 18 bp, Artificial Sequence
  Synthetic DNA
tatgaccactcactatag

SEQ ID NO: 10028 - DNA, 18 bp, Artificial Sequence
  Synthetic DNA
tattactgctcactatag

SEQ ID NO: 10029 - DNA, 18 bp, Artificial Sequence
  Synthetic DNA
tgaaacgactcactatgg

SEQ ID NO: 10030 - DNA, 18 bp, Artificial Sequence
  Synthetic DNA
tgatacgactgactattg

SEQ ID NO: 10031 - DNA, 18 bp, Artificial Sequence
  Synthetic DNA
tgatacgtctcactagag

SEQ ID NO: 10032 - DNA, 18 bp, Artificial Sequence
  Synthetic DNA
ttataccactcaccatag

SEQ ID NO: 10033 - DNA, 18 bp, Artificial Sequence
  Synthetic DNA
ttatacgactccctatcg

SEQ ID NO: 10034 - DNA, 18 bp, Artificial Sequence
  Synthetic DNA
taataaatctcactatag

SEQ ID NO: 10035 - DNA, 18 bp, Artificial Sequence
  Synthetic DNA
taatactacacaatatag

SEQ ID NO: 10036 - DNA, 18 bp, Artificial Sequence
  Synthetic DNA
ttatacgacatactatag

SEQ ID NO: 10037 - DNA, 18 bp, Artificial Sequence
  Synthetic DNA
taaaattactcactatag

SEQ ID NO: 10038 - DNA, 18 bp, Artificial Sequence
  Synthetic DNA
taatacatctaactatag

SEQ ID NO: 10039 - DNA, 18 bp, Artificial Sequence
  Synthetic DNA
ttatacgactcactgaag

SEQ ID NO: 10040 - DNA, 18 bp, Artificial Sequence
  Synthetic DNA
aattacgactgactatag

SEQ ID NO: 10041 - DNA, 18 bp, Artificial Sequence
  Synthetic DNA
taatacgtctctctgtag

SEQ ID NO: 10042 - DNA, 18 bp, Artificial Sequence
  Synthetic DNA
taattagactcaccatag

SEQ ID NO: 10043 - DNA, 18 bp, Artificial Sequence
  Synthetic DNA
taattctactcattatag

SEQ ID NO: 10044 - DNA, 18 bp, Artificial Sequence
  Synthetic DNA
tagtacaactcactttag

SEQ ID NO: 10045 - DNA, 18 bp, Artificial Sequence
  Synthetic DNA
acatacgactcactttag

SEQ ID NO: 10046 - DNA, 18 bp, Artificial Sequence
  Synthetic DNA
taatacgatttacaatag

SEQ ID NO: 10047 - DNA, 18 bp, Artificial Sequence
  Synthetic DNA
tataacgactctctatag

SEQ ID NO: 10048 - DNA, 18 bp, Artificial Sequence
  Synthetic DNA
taataagactctcaatag

SEQ ID NO: 10049 - DNA, 18 bp, Artificial Sequence
  Synthetic DNA
taatacgactaactttgg

SEQ ID NO: 10050 - DNA, 18 bp, Artificial Sequence
  Synthetic DNA
taattctacttactatag

SEQ ID NO: 10051 - DNA, 18 bp, Artificial Sequence
  Synthetic DNA
aaataagactcaccatag

SEQ ID NO: 10052 - DNA, 18 bp, Artificial Sequence
  Synthetic DNA
aaatactactcactgtag

SEQ ID NO: 10053 - DNA, 18 bp, Artificial Sequence
  Synthetic DNA
aagtacgactcactattg

SEQ ID NO: 10054 - DNA, 18 bp, Artificial Sequence
  Synthetic DNA
caatacgtcttactatag

SEQ ID NO: 10055 - DNA, 18 bp, Artificial Sequence
  Synthetic DNA
taaaaccacttactatag

SEQ ID NO: 10056 - DNA, 18 bp, Artificial Sequence
  Synthetic DNA
taacacgacttactttag

SEQ ID NO: 10057 - DNA, 18 bp, Artificial Sequence
  Synthetic DNA
taataatacttactatag

SEQ ID NO: 10058 - DNA, 18 bp, Artificial Sequence
  Synthetic DNA
taatacgacacattatcg

SEQ ID NO: 10059 - DNA, 18 bp, Artificial Sequence
  Synthetic DNA
taatacgactcaacaaag

SEQ ID NO: 10060 - DNA, 18 bp, Artificial Sequence
  Synthetic DNA
taatacgactctcaagag

SEQ ID NO: 10061 - DNA, 18 bp, Artificial Sequence
  Synthetic DNA
taatacgactctcgttag

SEQ ID NO: 10062 - DNA, 18 bp, Artificial Sequence
  Synthetic DNA
taatacgtatcactgtag

SEQ ID NO: 10063 - DNA, 18 bp, Artificial Sequence
  Synthetic DNA
taatacgtctccctaaag

SEQ ID NO: 10064 - DNA, 18 bp, Artificial Sequence
  Synthetic DNA
taattcgaataactatag

SEQ ID NO: 10065 - DNA, 18 bp, Artificial Sequence
  Synthetic DNA
tactaggactcacaatag

SEQ ID NO: 10066 - DNA, 18 bp, Artificial Sequence
  Synthetic DNA
tagtacgactgactattg

SEQ ID NO: 10067 - DNA, 18 bp, Artificial Sequence
  Synthetic DNA
tcatacaactcactttag

SEQ ID NO: 10068 - DNA, 18 bp, Artificial Sequence
  Synthetic DNA
tcatacgattcactattg

SEQ ID NO: 10069 - DNA, 18 bp, Artificial Sequence
  Synthetic DNA
ttataaggctcactatag

SEQ ID NO: 10070 - DNA, 18 bp, Artificial Sequence
  Synthetic DNA
taataagattctctatag

SEQ ID NO: 10071 - DNA, 18 bp, Artificial Sequence
  Synthetic DNA
taatatgactcacaaaag

SEQ ID NO: 10072 - DNA, 18 bp, Artificial Sequence
  Synthetic DNA
taatacgtcttactaaag

SEQ ID NO: 10073 - DNA, 18 bp, Artificial Sequence
  Synthetic DNA
taaaacgactcacagtag

SEQ ID NO: 10074 - DNA, 18 bp, Artificial Sequence
  Synthetic DNA
taaaacgactgactttag

SEQ ID NO: 10075 - DNA, 18 bp, Artificial Sequence
  Synthetic DNA
taataaaacacactatag

SEQ ID NO: 10076 - DNA, 18 bp, Artificial Sequence
  Synthetic DNA
taatactaattactatag

SEQ ID NO: 10077 - DNA, 18 bp, Artificial Sequence
  Synthetic DNA
tattacgattcgctatag

SEQ ID NO: 10078 - DNA, 18 bp, Artificial Sequence
  Synthetic DNA
tcattcgactcactttag

SEQ ID NO: 10079 - DNA, 18 bp, Artificial Sequence
  Synthetic DNA
taatacaattctctatag

SEQ ID NO: 10080 - DNA, 18 bp, Artificial Sequence
  Synthetic DNA
tattacgacttacaatag

SEQ ID NO: 10081 - DNA, 18 bp, Artificial Sequence
  Synthetic DNA
taatacgtctctctattg

SEQ ID NO: 10082 - DNA, 18 bp, Artificial Sequence
  Synthetic DNA
ttatacgactcaatttag

SEQ ID NO: 10083 - DNA, 18 bp, Artificial Sequence
  Synthetic DNA
aaatacgactctctacag

SEQ ID NO: 10084 - DNA, 18 bp, Artificial Sequence
  Synthetic DNA
aaatactactcactattg

SEQ ID NO: 10085 - DNA, 18 bp, Artificial Sequence
  Synthetic DNA
taatacgaatttctatag

SEQ ID NO: 10086 - DNA, 18 bp, Artificial Sequence
  Synthetic DNA
taatttgacacactatag

SEQ ID NO: 10087 - DNA, 18 bp, Artificial Sequence
  Synthetic DNA
aaatactactaactatag

SEQ ID NO: 10088 - DNA, 18 bp, Artificial Sequence
  Synthetic DNA
taatacgacactccatag

SEQ ID NO: 10089 - DNA, 18 bp, Artificial Sequence
  Synthetic DNA
tactacgactatctatag

SEQ ID NO: 10090 - DNA, 18 bp, Artificial Sequence
  Synthetic DNA
ttatacgacccacaatag

SEQ ID NO: 10091 - DNA, 18 bp, Artificial Sequence
  Synthetic DNA
aaatacgactcatcatag

SEQ ID NO: 10092 - DNA, 18 bp, Artificial Sequence
  Synthetic DNA
caatacgactcattattg

SEQ ID NO: 10093 - DNA, 18 bp, Artificial Sequence
  Synthetic DNA
taaaatgactaactatag

SEQ ID NO: 10094 - DNA, 18 bp, Artificial Sequence
  Synthetic DNA
taagacgacactctatag

SEQ ID NO: 10095 - DNA, 18 bp, Artificial Sequence
  Synthetic DNA
taataagactcagtttag

SEQ ID NO: 10096 - DNA, 18 bp, Artificial Sequence
  Synthetic DNA
taataccactctctacag

SEQ ID NO: 10097 - DNA, 18 bp, Artificial Sequence
  Synthetic DNA
taatacgattctctgtag

SEQ ID NO: 10098 - DNA, 18 bp, Artificial Sequence
  Synthetic DNA
taatacggcttactaaag

SEQ ID NO: 10099 - DNA, 18 bp, Artificial Sequence
  Synthetic DNA
taatccaactcacaatag

SEQ ID NO: 10100 - DNA, 18 bp, Artificial Sequence
  Synthetic DNA
taatccgactctttatag

SEQ ID NO: 10101 - DNA, 18 bp, Artificial Sequence
  Synthetic DNA
taattcgcctcacaatag

SEQ ID NO: 10102 - DNA, 18 bp, Artificial Sequence
  Synthetic DNA
tagtacgacacacaatag

SEQ ID NO: 10103 - DNA, 18 bp, Artificial Sequence
  Synthetic DNA
tattactactcgctatag

SEQ ID NO: 10104 - DNA, 18 bp, Artificial Sequence
  Synthetic DNA
aaataagagtcactatag

SEQ ID NO: 10105 - DNA, 18 bp, Artificial Sequence
  Synthetic DNA
aaatatcactcactatag

SEQ ID NO: 10106 - DNA, 18 bp, Artificial Sequence
  Synthetic DNA
acgtacgactcactatag

SEQ ID NO: 10107 - DNA, 18 bp, Artificial Sequence
  Synthetic DNA
caatacgacgctctatag

SEQ ID NO: 10108 - DNA, 18 bp, Artificial Sequence
  Synthetic DNA
cgttacgactcactatag

SEQ ID NO: 10109 - DNA, 18 bp, Artificial Sequence
  Synthetic DNA
gtatacggctcactatag

SEQ ID NO: 10110 - DNA, 18 bp, Artificial Sequence
  Synthetic DNA
taaaacgacacacgatag

SEQ ID NO: 10111 - DNA, 18 bp, Artificial Sequence
  Synthetic DNA
taacacaactcaccatag

SEQ ID NO: 10112 - DNA, 18 bp, Artificial Sequence
  Synthetic DNA
taacacgactcccaatag

SEQ ID NO: 10113 - DNA, 18 bp, Artificial Sequence
  Synthetic DNA
taacccgtctcactatag

SEQ ID NO: 10114 - DNA, 18 bp, Artificial Sequence
  Synthetic DNA
taactcgactcactacag

SEQ ID NO: 10115 - DNA, 18 bp, Artificial Sequence
  Synthetic DNA
taagacgactcattttag

SEQ ID NO: 10116 - DNA, 18 bp, Artificial Sequence
  Synthetic DNA
taataagacccattatag

SEQ ID NO: 10117 - DNA, 18 bp, Artificial Sequence
  Synthetic DNA
taataagtctcagtatag

SEQ ID NO: 10118 - DNA, 18 bp, Artificial Sequence
  Synthetic DNA
taataccaatcaccatag

SEQ ID NO: 10119 - DNA, 18 bp, Artificial Sequence
  Synthetic DNA
taataccattaactatag

SEQ ID NO: 10120 - DNA, 18 bp, Artificial Sequence
  Synthetic DNA
taatacctctcactatgg

SEQ ID NO: 10121 - DNA, 18 bp, Artificial Sequence
  Synthetic DNA
taatacgactgacaatgg

SEQ ID NO: 10122 - DNA, 18 bp, Artificial Sequence
  Synthetic DNA
taatacgacttgctttag

SEQ ID NO: 10123 - DNA, 18 bp, Artificial Sequence
  Synthetic DNA
taatacgagtcacttcag

SEQ ID NO: 10124 - DNA, 18 bp, Artificial Sequence
  Synthetic DNA
taatacgagtcatcatag

SEQ ID NO: 10125 - DNA, 18 bp, Artificial Sequence
  Synthetic DNA
taatacgatgctctatag

SEQ ID NO: 10126 - DNA, 18 bp, Artificial Sequence
  Synthetic DNA
taatacgattaactctag

SEQ ID NO: 10127 - DNA, 18 bp, Artificial Sequence
  Synthetic DNA
taatacggctaactttag

SEQ ID NO: 10128 - DNA, 18 bp, Artificial Sequence
  Synthetic DNA
taatacgtctaagtatag

SEQ ID NO: 10129 - DNA, 18 bp, Artificial Sequence
  Synthetic DNA
taatactccttactatag

SEQ ID NO: 10130 - DNA, 18 bp, Artificial Sequence
  Synthetic DNA
taatagcactcactatgg

SEQ ID NO: 10131 - DNA, 18 bp, Artificial Sequence
  Synthetic DNA
taatatggcacactatag

SEQ ID NO: 10132 - DNA, 18 bp, Artificial Sequence
  Synthetic DNA
taatccgactaacaatag

SEQ ID NO: 10133 - DNA, 18 bp, Artificial Sequence
  Synthetic DNA
taatcctacccactatag

SEQ ID NO: 10134 - DNA, 18 bp, Artificial Sequence
  Synthetic DNA
taatgcgaataactatag

SEQ ID NO: 10135 - DNA, 18 bp, Artificial Sequence
  Synthetic DNA
taattcgacctactatag

SEQ ID NO: 10136 - DNA, 18 bp, Artificial Sequence
  Synthetic DNA
tactacgacacactatgg

SEQ ID NO: 10137 - DNA, 18 bp, Artificial Sequence
  Synthetic DNA
tactacgactcaccaaag

SEQ ID NO: 10138 - DNA, 18 bp, Artificial Sequence
  Synthetic DNA
tactacgtcttactatag

SEQ ID NO: 10139 - DNA, 18 bp, Artificial Sequence
  Synthetic DNA
tactactactcgctatag

SEQ ID NO: 10140 - DNA, 18 bp, Artificial Sequence
  Synthetic DNA
tagtaccactcacaatag

SEQ ID NO: 10141 - DNA, 18 bp, Artificial Sequence
  Synthetic DNA
tagtacgactcacgaaag

SEQ ID NO: 10142 - DNA, 18 bp, Artificial Sequence
  Synthetic DNA
tagtatcactcactatag

SEQ ID NO: 10143 - DNA, 18 bp, Artificial Sequence
  Synthetic DNA
tagttggactcactatag

SEQ ID NO: 10144 - DNA, 18 bp, Artificial Sequence
  Synthetic DNA
tcaaacgcctcactatag

SEQ ID NO: 10145 - DNA, 18 bp, Artificial Sequence
  Synthetic DNA
tcatatgactctctatag

SEQ ID NO: 10146 - DNA, 18 bp, Artificial Sequence
  Synthetic DNA
tgatacgattccctatag

SEQ ID NO: 10147 - DNA, 18 bp, Artificial Sequence
  Synthetic DNA
ttacacgagtcactatag

SEQ ID NO: 10148 - DNA, 18 bp, Artificial Sequence
  Synthetic DNA
ttataccactcacgatag

SEQ ID NO: 10149 - DNA, 18 bp, Artificial Sequence
  Synthetic DNA
taatacgactatctattg

SEQ ID NO: 10150 - DNA, 18 bp, Artificial Sequence
  Synthetic DNA
taatacgactcataaaag

SEQ ID NO: 10151 - DNA, 18 bp, Artificial Sequence
  Synthetic DNA
taatacttctaactatag

SEQ ID NO: 10152 - DNA, 18 bp, Artificial Sequence
  Synthetic DNA
taatacgtctcattattg

SEQ ID NO: 10153 - DNA, 18 bp, Artificial Sequence
  Synthetic DNA
tataacgacacactatag

SEQ ID NO: 10154 - DNA, 18 bp, Artificial Sequence
  Synthetic DNA
caatacgactcacattag

SEQ ID NO: 10155 - DNA, 18 bp, Artificial Sequence
  Synthetic DNA
taatatgacacactattg

SEQ ID NO: 10156 - DNA, 18 bp, Artificial Sequence
  Synthetic DNA
tattatgactcacaatag

SEQ ID NO: 10157 - DNA, 18 bp, Artificial Sequence
  Synthetic DNA
caatacgattctctatag

SEQ ID NO: 10158 - DNA, 18 bp, Artificial Sequence
  Synthetic DNA
taatacgactaacattag

SEQ ID NO: 10159 - DNA, 18 bp, Artificial Sequence
  Synthetic DNA
tcatacgactaactattg

SEQ ID NO: 10160 - DNA, 18 bp, Artificial Sequence
  Synthetic DNA
ttttacgactccctatag

SEQ ID NO: 10161 - DNA, 18 bp, Artificial Sequence
  Synthetic DNA
taaaacatctcactatag

SEQ ID NO: 10162 - DNA, 18 bp, Artificial Sequence
  Synthetic DNA
taatacgactttctattg

SEQ ID NO: 10163 - DNA, 18 bp, Artificial Sequence
  Synthetic DNA
ttatacgactctcaatag

SEQ ID NO: 10164 - DNA, 18 bp, Artificial Sequence
  Synthetic DNA
tattacgactaattatag

SEQ ID NO: 10165 - DNA, 18 bp, Artificial Sequence
  Synthetic DNA
ttatacaaatcactatag

SEQ ID NO: 10166 - DNA, 18 bp, Artificial Sequence
  Synthetic DNA
taacacgtctcaatatag

SEQ ID NO: 10167 - DNA, 18 bp, Artificial Sequence
  Synthetic DNA
taatacaactgactttag

SEQ ID NO: 10168 - DNA, 18 bp, Artificial Sequence
  Synthetic DNA
taatacgactcacgtaag

SEQ ID NO: 10169 - DNA, 18 bp, Artificial Sequence
  Synthetic DNA
taatacgacttcctattg

SEQ ID NO: 10170 - DNA, 18 bp, Artificial Sequence
  Synthetic DNA
taatacgcctcattaaag

SEQ ID NO: 10171 - DNA, 18 bp, Artificial Sequence
  Synthetic DNA
taatacgccttactattg

SEQ ID NO: 10172 - DNA, 18 bp, Artificial Sequence
  Synthetic DNA
taatacgtcttactatcg

SEQ ID NO: 10173 - DNA, 18 bp, Artificial Sequence
  Synthetic DNA
taataggaatcactttag

SEQ ID NO: 10174 - DNA, 18 bp, Artificial Sequence
  Synthetic DNA
tcatacaactcactaaag

SEQ ID NO: 10175 - DNA, 18 bp, Artificial Sequence
  Synthetic DNA
ttgtacgacacactatag

SEQ ID NO: 10176 - DNA, 18 bp, Artificial Sequence
  Synthetic DNA
ttatacgtttcactatag

SEQ ID NO: 10177 - DNA, 18 bp, Artificial Sequence
  Synthetic DNA
tattacgagtcacaatag

SEQ ID NO: 10178 - DNA, 18 bp, Artificial Sequence
  Synthetic DNA
taatacaacacaccatag

SEQ ID NO: 10179 - DNA, 18 bp, Artificial Sequence
  Synthetic DNA
taatattactcactattg

SEQ ID NO: 10180 - DNA, 18 bp, Artificial Sequence
  Synthetic DNA
tactacgtctctctatag

SEQ ID NO: 10181 - DNA, 18 bp, Artificial Sequence
  Synthetic DNA
aaatacgactcattttag

SEQ ID NO: 10182 - DNA, 18 bp, Artificial Sequence
  Synthetic DNA
taaaacgattcactttag

SEQ ID NO: 10183 - DNA, 18 bp, Artificial Sequence
  Synthetic DNA
ttttaccactcactatag

SEQ ID NO: 10184 - DNA, 18 bp, Artificial Sequence
  Synthetic DNA
taaaatgactcactttag

SEQ ID NO: 10185 - DNA, 18 bp, Artificial Sequence
  Synthetic DNA
taatacgactcccttttg

SEQ ID NO: 10186 - DNA, 18 bp, Artificial Sequence
  Synthetic DNA
taatacgattcacaatcg

SEQ ID NO: 10187 - DNA, 18 bp, Artificial Sequence
  Synthetic DNA
taatatgactcataatag

SEQ ID NO: 10188 - DNA, 18 bp, Artificial Sequence
  Synthetic DNA
tattacgacttactacag

SEQ ID NO: 10189 - DNA, 18 bp, Artificial Sequence
  Synthetic DNA
tgatacgactctcaatag

SEQ ID NO: 10190 - DNA, 18 bp, Artificial Sequence
  Synthetic DNA
caatacaactctctatag

SEQ ID NO: 10191 - DNA, 18 bp, Artificial Sequence
  Synthetic DNA
aaatacgactcacaacag

SEQ ID NO: 10192 - DNA, 18 bp, Artificial Sequence
  Synthetic DNA
taaaacgacccacaatag

SEQ ID NO: 10193 - DNA, 18 bp, Artificial Sequence
  Synthetic DNA
taaaacgacttgctatag

SEQ ID NO: 10194 - DNA, 18 bp, Artificial Sequence
  Synthetic DNA
taataaaaatcactatag

SEQ ID NO: 10195 - DNA, 18 bp, Artificial Sequence
  Synthetic DNA
taataaaactcaatatag

SEQ ID NO: 10196 - DNA, 18 bp, Artificial Sequence
  Synthetic DNA
taatacgactttctgtag

SEQ ID NO: 10197 - DNA, 18 bp, Artificial Sequence
  Synthetic DNA
taatgcgactaactattg

SEQ ID NO: 10198 - DNA, 18 bp, Artificial Sequence
  Synthetic DNA
taattcaactcaccatag

SEQ ID NO: 10199 - DNA, 18 bp, Artificial Sequence
  Synthetic DNA
tagtacgactcattttag

SEQ ID NO: 10200 - DNA, 18 bp, Artificial Sequence
  Synthetic DNA
tagtatgactcactaaag

SEQ ID NO: 10201 - DNA, 18 bp, Artificial Sequence
  Synthetic DNA
tattacgactcaacatag

SEQ ID NO: 10202 - DNA, 18 bp, Artificial Sequence
  Synthetic DNA
tattacgacttactatcg

SEQ ID NO: 10203 - DNA, 18 bp, Artificial Sequence
  Synthetic DNA
tattacgtctccctatag

SEQ ID NO: 10204 - DNA, 18 bp, Artificial Sequence
  Synthetic DNA
tattatgactcaccatag

SEQ ID NO: 10205 - DNA, 18 bp, Artificial Sequence
  Synthetic DNA
tcatacgaatctctatag

SEQ ID NO: 10206 - DNA, 18 bp, Artificial Sequence
  Synthetic DNA
ttatacaacccactatag

SEQ ID NO: 10207 - DNA, 18 bp, Artificial Sequence
  Synthetic DNA
aaaaacgactgactatag

SEQ ID NO: 10208 - DNA, 18 bp, Artificial Sequence
  Synthetic DNA
aaacacgactcactattg

SEQ ID NO: 10209 - DNA, 18 bp, Artificial Sequence
  Synthetic DNA
aaatacgagtgactatag

SEQ ID NO: 10210 - DNA, 18 bp, Artificial Sequence
  Synthetic DNA
aaatatgactgactatag

SEQ ID NO: 10211 - DNA, 18 bp, Artificial Sequence
  Synthetic DNA
atatacgactcacgatag

SEQ ID NO: 10212 - DNA, 18 bp, Artificial Sequence
  Synthetic DNA
caatacgattcactacag

SEQ ID NO: 10213 - DNA, 18 bp, Artificial Sequence
  Synthetic DNA
caatactaatcactatag

SEQ ID NO: 10214 - DNA, 18 bp, Artificial Sequence
  Synthetic DNA
caatatgacttactatag

SEQ ID NO: 10215 - DNA, 18 bp, Artificial Sequence
  Synthetic DNA
caatccgactctctatag

SEQ ID NO: 10216 - DNA, 18 bp, Artificial Sequence
  Synthetic DNA
cagaacgactcactatag

SEQ ID NO: 10217 - DNA, 18 bp, Artificial Sequence
  Synthetic DNA
taaaacaactcagtatag

SEQ ID NO: 10218 - DNA, 18 bp, Artificial Sequence
  Synthetic DNA
taaaacgtcgcactatag

SEQ ID NO: 10219 - DNA, 18 bp, Artificial Sequence
  Synthetic DNA
taacacgaatcactaaag

SEQ ID NO: 10220 - DNA, 18 bp, Artificial Sequence
  Synthetic DNA
taacactactaactatag

SEQ ID NO: 10221 - DNA, 18 bp, Artificial Sequence
  Synthetic DNA
taactcgacccactatag

SEQ ID NO: 10222 - DNA, 18 bp, Artificial Sequence
  Synthetic DNA
taagacgaattactatag

SEQ ID NO: 10223 - DNA, 18 bp, Artificial Sequence
  Synthetic DNA
taatacaagtaactatag

SEQ ID NO: 10224 - DNA, 18 bp, Artificial Sequence
  Synthetic DNA
taataccacccactttag

SEQ ID NO: 10225 - DNA, 18 bp, Artificial Sequence
  Synthetic DNA
taatacgacatagtatag

SEQ ID NO: 10226 - DNA, 18 bp, Artificial Sequence
  Synthetic DNA
taatacgacgcactcttg

SEQ ID NO: 10227 - DNA, 18 bp, Artificial Sequence
  Synthetic DNA
taatacgactaacgattg

SEQ ID NO: 10228 - DNA, 18 bp, Artificial Sequence
  Synthetic DNA
taatacgactacatatag

SEQ ID NO: 10229 - DNA, 18 bp, Artificial Sequence
  Synthetic DNA
taatacgactgtgtatag

SEQ ID NO: 10230 - DNA, 18 bp, Artificial Sequence
  Synthetic DNA
taatacgacttaatagag

SEQ ID NO: 10231 - DNA, 18 bp, Artificial Sequence
  Synthetic DNA
taatacgacttaccacag

SEQ ID NO: 10232 - DNA, 18 bp, Artificial Sequence
  Synthetic DNA
taatacgacttattgtag

SEQ ID NO: 10233 - DNA, 18 bp, Artificial Sequence
  Synthetic DNA
taatacgatacactagag

SEQ ID NO: 10234 - DNA, 18 bp, Artificial Sequence
  Synthetic DNA
taatacggcacactgtag

SEQ ID NO: 10235 - DNA, 18 bp, Artificial Sequence
  Synthetic DNA
taataggactcattgtag

SEQ ID NO: 10236 - DNA, 18 bp, Artificial Sequence
  Synthetic DNA
taatataacccactatag

SEQ ID NO: 10237 - DNA, 18 bp, Artificial Sequence
  Synthetic DNA
taatatcactcaatatag

SEQ ID NO: 10238 - DNA, 18 bp, Artificial Sequence
  Synthetic DNA
taatatgactgactatgg

SEQ ID NO: 10239 - DNA, 18 bp, Artificial Sequence
  Synthetic DNA
taatatggcttactatag

SEQ ID NO: 10240 - DNA, 18 bp, Artificial Sequence
  Synthetic DNA
taatcggtctcactatag

SEQ ID NO: 10241 - DNA, 18 bp, Artificial Sequence
  Synthetic DNA
taatgcgacgaactatag

SEQ ID NO: 10242 - DNA, 18 bp, Artificial Sequence
  Synthetic DNA
taatgcgactcacaacag

SEQ ID NO: 10243 - DNA, 18 bp, Artificial Sequence
  Synthetic DNA
taatgcgattaactatag

SEQ ID NO: 10244 - DNA, 18 bp, Artificial Sequence
  Synthetic DNA
taatgtgagtcactatag

SEQ ID NO: 10245 - DNA, 18 bp, Artificial Sequence
  Synthetic DNA
taattcggctccctatag

SEQ ID NO: 10246 - DNA, 18 bp, Artificial Sequence
  Synthetic DNA
tactacgacccaccatag

SEQ ID NO: 10247 - DNA, 18 bp, Artificial Sequence
  Synthetic DNA
tactacgcctcacaatag

SEQ ID NO: 10248 - DNA, 18 bp, Artificial Sequence
  Synthetic DNA
tactacgcttcactatag

SEQ ID NO: 10249 - DNA, 18 bp, Artificial Sequence
  Synthetic DNA
tagtacgactcaatattg

SEQ ID NO: 10250 - DNA, 18 bp, Artificial Sequence
  Synthetic DNA
tcatacaactcaatatag

SEQ ID NO: 10251 - DNA, 18 bp, Artificial Sequence
  Synthetic DNA
tcatacgaatgactatag

SEQ ID NO: 10252 - DNA, 18 bp, Artificial Sequence
  Synthetic DNA
tcatacgactcccaatag

SEQ ID NO: 10253 - DNA, 18 bp, Artificial Sequence
  Synthetic DNA
ttagacgactcaatatag

SEQ ID NO: 10254 - DNA, 18 bp, Artificial Sequence
  Synthetic DNA
ttagacgattcactatag

SEQ ID NO: 10255 - DNA, 18 bp, Artificial Sequence
  Synthetic DNA
ttatacgactggctatag

SEQ ID NO: 10256 - DNA, 18 bp, Artificial Sequence
  Synthetic DNA
ttatactacgcactatag

SEQ ID NO: 10257 - DNA, 18 bp, Artificial Sequence
  Synthetic DNA
taaaacgacatactatag

SEQ ID NO: 10258 - DNA, 18 bp, Artificial Sequence
  Synthetic DNA
taatacaactctatatag

SEQ ID NO: 10259 - DNA, 18 bp, Artificial Sequence
  Synthetic DNA
taatacctcacactatag

SEQ ID NO: 10260 - DNA, 18 bp, Artificial Sequence
  Synthetic DNA
ttatactactcactatcg

SEQ ID NO: 10261 - DNA, 18 bp, Artificial Sequence
  Synthetic DNA
taacacaacacactatag

SEQ ID NO: 10262 - DNA, 18 bp, Artificial Sequence
  Synthetic DNA
taattagactcaatatag

SEQ ID NO: 10263 - DNA, 18 bp, Artificial Sequence
  Synthetic DNA
taatatttctcactatag

SEQ ID NO: 10264 - DNA, 18 bp, Artificial Sequence
  Synthetic DNA
tattacgaatcactttag

SEQ ID NO: 10265 - DNA, 18 bp, Artificial Sequence
  Synthetic DNA
taatacgaatctctattg

SEQ ID NO: 10266 - DNA, 18 bp, Artificial Sequence
  Synthetic DNA
taatacgtcccactttag

SEQ ID NO: 10267 - DNA, 18 bp, Artificial Sequence
  Synthetic DNA
tattacaactcaatatag

SEQ ID NO: 10268 - DNA, 18 bp, Artificial Sequence
  Synthetic DNA
aactacgactctctatag

SEQ ID NO: 10269 - DNA, 18 bp, Artificial Sequence
  Synthetic DNA
caatacgacacacaatag

SEQ ID NO: 10270 - DNA, 18 bp, Artificial Sequence
  Synthetic DNA
caatatgactcactattg

SEQ ID NO: 10271 - DNA, 18 bp, Artificial Sequence
  Synthetic DNA
cattacgattcactatag

SEQ ID NO: 10272 - DNA, 18 bp, Artificial Sequence
  Synthetic DNA
cattacggctcactatag

SEQ ID NO: 10273 - DNA, 18 bp, Artificial Sequence
  Synthetic DNA
taaaacgactaacaatag

SEQ ID NO: 10274 - DNA, 18 bp, Artificial Sequence
  Synthetic DNA
taagactactcactattg

SEQ ID NO: 10275 - DNA, 18 bp, Artificial Sequence
  Synthetic DNA
taatacgacacacttcag

SEQ ID NO: 10276 - DNA, 18 bp, Artificial Sequence
  Synthetic DNA
taatacgactctttctag

SEQ ID NO: 10277 - DNA, 18 bp, Artificial Sequence
  Synthetic DNA
taatacgactgtctttag

SEQ ID NO: 10278 - DNA, 18 bp, Artificial Sequence
  Synthetic DNA
taatattactcattatag

SEQ ID NO: 10279 - DNA, 18 bp, Artificial Sequence
  Synthetic DNA
taatccgaatcactttag

SEQ ID NO: 10280 - DNA, 18 bp, Artificial Sequence
  Synthetic DNA
taatccgattcactattg

SEQ ID NO: 10281 - DNA, 18 bp, Artificial Sequence
  Synthetic DNA
taattcgactaactctag

SEQ ID NO: 10282 - DNA, 18 bp, Artificial Sequence
  Synthetic DNA
tactacaactcaatatag

SEQ ID NO: 10283 - DNA, 18 bp, Artificial Sequence
  Synthetic DNA
tactaccactcactaaag

SEQ ID NO: 10284 - DNA, 18 bp, Artificial Sequence
  Synthetic DNA
tattacggctcacaatag

SEQ ID NO: 10285 - DNA, 18 bp, Artificial Sequence
  Synthetic DNA
tgatatgaatcactatag

SEQ ID NO: 10286 - DNA, 18 bp, Artificial Sequence
  Synthetic DNA
ttatacagctcactatag

SEQ ID NO: 10287 - DNA, 18 bp, Artificial Sequence
  Synthetic DNA
taatacgtctctctttag

SEQ ID NO: 10288 - DNA, 18 bp, Artificial Sequence
  Synthetic DNA
caattcgacacactatag

SEQ ID NO: 10289 - DNA, 18 bp, Artificial Sequence
  Synthetic DNA
taacacgacatactatag

SEQ ID NO: 10290 - DNA, 18 bp, Artificial Sequence
  Synthetic DNA
taatacgtctcactgaag

SEQ ID NO: 10291 - DNA, 18 bp, Artificial Sequence
  Synthetic DNA
ttatacgattcactttag

SEQ ID NO: 10292 - DNA, 18 bp, Artificial Sequence
  Synthetic DNA
tcatacgactcacttttg

SEQ ID NO: 10293 - DNA, 18 bp, Artificial Sequence
  Synthetic DNA
tcatacgactctctattg

SEQ ID NO: 10294 - DNA, 18 bp, Artificial Sequence
  Synthetic DNA
ttaaacgactctctatag

SEQ ID NO: 10295 - DNA, 18 bp, Artificial Sequence
  Synthetic DNA
taatacgacaccctttag

SEQ ID NO: 10296 - DNA, 18 bp, Artificial Sequence
  Synthetic DNA
taatatgactcaatattg

SEQ ID NO: 10297 - DNA, 18 bp, Artificial Sequence
  Synthetic DNA
taacacgtctctctatag

SEQ ID NO: 10298 - DNA, 18 bp, Artificial Sequence
  Synthetic DNA
taatacgaatcattattg

SEQ ID NO: 10299 - DNA, 18 bp, Artificial Sequence
  Synthetic DNA
taatacgactcaaattag

SEQ ID NO: 10300 - DNA, 18 bp, Artificial Sequence
  Synthetic DNA
ttgtacgactctctatag

SEQ ID NO: 10301 - DNA, 18 bp, Artificial Sequence
  Synthetic DNA
aaatacaactaactatag

SEQ ID NO: 10302 - DNA, 18 bp, Artificial Sequence
  Synthetic DNA
aaatcagactcactatag

SEQ ID NO: 10303 - DNA, 18 bp, Artificial Sequence
  Synthetic DNA
acataagactcactatag

SEQ ID NO: 10304 - DNA, 18 bp, Artificial Sequence
  Synthetic DNA
caatacgacttattatag

SEQ ID NO: 10305 - DNA, 18 bp, Artificial Sequence
  Synthetic DNA
taatacgacagtctatag

SEQ ID NO: 10306 - DNA, 18 bp, Artificial Sequence
  Synthetic DNA
tacaacgactaactatag

SEQ ID NO: 10307 - DNA, 18 bp, Artificial Sequence
  Synthetic DNA
tactacgaatcactttag

SEQ ID NO: 10308 - DNA, 18 bp, Artificial Sequence
  Synthetic DNA
tattacgattccctatag

SEQ ID NO: 10309 - DNA, 18 bp, Artificial Sequence
  Synthetic DNA
tcatacatctcactatag

SEQ ID NO: 10310 - DNA, 18 bp, Artificial Sequence
  Synthetic DNA
aaatacgactcattgtag

SEQ ID NO: 10311 - DNA, 18 bp, Artificial Sequence
  Synthetic DNA
caatacgactcgttatag

SEQ ID NO: 10312 - DNA, 18 bp, Artificial Sequence
  Synthetic DNA
taaaaccactgactatag

SEQ ID NO: 10313 - DNA, 18 bp, Artificial Sequence
  Synthetic DNA
taacaagcctcactatag

SEQ ID NO: 10314 - DNA, 18 bp, Artificial Sequence
  Synthetic DNA
taacacgaatcaatatag

SEQ ID NO: 10315 - DNA, 18 bp, Artificial Sequence
  Synthetic DNA
taacacgactctcgatag

SEQ ID NO: 10316 - DNA, 18 bp, Artificial Sequence
  Synthetic DNA
taacacgagttactatag

SEQ ID NO: 10317 - DNA, 18 bp, Artificial Sequence
  Synthetic DNA
taacaggactcactaaag

SEQ ID NO: 10318 - DNA, 18 bp, Artificial Sequence
  Synthetic DNA
taacgtgactcactatag

SEQ ID NO: 10319 - DNA, 18 bp, Artificial Sequence
  Synthetic DNA
taataagactaaatatag

SEQ ID NO: 10320 - DNA, 18 bp, Artificial Sequence
  Synthetic DNA
taataagccttactatag

SEQ ID NO: 10321 - DNA, 18 bp, Artificial Sequence
  Synthetic DNA
taatacaagtcaccatag

SEQ ID NO: 10322 - DNA, 18 bp, Artificial Sequence
  Synthetic DNA
taatacaattcactctag

SEQ ID NO: 10323 - DNA, 18 bp, Artificial Sequence
  Synthetic DNA
taataccactcactctcg

SEQ ID NO: 10324 - DNA, 18 bp, Artificial Sequence
  Synthetic DNA
taatacctgtcactatag

SEQ ID NO: 10325 - DNA, 18 bp, Artificial Sequence
  Synthetic DNA
taatacgactcgcactag

SEQ ID NO: 10326 - DNA, 18 bp, Artificial Sequence
  Synthetic DNA
taatacgactcgccttag

SEQ ID NO: 10327 - DNA, 18 bp, Artificial Sequence
  Synthetic DNA
taatactactgaccatag

SEQ ID NO: 10328 - DNA, 18 bp, Artificial Sequence
  Synthetic DNA
taatactacttagtatag

SEQ ID NO: 10329 - DNA, 18 bp, Artificial Sequence
  Synthetic DNA
taatccgactcacaatgg

SEQ ID NO: 10330 - DNA, 18 bp, Artificial Sequence
  Synthetic DNA
tactacagctcactatag

SEQ ID NO: 10331 - DNA, 18 bp, Artificial Sequence
  Synthetic DNA
tacttcgactcactatgg

SEQ ID NO: 10332 - DNA, 18 bp, Artificial Sequence
  Synthetic DNA
tagtacgactcgctgtag

SEQ ID NO: 10333 - DNA, 18 bp, Artificial Sequence
  Synthetic DNA
tattacgaatcagtatag

SEQ ID NO: 10334 - DNA, 18 bp, Artificial Sequence
  Synthetic DNA
tattacgactcgatatag

SEQ ID NO: 10335 - DNA, 18 bp, Artificial Sequence
  Synthetic DNA
tcatacgacaccctatag

SEQ ID NO: 10336 - DNA, 18 bp, Artificial Sequence
  Synthetic DNA
tcatacgattaactatag

SEQ ID NO: 10337 - DNA, 18 bp, Artificial Sequence
  Synthetic DNA
tcatacgattcactctag

SEQ ID NO: 10338 - DNA, 18 bp, Artificial Sequence
  Synthetic DNA
tgacactactcactatag

SEQ ID NO: 10339 - DNA, 18 bp, Artificial Sequence
  Synthetic DNA
tgatacaagtcactatag

SEQ ID NO: 10340 - DNA, 18 bp, Artificial Sequence
  Synthetic DNA
tgatacgaatcactatcg

SEQ ID NO: 10341 - DNA, 18 bp, Artificial Sequence
  Synthetic DNA
tgatacgactaattatag

SEQ ID NO: 10342 - DNA, 18 bp, Artificial Sequence
  Synthetic DNA
tgatacgactcacaatgg

SEQ ID NO: 10343 - DNA, 18 bp, Artificial Sequence
  Synthetic DNA
tgatacgtctcaatatag

SEQ ID NO: 10344 - DNA, 18 bp, Artificial Sequence
  Synthetic DNA
ttatacgactaactatgg

SEQ ID NO: 10345 - DNA, 18 bp, Artificial Sequence
  Synthetic DNA
taatacgtctgtctatag

SEQ ID NO: 10346 - DNA, 18 bp, Artificial Sequence
  Synthetic DNA
taatatgtttcactatag

SEQ ID NO: 10347 - DNA, 18 bp, Artificial Sequence
  Synthetic DNA
taattcgactcattattg

SEQ ID NO: 10348 - DNA, 18 bp, Artificial Sequence
  Synthetic DNA
aaaaacaactcactatag

SEQ ID NO: 10349 - DNA, 18 bp, Artificial Sequence
  Synthetic DNA
aaatacgactcaccaaag

SEQ ID NO: 10350 - DNA, 18 bp, Artificial Sequence
  Synthetic DNA
taaaacgactaactacag

SEQ ID NO: 10351 - DNA, 18 bp, Artificial Sequence
  Synthetic DNA
taaaacgacttacaatag

SEQ ID NO: 10352 - DNA, 18 bp, Artificial Sequence
  Synthetic DNA
taataagacttacaatag

SEQ ID NO: 10353 - DNA, 18 bp, Artificial Sequence
  Synthetic DNA
taatacaatacactatag

SEQ ID NO: 10354 - DNA, 18 bp, Artificial Sequence
  Synthetic DNA
taatactactcactcaag

SEQ ID NO: 10355 - DNA, 18 bp, Artificial Sequence
  Synthetic DNA
tcatacgactcattattg

SEQ ID NO: 10356 - DNA, 18 bp, Artificial Sequence
  Synthetic DNA
ttataagactcacaatag

SEQ ID NO: 10357 - DNA, 18 bp, Artificial Sequence
  Synthetic DNA
ttatacgattcactattg

SEQ ID NO: 10358 - DNA, 18 bp, Artificial Sequence
  Synthetic DNA
taatatgattcacaatag

SEQ ID NO: 10359 - DNA, 18 bp, Artificial Sequence
  Synthetic DNA
taatattactcactaaag

SEQ ID NO: 10360 - DNA, 18 bp, Artificial Sequence
  Synthetic DNA
tcattcgtctcactatag

SEQ ID NO: 10361 - DNA, 18 bp, Artificial Sequence
  Synthetic DNA
aaatacctctcactatag

SEQ ID NO: 10362 - DNA, 18 bp, Artificial Sequence
  Synthetic DNA
ctatacgacttactatag

SEQ ID NO: 10363 - DNA, 18 bp, Artificial Sequence
  Synthetic DNA
taacaccactctctatag

SEQ ID NO: 10364 - DNA, 18 bp, Artificial Sequence
  Synthetic DNA
taatacgacaagctatag

SEQ ID NO: 10365 - DNA, 18 bp, Artificial Sequence
  Synthetic DNA
taatacgactcgtaatag

SEQ ID NO: 10366 - DNA, 18 bp, Artificial Sequence
  Synthetic DNA
taatacgagtttctatag

SEQ ID NO: 10367 - DNA, 18 bp, Artificial Sequence
  Synthetic DNA
taatactactcacgaaag

SEQ ID NO: 10368 - DNA, 18 bp, Artificial Sequence
  Synthetic DNA
taatccgtctcattatag

SEQ ID NO: 10369 - DNA, 18 bp, Artificial Sequence
  Synthetic DNA
taatgcgactcattaaag

SEQ ID NO: 10370 - DNA, 18 bp, Artificial Sequence
  Synthetic DNA
tagtaagactctctatag

SEQ ID NO: 10371 - DNA, 18 bp, Artificial Sequence
  Synthetic DNA
ttatacaactcaccatag

SEQ ID NO: 10372 - DNA, 18 bp, Artificial Sequence
  Synthetic DNA
ttatccgaatcactatag

SEQ ID NO: 10373 - DNA, 18 bp, Artificial Sequence
  Synthetic DNA
ttatccgacttactatag

SEQ ID NO: 10374 - DNA, 18 bp, Artificial Sequence
  Synthetic DNA
taatacgtccctctatag

SEQ ID NO: 10375 - DNA, 18 bp, Artificial Sequence
  Synthetic DNA
ttatacgactccctttag

SEQ ID NO: 10376 - DNA, 18 bp, Artificial Sequence
  Synthetic DNA
tattacgactctctacag

SEQ ID NO: 10377 - DNA, 18 bp, Artificial Sequence
  Synthetic DNA
ttataccactctctatag

SEQ ID NO: 10378 - DNA, 18 bp, Artificial Sequence
  Synthetic DNA
taattcgacatactatag

SEQ ID NO: 10379 - DNA, 18 bp, Artificial Sequence
  Synthetic DNA
ttatacgactcacattag

SEQ ID NO: 10380 - DNA, 18 bp, Artificial Sequence
  Synthetic DNA
ttatacgaatcactaaag

SEQ ID NO: 10381 - DNA, 18 bp, Artificial Sequence
  Synthetic DNA
taatactacacactaaag

SEQ ID NO: 10382 - DNA, 18 bp, Artificial Sequence
  Synthetic DNA
aaatacgacaaactatag

SEQ ID NO: 10383 - DNA, 18 bp, Artificial Sequence
  Synthetic DNA
taatacgacacagtaaag

SEQ ID NO: 10384 - DNA, 18 bp, Artificial Sequence
  Synthetic DNA
taatacgacttattaaag

SEQ ID NO: 10385 - DNA, 18 bp, Artificial Sequence
  Synthetic DNA
ataaacgactcactatag

SEQ ID NO: 10386 - DNA, 18 bp, Artificial Sequence
  Synthetic DNA
taaaacgtctaactatag

SEQ ID NO: 10387 - DNA, 18 bp, Artificial Sequence
  Synthetic DNA
caatacgatttactatag

SEQ ID NO: 10388 - DNA, 18 bp, Artificial Sequence
  Synthetic DNA
cattacgactcattatag

SEQ ID NO: 10389 - DNA, 18 bp, Artificial Sequence
  Synthetic DNA
gaatacgactctcaatag

SEQ ID NO: 10390 - DNA, 18 bp, Artificial Sequence
  Synthetic DNA
taaaacgattaactatag

SEQ ID NO: 10391 - DNA, 18 bp, Artificial Sequence
  Synthetic DNA
tagtacgattcaatatag

SEQ ID NO: 10392 - DNA, 18 bp, Artificial Sequence
  Synthetic DNA
tagtactacacactatag

SEQ ID NO: 10393 - DNA, 18 bp, Artificial Sequence
  Synthetic DNA
tataacgactgactatag

SEQ ID NO: 10394 - DNA, 18 bp, Artificial Sequence
  Synthetic DNA
tattacgactcattacag

SEQ ID NO: 10395 - DNA, 18 bp, Artificial Sequence
  Synthetic DNA
tgatacgatacactatag

SEQ ID NO: 10396 - DNA, 18 bp, Artificial Sequence
  Synthetic DNA
aaagacgactcactaaag

SEQ ID NO: 10397 - DNA, 18 bp, Artificial Sequence
  Synthetic DNA
aaataccactcattatag

SEQ ID NO: 10398 - DNA, 18 bp, Artificial Sequence
  Synthetic DNA
aaataggactcaatatag

SEQ ID NO: 10399 - DNA, 18 bp, Artificial Sequence
  Synthetic DNA
aaatatgactcagtatag

SEQ ID NO: 10400 - DNA, 18 bp, Artificial Sequence
  Synthetic DNA
caatatgactcgctatag

SEQ ID NO: 10401 - DNA, 18 bp, Artificial Sequence
  Synthetic DNA
caatccgaatcactatag

SEQ ID NO: 10402 - DNA, 18 bp, Artificial Sequence
  Synthetic DNA
taaaacggcacactatag

SEQ ID NO: 10403 - DNA, 18 bp, Artificial Sequence
  Synthetic DNA
taaaaggactcaccatag

SEQ ID NO: 10404 - DNA, 18 bp, Artificial Sequence
  Synthetic DNA
taaagcgacccactatag

SEQ ID NO: 10405 - DNA, 18 bp, Artificial Sequence
  Synthetic DNA
taacacgactcacattag

SEQ ID NO: 10406 - DNA, 18 bp, Artificial Sequence
  Synthetic DNA
taacacgactcataatag

SEQ ID NO: 10407 - DNA, 18 bp, Artificial Sequence
  Synthetic DNA
taacacgtctcagtatag

SEQ ID NO: 10408 - DNA, 18 bp, Artificial Sequence
  Synthetic DNA
taagacgactcacaaaag

SEQ ID NO: 10409 - DNA, 18 bp, Artificial Sequence
  Synthetic DNA
taagacgcctcactattg

SEQ ID NO: 10410 - DNA, 18 bp, Artificial Sequence
  Synthetic DNA
taagataactcactatag

SEQ ID NO: 10411 - DNA, 18 bp, Artificial Sequence
  Synthetic DNA
taataagacagactatag

SEQ ID NO: 10412 - DNA, 18 bp, Artificial Sequence
  Synthetic DNA
taataagacgcactaaag

SEQ ID NO: 10413 - DNA, 18 bp, Artificial Sequence
  Synthetic DNA
taataagcctcaatatag

SEQ ID NO: 10414 - DNA, 18 bp, Artificial Sequence
  Synthetic DNA
taataatactcactgtag

SEQ ID NO: 10415 - DNA, 18 bp, Artificial Sequence
  Synthetic DNA
taataccagtcattatag

SEQ ID NO: 10416 - DNA, 18 bp, Artificial Sequence
  Synthetic DNA
taatacgaaccactaaag

SEQ ID NO: 10417 - DNA, 18 bp, Artificial Sequence
  Synthetic DNA
taatacgaatcagaatag

SEQ ID NO: 10418 - DNA, 18 bp, Artificial Sequence
  Synthetic DNA
taatacgacaccctgtag

SEQ ID NO: 10419 - DNA, 18 bp, Artificial Sequence
  Synthetic DNA
taatacgactaagtattg

SEQ ID NO: 10420 - DNA, 18 bp, Artificial Sequence
  Synthetic DNA
taatacgactcactttcc

SEQ ID NO: 10421 - DNA, 18 bp, Artificial Sequence
  Synthetic DNA
taatacggctaattatag

SEQ ID NO: 10422 - DNA, 18 bp, Artificial Sequence
  Synthetic DNA
taatacggcttactacag

SEQ ID NO: 10423 - DNA, 18 bp, Artificial Sequence
  Synthetic DNA
taatacgtctcactatta

SEQ ID NO: 10424 - DNA, 18 bp, Artificial Sequence
  Synthetic DNA
taatacgtcttcctatag

SEQ ID NO: 10425 - DNA, 18 bp, Artificial Sequence
  Synthetic DNA
taatactacttactctag

SEQ ID NO: 10426 - DNA, 18 bp, Artificial Sequence
  Synthetic DNA
taatccgactctatatag

SEQ ID NO: 10427 - DNA, 18 bp, Artificial Sequence
  Synthetic DNA
taatgcgacacactctag

SEQ ID NO: 10428 - DNA, 18 bp, Artificial Sequence
  Synthetic DNA
taccacgaatcactatag

SEQ ID NO: 10429 - DNA, 18 bp, Artificial Sequence
  Synthetic DNA
tactaagactcaatatag

SEQ ID NO: 10430 - DNA, 18 bp, Artificial Sequence
  Synthetic DNA
tactaccactcactattg

SEQ ID NO: 10431 - DNA, 18 bp, Artificial Sequence
  Synthetic DNA
tagaacgactaactatag

SEQ ID NO: 10432 - DNA, 18 bp, Artificial Sequence
  Synthetic DNA
tagtgcgactcactattg

SEQ ID NO: 10433 - DNA, 18 bp, Artificial Sequence
  Synthetic DNA
tattacgacgcactttag

SEQ ID NO: 10434 - DNA, 18 bp, Artificial Sequence
  Synthetic DNA
tattatgagtcactatag

SEQ ID NO: 10435 - DNA, 18 bp, Artificial Sequence
  Synthetic DNA
tcatacctctcactatag

SEQ ID NO: 10436 - DNA, 18 bp, Artificial Sequence
  Synthetic DNA
tcatacgactcaatgtag

SEQ ID NO: 10437 - DNA, 18 bp, Artificial Sequence
  Synthetic DNA
tcatacgactcagtattg

SEQ ID NO: 10438 - DNA, 18 bp, Artificial Sequence
  Synthetic DNA
tgataagactcactctag

SEQ ID NO: 10439 - DNA, 18 bp, Artificial Sequence
  Synthetic DNA
tgatacaactaactatag

SEQ ID NO: 10440 - DNA, 18 bp, Artificial Sequence
  Synthetic DNA
tgatacgacgcactaaag

SEQ ID NO: 10441 - DNA, 18 bp, Artificial Sequence
  Synthetic DNA
taattctactcactttag

SEQ ID NO: 10442 - DNA, 18 bp, Artificial Sequence
  Synthetic DNA
aaatacgaatcactttag

SEQ ID NO: 10443 - DNA, 18 bp, Artificial Sequence
  Synthetic DNA
taatacggcacaatatag

SEQ ID NO: 10444 - DNA, 18 bp, Artificial Sequence
  Synthetic DNA
taatatgtctcattatag

SEQ ID NO: 10445 - DNA, 18 bp, Artificial Sequence
  Synthetic DNA
tcattcgactcactaaag

SEQ ID NO: 10446 - DNA, 18 bp, Artificial Sequence
  Synthetic DNA
ttaaacgactaactatag

SEQ ID NO: 10447 - DNA, 18 bp, Artificial Sequence
  Synthetic DNA
taatacgtctcaatttag

SEQ ID NO: 10448 - DNA, 18 bp, Artificial Sequence
  Synthetic DNA
ttatacgacttactttag

SEQ ID NO: 10449 - DNA, 18 bp, Artificial Sequence
  Synthetic DNA
aaatacgacacaccatag

SEQ ID NO: 10450 - DNA, 18 bp, Artificial Sequence
  Synthetic DNA
aagtacgactcactaaag

SEQ ID NO: 10451 - DNA, 18 bp, Artificial Sequence
  Synthetic DNA
taaaacgactctctctag

SEQ ID NO: 10452 - DNA, 18 bp, Artificial Sequence
  Synthetic DNA
taataacactcactattg

SEQ ID NO: 10453 - DNA, 18 bp, Artificial Sequence
  Synthetic DNA
taatacgactcaatactg

SEQ ID NO: 10454 - DNA, 18 bp, Artificial Sequence
  Synthetic DNA
taatactactgactttag

SEQ ID NO: 10455 - DNA, 18 bp, Artificial Sequence
  Synthetic DNA
taatatgacttacaatag

SEQ ID NO: 10456 - DNA, 18 bp, Artificial Sequence
  Synthetic DNA
taatatgagtcacaatag

SEQ ID NO: 10457 - DNA, 18 bp, Artificial Sequence
  Synthetic DNA
taattcgaccaactatag

SEQ ID NO: 10458 - DNA, 18 bp, Artificial Sequence
  Synthetic DNA
tactactactcactaaag

SEQ ID NO: 10459 - DNA, 18 bp, Artificial Sequence
  Synthetic DNA
tattacgagtcactaaag

SEQ ID NO: 10460 - DNA, 18 bp, Artificial Sequence
  Synthetic DNA
ttatatgactcactatcg

SEQ ID NO: 10461 - DNA, 18 bp, Artificial Sequence
  Synthetic DNA
caatacgattcactattg

SEQ ID NO: 10462 - DNA, 18 bp, Artificial Sequence
  Synthetic DNA
taatataaatcactatag

SEQ ID NO: 10463 - DNA, 18 bp, Artificial Sequence
  Synthetic DNA
taatgctactctctatag

SEQ ID NO: 10464 - DNA, 18 bp, Artificial Sequence
  Synthetic DNA
taatacgacacaatattg

SEQ ID NO: 10465 - DNA, 18 bp, Artificial Sequence
  Synthetic DNA
ttatacgactcaatattg

SEQ ID NO: 10466 - DNA, 18 bp, Artificial Sequence
  Synthetic DNA
taatacgactcatttttg

SEQ ID NO: 10467 - DNA, 18 bp, Artificial Sequence
  Synthetic DNA
taatacgtcacattatag

SEQ ID NO: 10468 - DNA, 18 bp, Artificial Sequence
  Synthetic DNA
taatacgattctcaatag

SEQ ID NO: 10469 - DNA, 18 bp, Artificial Sequence
  Synthetic DNA
taaaactactcattatag

SEQ ID NO: 10470 - DNA, 18 bp, Artificial Sequence
  Synthetic DNA
taatacgtaacactatag

SEQ ID NO: 10471 - DNA, 18 bp, Artificial Sequence
  Synthetic DNA
cattacgactcacaatag

SEQ ID NO: 10472 - DNA, 18 bp, Artificial Sequence
  Synthetic DNA
taatacgataaactatag

SEQ ID NO: 10473 - DNA, 18 bp, Artificial Sequence
  Synthetic DNA
taatatgaatcacaatag

SEQ ID NO: 10474 - DNA, 18 bp, Artificial Sequence
  Synthetic DNA
tagaacgactctctatag

SEQ ID NO: 10475 - DNA, 18 bp, Artificial Sequence
  Synthetic DNA
tattactactcaatatag

SEQ ID NO: 10476 - DNA, 18 bp, Artificial Sequence
  Synthetic DNA
aattacgactcactatcg

SEQ ID NO: 10477 - DNA, 18 bp, Artificial Sequence
  Synthetic DNA
taacacgactcattttag

SEQ ID NO: 10478 - DNA, 18 bp, Artificial Sequence
  Synthetic DNA
taactcgattcactatag

SEQ ID NO: 10479 - DNA, 18 bp, Artificial Sequence
  Synthetic DNA
taatacgactcaataagg

SEQ ID NO: 10480 - DNA, 18 bp, Artificial Sequence
  Synthetic DNA
taatacgtcacactatgg

SEQ ID NO: 10481 - DNA, 18 bp, Artificial Sequence
  Synthetic DNA
taattcgactcacttgag

SEQ ID NO: 10482 - DNA, 18 bp, Artificial Sequence
  Synthetic DNA
tagtaatactcactatag

SEQ ID NO: 10483 - DNA, 18 bp, Artificial Sequence
  Synthetic DNA
tattaggacttactatag

SEQ ID NO: 10484 - DNA, 18 bp, Artificial Sequence
  Synthetic DNA
tattatgactaactatag

SEQ ID NO: 10485 - DNA, 18 bp, Artificial Sequence
  Synthetic DNA
tgatacaattcactatag

SEQ ID NO: 10486 - DNA, 18 bp, Artificial Sequence
  Synthetic DNA
ttatacgacttcctatag

SEQ ID NO: 10487 - DNA, 18 bp, Artificial Sequence
  Synthetic DNA
aaatacgacccaatatag

SEQ ID NO: 10488 - DNA, 18 bp, Artificial Sequence
  Synthetic DNA
agacacgactcactatag

SEQ ID NO: 10489 - DNA, 18 bp, Artificial Sequence
  Synthetic DNA
caatacgactcagtttag

SEQ ID NO: 10490 - DNA, 18 bp, Artificial Sequence
  Synthetic DNA
caatacgactctccatag

SEQ ID NO: 10491 - DNA, 18 bp, Artificial Sequence
  Synthetic DNA
caatgcgacttactatag

SEQ ID NO: 10492 - DNA, 18 bp, Artificial Sequence
  Synthetic DNA
cattacgactcactatcg

SEQ ID NO: 10493 - DNA, 18 bp, Artificial Sequence
  Synthetic DNA
ctatacgactgactatag

SEQ ID NO: 10494 - DNA, 18 bp, Artificial Sequence
  Synthetic DNA
gaaaacgactcactattg

SEQ ID NO: 10495 - DNA, 18 bp, Artificial Sequence
  Synthetic DNA
gaatacgacacactattg

SEQ ID NO: 10496 - DNA, 18 bp, Artificial Sequence
  Synthetic DNA
taaaagcactcactatag

SEQ ID NO: 10497 - DNA, 18 bp, Artificial Sequence
  Synthetic DNA
taacacgactccctctag

SEQ ID NO: 10498 - DNA, 18 bp, Artificial Sequence
  Synthetic DNA
taacatgactcactctag

SEQ ID NO: 10499 - DNA, 18 bp, Artificial Sequence
  Synthetic DNA
taagatgactcactaaag

SEQ ID NO: 10500 - DNA, 18 bp, Artificial Sequence
  Synthetic DNA
taataagacccactttag

SEQ ID NO: 10501 - DNA, 18 bp, Artificial Sequence
  Synthetic DNA
taataaggttcactatag

SEQ ID NO: 10502 - DNA, 18 bp, Artificial Sequence
  Synthetic DNA
taataatactcactctag

SEQ ID NO: 10503 - DNA, 18 bp, Artificial Sequence
  Synthetic DNA
taatacaacacacgatag

SEQ ID NO: 10504 - DNA, 18 bp, Artificial Sequence
  Synthetic DNA
taataccactcaaaatag

SEQ ID NO: 10505 - DNA, 18 bp, Artificial Sequence
  Synthetic DNA
taatacgaatcattatgg

SEQ ID NO: 10506 - DNA, 18 bp, Artificial Sequence
  Synthetic DNA
taatacgacaccccatag

SEQ ID NO: 10507 - DNA, 18 bp, Artificial Sequence
  Synthetic DNA
taatacgacccactcaag

SEQ ID NO: 10508 - DNA, 18 bp, Artificial Sequence
  Synthetic DNA
taatacgacccgctttag

SEQ ID NO: 10509 - DNA, 18 bp, Artificial Sequence
  Synthetic DNA
taatacgaccctctatcg

SEQ ID NO: 10510 - DNA, 18 bp, Artificial Sequence
  Synthetic DNA
taatacgacttacttgag

SEQ ID NO: 10511 - DNA, 18 bp, Artificial Sequence
  Synthetic DNA
taatacgatacactatgg

SEQ ID NO: 10512 - DNA, 18 bp, Artificial Sequence
  Synthetic DNA
taatacgattccctaaag

SEQ ID NO: 10513 - DNA, 18 bp, Artificial Sequence
  Synthetic DNA
taatacggatcaatatag

SEQ ID NO: 10514 - DNA, 18 bp, Artificial Sequence
  Synthetic DNA
taatacggctcaccaaag

SEQ ID NO: 10515 - DNA, 18 bp, Artificial Sequence
  Synthetic DNA
taatacggctcactcaag

SEQ ID NO: 10516 - DNA, 18 bp, Artificial Sequence
  Synthetic DNA
taatacgtctcactgcag

SEQ ID NO: 10517 - DNA, 18 bp, Artificial Sequence
  Synthetic DNA
taatacgtctcagtaaag

SEQ ID NO: 10518 - DNA, 18 bp, Artificial Sequence
  Synthetic DNA
taataggacttaccatag

SEQ ID NO: 10519 - DNA, 18 bp, Artificial Sequence
  Synthetic DNA
taattccactcactagag

SEQ ID NO: 10520 - DNA, 18 bp, Artificial Sequence
  Synthetic DNA
tactacggctcactaaag

SEQ ID NO: 10521 - DNA, 18 bp, Artificial Sequence
  Synthetic DNA
tatcacgactccctatag

SEQ ID NO: 10522 - DNA, 18 bp, Artificial Sequence
  Synthetic DNA
tattacgaccaactatag

SEQ ID NO: 10523 - DNA, 18 bp, Artificial Sequence
  Synthetic DNA
tcatacgactgacaatag

SEQ ID NO: 10524 - DNA, 18 bp, Artificial Sequence
  Synthetic DNA
tcatacgacttactacag

SEQ ID NO: 10525 - DNA, 18 bp, Artificial Sequence
  Synthetic DNA
tcattcgactccctatag

SEQ ID NO: 10526 - DNA, 18 bp, Artificial Sequence
  Synthetic DNA
tgatacgacccactttag

SEQ ID NO: 10527 - DNA, 18 bp, Artificial Sequence
  Synthetic DNA
tgatacgactcactttcg

SEQ ID NO: 10528 - DNA, 18 bp, Artificial Sequence
  Synthetic DNA
tgatatgactcattatag

SEQ ID NO: 10529 - DNA, 18 bp, Artificial Sequence
  Synthetic DNA
aaatacgtcacactatag

SEQ ID NO: 10530 - DNA, 18 bp, Artificial Sequence
  Synthetic DNA
taatatgtcacactatag

SEQ ID NO: 10531 - DNA, 18 bp, Artificial Sequence
  Synthetic DNA
aaatacgtcttactatag

SEQ ID NO: 10532 - DNA, 18 bp, Artificial Sequence
  Synthetic DNA
taataagacacactaaag

SEQ ID NO: 10533 - DNA, 18 bp, Artificial Sequence
  Synthetic DNA
taatacaaattactatag

SEQ ID NO: 10534 - DNA, 18 bp, Artificial Sequence
  Synthetic DNA
taatacgacatactagag

SEQ ID NO: 10535 - DNA, 18 bp, Artificial Sequence
  Synthetic DNA
taatacgactccctaatg

SEQ ID NO: 10536 - DNA, 18 bp, Artificial Sequence
  Synthetic DNA
taatacgtctgactattg

SEQ ID NO: 10537 - DNA, 18 bp, Artificial Sequence
  Synthetic DNA
taatatgactcaccaaag

SEQ ID NO: 10538 - DNA, 18 bp, Artificial Sequence
  Synthetic DNA
taatatgattcattatag

SEQ ID NO: 10539 - DNA, 18 bp, Artificial Sequence
  Synthetic DNA
taatgcgtttcactatag

SEQ ID NO: 10540 - DNA, 18 bp, Artificial Sequence
  Synthetic DNA
tagtacgacactctatag

SEQ ID NO: 10541 - DNA, 18 bp, Artificial Sequence
  Synthetic DNA
tagtacgactaactaaag

SEQ ID NO: 10542 - DNA, 18 bp, Artificial Sequence
  Synthetic DNA
tcataagactcactaaag

SEQ ID NO: 10543 - DNA, 18 bp, Artificial Sequence
  Synthetic DNA
taatacgacacacttaag

SEQ ID NO: 10544 - DNA, 18 bp, Artificial Sequence
  Synthetic DNA
tattactactcacaatag

SEQ ID NO: 10545 - DNA, 18 bp, Artificial Sequence
  Synthetic DNA
aaatactactctctatag

SEQ ID NO: 10546 - DNA, 18 bp, Artificial Sequence
  Synthetic DNA
tattacgacacactacag

SEQ ID NO: 10547 - DNA, 18 bp, Artificial Sequence
  Synthetic DNA
taaaacgtttcactatag

SEQ ID NO: 10548 - DNA, 18 bp, Artificial Sequence
  Synthetic DNA
taatacgacacaaaatag

SEQ ID NO: 10549 - DNA, 18 bp, Artificial Sequence
  Synthetic DNA
ttatacgactctccatag

SEQ ID NO: 10550 - DNA, 18 bp, Artificial Sequence
  Synthetic DNA
ttatactactcactaaag

SEQ ID NO: 10551 - DNA, 18 bp, Artificial Sequence
  Synthetic DNA
tattactactcactattg

SEQ ID NO: 10552 - DNA, 18 bp, Artificial Sequence
  Synthetic DNA
aaatacgactcaataaag

SEQ ID NO: 10553 - DNA, 18 bp, Artificial Sequence
  Synthetic DNA
taatacaacacaatatag

SEQ ID NO: 10554 - DNA, 18 bp, Artificial Sequence
  Synthetic DNA
taatcctactcactattg

SEQ ID NO: 10555 - DNA, 18 bp, Artificial Sequence
  Synthetic DNA
ttataagaatcactatag

SEQ ID NO: 10556 - DNA, 18 bp, Artificial Sequence
  Synthetic DNA
taaatcgacccactatag

SEQ ID NO: 10557 - DNA, 18 bp, Artificial Sequence
  Synthetic DNA
taacaagactcactttag

SEQ ID NO: 10558 - DNA, 18 bp, Artificial Sequence
  Synthetic DNA
taataagactctatatag

SEQ ID NO: 10559 - DNA, 18 bp, Artificial Sequence
  Synthetic DNA
taatacaacttattatag

SEQ ID NO: 10560 - DNA, 18 bp, Artificial Sequence
  Synthetic DNA
taatacgacaccctacag

SEQ ID NO: 10561 - DNA, 18 bp, Artificial Sequence
  Synthetic DNA
taatacgacactctgtag

SEQ ID NO: 10562 - DNA, 18 bp, Artificial Sequence
  Synthetic DNA
taatacggttcactattg

SEQ ID NO: 10563 - DNA, 18 bp, Artificial Sequence
  Synthetic DNA
taatatgactctttatag

SEQ ID NO: 10564 - DNA, 18 bp, Artificial Sequence
  Synthetic DNA
tagtatgtctcactatag

SEQ ID NO: 10565 - DNA, 18 bp, Artificial Sequence
  Synthetic DNA
tattacgtcccactatag

SEQ ID NO: 10566 - DNA, 18 bp, Artificial Sequence
  Synthetic DNA
tcatatgattcactatag

SEQ ID NO: 10567 - DNA, 18 bp, Artificial Sequence
  Synthetic DNA
ttatacaactgactatag

SEQ ID NO: 10568 - DNA, 18 bp, Artificial Sequence
  Synthetic DNA
aaacatgactcactatag

SEQ ID NO: 10569 - DNA, 18 bp, Artificial Sequence
  Synthetic DNA
aaatacgacccagtatag

SEQ ID NO: 10570 - DNA, 18 bp, Artificial Sequence
  Synthetic DNA
aaatacgacttaatatag

SEQ ID NO: 10571 - DNA, 18 bp, Artificial Sequence
  Synthetic DNA
aagtacgacttactatag

SEQ ID NO: 10572 - DNA, 18 bp, Artificial Sequence
  Synthetic DNA
taaagcgactcaccatag

SEQ ID NO: 10573 - DNA, 18 bp, Artificial Sequence
  Synthetic DNA
taacacgacccactttag

SEQ ID NO: 10574 - DNA, 18 bp, Artificial Sequence
  Synthetic DNA
taacaggactcacaatag

SEQ ID NO: 10575 - DNA, 18 bp, Artificial Sequence
  Synthetic DNA
taacatgacccactatag

SEQ ID NO: 10576 - DNA, 18 bp, Artificial Sequence
  Synthetic DNA
taacccgacacactatag

SEQ ID NO: 10577 - DNA, 18 bp, Artificial Sequence
  Synthetic DNA
taataccactctctatcg

SEQ ID NO: 10578 - DNA, 18 bp, Artificial Sequence
  Synthetic DNA
taatacgaatcaccacag

SEQ ID NO: 10579 - DNA, 18 bp, Artificial Sequence
  Synthetic DNA
taatacgaccaactttag

SEQ ID NO: 10580 - DNA, 18 bp, Artificial Sequence
  Synthetic DNA
taatacgacctactttag

SEQ ID NO: 10581 - DNA, 18 bp, Artificial Sequence
  Synthetic DNA
taatacgacctattatag

SEQ ID NO: 10582 - DNA, 18 bp, Artificial Sequence
  Synthetic DNA
taatacgactccttacag

SEQ ID NO: 10583 - DNA, 18 bp, Artificial Sequence
  Synthetic DNA
taatacgactgcctttag

SEQ ID NO: 10584 - DNA, 18 bp, Artificial Sequence
  Synthetic DNA
taatacgactgtccatag

SEQ ID NO: 10585 - DNA, 18 bp, Artificial Sequence
  Synthetic DNA
taatacgactgtctagag

SEQ ID NO: 10586 - DNA, 18 bp, Artificial Sequence
  Synthetic DNA
taatacgactgtctatcg

SEQ ID NO: 10587 - DNA, 18 bp, Artificial Sequence
  Synthetic DNA
taatacgagtcactaacg

SEQ ID NO: 10588 - DNA, 18 bp, Artificial Sequence
  Synthetic DNA
taatacgagtcactcttg

SEQ ID NO: 10589 - DNA, 18 bp, Artificial Sequence
  Synthetic DNA
taatacgccaaactatag

SEQ ID NO: 10590 - DNA, 18 bp, Artificial Sequence
  Synthetic DNA
taatacgccccactaaag

SEQ ID NO: 10591 - DNA, 18 bp, Artificial Sequence
  Synthetic DNA
taatacgcttcactctag

SEQ ID NO: 10592 - DNA, 18 bp, Artificial Sequence
  Synthetic DNA
taatacgtctcagtatcg

SEQ ID NO: 10593 - DNA, 18 bp, Artificial Sequence
  Synthetic DNA
taatactactcatcatag

SEQ ID NO: 10594 - DNA, 18 bp, Artificial Sequence
  Synthetic DNA
taatactcctccctatag

SEQ ID NO: 10595 - DNA, 18 bp, Artificial Sequence
  Synthetic DNA
taataggactcacaatcg

SEQ ID NO: 10596 - DNA, 18 bp, Artificial Sequence
  Synthetic DNA
taataggtctaactatag

SEQ ID NO: 10597 - DNA, 18 bp, Artificial Sequence
  Synthetic DNA
taatatcactcactacag

SEQ ID NO: 10598 - DNA, 18 bp, Artificial Sequence
  Synthetic DNA
taatatgacttaccatag

SEQ ID NO: 10599 - DNA, 18 bp, Artificial Sequence
  Synthetic DNA
taatccgacgctctatag

SEQ ID NO: 10600 - DNA, 18 bp, Artificial Sequence
  Synthetic DNA
taatgtgactctctatag

SEQ ID NO: 10601 - DNA, 18 bp, Artificial Sequence
  Synthetic DNA
taattcgcctgactatag

SEQ ID NO: 10602 - DNA, 18 bp, Artificial Sequence
  Synthetic DNA
tacaaggactcactatag

SEQ ID NO: 10603 - DNA, 18 bp, Artificial Sequence
  Synthetic DNA
taccacgactcactgtag

SEQ ID NO: 10604 - DNA, 18 bp, Artificial Sequence
  Synthetic DNA
tacctcgactcactatag

SEQ ID NO: 10605 - DNA, 18 bp, Artificial Sequence
  Synthetic DNA
tactacgagttactatag

SEQ ID NO: 10606 - DNA, 18 bp, Artificial Sequence
  Synthetic DNA
tactacgtctcactgtag

SEQ ID NO: 10607 - DNA, 18 bp, Artificial Sequence
  Synthetic DNA
tactaggactctctatag

SEQ ID NO: 10608 - DNA, 18 bp, Artificial Sequence
  Synthetic DNA
tagtacgacacgctatag

SEQ ID NO: 10609 - DNA, 18 bp, Artificial Sequence
  Synthetic DNA
tagtacgattaactatag

SEQ ID NO: 10610 - DNA, 18 bp, Artificial Sequence
  Synthetic DNA
tagttcgactgactatag

SEQ ID NO: 10611 - DNA, 18 bp, Artificial Sequence
  Synthetic DNA
tattacgactcagtctag

SEQ ID NO: 10612 - DNA, 18 bp, Artificial Sequence
  Synthetic DNA
tattacggctcactctag

SEQ ID NO: 10613 - DNA, 18 bp, Artificial Sequence
  Synthetic DNA
tcacacgactaactatag

SEQ ID NO: 10614 - DNA, 18 bp, Artificial Sequence
  Synthetic DNA
tcatacaactcgctatag

SEQ ID NO: 10615 - DNA, 18 bp, Artificial Sequence
  Synthetic DNA
tcataccattcactatag

SEQ ID NO: 10616 - DNA, 18 bp, Artificial Sequence
  Synthetic DNA
tcatacgtctcactgtag

SEQ ID NO: 10617 - DNA, 18 bp, Artificial Sequence
  Synthetic DNA
tcatacgtctgactatag

SEQ ID NO: 10618 - DNA, 18 bp, Artificial Sequence
  Synthetic DNA
tcatccgtctcactatag

SEQ ID NO: 10619 - DNA, 18 bp, Artificial Sequence
  Synthetic DNA
tgataagactcactacag

SEQ ID NO: 10620 - DNA, 18 bp, Artificial Sequence
  Synthetic DNA
tgataaggctcactatag

SEQ ID NO: 10621 - DNA, 18 bp, Artificial Sequence
  Synthetic DNA
tgatacgacacgctatag

SEQ ID NO: 10622 - DNA, 18 bp, Artificial Sequence
  Synthetic DNA
tgatacgactcacgctag

SEQ ID NO: 10623 - DNA, 18 bp, Artificial Sequence
  Synthetic DNA
tgatccaactcactatag

SEQ ID NO: 10624 - DNA, 18 bp, Artificial Sequence
  Synthetic DNA
ttacacgactcactatgg

SEQ ID NO: 10625 - DNA, 18 bp, Artificial Sequence
  Synthetic DNA
ttagccgactcactatag

SEQ ID NO: 10626 - DNA, 18 bp, Artificial Sequence
  Synthetic DNA
ttatacgacacactttag

SEQ ID NO: 10627 - DNA, 18 bp, Artificial Sequence
  Synthetic DNA
taaaactactctctatag

SEQ ID NO: 10628 - DNA, 18 bp, Artificial Sequence
  Synthetic DNA
ttatacgacacattatag

SEQ ID NO: 10629 - DNA, 18 bp, Artificial Sequence
  Synthetic DNA
taatatgactcacattag

SEQ ID NO: 10630 - DNA, 18 bp, Artificial Sequence
  Synthetic DNA
tatctcgactcactatag

SEQ ID NO: 10631 - DNA, 18 bp, Artificial Sequence
  Synthetic DNA
taataagactttctatag

SEQ ID NO: 10632 - DNA, 18 bp, Artificial Sequence
  Synthetic DNA
taatacgaattacaatag

SEQ ID NO: 10633 - DNA, 18 bp, Artificial Sequence
  Synthetic DNA
taatacgactctctatta

SEQ ID NO: 10634 - DNA, 18 bp, Artificial Sequence
  Synthetic DNA
ttattcgactcacaatag

SEQ ID NO: 10635 - DNA, 18 bp, Artificial Sequence
  Synthetic DNA
taaatcgactcattatag

SEQ ID NO: 10636 - DNA, 18 bp, Artificial Sequence
  Synthetic DNA
taacactacttactatag

SEQ ID NO: 10637 - DNA, 18 bp, Artificial Sequence
  Synthetic DNA
taataagaatcaatatag

SEQ ID NO: 10638 - DNA, 18 bp, Artificial Sequence
  Synthetic DNA
taataagagtcactttag

SEQ ID NO: 10639 - DNA, 18 bp, Artificial Sequence
  Synthetic DNA
taatacgtcacacgatag

SEQ ID NO: 10640 - DNA, 18 bp, Artificial Sequence
  Synthetic DNA
taatacgtctcattacag

SEQ ID NO: 10641 - DNA, 18 bp, Artificial Sequence
  Synthetic DNA
tagtacatctcactatag

SEQ ID NO: 10642 - DNA, 18 bp, Artificial Sequence
  Synthetic DNA
tcatacgaatcacaatag

SEQ ID NO: 10643 - DNA, 18 bp, Artificial Sequence
  Synthetic DNA
taaaacgaatcactttag

SEQ ID NO: 10644 - DNA, 18 bp, Artificial Sequence
  Synthetic DNA
taatacaaatcactttag

SEQ ID NO: 10645 - DNA, 18 bp, Artificial Sequence
  Synthetic DNA
taatacttctcaccatag

SEQ ID NO: 10646 - DNA, 18 bp, Artificial Sequence
  Synthetic DNA
taatactaatcactttag

SEQ ID NO: 10647 - DNA, 18 bp, Artificial Sequence
  Synthetic DNA
tattaagacacactatag

SEQ ID NO: 10648 - DNA, 18 bp, Artificial Sequence
  Synthetic DNA
tattacgacacactaaag

SEQ ID NO: 10649 - DNA, 18 bp, Artificial Sequence
  Synthetic DNA
taaaacgattcactaaag

SEQ ID NO: 10650 - DNA, 18 bp, Artificial Sequence
  Synthetic DNA
taaaacgaatcactattg

SEQ ID NO: 10651 - DNA, 18 bp, Artificial Sequence
  Synthetic DNA
taattcgtttcactatag

SEQ ID NO: 10652 - DNA, 18 bp, Artificial Sequence
  Synthetic DNA
acatacgactctctatag

SEQ ID NO: 10653 - DNA, 18 bp, Artificial Sequence
  Synthetic DNA
atatacggctcactatag

SEQ ID NO: 10654 - DNA, 18 bp, Artificial Sequence
  Synthetic DNA
tattacgactcacaacag

SEQ ID NO: 10655 - DNA, 18 bp, Artificial Sequence
  Synthetic DNA
aaatacaagtcactatag

SEQ ID NO: 10656 - DNA, 18 bp, Artificial Sequence
  Synthetic DNA
taatacatctcagtatag

SEQ ID NO: 10657 - DNA, 18 bp, Artificial Sequence
  Synthetic DNA
taatacgactttctctag

SEQ ID NO: 10658 - DNA, 18 bp, Artificial Sequence
  Synthetic DNA
taatacttgtcactatag

SEQ ID NO: 10659 - DNA, 18 bp, Artificial Sequence
  Synthetic DNA
taattcgacacactgtag

SEQ ID NO: 10660 - DNA, 18 bp, Artificial Sequence
  Synthetic DNA
ttatacgactcattatcg

SEQ ID NO: 10661 - DNA, 18 bp, Artificial Sequence
  Synthetic DNA
aaaaccgactcactatag

SEQ ID NO: 10662 - DNA, 18 bp, Artificial Sequence
  Synthetic DNA
aaatacgacccactttag

SEQ ID NO: 10663 - DNA, 18 bp, Artificial Sequence
  Synthetic DNA
aaatacgacgcactaaag

SEQ ID NO: 10664 - DNA, 18 bp, Artificial Sequence
  Synthetic DNA
aaatacgtctcacgatag

SEQ ID NO: 10665 - DNA, 18 bp, Artificial Sequence
  Synthetic DNA
ctatacgacccactatag

SEQ ID NO: 10666 - DNA, 18 bp, Artificial Sequence
  Synthetic DNA
ctatacgactcactatgg

SEQ ID NO: 10667 - DNA, 18 bp, Artificial Sequence
  Synthetic DNA
ctatacgactccctatag

SEQ ID NO: 10668 - DNA, 18 bp, Artificial Sequence
  Synthetic DNA
taaaactacccactatag

SEQ ID NO: 10669 - DNA, 18 bp, Artificial Sequence
  Synthetic DNA
taaaactactcacgatag

SEQ ID NO: 10670 - DNA, 18 bp, Artificial Sequence
  Synthetic DNA
taacaagactcactgtag

SEQ ID NO: 10671 - DNA, 18 bp, Artificial Sequence
  Synthetic DNA
taacacgacacaccatag

SEQ ID NO: 10672 - DNA, 18 bp, Artificial Sequence
  Synthetic DNA
taactcgactccctatag

SEQ ID NO: 10673 - DNA, 18 bp, Artificial Sequence
  Synthetic DNA
taagacaactcactaaag

SEQ ID NO: 10674 - DNA, 18 bp, Artificial Sequence
  Synthetic DNA
taataacactcactaaag

SEQ ID NO: 10675 - DNA, 18 bp, Artificial Sequence
  Synthetic DNA
taataagacacactctag

SEQ ID NO: 10676 - DNA, 18 bp, Artificial Sequence
  Synthetic DNA
taatacaacttactatgg

SEQ ID NO: 10677 - DNA, 18 bp, Artificial Sequence
  Synthetic DNA
taataccactcagtttag

SEQ ID NO: 10678 - DNA, 18 bp, Artificial Sequence
  Synthetic DNA
taatacgacccactgaag

SEQ ID NO: 10679 - DNA, 18 bp, Artificial Sequence
  Synthetic DNA
taatacgactcattccag

SEQ ID NO: 10680 - DNA, 18 bp, Artificial Sequence
  Synthetic DNA
taatacgactctccatgg

SEQ ID NO: 10681 - DNA, 18 bp, Artificial Sequence
  Synthetic DNA
taatacgtctccccatag

SEQ ID NO: 10682 - DNA, 18 bp, Artificial Sequence
  Synthetic DNA
taatactgctcattatag

SEQ ID NO: 10683 - DNA, 18 bp, Artificial Sequence
  Synthetic DNA
taatatgattaactatag

SEQ ID NO: 10684 - DNA, 18 bp, Artificial Sequence
  Synthetic DNA
taatgcgaatcactagag

SEQ ID NO: 10685 - DNA, 18 bp, Artificial Sequence
  Synthetic DNA
taatgcgactcaccttag

SEQ ID NO: 10686 - DNA, 18 bp, Artificial Sequence
  Synthetic DNA
taattccactcagtatag

SEQ ID NO: 10687 - DNA, 18 bp, Artificial Sequence
  Synthetic DNA
taattcgactcagcatag

SEQ ID NO: 10688 - DNA, 18 bp, Artificial Sequence
  Synthetic DNA
tactaggactcattatag

SEQ ID NO: 10689 - DNA, 18 bp, Artificial Sequence
  Synthetic DNA
tactatgactcactacag

SEQ ID NO: 10690 - DNA, 18 bp, Artificial Sequence
  Synthetic DNA
taggacgtctcactatag

SEQ ID NO: 10691 - DNA, 18 bp, Artificial Sequence
  Synthetic DNA
tagtacgtctcactacag

SEQ ID NO: 10692 - DNA, 18 bp, Artificial Sequence
  Synthetic DNA
tattacgattcacgatag

SEQ ID NO: 10693 - DNA, 18 bp, Artificial Sequence
  Synthetic DNA
tattactactgactatag

SEQ ID NO: 10694 - DNA, 18 bp, Artificial Sequence
  Synthetic DNA
tcaaccgactcactatag

SEQ ID NO: 10695 - DNA, 18 bp, Artificial Sequence
  Synthetic DNA
tcacacgactcactttag

SEQ ID NO: 10696 - DNA, 18 bp, Artificial Sequence
  Synthetic DNA
tcttacgactcactgtag

SEQ ID NO: 10697 - DNA, 18 bp, Artificial Sequence
  Synthetic DNA
tcttacgagtcactatag

SEQ ID NO: 10698 - DNA, 18 bp, Artificial Sequence
  Synthetic DNA
ttgtacgactaactatag

SEQ ID NO: 10699 - DNA, 18 bp, Artificial Sequence
  Synthetic DNA
ttgtacgactcaatatag

SEQ ID NO: 10700 - DNA, 18 bp, Artificial Sequence
  Synthetic DNA
ttgtacgcctcactatag

SEQ ID NO: 10701 - DNA, 18 bp, Artificial Sequence
  Synthetic DNA
atatacgtctcactatag

SEQ ID NO: 10702 - DNA, 18 bp, Artificial Sequence
  Synthetic DNA
taacacgtctcactattg

SEQ ID NO: 10703 - DNA, 18 bp, Artificial Sequence
  Synthetic DNA
taatacgtctcataatag

SEQ ID NO: 10704 - DNA, 18 bp, Artificial Sequence
  Synthetic DNA
taatacgtcatactatag

SEQ ID NO: 10705 - DNA, 18 bp, Artificial Sequence
  Synthetic DNA
aaatatgacacactatag

SEQ ID NO: 10706 - DNA, 18 bp, Artificial Sequence
  Synthetic DNA
taataccactctcaatag

SEQ ID NO: 10707 - DNA, 18 bp, Artificial Sequence
  Synthetic DNA
taatacgacacactcttg

SEQ ID NO: 10708 - DNA, 18 bp, Artificial Sequence
  Synthetic DNA
taatactactcaccattg

SEQ ID NO: 10709 - DNA, 18 bp, Artificial Sequence
  Synthetic DNA
aaatactactcaccatag

SEQ ID NO: 10710 - DNA, 18 bp, Artificial Sequence
  Synthetic DNA
aaatactacttactatag

SEQ ID NO: 10711 - DNA, 18 bp, Artificial Sequence
  Synthetic DNA
taaaacgactaattatag

SEQ ID NO: 10712 - DNA, 18 bp, Artificial Sequence
  Synthetic DNA
taataacacttactatag

SEQ ID NO: 10713 - DNA, 18 bp, Artificial Sequence
  Synthetic DNA
taatacgacacactaagg

SEQ ID NO: 10714 - DNA, 18 bp, Artificial Sequence
  Synthetic DNA
taatacgacacactagtg

SEQ ID NO: 10715 - DNA, 18 bp, Artificial Sequence
  Synthetic DNA
taattcgactaactgtag

SEQ ID NO: 10716 - DNA, 18 bp, Artificial Sequence
  Synthetic DNA
tacttcgacacactatag

SEQ ID NO: 10717 - DNA, 18 bp, Artificial Sequence
  Synthetic DNA
tgatacgaatcacaatag

SEQ ID NO: 10718 - DNA, 18 bp, Artificial Sequence
  Synthetic DNA
taattcaacacactatag

SEQ ID NO: 10719 - DNA, 18 bp, Artificial Sequence
  Synthetic DNA
taatacgaccctttatag

SEQ ID NO: 10720 - DNA, 18 bp, Artificial Sequence
  Synthetic DNA
tattacgtctcactatgg

SEQ ID NO: 10721 - DNA, 18 bp, Artificial Sequence
  Synthetic DNA
taattcgactctcaatag

SEQ ID NO: 10722 - DNA, 18 bp, Artificial Sequence
  Synthetic DNA
taaaacgactaactttag

SEQ ID NO: 10723 - DNA, 18 bp, Artificial Sequence
  Synthetic DNA
taaaacgactcattaaag

SEQ ID NO: 10724 - DNA, 18 bp, Artificial Sequence
  Synthetic DNA
taatacgacttactaatg

SEQ ID NO: 10725 - DNA, 18 bp, Artificial Sequence
  Synthetic DNA
taatactactcacattag

SEQ ID NO: 10726 - DNA, 18 bp, Artificial Sequence
  Synthetic DNA
taatacgacactatatag

SEQ ID NO: 10727 - DNA, 18 bp, Artificial Sequence
  Synthetic DNA
tattccgactcattatag

SEQ ID NO: 10728 - DNA, 18 bp, Artificial Sequence
  Synthetic DNA
ttataagacttactatag

SEQ ID NO: 10729 - DNA, 18 bp, Artificial Sequence
  Synthetic DNA
aaatacgactctctctag

SEQ ID NO: 10730 - DNA, 18 bp, Artificial Sequence
  Synthetic DNA
caaaacgactctctatag

SEQ ID NO: 10731 - DNA, 18 bp, Artificial Sequence
  Synthetic DNA
taaaaagacacactatag

SEQ ID NO: 10732 - DNA, 18 bp, Artificial Sequence
  Synthetic DNA
taaaaagactctctatag

SEQ ID NO: 10733 - DNA, 18 bp, Artificial Sequence
  Synthetic DNA
taaaacgacagactatag

SEQ ID NO: 10734 - DNA, 18 bp, Artificial Sequence
  Synthetic DNA
taatacaaatcattatag

SEQ ID NO: 10735 - DNA, 18 bp, Artificial Sequence
  Synthetic DNA
taatacgaccctctattg

SEQ ID NO: 10736 - DNA, 18 bp, Artificial Sequence
  Synthetic DNA
taatacgactttccatag

SEQ ID NO: 10737 - DNA, 18 bp, Artificial Sequence
  Synthetic DNA
taatatgtctaactatag

SEQ ID NO: 10738 - DNA, 18 bp, Artificial Sequence
  Synthetic DNA
taattcgactcaacatag

SEQ ID NO: 10739 - DNA, 18 bp, Artificial Sequence
  Synthetic DNA
tattacgacttcctatag

SEQ ID NO: 10740 - DNA, 18 bp, Artificial Sequence
  Synthetic DNA
tattatgacttactatag

SEQ ID NO: 10741 - DNA, 18 bp, Artificial Sequence
  Synthetic DNA
tattgctactcactatag

SEQ ID NO: 10742 - DNA, 18 bp, Artificial Sequence
  Synthetic DNA
aaatacgactcaatctag

SEQ ID NO: 10743 - DNA, 18 bp, Artificial Sequence
  Synthetic DNA
aaataggacttactatag

SEQ ID NO: 10744 - DNA, 18 bp, Artificial Sequence
  Synthetic DNA
aaatgcgacacactatag

SEQ ID NO: 10745 - DNA, 18 bp, Artificial Sequence
  Synthetic DNA
acatacgactcagtatag

SEQ ID NO: 10746 - DNA, 18 bp, Artificial Sequence
  Synthetic DNA
taaaacgagacactatag

SEQ ID NO: 10747 - DNA, 18 bp, Artificial Sequence
  Synthetic DNA
taacaacactcactatag

SEQ ID NO: 10748 - DNA, 18 bp, Artificial Sequence
  Synthetic DNA
taacacaactcagtatag

SEQ ID NO: 10749 - DNA, 18 bp, Artificial Sequence
  Synthetic DNA
taacaccacttactatag

SEQ ID NO: 10750 - DNA, 18 bp, Artificial Sequence
  Synthetic DNA
taacacgactcaatatgg

SEQ ID NO: 10751 - DNA, 18 bp, Artificial Sequence
  Synthetic DNA
taacacgattcactacag

SEQ ID NO: 10752 - DNA, 18 bp, Artificial Sequence
  Synthetic DNA
taacatgactaactatag

SEQ ID NO: 10753 - DNA, 18 bp, Artificial Sequence
  Synthetic DNA
taagacgactcattattg

SEQ ID NO: 10754 - DNA, 18 bp, Artificial Sequence
  Synthetic DNA
taatacgaatcactatta

SEQ ID NO: 10755 - DNA, 18 bp, Artificial Sequence
  Synthetic DNA
taatacgaatcagtaaag

SEQ ID NO: 10756 - DNA, 18 bp, Artificial Sequence
  Synthetic DNA
taatacgacacactccag

SEQ ID NO: 10757 - DNA, 18 bp, Artificial Sequence
  Synthetic DNA
taatacgacacgatatag

SEQ ID NO: 10758 - DNA, 18 bp, Artificial Sequence
  Synthetic DNA
taatacgacagactatcg

SEQ ID NO: 10759 - DNA, 18 bp, Artificial Sequence
  Synthetic DNA
taatacgacctaccatag

SEQ ID NO: 10760 - DNA, 18 bp, Artificial Sequence
  Synthetic DNA
taatacgacttgcaatag

SEQ ID NO: 10761 - DNA, 18 bp, Artificial Sequence
  Synthetic DNA
taatacgagtatctatag

SEQ ID NO: 10762 - DNA, 18 bp, Artificial Sequence
  Synthetic DNA
taatacgagtcactgaag

SEQ ID NO: 10763 - DNA, 18 bp, Artificial Sequence
  Synthetic DNA
taatacggatctctatag

SEQ ID NO: 10764 - DNA, 18 bp, Artificial Sequence
  Synthetic DNA
taatacggttcaatatag

SEQ ID NO: 10765 - DNA, 18 bp, Artificial Sequence
  Synthetic DNA
taatacgtctcaatatgg

SEQ ID NO: 10766 - DNA, 18 bp, Artificial Sequence
  Synthetic DNA
taatacgtgtcaccatag

SEQ ID NO: 10767 - DNA, 18 bp, Artificial Sequence
  Synthetic DNA
taatactaatgactatag

SEQ ID NO: 10768 - DNA, 18 bp, Artificial Sequence
  Synthetic DNA
taatactactcactgcag

SEQ ID NO: 10769 - DNA, 18 bp, Artificial Sequence
  Synthetic DNA
taatactattgactatag

SEQ ID NO: 10770 - DNA, 18 bp, Artificial Sequence
  Synthetic DNA
taataggactcattttag

SEQ ID NO: 10771 - DNA, 18 bp, Artificial Sequence
  Synthetic DNA
taatagtactctctatag

SEQ ID NO: 10772 - DNA, 18 bp, Artificial Sequence
  Synthetic DNA
taatccgactaattatag

SEQ ID NO: 10773 - DNA, 18 bp, Artificial Sequence
  Synthetic DNA
taatccgattcaatatag

SEQ ID NO: 10774 - DNA, 18 bp, Artificial Sequence
  Synthetic DNA
taatgcgacagactatag

SEQ ID NO: 10775 - DNA, 18 bp, Artificial Sequence
  Synthetic DNA
taatgcgacttacaatag

SEQ ID NO: 10776 - DNA, 18 bp, Artificial Sequence
  Synthetic DNA
tactacaactcagtatag

SEQ ID NO: 10777 - DNA, 18 bp, Artificial Sequence
  Synthetic DNA
tactacgacacacgatag

SEQ ID NO: 10778 - DNA, 18 bp, Artificial Sequence
  Synthetic DNA
tactacgacttagtatag

SEQ ID NO: 10779 - DNA, 18 bp, Artificial Sequence
  Synthetic DNA
tacttggactcactatag

SEQ ID NO: 10780 - DNA, 18 bp, Artificial Sequence
  Synthetic DNA
tagtacgagtctctatag

SEQ ID NO: 10781 - DNA, 18 bp, Artificial Sequence
  Synthetic DNA
tagtacgccacactatag

SEQ ID NO: 10782 - DNA, 18 bp, Artificial Sequence
  Synthetic DNA
tattacgactcacaagag

SEQ ID NO: 10783 - DNA, 18 bp, Artificial Sequence
  Synthetic DNA
tcataagactcacaatag

SEQ ID NO: 10784 - DNA, 18 bp, Artificial Sequence
  Synthetic DNA
tcatacgaaccactatag

SEQ ID NO: 10785 - DNA, 18 bp, Artificial Sequence
  Synthetic DNA
tcataggactctctatag

SEQ ID NO: 10786 - DNA, 18 bp, Artificial Sequence
  Synthetic DNA
tcatatgagtcactatag

SEQ ID NO: 10787 - DNA, 18 bp, Artificial Sequence
  Synthetic DNA
tgatacgaccaactatag

SEQ ID NO: 10788 - DNA, 18 bp, Artificial Sequence
  Synthetic DNA
ttatacgactccgtatag

SEQ ID NO: 10789 - DNA, 18 bp, Artificial Sequence
  Synthetic DNA
ttatccgacgcactatag

SEQ ID NO: 10790 - DNA, 18 bp, Artificial Sequence
  Synthetic DNA
tactactactctctatag

SEQ ID NO: 10791 - DNA, 18 bp, Artificial Sequence
  Synthetic DNA
taatcctactcacaatag

SEQ ID NO: 10792 - DNA, 18 bp, Artificial Sequence
  Synthetic DNA
taatacgacacacattag

SEQ ID NO: 10793 - DNA, 18 bp, Artificial Sequence
  Synthetic DNA
taatactactcaatattg

SEQ ID NO: 10794 - DNA, 18 bp, Artificial Sequence
  Synthetic DNA
taatacctctcaatatag

SEQ ID NO: 10795 - DNA, 18 bp, Artificial Sequence
  Synthetic DNA
taatacgaatctccatag

SEQ ID NO: 10796 - DNA, 18 bp, Artificial Sequence
  Synthetic DNA
taatacgaattactattg

SEQ ID NO: 10797 - DNA, 18 bp, Artificial Sequence
  Synthetic DNA
taatacgaccaactattg

SEQ ID NO: 10798 - DNA, 18 bp, Artificial Sequence
  Synthetic DNA
taataggattcacaatag

SEQ ID NO: 10799 - DNA, 18 bp, Artificial Sequence
  Synthetic DNA
taatcatactcactatag

SEQ ID NO: 10800 - DNA, 18 bp, Artificial Sequence
  Synthetic DNA
taatccgactcataatag

SEQ ID NO: 10801 - DNA, 18 bp, Artificial Sequence
  Synthetic DNA
taattcgacccactaaag

SEQ ID NO: 10802 - DNA, 18 bp, Artificial Sequence
  Synthetic DNA
tcaaacgacacactatag

SEQ ID NO: 10803 - DNA, 18 bp, Artificial Sequence
  Synthetic DNA
tcattcaactcactatag

SEQ ID NO: 10804 - DNA, 18 bp, Artificial Sequence
  Synthetic DNA
ttatacgaatcacaatag

SEQ ID NO: 10805 - DNA, 18 bp, Artificial Sequence
  Synthetic DNA
aaatacgtctcattatag

SEQ ID NO: 10806 - DNA, 18 bp, Artificial Sequence
  Synthetic DNA
tcatacgacactctatag

SEQ ID NO: 10807 - DNA, 18 bp, Artificial Sequence
  Synthetic DNA
taaaacgactcattattg

SEQ ID NO: 10808 - DNA, 18 bp, Artificial Sequence
  Synthetic DNA
taatactactctatatag

SEQ ID NO: 10809 - DNA, 18 bp, Artificial Sequence
  Synthetic DNA
tcattcgactcacaatag

SEQ ID NO: 10810 - DNA, 18 bp, Artificial Sequence
  Synthetic DNA
ttaaacgaatcactatag

SEQ ID NO: 10811 - DNA, 18 bp, Artificial Sequence
  Synthetic DNA
ttacacgactcactaaag

SEQ ID NO: 10812 - DNA, 18 bp, Artificial Sequence
  Synthetic DNA
taaaacgacacactattg

SEQ ID NO: 10813 - DNA, 18 bp, Artificial Sequence
  Synthetic DNA
taaaacttctcactatag

SEQ ID NO: 10814 - DNA, 18 bp, Artificial Sequence
  Synthetic DNA
taacacgacttactattg

SEQ ID NO: 10815 - DNA, 18 bp, Artificial Sequence
  Synthetic DNA
taaaacaactcattatag

SEQ ID NO: 10816 - DNA, 18 bp, Artificial Sequence
  Synthetic DNA
taataacactctctatag

SEQ ID NO: 10817 - DNA, 18 bp, Artificial Sequence
  Synthetic DNA
taatacaactcaccttag

SEQ ID NO: 10818 - DNA, 18 bp, Artificial Sequence
  Synthetic DNA
taatatgactcacactag

SEQ ID NO: 10819 - DNA, 18 bp, Artificial Sequence
  Synthetic DNA
taatgcgactatctatag

SEQ ID NO: 10820 - DNA, 18 bp, Artificial Sequence
  Synthetic DNA
tagttcgactcactttag

SEQ ID NO: 10821 - DNA, 18 bp, Artificial Sequence
  Synthetic DNA
tattacgattcaccatag

SEQ ID NO: 10822 - DNA, 18 bp, Artificial Sequence
  Synthetic DNA
aaatacgactcgatatag

SEQ ID NO: 10823 - DNA, 18 bp, Artificial Sequence
  Synthetic DNA
aaatacgacttactatgg

SEQ ID NO: 10824 - DNA, 18 bp, Artificial Sequence
  Synthetic DNA
aaatccgactcattatag

SEQ ID NO: 10825 - DNA, 18 bp, Artificial Sequence
  Synthetic DNA
aactacgattcactatag

SEQ ID NO: 10826 - DNA, 18 bp, Artificial Sequence
  Synthetic DNA
aagtacggctcactatag

SEQ ID NO: 10827 - DNA, 18 bp, Artificial Sequence
  Synthetic DNA
caatacgactcaataaag

SEQ ID NO: 10828 - DNA, 18 bp, Artificial Sequence
  Synthetic DNA
gattacgaatcactatag

SEQ ID NO: 10829 - DNA, 18 bp, Artificial Sequence
  Synthetic DNA
taacaccactcattatag

SEQ ID NO: 10830 - DNA, 18 bp, Artificial Sequence
  Synthetic DNA
taacacgaataactatag

SEQ ID NO: 10831 - DNA, 18 bp, Artificial Sequence
  Synthetic DNA
taacacgactaaatatag

SEQ ID NO: 10832 - DNA, 18 bp, Artificial Sequence
  Synthetic DNA
taataagactcgctttag

SEQ ID NO: 10833 - DNA, 18 bp, Artificial Sequence
  Synthetic DNA
taataagactgaatatag

SEQ ID NO: 10834 - DNA, 18 bp, Artificial Sequence
  Synthetic DNA
taataccactcacaacag

SEQ ID NO: 10835 - DNA, 18 bp, Artificial Sequence
  Synthetic DNA
taatacctctcactatcg

SEQ ID NO: 10836 - DNA, 18 bp, Artificial Sequence
  Synthetic DNA
taatacgaatcgatatag

SEQ ID NO: 10837 - DNA, 18 bp, Artificial Sequence
  Synthetic DNA
taatacgactgaatattg

SEQ ID NO: 10838 - DNA, 18 bp, Artificial Sequence
  Synthetic DNA
taataggacacaatatag

SEQ ID NO: 10839 - DNA, 18 bp, Artificial Sequence
  Synthetic DNA
taatcagactaactatag

SEQ ID NO: 10840 - DNA, 18 bp, Artificial Sequence
  Synthetic DNA
taatccgtctccctatag

SEQ ID NO: 10841 - DNA, 18 bp, Artificial Sequence
  Synthetic DNA
taatgcgacacactatcg

SEQ ID NO: 10842 - DNA, 18 bp, Artificial Sequence
  Synthetic DNA
taattctactgactatag

SEQ ID NO: 10843 - DNA, 18 bp, Artificial Sequence
  Synthetic DNA
tactaagactcactctag

SEQ ID NO: 10844 - DNA, 18 bp, Artificial Sequence
  Synthetic DNA
tactacgactctctctag

SEQ ID NO: 10845 - DNA, 18 bp, Artificial Sequence
  Synthetic DNA
tagaacgacttactatag

SEQ ID NO: 10846 - DNA, 18 bp, Artificial Sequence
  Synthetic DNA
tagcacgactcacaatag

SEQ ID NO: 10847 - DNA, 18 bp, Artificial Sequence
  Synthetic DNA
tagtaagtctcactatag

SEQ ID NO: 10848 - DNA, 18 bp, Artificial Sequence
  Synthetic DNA
tagtacgcctctctatag

SEQ ID NO: 10849 - DNA, 18 bp, Artificial Sequence
  Synthetic DNA
tagtacggctctctatag

SEQ ID NO: 10850 - DNA, 18 bp, Artificial Sequence
  Synthetic DNA
tagtactactaactatag

SEQ ID NO: 10851 - DNA, 18 bp, Artificial Sequence
  Synthetic DNA
tatgacgactcactattg

SEQ ID NO: 10852 - DNA, 18 bp, Artificial Sequence
  Synthetic DNA
tattaccactgactatag

SEQ ID NO: 10853 - DNA, 18 bp, Artificial Sequence
  Synthetic DNA
tattacgactccctctag

SEQ ID NO: 10854 - DNA, 18 bp, Artificial Sequence
  Synthetic DNA
tcataccactcattatag

SEQ ID NO: 10855 - DNA, 18 bp, Artificial Sequence
  Synthetic DNA
tcatacgaccctctatag

SEQ ID NO: 10856 - DNA, 18 bp, Artificial Sequence
  Synthetic DNA
tcatactaatcactatag

SEQ ID NO: 10857 - DNA, 18 bp, Artificial Sequence
  Synthetic DNA
tgataggactcattatag

SEQ ID NO: 10858 - DNA, 18 bp, Artificial Sequence
  Synthetic DNA
tgcttcgactcactatag

SEQ ID NO: 10859 - DNA, 18 bp, Artificial Sequence
  Synthetic DNA
ttacccgactcactatag

SEQ ID NO: 10860 - DNA, 18 bp, Artificial Sequence
  Synthetic DNA
ttatacgactccttatag

SEQ ID NO: 10861 - DNA, 18 bp, Artificial Sequence
  Synthetic DNA
aaatacgactctttatag

SEQ ID NO: 10862 - DNA, 18 bp, Artificial Sequence
  Synthetic DNA
taatacgactatctaaag

SEQ ID NO: 10863 - DNA, 18 bp, Artificial Sequence
  Synthetic DNA
taatactactcattaaag

SEQ ID NO: 10864 - DNA, 18 bp, Artificial Sequence
  Synthetic DNA
taatacgccacactttag

SEQ ID NO: 10865 - DNA, 18 bp, Artificial Sequence
  Synthetic DNA
taatactaatcactaaag

SEQ ID NO: 10866 - DNA, 18 bp, Artificial Sequence
  Synthetic DNA
taatataactctctatag

SEQ ID NO: 10867 - DNA, 18 bp, Artificial Sequence
  Synthetic DNA
taatacgactctcaaaag

SEQ ID NO: 10868 - DNA, 18 bp, Artificial Sequence
  Synthetic DNA
taacacgaatctctatag

SEQ ID NO: 10869 - DNA, 18 bp, Artificial Sequence
  Synthetic DNA
taataccattcactacag

SEQ ID NO: 10870 - DNA, 18 bp, Artificial Sequence
  Synthetic DNA
tagtactactctctatag

SEQ ID NO: 10871 - DNA, 18 bp, Artificial Sequence
  Synthetic DNA
tgattcgactcaccatag

SEQ ID NO: 10872 - DNA, 18 bp, Artificial Sequence
  Synthetic DNA
ttatacgacacagtatag

SEQ ID NO: 10873 - DNA, 18 bp, Artificial Sequence
  Synthetic DNA
taattcgactctttatag

SEQ ID NO: 10874 - DNA, 18 bp, Artificial Sequence
  Synthetic DNA
tacttcgactcactaaag

SEQ ID NO: 10875 - DNA, 18 bp, Artificial Sequence
  Synthetic DNA
tattacgactaacaatag

SEQ ID NO: 10876 - DNA, 18 bp, Artificial Sequence
  Synthetic DNA
ttatactactcaatatag

SEQ ID NO: 10877 - DNA, 18 bp, Artificial Sequence
  Synthetic DNA
taatacgattcacttttg

SEQ ID NO: 10878 - DNA, 18 bp, Artificial Sequence
  Synthetic DNA
taaaacgactcacaaaag

SEQ ID NO: 10879 - DNA, 18 bp, Artificial Sequence
  Synthetic DNA
tattacgtatcactatag

SEQ ID NO: 10880 - DNA, 18 bp, Artificial Sequence
  Synthetic DNA
tcatactactctctatag

SEQ ID NO: 10881 - DNA, 18 bp, Artificial Sequence
  Synthetic DNA
taaaaccactcacaatag

SEQ ID NO: 10882 - DNA, 18 bp, Artificial Sequence
  Synthetic DNA
taataccactctgtatag

SEQ ID NO: 10883 - DNA, 18 bp, Artificial Sequence
  Synthetic DNA
taataccactttctatag

SEQ ID NO: 10884 - DNA, 18 bp, Artificial Sequence
  Synthetic DNA
taatacgtctcaccatgg

SEQ ID NO: 10885 - DNA, 18 bp, Artificial Sequence
  Synthetic DNA
taatactattcattatag

SEQ ID NO: 10886 - DNA, 18 bp, Artificial Sequence
  Synthetic DNA
taatccgtctcacaatag

SEQ ID NO: 10887 - DNA, 18 bp, Artificial Sequence
  Synthetic DNA
taatgcgatttactatag

SEQ ID NO: 10888 - DNA, 18 bp, Artificial Sequence
  Synthetic DNA
tagaacaactcactatag

SEQ ID NO: 10889 - DNA, 18 bp, Artificial Sequence
  Synthetic DNA
tattaccactaactatag

SEQ ID NO: 10890 - DNA, 18 bp, Artificial Sequence
  Synthetic DNA
tgatacaacacactatag

SEQ ID NO: 10891 - DNA, 18 bp, Artificial Sequence
  Synthetic DNA
tgatacgaatcactttag

SEQ ID NO: 10892 - DNA, 18 bp, Artificial Sequence
  Synthetic DNA
ttttacgactgactatag

SEQ ID NO: 10893 - DNA, 18 bp, Artificial Sequence
  Synthetic DNA
aaataagactccctatag

SEQ ID NO: 10894 - DNA, 18 bp, Artificial Sequence
  Synthetic DNA
caatacaacttactatag

SEQ ID NO: 10895 - DNA, 18 bp, Artificial Sequence
  Synthetic DNA
caatacgacacaatatag

SEQ ID NO: 10896 - DNA, 18 bp, Artificial Sequence
  Synthetic DNA
taaaaccactcactacag

SEQ ID NO: 10897 - DNA, 18 bp, Artificial Sequence
  Synthetic DNA
taacactactcactctag

SEQ ID NO: 10898 - DNA, 18 bp, Artificial Sequence
  Synthetic DNA
taataagacacaccatag

SEQ ID NO: 10899 - DNA, 18 bp, Artificial Sequence
  Synthetic DNA
taataagagtcacaatag

SEQ ID NO: 10900 - DNA, 18 bp, Artificial Sequence
  Synthetic DNA
taataccactcaccaaag

SEQ ID NO: 10901 - DNA, 18 bp, Artificial Sequence
  Synthetic DNA
taataccactccctattg

SEQ ID NO: 10902 - DNA, 18 bp, Artificial Sequence
  Synthetic DNA
taatacgacaaaatatag

SEQ ID NO: 10903 - DNA, 18 bp, Artificial Sequence
  Synthetic DNA
taatacgacatactatcg

SEQ ID NO: 10904 - DNA, 18 bp, Artificial Sequence
  Synthetic DNA
taatacgagtctctgtag

SEQ ID NO: 10905 - DNA, 18 bp, Artificial Sequence
  Synthetic DNA
taatacgattaactatgg

SEQ ID NO: 10906 - DNA, 18 bp, Artificial Sequence
  Synthetic DNA
taatacgcctccctatcg

SEQ ID NO: 10907 - DNA, 18 bp, Artificial Sequence
  Synthetic DNA
taatacgcgtcacaatag

SEQ ID NO: 10908 - DNA, 18 bp, Artificial Sequence
  Synthetic DNA
taataggtgtcactatag

SEQ ID NO: 10909 - DNA, 18 bp, Artificial Sequence
  Synthetic DNA
taatagtactcgctatag

SEQ ID NO: 10910 - DNA, 18 bp, Artificial Sequence
  Synthetic DNA
taatatgactcaccacag

SEQ ID NO: 10911 - DNA, 18 bp, Artificial Sequence
  Synthetic DNA
taatatgattcactagag

SEQ ID NO: 10912 - DNA, 18 bp, Artificial Sequence
  Synthetic DNA
taatattgctcactatag

SEQ ID NO: 10913 - DNA, 18 bp, Artificial Sequence
  Synthetic DNA
taattcgattcactatgg

SEQ ID NO: 10914 - DNA, 18 bp, Artificial Sequence
  Synthetic DNA
tactaccacttactatag

SEQ ID NO: 10915 - DNA, 18 bp, Artificial Sequence
  Synthetic DNA
tagcatgactcactatag

SEQ ID NO: 10916 - DNA, 18 bp, Artificial Sequence
  Synthetic DNA
tcatacgaatccctatag

SEQ ID NO: 10917 - DNA, 18 bp, Artificial Sequence
  Synthetic DNA
tgatacgactccccatag

SEQ ID NO: 10918 - DNA, 18 bp, Artificial Sequence
  Synthetic DNA
tgatacgtctccctatag

SEQ ID NO: 10919 - DNA, 18 bp, Artificial Sequence
  Synthetic DNA
ttataagactcaccatag

SEQ ID NO: 10920 - DNA, 18 bp, Artificial Sequence
  Synthetic DNA
ttataccactcactgtag

SEQ ID NO: 10921 - DNA, 18 bp, Artificial Sequence
  Synthetic DNA
ttatacgaaccactatag

SEQ ID NO: 10922 - DNA, 18 bp, Artificial Sequence
  Synthetic DNA
ttatacgaatcactgtag

SEQ ID NO: 10923 - DNA, 18 bp, Artificial Sequence
  Synthetic DNA
taatacatctctctatag

SEQ ID NO: 10924 - DNA, 18 bp, Artificial Sequence
  Synthetic DNA
ttatacatctcactatag

SEQ ID NO: 10925 - DNA, 18 bp, Artificial Sequence
  Synthetic DNA
taaatcgattcactatag

SEQ ID NO: 10926 - DNA, 18 bp, Artificial Sequence
  Synthetic DNA
taatacatctcacaatag

SEQ ID NO: 10927 - DNA, 18 bp, Artificial Sequence
  Synthetic DNA
taatttgattcactatag

SEQ ID NO: 10928 - DNA, 18 bp, Artificial Sequence
  Synthetic DNA
aattacaactcactatag

SEQ ID NO: 10929 - DNA, 18 bp, Artificial Sequence
  Synthetic DNA
ttattcgactaactatag

SEQ ID NO: 10930 - DNA, 18 bp, Artificial Sequence
  Synthetic DNA
taatatcactcactttag

SEQ ID NO: 10931 - DNA, 18 bp, Artificial Sequence
  Synthetic DNA
tagtacgacacactattg

SEQ ID NO: 10932 - DNA, 18 bp, Artificial Sequence
  Synthetic DNA
tattacggctctctatag

SEQ ID NO: 10933 - DNA, 18 bp, Artificial Sequence
  Synthetic DNA
taatacgtctctcaatag

SEQ ID NO: 10934 - DNA, 18 bp, Artificial Sequence
  Synthetic DNA
taatacgacactctttag

SEQ ID NO: 10935 - DNA, 18 bp, Artificial Sequence
  Synthetic DNA
tattacgactcattattg

SEQ ID NO: 10936 - DNA, 18 bp, Artificial Sequence
  Synthetic DNA
ttatacgacacaatatag

SEQ ID NO: 10937 - DNA, 18 bp, Artificial Sequence
  Synthetic DNA
tattacgtctctctatag

SEQ ID NO: 10938 - DNA, 18 bp, Artificial Sequence
  Synthetic DNA
ttatacgattcacaatag

SEQ ID NO: 10939 - DNA, 18 bp, Artificial Sequence
  Synthetic DNA
taatactactcactttgg

SEQ ID NO: 10940 - DNA, 18 bp, Artificial Sequence
  Synthetic DNA
aaattcaactcactatag

SEQ ID NO: 10941 - DNA, 18 bp, Artificial Sequence
  Synthetic DNA
tatttcgacttactatag

SEQ ID NO: 10942 - DNA, 18 bp, Artificial Sequence
  Synthetic DNA
taaaacgactctatatag

SEQ ID NO: 10943 - DNA, 18 bp, Artificial Sequence
  Synthetic DNA
taatacgtcacgctatag

SEQ ID NO: 10944 - DNA, 18 bp, Artificial Sequence
  Synthetic DNA
taatgcgactctccatag

SEQ ID NO: 10945 - DNA, 18 bp, Artificial Sequence
  Synthetic DNA
ttatacgacccactttag

SEQ ID NO: 10946 - DNA, 18 bp, Artificial Sequence
  Synthetic DNA
ttatacgactcattacag

SEQ ID NO: 10947 - DNA, 18 bp, Artificial Sequence
  Synthetic DNA
aaaaaagactcactatag

SEQ ID NO: 10948 - DNA, 18 bp, Artificial Sequence
  Synthetic DNA
aaacacgacttactatag

SEQ ID NO: 10949 - DNA, 18 bp, Artificial Sequence
  Synthetic DNA
aaatacaactgactatag

SEQ ID NO: 10950 - DNA, 18 bp, Artificial Sequence
  Synthetic DNA
aaatacgaatcactgtag

SEQ ID NO: 10951 - DNA, 18 bp, Artificial Sequence
  Synthetic DNA
aaatacgacccaccatag

SEQ ID NO: 10952 - DNA, 18 bp, Artificial Sequence
  Synthetic DNA
aaatacgactggctatag

SEQ ID NO: 10953 - DNA, 18 bp, Artificial Sequence
  Synthetic DNA
acatacgattcactatag

SEQ ID NO: 10954 - DNA, 18 bp, Artificial Sequence
  Synthetic DNA
atatacgacgcactatag

SEQ ID NO: 10955 - DNA, 18 bp, Artificial Sequence
  Synthetic DNA
caatacgacaaactatag

SEQ ID NO: 10956 - DNA, 18 bp, Artificial Sequence
  Synthetic DNA
gaatacgactcacaattg

SEQ ID NO: 10957 - DNA, 18 bp, Artificial Sequence
  Synthetic DNA
taaaacaactcactatgg

SEQ ID NO: 10958 - DNA, 18 bp, Artificial Sequence
  Synthetic DNA
taagtcaactcactatag

SEQ ID NO: 10959 - DNA, 18 bp, Artificial Sequence
  Synthetic DNA
taataagactcattacag

SEQ ID NO: 10960 - DNA, 18 bp, Artificial Sequence
  Synthetic DNA
taatacccctcacaatag

SEQ ID NO: 10961 - DNA, 18 bp, Artificial Sequence
  Synthetic DNA
taatacgacactctagag

SEQ ID NO: 10962 - DNA, 18 bp, Artificial Sequence
  Synthetic DNA
taatacgactaacaacag

SEQ ID NO: 10963 - DNA, 18 bp, Artificial Sequence
  Synthetic DNA
taatacgactcatcgtag

SEQ ID NO: 10964 - DNA, 18 bp, Artificial Sequence
  Synthetic DNA
taatacgattcagaatag

SEQ ID NO: 10965 - DNA, 18 bp, Artificial Sequence
  Synthetic DNA
taatacgcttcaatatag

SEQ ID NO: 10966 - DNA, 18 bp, Artificial Sequence
  Synthetic DNA
taatacggttcattatag

SEQ ID NO: 10967 - DNA, 18 bp, Artificial Sequence
  Synthetic DNA
taataggattcaatatag

SEQ ID NO: 10968 - DNA, 18 bp, Artificial Sequence
  Synthetic DNA
taatatgagtcactattg

SEQ ID NO: 10969 - DNA, 18 bp, Artificial Sequence
  Synthetic DNA
taatattactcactgtag

SEQ ID NO: 10970 - DNA, 18 bp, Artificial Sequence
  Synthetic DNA
taattccactcactctag

SEQ ID NO: 10971 - DNA, 18 bp, Artificial Sequence
  Synthetic DNA
taattccactccctatag

SEQ ID NO: 10972 - DNA, 18 bp, Artificial Sequence
  Synthetic DNA
taattcgagtcactattg

SEQ ID NO: 10973 - DNA, 18 bp, Artificial Sequence
  Synthetic DNA
tacaacgactcactctag

SEQ ID NO: 10974 - DNA, 18 bp, Artificial Sequence
  Synthetic DNA
tagaacgactcactatcg

SEQ ID NO: 10975 - DNA, 18 bp, Artificial Sequence
  Synthetic DNA
tagtacgaatcattatag

SEQ ID NO: 10976 - DNA, 18 bp, Artificial Sequence
  Synthetic DNA
tagtacgactcacaatcg

SEQ ID NO: 10977 - DNA, 18 bp, Artificial Sequence
  Synthetic DNA
tattacggcacactatag

SEQ ID NO: 10978 - DNA, 18 bp, Artificial Sequence
  Synthetic DNA
tcttacgactccctatag

SEQ ID NO: 10979 - DNA, 18 bp, Artificial Sequence
  Synthetic DNA
tgatacgactcattacag

SEQ ID NO: 10980 - DNA, 18 bp, Artificial Sequence
  Synthetic DNA
tgatactacttactatag

SEQ ID NO: 10981 - DNA, 18 bp, Artificial Sequence
  Synthetic DNA
tgataggactaactatag

SEQ ID NO: 10982 - DNA, 18 bp, Artificial Sequence
  Synthetic DNA
ttatacgacccaatatag

SEQ ID NO: 10983 - DNA, 18 bp, Artificial Sequence
  Synthetic DNA
taatacgtctaacaatag

SEQ ID NO: 10984 - DNA, 18 bp, Artificial Sequence
  Synthetic DNA
taaaatgactcactattg

SEQ ID NO: 10985 - DNA, 18 bp, Artificial Sequence
  Synthetic DNA
taataagactcaataaag

SEQ ID NO: 10986 - DNA, 18 bp, Artificial Sequence
  Synthetic DNA
tattacgactccctttag

SEQ ID NO: 10987 - DNA, 18 bp, Artificial Sequence
  Synthetic DNA
ttatactacacactatag

SEQ ID NO: 10988 - DNA, 18 bp, Artificial Sequence
  Synthetic DNA
aaatacgacacaatatag

SEQ ID NO: 10989 - DNA, 18 bp, Artificial Sequence
  Synthetic DNA
aaattcgacttactatag

SEQ ID NO: 10990 - DNA, 18 bp, Artificial Sequence
  Synthetic DNA
caatactactcactttag

SEQ ID NO: 10991 - DNA, 18 bp, Artificial Sequence
  Synthetic DNA
taaaacctctcactatag

SEQ ID NO: 10992 - DNA, 18 bp, Artificial Sequence
  Synthetic DNA
taataaaattcactatag

SEQ ID NO: 10993 - DNA, 18 bp, Artificial Sequence
  Synthetic DNA
taatacgactaaaaatag

SEQ ID NO: 10994 - DNA, 18 bp, Artificial Sequence
  Synthetic DNA
taatacttctcagtatag

SEQ ID NO: 10995 - DNA, 18 bp, Artificial Sequence
  Synthetic DNA
taattcgactcaatacag

SEQ ID NO: 10996 - DNA, 18 bp, Artificial Sequence
  Synthetic DNA
taataatactcactttag

SEQ ID NO: 10997 - DNA, 18 bp, Artificial Sequence
  Synthetic DNA
taatacgacaaactttag

SEQ ID NO: 10998 - DNA, 18 bp, Artificial Sequence
  Synthetic DNA
ttatacgacttacaatag

SEQ ID NO: 10999 - DNA, 18 bp, Artificial Sequence
  Synthetic DNA
taaaactacttactatag

SEQ ID NO: 11000 - DNA, 18 bp, Artificial Sequence
  Synthetic DNA
taatacgcctaactttag

SEQ ID NO: 11001 - DNA, 18 bp, Artificial Sequence
  Synthetic DNA
ttatacgactcactatta

SEQ ID NO: 11002 - DNA, 18 bp, Artificial Sequence
  Synthetic DNA
tattacgactcattaaag

SEQ ID NO: 11003 - DNA, 18 bp, Artificial Sequence
  Synthetic DNA
aaaaacggctcactatag

SEQ ID NO: 11004 - DNA, 18 bp, Artificial Sequence
  Synthetic DNA
aaatacgactcagtattg

SEQ ID NO: 11005 - DNA, 18 bp, Artificial Sequence
  Synthetic DNA
taatacgtctcaacatag

SEQ ID NO: 11006 - DNA, 18 bp, Artificial Sequence
  Synthetic DNA
taatactacacactctag

SEQ ID NO: 11007 - DNA, 18 bp, Artificial Sequence
  Synthetic DNA
taatacttcccactatag

SEQ ID NO: 11008 - DNA, 18 bp, Artificial Sequence
  Synthetic DNA
taattcctctcactatag

SEQ ID NO: 11009 - DNA, 18 bp, Artificial Sequence
  Synthetic DNA
tattacgacccattatag

SEQ ID NO: 11010 - DNA, 18 bp, Artificial Sequence
  Synthetic DNA
tattacgactaaatatag

SEQ ID NO: 11011 - DNA, 18 bp, Artificial Sequence
  Synthetic DNA
ttatatgactaactatag

SEQ ID NO: 11012 - DNA, 18 bp, Artificial Sequence
  Synthetic DNA
aaatacgatccactatag

SEQ ID NO: 11013 - DNA, 18 bp, Artificial Sequence
  Synthetic DNA
caataggtctcactatag

SEQ ID NO: 11014 - DNA, 18 bp, Artificial Sequence
  Synthetic DNA
taaaacgagtcactattg

SEQ ID NO: 11015 - DNA, 18 bp, Artificial Sequence
  Synthetic DNA
taacactactcactacag

SEQ ID NO: 11016 - DNA, 18 bp, Artificial Sequence
  Synthetic DNA
taataacactaactatag

SEQ ID NO: 11017 - DNA, 18 bp, Artificial Sequence
  Synthetic DNA
taataagactaactgtag

SEQ ID NO: 11018 - DNA, 18 bp, Artificial Sequence
  Synthetic DNA
taatacaaatcagtatag

SEQ ID NO: 11019 - DNA, 18 bp, Artificial Sequence
  Synthetic DNA
taatacgacgcacaaaag

SEQ ID NO: 11020 - DNA, 18 bp, Artificial Sequence
  Synthetic DNA
taatacgacttaccatcg

SEQ ID NO: 11021 - DNA, 18 bp, Artificial Sequence
  Synthetic DNA
taatacgacttcctaaag

SEQ ID NO: 11022 - DNA, 18 bp, Artificial Sequence
  Synthetic DNA
taatacgagttacaatag

SEQ ID NO: 11023 - DNA, 18 bp, Artificial Sequence
  Synthetic DNA
taatacggctctctacag

SEQ ID NO: 11024 - DNA, 18 bp, Artificial Sequence
  Synthetic DNA
taatacgtctgattatag

SEQ ID NO: 11025 - DNA, 18 bp, Artificial Sequence
  Synthetic DNA
taatactactcaatagag

SEQ ID NO: 11026 - DNA, 18 bp, Artificial Sequence
  Synthetic DNA
taataggaatcattatag

SEQ ID NO: 11027 - DNA, 18 bp, Artificial Sequence
  Synthetic DNA
taatatgacttactatgg

SEQ ID NO: 11028 - DNA, 18 bp, Artificial Sequence
  Synthetic DNA
taatatgagtcattatag

SEQ ID NO: 11029 - DNA, 18 bp, Artificial Sequence
  Synthetic DNA
taatatggctcacaatag

SEQ ID NO: 11030 - DNA, 18 bp, Artificial Sequence
  Synthetic DNA
taatatggttcactatag

SEQ ID NO: 11031 - DNA, 18 bp, Artificial Sequence
  Synthetic DNA
taatccgacacactctag

SEQ ID NO: 11032 - DNA, 18 bp, Artificial Sequence
  Synthetic DNA
taatcctactctctatag

SEQ ID NO: 11033 - DNA, 18 bp, Artificial Sequence
  Synthetic DNA
taatctgactcaccatag

SEQ ID NO: 11034 - DNA, 18 bp, Artificial Sequence
  Synthetic DNA
taatgcgactcactatta

SEQ ID NO: 11035 - DNA, 18 bp, Artificial Sequence
  Synthetic DNA
taattccactcactgtag

SEQ ID NO: 11036 - DNA, 18 bp, Artificial Sequence
  Synthetic DNA
taattggaatcactatag

SEQ ID NO: 11037 - DNA, 18 bp, Artificial Sequence
  Synthetic DNA
tactaatactcactatag

SEQ ID NO: 11038 - DNA, 18 bp, Artificial Sequence
  Synthetic DNA
tactaccactcacaatag

SEQ ID NO: 11039 - DNA, 18 bp, Artificial Sequence
  Synthetic DNA
tactactacgcactatag

SEQ ID NO: 11040 - DNA, 18 bp, Artificial Sequence
  Synthetic DNA
tagtacgtctcactgtag

SEQ ID NO: 11041 - DNA, 18 bp, Artificial Sequence
  Synthetic DNA
tcaaacgactcaccatag

SEQ ID NO: 11042 - DNA, 18 bp, Artificial Sequence
  Synthetic DNA
tcatacgtgtcactatag

SEQ ID NO: 11043 - DNA, 18 bp, Artificial Sequence
  Synthetic DNA
tgatacgacacactatcg

SEQ ID NO: 11044 - DNA, 18 bp, Artificial Sequence
  Synthetic DNA
ttacatgactcactatag

SEQ ID NO: 11045 - DNA, 18 bp, Artificial Sequence
  Synthetic DNA
ttatacccctcactatag

SEQ ID NO: 11046 - DNA, 18 bp, Artificial Sequence
  Synthetic DNA
ttctacgactcactatgg

SEQ ID NO: 11047 - DNA, 18 bp, Artificial Sequence
  Synthetic DNA
tataacgactcattatag

SEQ ID NO: 11048 - DNA, 18 bp, Artificial Sequence
  Synthetic DNA
aaatacgactaacaatag

SEQ ID NO: 11049 - DNA, 18 bp, Artificial Sequence
  Synthetic DNA
caaaaccactcactatag

SEQ ID NO: 11050 - DNA, 18 bp, Artificial Sequence
  Synthetic DNA
taacacgaatcactttag

SEQ ID NO: 11051 - DNA, 18 bp, Artificial Sequence
  Synthetic DNA
taacacttctcactatag

SEQ ID NO: 11052 - DNA, 18 bp, Artificial Sequence
  Synthetic DNA
taatacgaataactattg

SEQ ID NO: 11053 - DNA, 18 bp, Artificial Sequence
  Synthetic DNA
tattacgacagactatag

SEQ ID NO: 11054 - DNA, 18 bp, Artificial Sequence
  Synthetic DNA
tattacgagtctctatag

SEQ ID NO: 11055 - DNA, 18 bp, Artificial Sequence
  Synthetic DNA
tcacacgactcacaatag

SEQ ID NO: 11056 - DNA, 18 bp, Artificial Sequence
  Synthetic DNA
tcatacgtttcactatag

SEQ ID NO: 11057 - DNA, 18 bp, Artificial Sequence
  Synthetic DNA
tgattcgacttactatag

SEQ ID NO: 11058 - DNA, 18 bp, Artificial Sequence
  Synthetic DNA
taatacgtatcacaatag

SEQ ID NO: 11059 - DNA, 18 bp, Artificial Sequence
  Synthetic DNA
ttaaacgacacactatag

SEQ ID NO: 11060 - DNA, 18 bp, Artificial Sequence
  Synthetic DNA
taattagattcactatag

SEQ ID NO: 11061 - DNA, 18 bp, Artificial Sequence
  Synthetic DNA
taaaaccacacactatag

SEQ ID NO: 11062 - DNA, 18 bp, Artificial Sequence
  Synthetic DNA
taacacgtcacactatag

SEQ ID NO: 11063 - DNA, 18 bp, Artificial Sequence
  Synthetic DNA
taatacaacttactaaag

SEQ ID NO: 11064 - DNA, 18 bp, Artificial Sequence
  Synthetic DNA
tacttcgactcattatag

SEQ ID NO: 11065 - DNA, 18 bp, Artificial Sequence
  Synthetic DNA
tattaccactctctatag

SEQ ID NO: 11066 - DNA, 18 bp, Artificial Sequence
  Synthetic DNA
tgatacgtcacactatag

SEQ ID NO: 11067 - DNA, 18 bp, Artificial Sequence
  Synthetic DNA
aaaaacgacgcactatag

SEQ ID NO: 11068 - DNA, 18 bp, Artificial Sequence
  Synthetic DNA
aaatacgactcattctag

SEQ ID NO: 11069 - DNA, 18 bp, Artificial Sequence
  Synthetic DNA
caatacgattaactatag

SEQ ID NO: 11070 - DNA, 18 bp, Artificial Sequence
  Synthetic DNA
gaaaacgactcactttag

SEQ ID NO: 11071 - DNA, 18 bp, Artificial Sequence
  Synthetic DNA
taacacgactctccatag

SEQ ID NO: 11072 - DNA, 18 bp, Artificial Sequence
  Synthetic DNA
taacactattcactatag

SEQ ID NO: 11073 - DNA, 18 bp, Artificial Sequence
  Synthetic DNA
taagacgtctaactatag

SEQ ID NO: 11074 - DNA, 18 bp, Artificial Sequence
  Synthetic DNA
taataagacttaccatag

SEQ ID NO: 11075 - DNA, 18 bp, Artificial Sequence
  Synthetic DNA
taataagatccactatag

SEQ ID NO: 11076 - DNA, 18 bp, Artificial Sequence
  Synthetic DNA
taataagattcaccatag

SEQ ID NO: 11077 - DNA, 18 bp, Artificial Sequence
  Synthetic DNA
taatacaactcacgaaag

SEQ ID NO: 11078 - DNA, 18 bp, Artificial Sequence
  Synthetic DNA
taatacgacgcattattg

SEQ ID NO: 11079 - DNA, 18 bp, Artificial Sequence
  Synthetic DNA
taatacgacttactctcg

SEQ ID NO: 11080 - DNA, 18 bp, Artificial Sequence
  Synthetic DNA
taatacgcctcacaattg

SEQ ID NO: 11081 - DNA, 18 bp, Artificial Sequence
  Synthetic DNA
taatactaatcactacag

SEQ ID NO: 11082 - DNA, 18 bp, Artificial Sequence
  Synthetic DNA
taatactactccttatag

SEQ ID NO: 11083 - DNA, 18 bp, Artificial Sequence
  Synthetic DNA
taatactagtcacaatag

SEQ ID NO: 11084 - DNA, 18 bp, Artificial Sequence
  Synthetic DNA
taatagaacacactatag

SEQ ID NO: 11085 - DNA, 18 bp, Artificial Sequence
  Synthetic DNA
taataggactccctaaag

SEQ ID NO: 11086 - DNA, 18 bp, Artificial Sequence
  Synthetic DNA
taatctgactcactttag

SEQ ID NO: 11087 - DNA, 18 bp, Artificial Sequence
  Synthetic DNA
taatgcgacccactattg

SEQ ID NO: 11088 - DNA, 18 bp, Artificial Sequence
  Synthetic DNA
taatgcgactcattctag

SEQ ID NO: 11089 - DNA, 18 bp, Artificial Sequence
  Synthetic DNA
taattcgagtcaccatag

SEQ ID NO: 11090 - DNA, 18 bp, Artificial Sequence
  Synthetic DNA
tactacctctcactatag

SEQ ID NO: 11091 - DNA, 18 bp, Artificial Sequence
  Synthetic DNA
tactacgactctctgtag

SEQ ID NO: 11092 - DNA, 18 bp, Artificial Sequence
  Synthetic DNA
tactacgtctcattatag

SEQ ID NO: 11093 - DNA, 18 bp, Artificial Sequence
  Synthetic DNA
tactgcgactaactatag

SEQ ID NO: 11094 - DNA, 18 bp, Artificial Sequence
  Synthetic DNA
tcaaacgactccctatag

SEQ ID NO: 11095 - DNA, 18 bp, Artificial Sequence
  Synthetic DNA
tgatacgaataactatag

SEQ ID NO: 11096 - DNA, 18 bp, Artificial Sequence
  Synthetic DNA
tgatactacacactatag

SEQ ID NO: 11097 - DNA, 18 bp, Artificial Sequence
  Synthetic DNA
tgttacggctcactatag

SEQ ID NO: 11098 - DNA, 18 bp, Artificial Sequence
  Synthetic DNA
ttatacgactcatgatag

SEQ ID NO: 11099 - DNA, 18 bp, Artificial Sequence
  Synthetic DNA
ttatacgagccactatag

SEQ ID NO: 11100 - DNA, 18 bp, Artificial Sequence
  Synthetic DNA
ttatacgagtcagtatag

SEQ ID NO: 11101 - DNA, 18 bp, Artificial Sequence
  Synthetic DNA
ttatacggttcactatag

SEQ ID NO: 11102 - DNA, 18 bp, Artificial Sequence
  Synthetic DNA
taatactactctctaaag

SEQ ID NO: 11103 - DNA, 18 bp, Artificial Sequence
  Synthetic DNA
taatttgactcacaatag

SEQ ID NO: 11104 - DNA, 18 bp, Artificial Sequence
  Synthetic DNA
aaatacgtgtcactatag

SEQ ID NO: 11105 - DNA, 18 bp, Artificial Sequence
  Synthetic DNA
taaaatgaatcactatag

SEQ ID NO: 11106 - DNA, 18 bp, Artificial Sequence
  Synthetic DNA
taatacgaatcactgttg

SEQ ID NO: 11107 - DNA, 18 bp, Artificial Sequence
  Synthetic DNA
taatacgacaaacaatag

SEQ ID NO: 11108 - DNA, 18 bp, Artificial Sequence
  Synthetic DNA
taatacgagtcaataaag

SEQ ID NO: 11109 - DNA, 18 bp, Artificial Sequence
  Synthetic DNA
taatatgactatctatag

SEQ ID NO: 11110 - DNA, 18 bp, Artificial Sequence
  Synthetic DNA
tattacgcctaactatag

SEQ ID NO: 11111 - DNA, 18 bp, Artificial Sequence
  Synthetic DNA
taacacgactcacttaag

SEQ ID NO: 11112 - DNA, 18 bp, Artificial Sequence
  Synthetic DNA
taatacgtctcacaattg

SEQ ID NO: 11113 - DNA, 18 bp, Artificial Sequence
  Synthetic DNA
taatacgacaatctatag

SEQ ID NO: 11114 - DNA, 18 bp, Artificial Sequence
  Synthetic DNA
taatacgattcaatttag

SEQ ID NO: 11115 - DNA, 18 bp, Artificial Sequence
  Synthetic DNA
taattcgacacactttag

SEQ ID NO: 11116 - DNA, 18 bp, Artificial Sequence
  Synthetic DNA
taatactactcattttag

SEQ ID NO: 11117 - DNA, 18 bp, Artificial Sequence
  Synthetic DNA
ttatacgactaactttag

SEQ ID NO: 11118 - DNA, 18 bp, Artificial Sequence
  Synthetic DNA
ttatatgactcacaatag

SEQ ID NO: 11119 - DNA, 18 bp, Artificial Sequence
  Synthetic DNA
aaatacgattcattatag

SEQ ID NO: 11120 - DNA, 18 bp, Artificial Sequence
  Synthetic DNA
taatacaactcaaaatag

SEQ ID NO: 11121 - DNA, 18 bp, Artificial Sequence
  Synthetic DNA
taattagacttactatag

SEQ ID NO: 11122 - DNA, 18 bp, Artificial Sequence
  Synthetic DNA
caatacgacactctatag

SEQ ID NO: 11123 - DNA, 18 bp, Artificial Sequence
  Synthetic DNA
taacacgactcaataaag

SEQ ID NO: 11124 - DNA, 18 bp, Artificial Sequence
  Synthetic DNA
taacatgactcacaatag

SEQ ID NO: 11125 - DNA, 18 bp, Artificial Sequence
  Synthetic DNA
taatactactcacaacag

SEQ ID NO: 11126 - DNA, 18 bp, Artificial Sequence
  Synthetic DNA
ttataccacttactatag

SEQ ID NO: 11127 - DNA, 18 bp, Artificial Sequence
  Synthetic DNA
aaataccactcactatcg

SEQ ID NO: 11128 - DNA, 18 bp, Artificial Sequence
  Synthetic DNA
gaatacgactcacaaaag

SEQ ID NO: 11129 - DNA, 18 bp, Artificial Sequence
  Synthetic DNA
taaaacgactcattgtag

SEQ ID NO: 11130 - DNA, 18 bp, Artificial Sequence
  Synthetic DNA
taaaacgacttactatgg

SEQ ID NO: 11131 - DNA, 18 bp, Artificial Sequence
  Synthetic DNA
taaaacgattcgctatag

SEQ ID NO: 11132 - DNA, 18 bp, Artificial Sequence
  Synthetic DNA
taacaggtctcactatag

SEQ ID NO: 11133 - DNA, 18 bp, Artificial Sequence
  Synthetic DNA
taataagacttactatgg

SEQ ID NO: 11134 - DNA, 18 bp, Artificial Sequence
  Synthetic DNA
taataccactcacaatcg

SEQ ID NO: 11135 - DNA, 18 bp, Artificial Sequence
  Synthetic DNA
taatacctctcaccatag

SEQ ID NO: 11136 - DNA, 18 bp, Artificial Sequence
  Synthetic DNA
taatacgaaacactatcg

SEQ ID NO: 11137 - DNA, 18 bp, Artificial Sequence
  Synthetic DNA
taatacgaataaccatag

SEQ ID NO: 11138 - DNA, 18 bp, Artificial Sequence
  Synthetic DNA
taatacgaattgctatag

SEQ ID NO: 11139 - DNA, 18 bp, Artificial Sequence
  Synthetic DNA
taatacgactcaatgtcg

SEQ ID NO: 11140 - DNA, 18 bp, Artificial Sequence
  Synthetic DNA
taatacgacttaccttag

SEQ ID NO: 11141 - DNA, 18 bp, Artificial Sequence
  Synthetic DNA
taatacgactttctacag

SEQ ID NO: 11142 - DNA, 18 bp, Artificial Sequence
  Synthetic DNA
taatacgactttctagag

SEQ ID NO: 11143 - DNA, 18 bp, Artificial Sequence
  Synthetic DNA
taatacgcttaactatag

SEQ ID NO: 11144 - DNA, 18 bp, Artificial Sequence
  Synthetic DNA
taatacggctaactaaag

SEQ ID NO: 11145 - DNA, 18 bp, Artificial Sequence
  Synthetic DNA
taatacgtctcggtatag

SEQ ID NO: 11146 - DNA, 18 bp, Artificial Sequence
  Synthetic DNA
taatactactagctatag

SEQ ID NO: 11147 - DNA, 18 bp, Artificial Sequence
  Synthetic DNA
taataggactcataatag

SEQ ID NO: 11148 - DNA, 18 bp, Artificial Sequence
  Synthetic DNA
taatatgactcattctag

SEQ ID NO: 11149 - DNA, 18 bp, Artificial Sequence
  Synthetic DNA
taatattactcgctatag

SEQ ID NO: 11150 - DNA, 18 bp, Artificial Sequence
  Synthetic DNA
taatggaactcactatag

SEQ ID NO: 11151 - DNA, 18 bp, Artificial Sequence
  Synthetic DNA
taattcgattcagtatag

SEQ ID NO: 11152 - DNA, 18 bp, Artificial Sequence
  Synthetic DNA
taattggactcaatatag

SEQ ID NO: 11153 - DNA, 18 bp, Artificial Sequence
  Synthetic DNA
tactacaactcattatag

SEQ ID NO: 11154 - DNA, 18 bp, Artificial Sequence
  Synthetic DNA
tagtacgactcacaacag

SEQ ID NO: 11155 - DNA, 18 bp, Artificial Sequence
  Synthetic DNA
tagtatgactcactttag

SEQ ID NO: 11156 - DNA, 18 bp, Artificial Sequence
  Synthetic DNA
tattacgcctcgctatag

SEQ ID NO: 11157 - DNA, 18 bp, Artificial Sequence
  Synthetic DNA
tattaggagtcactatag

SEQ ID NO: 11158 - DNA, 18 bp, Artificial Sequence
  Synthetic DNA
tcatagtactcactatag

SEQ ID NO: 11159 - DNA, 18 bp, Artificial Sequence
  Synthetic DNA
tcatataactcactatag

SEQ ID NO: 11160 - DNA, 18 bp, Artificial Sequence
  Synthetic DNA
ttacacgactcactatcg

SEQ ID NO: 11161 - DNA, 18 bp, Artificial Sequence
  Synthetic DNA
ttatacgattcaatatag

SEQ ID NO: 11162 - DNA, 18 bp, Artificial Sequence
  Synthetic DNA
taatataacacactatag

SEQ ID NO: 11163 - DNA, 18 bp, Artificial Sequence
  Synthetic DNA
taatattattcactatag

SEQ ID NO: 11164 - DNA, 18 bp, Artificial Sequence
  Synthetic DNA
taaatcgactctctatag

SEQ ID NO: 11165 - DNA, 18 bp, Artificial Sequence
  Synthetic DNA
aaataagacttactatag

SEQ ID NO: 11166 - DNA, 18 bp, Artificial Sequence
  Synthetic DNA
taaaacgattccctatag

SEQ ID NO: 11167 - DNA, 18 bp, Artificial Sequence
  Synthetic DNA
taatacgactcccaaaag

SEQ ID NO: 11168 - DNA, 18 bp, Artificial Sequence
  Synthetic DNA
taatacgtcccattatag

SEQ ID NO: 11169 - DNA, 18 bp, Artificial Sequence
  Synthetic DNA
taatatgactcaatttag

SEQ ID NO: 11170 - DNA, 18 bp, Artificial Sequence
  Synthetic DNA
taattcgactcatcatag

SEQ ID NO: 11171 - DNA, 18 bp, Artificial Sequence
  Synthetic DNA
ttataagactaactatag

SEQ ID NO: 11172 - DNA, 18 bp, Artificial Sequence
  Synthetic DNA
ttatacgactcaatacag

SEQ ID NO: 11173 - DNA, 18 bp, Artificial Sequence
  Synthetic DNA
ttatactactcagtatag

SEQ ID NO: 11174 - DNA, 18 bp, Artificial Sequence
  Synthetic DNA
taattcgactcaataaag

SEQ ID NO: 11175 - DNA, 18 bp, Artificial Sequence
  Synthetic DNA
tatttcgaatcactatag

SEQ ID NO: 11176 - DNA, 18 bp, Artificial Sequence
  Synthetic DNA
taaaactactaactatag

SEQ ID NO: 11177 - DNA, 18 bp, Artificial Sequence
  Synthetic DNA
taatccgactcacattag

SEQ ID NO: 11178 - DNA, 18 bp, Artificial Sequence
  Synthetic DNA
ttatacgacacactctag

SEQ ID NO: 11179 - DNA, 18 bp, Artificial Sequence
  Synthetic DNA
ttatacgtctcagtatag

SEQ ID NO: 11180 - DNA, 18 bp, Artificial Sequence
  Synthetic DNA
aaatacgactcactaatg

SEQ ID NO: 11181 - DNA, 18 bp, Artificial Sequence
  Synthetic DNA
tattaagaatcactatag

SEQ ID NO: 11182 - DNA, 18 bp, Artificial Sequence
  Synthetic DNA
aaatacgaccctctatag

SEQ ID NO: 11183 - DNA, 18 bp, Artificial Sequence
  Synthetic DNA
taataccacttactattg

SEQ ID NO: 11184 - DNA, 18 bp, Artificial Sequence
  Synthetic DNA
taatacgaccttctatag

SEQ ID NO: 11185 - DNA, 18 bp, Artificial Sequence
  Synthetic DNA
taatacgattcaccttag

SEQ ID NO: 11186 - DNA, 18 bp, Artificial Sequence
  Synthetic DNA
taatatgaattactatag

SEQ ID NO: 11187 - DNA, 18 bp, Artificial Sequence
  Synthetic DNA
tattacgactaaccatag

SEQ ID NO: 11188 - DNA, 18 bp, Artificial Sequence
  Synthetic DNA
tattactactcactatgg

SEQ ID NO: 11189 - DNA, 18 bp, Artificial Sequence
  Synthetic DNA
aaatacgactaactgtag

SEQ ID NO: 11190 - DNA, 18 bp, Artificial Sequence
  Synthetic DNA
aaatacgactacctatag

SEQ ID NO: 11191 - DNA, 18 bp, Artificial Sequence
  Synthetic DNA
aaatacgactcaatatgg

SEQ ID NO: 11192 - DNA, 18 bp, Artificial Sequence
  Synthetic DNA
aaatgcgactgactatag

SEQ ID NO: 11193 - DNA, 18 bp, Artificial Sequence
  Synthetic DNA
agatacgactcaatatag

SEQ ID NO: 11194 - DNA, 18 bp, Artificial Sequence
  Synthetic DNA
agatacgactcactttag

SEQ ID NO: 11195 - DNA, 18 bp, Artificial Sequence
  Synthetic DNA
caatacaagtcactatag

SEQ ID NO: 11196 - DNA, 18 bp, Artificial Sequence
  Synthetic DNA
caatatgactcactatcg

SEQ ID NO: 11197 - DNA, 18 bp, Artificial Sequence
  Synthetic DNA
caatatgtctcactatag

SEQ ID NO: 11198 - DNA, 18 bp, Artificial Sequence
  Synthetic DNA
caattcgattcactatag

SEQ ID NO: 11199 - DNA, 18 bp, Artificial Sequence
  Synthetic DNA
taacaagactcattatag

SEQ ID NO: 11200 - DNA, 18 bp, Artificial Sequence
  Synthetic DNA
taataacactcactgtag

SEQ ID NO: 11201 - DNA, 18 bp, Artificial Sequence
  Synthetic DNA
taataagactcaatatgg

SEQ ID NO: 11202 - DNA, 18 bp, Artificial Sequence
  Synthetic DNA
taataagactcaatgtag

SEQ ID NO: 11203 - DNA, 18 bp, Artificial Sequence
  Synthetic DNA
taatacgacgctctaaag

SEQ ID NO: 11204 - DNA, 18 bp, Artificial Sequence
  Synthetic DNA
taatacgactaagtaaag

SEQ ID NO: 11205 - DNA, 18 bp, Artificial Sequence
  Synthetic DNA
taatacgactcataagag

SEQ ID NO: 11206 - DNA, 18 bp, Artificial Sequence
  Synthetic DNA
taatacgactgtctacag

SEQ ID NO: 11207 - DNA, 18 bp, Artificial Sequence
  Synthetic DNA
taataggacacactatcg

SEQ ID NO: 11208 - DNA, 18 bp, Artificial Sequence
  Synthetic DNA
taatatgcttcactatag

SEQ ID NO: 11209 - DNA, 18 bp, Artificial Sequence
  Synthetic DNA
taatattactccctatag

SEQ ID NO: 11210 - DNA, 18 bp, Artificial Sequence
  Synthetic DNA
taatgcgactaacaatag

SEQ ID NO: 11211 - DNA, 18 bp, Artificial Sequence
  Synthetic DNA
taccactactcactatag

SEQ ID NO: 11212 - DNA, 18 bp, Artificial Sequence
  Synthetic DNA
tactatgacacactatag

SEQ ID NO: 11213 - DNA, 18 bp, Artificial Sequence
  Synthetic DNA
tactccaactcactatag

SEQ ID NO: 11214 - DNA, 18 bp, Artificial Sequence
  Synthetic DNA
tagaacgactcactacag

SEQ ID NO: 11215 - DNA, 18 bp, Artificial Sequence
  Synthetic DNA
tagtacgactcaaaatag

SEQ ID NO: 11216 - DNA, 18 bp, Artificial Sequence
  Synthetic DNA
tagtacgactccctattg

SEQ ID NO: 11217 - DNA, 18 bp, Artificial Sequence
  Synthetic DNA
tagtatgactcactacag

SEQ ID NO: 11218 - DNA, 18 bp, Artificial Sequence
  Synthetic DNA
tagtccgactctctatag

SEQ ID NO: 11219 - DNA, 18 bp, Artificial Sequence
  Synthetic DNA
tattaccactcactacag

SEQ ID NO: 11220 - DNA, 18 bp, Artificial Sequence
  Synthetic DNA
tcatacaactaactatag

SEQ ID NO: 11221 - DNA, 18 bp, Artificial Sequence
  Synthetic DNA
tcatacgactaattatag

SEQ ID NO: 11222 - DNA, 18 bp, Artificial Sequence
  Synthetic DNA
tcatacgattcactatgg

SEQ ID NO: 11223 - DNA, 18 bp, Artificial Sequence
  Synthetic DNA
tcctaagactcactatag

SEQ ID NO: 11224 - DNA, 18 bp, Artificial Sequence
  Synthetic DNA
tcttaagactcactatag

SEQ ID NO: 11225 - DNA, 18 bp, Artificial Sequence
  Synthetic DNA
tgctaagactcactatag

SEQ ID NO: 11226 - DNA, 18 bp, Artificial Sequence
  Synthetic DNA
ttacacgactcaccatag

SEQ ID NO: 11227 - DNA, 18 bp, Artificial Sequence
  Synthetic DNA
taatactaatcacaatag

SEQ ID NO: 11228 - DNA, 18 bp, Artificial Sequence
  Synthetic DNA
taattcaattcactatag

SEQ ID NO: 11229 - DNA, 18 bp, Artificial Sequence
  Synthetic DNA
tattacgacttactttag

SEQ ID NO: 11230 - DNA, 18 bp, Artificial Sequence
  Synthetic DNA
aaataagattcactatag

SEQ ID NO: 11231 - DNA, 18 bp, Artificial Sequence
  Synthetic DNA
acatactactcactatag

SEQ ID NO: 11232 - DNA, 18 bp, Artificial Sequence
  Synthetic DNA
taacacgattcactttag

SEQ ID NO: 11233 - DNA, 18 bp, Artificial Sequence
  Synthetic DNA
taataatattcactatag

SEQ ID NO: 11234 - DNA, 18 bp, Artificial Sequence
  Synthetic DNA
taatacgattcagtttag

SEQ ID NO: 11235 - DNA, 18 bp, Artificial Sequence
  Synthetic DNA
taatacgtcacactctag

SEQ ID NO: 11236 - DNA, 18 bp, Artificial Sequence
  Synthetic DNA
aaattcgactctctatag

SEQ ID NO: 11237 - DNA, 18 bp, Artificial Sequence
  Synthetic DNA
aaatacgtctcaatatag

SEQ ID NO: 11238 - DNA, 18 bp, Artificial Sequence
  Synthetic DNA
aaattcgactcaatatag

SEQ ID NO: 11239 - DNA, 18 bp, Artificial Sequence
  Synthetic DNA
taatacaactcaatttag

SEQ ID NO: 11240 - DNA, 18 bp, Artificial Sequence
  Synthetic DNA
taatacaatttactatag

SEQ ID NO: 11241 - DNA, 18 bp, Artificial Sequence
  Synthetic DNA
taatacgatttactaaag

SEQ ID NO: 11242 - DNA, 18 bp, Artificial Sequence
  Synthetic DNA
taatacttttcactatag

SEQ ID NO: 11243 - DNA, 18 bp, Artificial Sequence
  Synthetic DNA
taataagacttactttag

SEQ ID NO: 11244 - DNA, 18 bp, Artificial Sequence
  Synthetic DNA
taatacgacttacttcag

SEQ ID NO: 11245 - DNA, 18 bp, Artificial Sequence
  Synthetic DNA
ttatacgaattactatag

SEQ ID NO: 11246 - DNA, 18 bp, Artificial Sequence
  Synthetic DNA
tattacgactcacaaaag

SEQ ID NO: 11247 - DNA, 18 bp, Artificial Sequence
  Synthetic DNA
ctatacgactcactattg

SEQ ID NO: 11248 - DNA, 18 bp, Artificial Sequence
  Synthetic DNA
taataagtctcacaatag

SEQ ID NO: 11249 - DNA, 18 bp, Artificial Sequence
  Synthetic DNA
taatacgacttataatag

SEQ ID NO: 11250 - DNA, 18 bp, Artificial Sequence
  Synthetic DNA
taatacttctcactgtag

SEQ ID NO: 11251 - DNA, 18 bp, Artificial Sequence
  Synthetic DNA
taattcgaatcactaaag

SEQ ID NO: 11252 - DNA, 18 bp, Artificial Sequence
  Synthetic DNA
tcattctactcactatag

SEQ ID NO: 11253 - DNA, 18 bp, Artificial Sequence
  Synthetic DNA
aaataccattcactatag

SEQ ID NO: 11254 - DNA, 18 bp, Artificial Sequence
  Synthetic DNA
aaatgcgattcactatag

SEQ ID NO: 11255 - DNA, 18 bp, Artificial Sequence
  Synthetic DNA
aactatgactcactatag

SEQ ID NO: 11256 - DNA, 18 bp, Artificial Sequence
  Synthetic DNA
caatacgactccctattg

SEQ ID NO: 11257 - DNA, 18 bp, Artificial Sequence
  Synthetic DNA
caatacgattcaccatag

SEQ ID NO: 11258 - DNA, 18 bp, Artificial Sequence
  Synthetic DNA
taactcgaatcactatag

SEQ ID NO: 11259 - DNA, 18 bp, Artificial Sequence
  Synthetic DNA
taataagactctctatgg

SEQ ID NO: 11260 - DNA, 18 bp, Artificial Sequence
  Synthetic DNA
taatacaactaaatatag

SEQ ID NO: 11261 - DNA, 18 bp, Artificial Sequence
  Synthetic DNA
taataccattcacgatag

SEQ ID NO: 11262 - DNA, 18 bp, Artificial Sequence
  Synthetic DNA
taatacgactagctttag

SEQ ID NO: 11263 - DNA, 18 bp, Artificial Sequence
  Synthetic DNA
taatacgactcatttgag

SEQ ID NO: 11264 - DNA, 18 bp, Artificial Sequence
  Synthetic DNA
taatacgatccattatag

SEQ ID NO: 11265 - DNA, 18 bp, Artificial Sequence
  Synthetic DNA
taatacgcctctccatag

SEQ ID NO: 11266 - DNA, 18 bp, Artificial Sequence
  Synthetic DNA
taatacgtccaactatag

SEQ ID NO: 11267 - DNA, 18 bp, Artificial Sequence
  Synthetic DNA
taatacgtgtccctatag

SEQ ID NO: 11268 - DNA, 18 bp, Artificial Sequence
  Synthetic DNA
taatactacacactatgg

SEQ ID NO: 11269 - DNA, 18 bp, Artificial Sequence
  Synthetic DNA
taatagtactcactaaag

SEQ ID NO: 11270 - DNA, 18 bp, Artificial Sequence
  Synthetic DNA
taatataactcaccatag

SEQ ID NO: 11271 - DNA, 18 bp, Artificial Sequence
  Synthetic DNA
taatatgacttagtatag

SEQ ID NO: 11272 - DNA, 18 bp, Artificial Sequence
  Synthetic DNA
taattcgattcactagag

SEQ ID NO: 11273 - DNA, 18 bp, Artificial Sequence
  Synthetic DNA
taattctcctcactatag

SEQ ID NO: 11274 - DNA, 18 bp, Artificial Sequence
  Synthetic DNA
tactacgactcgctttag

SEQ ID NO: 11275 - DNA, 18 bp, Artificial Sequence
  Synthetic DNA
tgatacgactcaaaatag

SEQ ID NO: 11276 - DNA, 18 bp, Artificial Sequence
  Synthetic DNA
taatacaacttactattg

SEQ ID NO: 11277 - DNA, 18 bp, Artificial Sequence
  Synthetic DNA
tattatgactcactattg

SEQ ID NO: 11278 - DNA, 18 bp, Artificial Sequence
  Synthetic DNA
aaacacgactcactaaag

SEQ ID NO: 11279 - DNA, 18 bp, Artificial Sequence
  Synthetic DNA
aaacactactcactatag

SEQ ID NO: 11280 - DNA, 18 bp, Artificial Sequence
  Synthetic DNA
taataagtcccactatag

SEQ ID NO: 11281 - DNA, 18 bp, Artificial Sequence
  Synthetic DNA
taatacaattcactaaag

SEQ ID NO: 11282 - DNA, 18 bp, Artificial Sequence
  Synthetic DNA
taatacctctcactaaag

SEQ ID NO: 11283 - DNA, 18 bp, Artificial Sequence
  Synthetic DNA
taatacgagtcacaattg

SEQ ID NO: 11284 - DNA, 18 bp, Artificial Sequence
  Synthetic DNA
taatacgagtcacttaag

SEQ ID NO: 11285 - DNA, 18 bp, Artificial Sequence
  Synthetic DNA
taatatcactcactattg

SEQ ID NO: 11286 - DNA, 18 bp, Artificial Sequence
  Synthetic DNA
tagtacgtcacactatag

SEQ ID NO: 11287 - DNA, 18 bp, Artificial Sequence
  Synthetic DNA
ttatacggcacactatag

SEQ ID NO: 11288 - DNA, 18 bp, Artificial Sequence
  Synthetic DNA
taatactacactctatag

SEQ ID NO: 11289 - DNA, 18 bp, Artificial Sequence
  Synthetic DNA
aaatacgacttacaatag

SEQ ID NO: 11290 - DNA, 18 bp, Artificial Sequence
  Synthetic DNA
aattacgactaactatag

SEQ ID NO: 11291 - DNA, 18 bp, Artificial Sequence
  Synthetic DNA
aaatacgaatcattatag

SEQ ID NO: 11292 - DNA, 18 bp, Artificial Sequence
  Synthetic DNA
taatactacacattatag

SEQ ID NO: 11293 - DNA, 18 bp, Artificial Sequence
  Synthetic DNA
taataggtctctctatag

SEQ ID NO: 11294 - DNA, 18 bp, Artificial Sequence
  Synthetic DNA
tattacgagtcactattg

SEQ ID NO: 11295 - DNA, 18 bp, Artificial Sequence
  Synthetic DNA
aaatacgtcccactatag

SEQ ID NO: 11296 - DNA, 18 bp, Artificial Sequence
  Synthetic DNA
aagtatgactcactatag

SEQ ID NO: 11297 - DNA, 18 bp, Artificial Sequence
  Synthetic DNA
caatataactcactatag

SEQ ID NO: 11298 - DNA, 18 bp, Artificial Sequence
  Synthetic DNA
taaaacgactcatcatag

SEQ ID NO: 11299 - DNA, 18 bp, Artificial Sequence
  Synthetic DNA
taaaaggactcaatatag

SEQ ID NO: 11300 - DNA, 18 bp, Artificial Sequence
  Synthetic DNA
taacacggctcactttag

SEQ ID NO: 11301 - DNA, 18 bp, Artificial Sequence
  Synthetic DNA
taactcgactcactattg

SEQ ID NO: 11302 - DNA, 18 bp, Artificial Sequence
  Synthetic DNA
taagactactcactaaag

SEQ ID NO: 11303 - DNA, 18 bp, Artificial Sequence
  Synthetic DNA
taagatgattcactatag

SEQ ID NO: 11304 - DNA, 18 bp, Artificial Sequence
  Synthetic DNA
taataaaactcactgtag

SEQ ID NO: 11305 - DNA, 18 bp, Artificial Sequence
  Synthetic DNA
taataccactaattatag

SEQ ID NO: 11306 - DNA, 18 bp, Artificial Sequence
  Synthetic DNA
taataccactcactactg

SEQ ID NO: 11307 - DNA, 18 bp, Artificial Sequence
  Synthetic DNA
taatacgaatcaccatcg

SEQ ID NO: 11308 - DNA, 18 bp, Artificial Sequence
  Synthetic DNA
taatacgacaccctatgg

SEQ ID NO: 11309 - DNA, 18 bp, Artificial Sequence
  Synthetic DNA
taatactactgactattg

SEQ ID NO: 11310 - DNA, 18 bp, Artificial Sequence
  Synthetic DNA
taataggatttactatag

SEQ ID NO: 11311 - DNA, 18 bp, Artificial Sequence
  Synthetic DNA
taatatgaccaactatag

SEQ ID NO: 11312 - DNA, 18 bp, Artificial Sequence
  Synthetic DNA
taatctaactcactatag

SEQ ID NO: 11313 - DNA, 18 bp, Artificial Sequence
  Synthetic DNA
taatgcgacatactatag

SEQ ID NO: 11314 - DNA, 18 bp, Artificial Sequence
  Synthetic DNA
taattcgaatgactatag

SEQ ID NO: 11315 - DNA, 18 bp, Artificial Sequence
  Synthetic DNA
tactaagactcacaatag

SEQ ID NO: 11316 - DNA, 18 bp, Artificial Sequence
  Synthetic DNA
tactacgactcattgtag

SEQ ID NO: 11317 - DNA, 18 bp, Artificial Sequence
  Synthetic DNA
tactacgactccttatag

SEQ ID NO: 11318 - DNA, 18 bp, Artificial Sequence
  Synthetic DNA
tactccgactcactaaag

SEQ ID NO: 11319 - DNA, 18 bp, Artificial Sequence
  Synthetic DNA
tagaacgattcactatag

SEQ ID NO: 11320 - DNA, 18 bp, Artificial Sequence
  Synthetic DNA
tagtaccactcactattg

SEQ ID NO: 11321 - DNA, 18 bp, Artificial Sequence
  Synthetic DNA
tagtacgaatcacaatag

SEQ ID NO: 11322 - DNA, 18 bp, Artificial Sequence
  Synthetic DNA
tattacggttcactatag

SEQ ID NO: 11323 - DNA, 18 bp, Artificial Sequence
  Synthetic DNA
tcactcgactcactatag

SEQ ID NO: 11324 - DNA, 18 bp, Artificial Sequence
  Synthetic DNA
tcatacgactcactgttg

SEQ ID NO: 11325 - DNA, 18 bp, Artificial Sequence
  Synthetic DNA
tcatactactaactatag

SEQ ID NO: 11326 - DNA, 18 bp, Artificial Sequence
  Synthetic DNA
tcattcgactcactatgg

SEQ ID NO: 11327 - DNA, 18 bp, Artificial Sequence
  Synthetic DNA
tcctacgactcactaaag

SEQ ID NO: 11328 - DNA, 18 bp, Artificial Sequence
  Synthetic DNA
tgatacgactcgttatag

SEQ ID NO: 11329 - DNA, 18 bp, Artificial Sequence
  Synthetic DNA
tgctacgactctctatag

SEQ ID NO: 11330 - DNA, 18 bp, Artificial Sequence
  Synthetic DNA
tgttacgagtcactatag

SEQ ID NO: 11331 - DNA, 18 bp, Artificial Sequence
  Synthetic DNA
ttacacgactcaatatag

SEQ ID NO: 11332 - DNA, 18 bp, Artificial Sequence
  Synthetic DNA
ttatacaactccctatag

SEQ ID NO: 11333 - DNA, 18 bp, Artificial Sequence
  Synthetic DNA
ttataccactcactatcg

SEQ ID NO: 11334 - DNA, 18 bp, Artificial Sequence
  Synthetic DNA
ttatgcgactccctatag

SEQ ID NO: 11335 - DNA, 18 bp, Artificial Sequence
  Synthetic DNA
taaaacgatttactatag

SEQ ID NO: 11336 - DNA, 18 bp, Artificial Sequence
  Synthetic DNA
taaaacgactcactttcg

SEQ ID NO: 11337 - DNA, 18 bp, Artificial Sequence
  Synthetic DNA
taatacgaaaaactatag

SEQ ID NO: 11338 - DNA, 18 bp, Artificial Sequence
  Synthetic DNA
taatacgacacattttag

SEQ ID NO: 11339 - DNA, 18 bp, Artificial Sequence
  Synthetic DNA
tcatactactcactttag

SEQ ID NO: 11340 - DNA, 18 bp, Artificial Sequence
  Synthetic DNA
ttatacgactctttatag

SEQ ID NO: 11341 - DNA, 18 bp, Artificial Sequence
  Synthetic DNA
taatacttcttactatag

SEQ ID NO: 11342 - DNA, 18 bp, Artificial Sequence
  Synthetic DNA
tattactacacactatag

SEQ ID NO: 11343 - DNA, 18 bp, Artificial Sequence
  Synthetic DNA
ttatacgacacacaatag

SEQ ID NO: 11344 - DNA, 18 bp, Artificial Sequence
  Synthetic DNA
taataagactcattaaag

SEQ ID NO: 11345 - DNA, 18 bp, Artificial Sequence
  Synthetic DNA
taatacaattcaatatag

SEQ ID NO: 11346 - DNA, 18 bp, Artificial Sequence
  Synthetic DNA
aaatacgactaactatcg

SEQ ID NO: 11347 - DNA, 18 bp, Artificial Sequence
  Synthetic DNA
caatacgtctcactatgg

SEQ ID NO: 11348 - DNA, 18 bp, Artificial Sequence
  Synthetic DNA
cattacgactcagtatag

SEQ ID NO: 11349 - DNA, 18 bp, Artificial Sequence
  Synthetic DNA
taacacgactcattattg

SEQ ID NO: 11350 - DNA, 18 bp, Artificial Sequence
  Synthetic DNA
taataatactccctatag

SEQ ID NO: 11351 - DNA, 18 bp, Artificial Sequence
  Synthetic DNA
taataccacccactattg

SEQ ID NO: 11352 - DNA, 18 bp, Artificial Sequence
  Synthetic DNA
taataccaccctctatag

SEQ ID NO: 11353 - DNA, 18 bp, Artificial Sequence
  Synthetic DNA
taataccactcaatctag

SEQ ID NO: 11354 - DNA, 18 bp, Artificial Sequence
  Synthetic DNA
taataccacttactttag

SEQ ID NO: 11355 - DNA, 18 bp, Artificial Sequence
  Synthetic DNA
taatacgacacattatgg

SEQ ID NO: 11356 - DNA, 18 bp, Artificial Sequence
  Synthetic DNA
taatacgactcagactag

SEQ ID NO: 11357 - DNA, 18 bp, Artificial Sequence
  Synthetic DNA
taatacgactgattattg

SEQ ID NO: 11358 - DNA, 18 bp, Artificial Sequence
  Synthetic DNA
taatacgacttacagtag

SEQ ID NO: 11359 - DNA, 18 bp, Artificial Sequence
  Synthetic DNA
taatacgcctccctattg

SEQ ID NO: 11360 - DNA, 18 bp, Artificial Sequence
  Synthetic DNA
taataggactcaccttag

SEQ ID NO: 11361 - DNA, 18 bp, Artificial Sequence
  Synthetic DNA
taatatcacttactatag

SEQ ID NO: 11362 - DNA, 18 bp, Artificial Sequence
  Synthetic DNA
taatccaactcactaaag

SEQ ID NO: 11363 - DNA, 18 bp, Artificial Sequence
  Synthetic DNA
taatgagacacactatag

SEQ ID NO: 11364 - DNA, 18 bp, Artificial Sequence
  Synthetic DNA
taattccactcactatgg

SEQ ID NO: 11365 - DNA, 18 bp, Artificial Sequence
  Synthetic DNA
tactactattcactatag

SEQ ID NO: 11366 - DNA, 18 bp, Artificial Sequence
  Synthetic DNA
tacttcgattcactatag

SEQ ID NO: 11367 - DNA, 18 bp, Artificial Sequence
  Synthetic DNA
tagtacgaatcaatatag

SEQ ID NO: 11368 - DNA, 18 bp, Artificial Sequence
  Synthetic DNA
tagtacgaattactatag

SEQ ID NO: 11369 - DNA, 18 bp, Artificial Sequence
  Synthetic DNA
tattaccactcactctag

SEQ ID NO: 11370 - DNA, 18 bp, Artificial Sequence
  Synthetic DNA
tattacgactcaatatgg

SEQ ID NO: 11371 - DNA, 18 bp, Artificial Sequence
  Synthetic DNA
tcataggactcactaaag

SEQ ID NO: 11372 - DNA, 18 bp, Artificial Sequence
  Synthetic DNA
tgttacgaatcactatag

SEQ ID NO: 11373 - DNA, 18 bp, Artificial Sequence
  Synthetic DNA
ttatacgacaccctatag

SEQ ID NO: 11374 - DNA, 18 bp, Artificial Sequence
  Synthetic DNA
ttatacgcctgactatag

SEQ ID NO: 11375 - DNA, 18 bp, Artificial Sequence
  Synthetic DNA
ttatacgactttctatag

SEQ ID NO: 11376 - DNA, 18 bp, Artificial Sequence
  Synthetic DNA
taataatactcactaaag

SEQ ID NO: 11377 - DNA, 18 bp, Artificial Sequence
  Synthetic DNA
taatacgtctctctaaag

SEQ ID NO: 11378 - DNA, 18 bp, Artificial Sequence
  Synthetic DNA
taatacgacatactttag

SEQ ID NO: 11379 - DNA, 18 bp, Artificial Sequence
  Synthetic DNA
taatatgtcttactatag

SEQ ID NO: 11380 - DNA, 18 bp, Artificial Sequence
  Synthetic DNA
tcatacttctcactatag

SEQ ID NO: 11381 - DNA, 18 bp, Artificial Sequence
  Synthetic DNA
ttatccgactcacaatag

SEQ ID NO: 11382 - DNA, 18 bp, Artificial Sequence
  Synthetic DNA
ttatacgtctcattatag

SEQ ID NO: 11383 - DNA, 18 bp, Artificial Sequence
  Synthetic DNA
taaaaagacttactatag

SEQ ID NO: 11384 - DNA, 18 bp, Artificial Sequence
  Synthetic DNA
taaaacgactcacaacag

SEQ ID NO: 11385 - DNA, 18 bp, Artificial Sequence
  Synthetic DNA
taatactactcacagtag

SEQ ID NO: 11386 - DNA, 18 bp, Artificial Sequence
  Synthetic DNA
tagtacgattcactaaag

SEQ ID NO: 11387 - DNA, 18 bp, Artificial Sequence
  Synthetic DNA
ttacacgacacactatag

SEQ ID NO: 11388 - DNA, 18 bp, Artificial Sequence
  Synthetic DNA
ttatactacccactatag

SEQ ID NO: 11389 - DNA, 18 bp, Artificial Sequence
  Synthetic DNA
ttatacgatttactatag

SEQ ID NO: 11390 - DNA, 18 bp, Artificial Sequence
  Synthetic DNA
taaaactacacactatag

SEQ ID NO: 11391 - DNA, 18 bp, Artificial Sequence
  Synthetic DNA
taatacaactctttatag

SEQ ID NO: 11392 - DNA, 18 bp, Artificial Sequence
  Synthetic DNA
taattcgacttacaatag

SEQ ID NO: 11393 - DNA, 18 bp, Artificial Sequence
  Synthetic DNA
taatccgactcacaaaag

SEQ ID NO: 11394 - DNA, 18 bp, Artificial Sequence
  Synthetic DNA
tcatacgactcactttcg

SEQ ID NO: 11395 - DNA, 18 bp, Artificial Sequence
  Synthetic DNA
aaatacgacccgctatag

SEQ ID NO: 11396 - DNA, 18 bp, Artificial Sequence
  Synthetic DNA
aaatacgagtctctatag

SEQ ID NO: 11397 - DNA, 18 bp, Artificial Sequence
  Synthetic DNA
aaatctgactcactatag

SEQ ID NO: 11398 - DNA, 18 bp, Artificial Sequence
  Synthetic DNA
caacacgacttactatag

SEQ ID NO: 11399 - DNA, 18 bp, Artificial Sequence
  Synthetic DNA
taaaaagactcactatgg

SEQ ID NO: 11400 - DNA, 18 bp, Artificial Sequence
  Synthetic DNA
taagacgactctctttag

SEQ ID NO: 11401 - DNA, 18 bp, Artificial Sequence
  Synthetic DNA
taataccactctctctag

SEQ ID NO: 11402 - DNA, 18 bp, Artificial Sequence
  Synthetic DNA
taatacgattcaccacag

SEQ ID NO: 11403 - DNA, 18 bp, Artificial Sequence
  Synthetic DNA
taatacgcctccatatag

SEQ ID NO: 11404 - DNA, 18 bp, Artificial Sequence
  Synthetic DNA
taatatgactcacaatcg

SEQ ID NO: 11405 - DNA, 18 bp, Artificial Sequence
  Synthetic DNA
taatatgactcccaatag

SEQ ID NO: 11406 - DNA, 18 bp, Artificial Sequence
  Synthetic DNA
taatatgactgactaaag

SEQ ID NO: 11407 - DNA, 18 bp, Artificial Sequence
  Synthetic DNA
taatccgacttactttag

SEQ ID NO: 11408 - DNA, 18 bp, Artificial Sequence
  Synthetic DNA
taatcctactcattatag

SEQ ID NO: 11409 - DNA, 18 bp, Artificial Sequence
  Synthetic DNA
taatctgactcactattg

SEQ ID NO: 11410 - DNA, 18 bp, Artificial Sequence
  Synthetic DNA
taattcgaatcaccatag

SEQ ID NO: 11411 - DNA, 18 bp, Artificial Sequence
  Synthetic DNA
taattcgactaactacag

SEQ ID NO: 11412 - DNA, 18 bp, Artificial Sequence
  Synthetic DNA
taattggattcactatag

SEQ ID NO: 11413 - DNA, 18 bp, Artificial Sequence
  Synthetic DNA
taatttgactcactatgg

SEQ ID NO: 11414 - DNA, 18 bp, Artificial Sequence
  Synthetic DNA
tactacgactcactttgg

SEQ ID NO: 11415 - DNA, 18 bp, Artificial Sequence
  Synthetic DNA
tactacgacttattatag

SEQ ID NO: 11416 - DNA, 18 bp, Artificial Sequence
  Synthetic DNA
tattacgactcgttatag

SEQ ID NO: 11417 - DNA, 18 bp, Artificial Sequence
  Synthetic DNA
tattacgattcactgtag

SEQ ID NO: 11418 - DNA, 18 bp, Artificial Sequence
  Synthetic DNA
tcatacgacatactatag

SEQ ID NO: 11419 - DNA, 18 bp, Artificial Sequence
  Synthetic DNA
tgatacgactccctaaag

SEQ ID NO: 11420 - DNA, 18 bp, Artificial Sequence
  Synthetic DNA
ttataggacttactatag

SEQ ID NO: 11421 - DNA, 18 bp, Artificial Sequence
  Synthetic DNA
ttatcggactcactatag

SEQ ID NO: 11422 - DNA, 18 bp, Artificial Sequence
  Synthetic DNA
ttatgcgaatcactatag

SEQ ID NO: 11423 - DNA, 18 bp, Artificial Sequence
  Synthetic DNA
taatactattcactattg

SEQ ID NO: 11424 - DNA, 18 bp, Artificial Sequence
  Synthetic DNA
aaatacgacacactaaag

SEQ ID NO: 11425 - DNA, 18 bp, Artificial Sequence
  Synthetic DNA
taaaacgaatctctatag

SEQ ID NO: 11426 - DNA, 18 bp, Artificial Sequence
  Synthetic DNA
taatacgtgtcacaatag

SEQ ID NO: 11427 - DNA, 18 bp, Artificial Sequence
  Synthetic DNA
tattacgtcacactatag

SEQ ID NO: 11428 - DNA, 18 bp, Artificial Sequence
  Synthetic DNA
taatacgtcttacaatag

SEQ ID NO: 11429 - DNA, 18 bp, Artificial Sequence
  Synthetic DNA
taatacgacacaccaaag

SEQ ID NO: 11430 - DNA, 18 bp, Artificial Sequence
  Synthetic DNA
tcaaaagactcactatag

SEQ ID NO: 11431 - DNA, 18 bp, Artificial Sequence
  Synthetic DNA
aaatatgactcactattg

SEQ ID NO: 11432 - DNA, 18 bp, Artificial Sequence
  Synthetic DNA
taataagacttactattg

SEQ ID NO: 11433 - DNA, 18 bp, Artificial Sequence
  Synthetic DNA
taataattctcactatag

SEQ ID NO: 11434 - DNA, 18 bp, Artificial Sequence
  Synthetic DNA
taatacctctctctatag

SEQ ID NO: 11435 - DNA, 18 bp, Artificial Sequence
  Synthetic DNA
taatacgattcaataaag

SEQ ID NO: 11436 - DNA, 18 bp, Artificial Sequence
  Synthetic DNA
taatactgctcactattg

SEQ ID NO: 11437 - DNA, 18 bp, Artificial Sequence
  Synthetic DNA
tagtacgacacactaaag

SEQ ID NO: 11438 - DNA, 18 bp, Artificial Sequence
  Synthetic DNA
tatgacgactcactttag

SEQ ID NO: 11439 - DNA, 18 bp, Artificial Sequence
  Synthetic DNA
tcatacgactctttatag

SEQ ID NO: 11440 - DNA, 18 bp, Artificial Sequence
  Synthetic DNA
aaatacgactccccatag

SEQ ID NO: 11441 - DNA, 18 bp, Artificial Sequence
  Synthetic DNA
aaatacgccacactatag

SEQ ID NO: 11442 - DNA, 18 bp, Artificial Sequence
  Synthetic DNA
aaattcgactgactatag

SEQ ID NO: 11443 - DNA, 18 bp, Artificial Sequence
  Synthetic DNA
taaaacgattgactatag

SEQ ID NO: 11444 - DNA, 18 bp, Artificial Sequence
  Synthetic DNA
taacaagactctctatag

SEQ ID NO: 11445 - DNA, 18 bp, Artificial Sequence
  Synthetic DNA
taactcgcctcactatag

SEQ ID NO: 11446 - DNA, 18 bp, Artificial Sequence
  Synthetic DNA
taagacgtctcactattg

SEQ ID NO: 11447 - DNA, 18 bp, Artificial Sequence
  Synthetic DNA
taataagactcgatatag

SEQ ID NO: 11448 - DNA, 18 bp, Artificial Sequence
  Synthetic DNA
taataccatccactatag

SEQ ID NO: 11449 - DNA, 18 bp, Artificial Sequence
  Synthetic DNA
taatacgacaccctctag

SEQ ID NO: 11450 - DNA, 18 bp, Artificial Sequence
  Synthetic DNA
taatacgactgactaacg

SEQ ID NO: 11451 - DNA, 18 bp, Artificial Sequence
  Synthetic DNA
taatacgattccctatgg

SEQ ID NO: 11452 - DNA, 18 bp, Artificial Sequence
  Synthetic DNA
taatacgcctcaataaag

SEQ ID NO: 11453 - DNA, 18 bp, Artificial Sequence
  Synthetic DNA
taatacgtctcagaatag

SEQ ID NO: 11454 - DNA, 18 bp, Artificial Sequence
  Synthetic DNA
taataggacacacaatag

SEQ ID NO: 11455 - DNA, 18 bp, Artificial Sequence
  Synthetic DNA
taataggtcacactatag

SEQ ID NO: 11456 - DNA, 18 bp, Artificial Sequence
  Synthetic DNA
taatattacccactatag

SEQ ID NO: 11457 - DNA, 18 bp, Artificial Sequence
  Synthetic DNA
taatccgtctaactatag

SEQ ID NO: 11458 - DNA, 18 bp, Artificial Sequence
  Synthetic DNA
taattccacccactatag

SEQ ID NO: 11459 - DNA, 18 bp, Artificial Sequence
  Synthetic DNA
tactacgactcaatatgg

SEQ ID NO: 11460 - DNA, 18 bp, Artificial Sequence
  Synthetic DNA
tactacgactcacttcag

SEQ ID NO: 11461 - DNA, 18 bp, Artificial Sequence
  Synthetic DNA
tagtaccactcactttag

SEQ ID NO: 11462 - DNA, 18 bp, Artificial Sequence
  Synthetic DNA
tatgacgactcactatcg

SEQ ID NO: 11463 - DNA, 18 bp, Artificial Sequence
  Synthetic DNA
tcatacgacccactattg

SEQ ID NO: 11464 - DNA, 18 bp, Artificial Sequence
  Synthetic DNA
tcatactactcaatatag

SEQ ID NO: 11465 - DNA, 18 bp, Artificial Sequence
  Synthetic DNA
tgatacaaatcactatag

SEQ ID NO: 11466 - DNA, 18 bp, Artificial Sequence
  Synthetic DNA
ttatacgacttactgtag

SEQ ID NO: 11467 - DNA, 18 bp, Artificial Sequence
  Synthetic DNA
aaatacgattcactttag

SEQ ID NO: 11468 - DNA, 18 bp, Artificial Sequence
  Synthetic DNA
ttatacgtcacactatag

SEQ ID NO: 11469 - DNA, 18 bp, Artificial Sequence
  Synthetic DNA
taatactactatctatag

SEQ ID NO: 11470 - DNA, 18 bp, Artificial Sequence
  Synthetic DNA
taaatcgacacactatag

SEQ ID NO: 11471 - DNA, 18 bp, Artificial Sequence
  Synthetic DNA
taataagacacaatatag

SEQ ID NO: 11472 - DNA, 18 bp, Artificial Sequence
  Synthetic DNA
taataccacacactttag

SEQ ID NO: 11473 - DNA, 18 bp, Artificial Sequence
  Synthetic DNA
taatacgacacaatacag

SEQ ID NO: 11474 - DNA, 18 bp, Artificial Sequence
  Synthetic DNA
taatattacacactatag

SEQ ID NO: 11475 - DNA, 18 bp, Artificial Sequence
  Synthetic DNA
taatacgtcactctatag

SEQ ID NO: 11476 - DNA, 18 bp, Artificial Sequence
  Synthetic DNA
caatacatctcactatag

SEQ ID NO: 11477 - DNA, 18 bp, Artificial Sequence
  Synthetic DNA
taataccactcacttaag

SEQ ID NO: 11478 - DNA, 18 bp, Artificial Sequence
  Synthetic DNA
taatacgattcaccaaag

SEQ ID NO: 11479 - DNA, 18 bp, Artificial Sequence
  Synthetic DNA
tattacgactcattatcg

SEQ ID NO: 11480 - DNA, 18 bp, Artificial Sequence
  Synthetic DNA
aaatacgacccacaatag

SEQ ID NO: 11481 - DNA, 18 bp, Artificial Sequence
  Synthetic DNA
aaattcgactcactagag

SEQ ID NO: 11482 - DNA, 18 bp, Artificial Sequence
  Synthetic DNA
caatacgacagactatag

SEQ ID NO: 11483 - DNA, 18 bp, Artificial Sequence
  Synthetic DNA
ctataccactcactatag

SEQ ID NO: 11484 - DNA, 18 bp, Artificial Sequence
  Synthetic DNA
taacacgactaactaaag

SEQ ID NO: 11485 - DNA, 18 bp, Artificial Sequence
  Synthetic DNA
taatacaattaactatag

SEQ ID NO: 11486 - DNA, 18 bp, Artificial Sequence
  Synthetic DNA
taatacgattaactacag

SEQ ID NO: 11487 - DNA, 18 bp, Artificial Sequence
  Synthetic DNA
taatacgattcactccag

SEQ ID NO: 11488 - DNA, 18 bp, Artificial Sequence
  Synthetic DNA
taatatgactaattatag

SEQ ID NO: 11489 - DNA, 18 bp, Artificial Sequence
  Synthetic DNA
taatgccactaactatag

SEQ ID NO: 11490 - DNA, 18 bp, Artificial Sequence
  Synthetic DNA
tagaaagactcactatag

SEQ ID NO: 11491 - DNA, 18 bp, Artificial Sequence
  Synthetic DNA
tattacgactgacaatag

SEQ ID NO: 11492 - DNA, 18 bp, Artificial Sequence
  Synthetic DNA
tattccgactcactatgg

SEQ ID NO: 11493 - DNA, 18 bp, Artificial Sequence
  Synthetic DNA
tcatacgactcaccttag

SEQ ID NO: 11494 - DNA, 18 bp, Artificial Sequence
  Synthetic DNA
tcatccgattcactatag

SEQ ID NO: 11495 - DNA, 18 bp, Artificial Sequence
  Synthetic DNA
tgatacgattcaatatag

SEQ ID NO: 11496 - DNA, 18 bp, Artificial Sequence
  Synthetic DNA
ttatacgacccactgtag

SEQ ID NO: 11497 - DNA, 18 bp, Artificial Sequence
  Synthetic DNA
ttatacgacccattatag

SEQ ID NO: 11498 - DNA, 18 bp, Artificial Sequence
  Synthetic DNA
ttatgccactcactatag

SEQ ID NO: 11499 - DNA, 18 bp, Artificial Sequence
  Synthetic DNA
taatacgactttctttag

SEQ ID NO: 11500 - DNA, 18 bp, Artificial Sequence
  Synthetic DNA
tataacgactaactatag

SEQ ID NO: 11501 - DNA, 18 bp, Artificial Sequence
  Synthetic DNA
aattacgactcattatag

SEQ ID NO: 11502 - DNA, 18 bp, Artificial Sequence
  Synthetic DNA
aaataagactcacaatag

SEQ ID NO: 11503 - DNA, 18 bp, Artificial Sequence
  Synthetic DNA
taaaacaactcaatatag

SEQ ID NO: 11504 - DNA, 18 bp, Artificial Sequence
  Synthetic DNA
taatacgattcactttgg

SEQ ID NO: 11505 - DNA, 18 bp, Artificial Sequence
  Synthetic DNA
taatacgacactcaatag

SEQ ID NO: 11506 - DNA, 18 bp, Artificial Sequence
  Synthetic DNA
taaaacgacacactaaag

SEQ ID NO: 11507 - DNA, 18 bp, Artificial Sequence
  Synthetic DNA
taaaacgacactctatag

SEQ ID NO: 11508 - DNA, 18 bp, Artificial Sequence
  Synthetic DNA
taatacaacacactattg

SEQ ID NO: 11509 - DNA, 18 bp, Artificial Sequence
  Synthetic DNA
taatactactttctatag

SEQ ID NO: 11510 - DNA, 18 bp, Artificial Sequence
  Synthetic DNA
aaatacgactcattattg

SEQ ID NO: 11511 - DNA, 18 bp, Artificial Sequence
  Synthetic DNA
taatacgacacacaatcg

SEQ ID NO: 11512 - DNA, 18 bp, Artificial Sequence
  Synthetic DNA
taatacgacacactcaag

SEQ ID NO: 11513 - DNA, 18 bp, Artificial Sequence
  Synthetic DNA
aaagacgactcactttag

SEQ ID NO: 11514 - DNA, 18 bp, Artificial Sequence
  Synthetic DNA
acatacgcctcactatag

SEQ ID NO: 11515 - DNA, 18 bp, Artificial Sequence
  Synthetic DNA
caataagacacactatag

SEQ ID NO: 11516 - DNA, 18 bp, Artificial Sequence
  Synthetic DNA
caatacgactaactaaag

SEQ ID NO: 11517 - DNA, 18 bp, Artificial Sequence
  Synthetic DNA
caatacgactctctacag

SEQ ID NO: 11518 - DNA, 18 bp, Artificial Sequence
  Synthetic DNA
caatatgacacactatag

SEQ ID NO: 11519 - DNA, 18 bp, Artificial Sequence
  Synthetic DNA
taaaacgactcattctag

SEQ ID NO: 11520 - DNA, 18 bp, Artificial Sequence
  Synthetic DNA
taaaatgactccctatag

SEQ ID NO: 11521 - DNA, 18 bp, Artificial Sequence
  Synthetic DNA
taataatactcgctatag

SEQ ID NO: 11522 - DNA, 18 bp, Artificial Sequence
  Synthetic DNA
taatacaactagctatag

SEQ ID NO: 11523 - DNA, 18 bp, Artificial Sequence
  Synthetic DNA
taatacaactcaccatgg

SEQ ID NO: 11524 - DNA, 18 bp, Artificial Sequence
  Synthetic DNA
taatacgaaccattatag

SEQ ID NO: 11525 - DNA, 18 bp, Artificial Sequence
  Synthetic DNA
taatacgattcactctcg

SEQ ID NO: 11526 - DNA, 18 bp, Artificial Sequence
  Synthetic DNA
taatacgtctccctgtag

SEQ ID NO: 11527 - DNA, 18 bp, Artificial Sequence
  Synthetic DNA
taatattactcaccatag

SEQ ID NO: 11528 - DNA, 18 bp, Artificial Sequence
  Synthetic DNA
taattcggctcaatatag

SEQ ID NO: 11529 - DNA, 18 bp, Artificial Sequence
  Synthetic DNA
tactacgactctatatag

SEQ ID NO: 11530 - DNA, 18 bp, Artificial Sequence
  Synthetic DNA
tagtacgacacaccatag

SEQ ID NO: 11531 - DNA, 18 bp, Artificial Sequence
  Synthetic DNA
tattaccactcgctatag

SEQ ID NO: 11532 - DNA, 18 bp, Artificial Sequence
  Synthetic DNA
tcataagattcactatag

SEQ ID NO: 11533 - DNA, 18 bp, Artificial Sequence
  Synthetic DNA
tcataatactcactatag

SEQ ID NO: 11534 - DNA, 18 bp, Artificial Sequence
  Synthetic DNA
tcttatgactcactatag

SEQ ID NO: 11535 - DNA, 18 bp, Artificial Sequence
  Synthetic DNA
tgatacgactaactattg

SEQ ID NO: 11536 - DNA, 18 bp, Artificial Sequence
  Synthetic DNA
tgattcgactcaatatag

SEQ ID NO: 11537 - DNA, 18 bp, Artificial Sequence
  Synthetic DNA
taattcgactcattttag

SEQ ID NO: 11538 - DNA, 18 bp, Artificial Sequence
  Synthetic DNA
taaaacgacacacaatag

SEQ ID NO: 11539 - DNA, 18 bp, Artificial Sequence
  Synthetic DNA
aaaaacgactaactatag

SEQ ID NO: 11540 - DNA, 18 bp, Artificial Sequence
  Synthetic DNA
taataatactcattatag

SEQ ID NO: 11541 - DNA, 18 bp, Artificial Sequence
  Synthetic DNA
taatattactcaatatag

SEQ ID NO: 11542 - DNA, 18 bp, Artificial Sequence
  Synthetic DNA
taatccgattctctatag

SEQ ID NO: 11543 - DNA, 18 bp, Artificial Sequence
  Synthetic DNA
ttatccgacacactatag

SEQ ID NO: 11544 - DNA, 18 bp, Artificial Sequence
  Synthetic DNA
taaaacgtatcactatag

SEQ ID NO: 11545 - DNA, 18 bp, Artificial Sequence
  Synthetic DNA
taatacgatttactttag

SEQ ID NO: 11546 - DNA, 18 bp, Artificial Sequence
  Synthetic DNA
taatacgattctatatag

SEQ ID NO: 11547 - DNA, 18 bp, Artificial Sequence
  Synthetic DNA
taatacgcttcacaatag

SEQ ID NO: 11548 - DNA, 18 bp, Artificial Sequence
  Synthetic DNA
taatacggctcacttttg

SEQ ID NO: 11549 - DNA, 18 bp, Artificial Sequence
  Synthetic DNA
taatactactctttatag

SEQ ID NO: 11550 - DNA, 18 bp, Artificial Sequence
  Synthetic DNA
taatattactcacaatag

SEQ ID NO: 11551 - DNA, 18 bp, Artificial Sequence
  Synthetic DNA
tcatacgacttactttag

SEQ ID NO: 11552 - DNA, 18 bp, Artificial Sequence
  Synthetic DNA
ttataccactcacaatag

SEQ ID NO: 11553 - DNA, 18 bp, Artificial Sequence
  Synthetic DNA
aaatacaacccactatag

SEQ ID NO: 11554 - DNA, 18 bp, Artificial Sequence
  Synthetic DNA
caatacgactaacaatag

SEQ ID NO: 11555 - DNA, 18 bp, Artificial Sequence
  Synthetic DNA
caatacgagtcactattg

SEQ ID NO: 11556 - DNA, 18 bp, Artificial Sequence
  Synthetic DNA
taaaccgactcaatatag

SEQ ID NO: 11557 - DNA, 18 bp, Artificial Sequence
  Synthetic DNA
taacacgtctcactgtag

SEQ ID NO: 11558 - DNA, 18 bp, Artificial Sequence
  Synthetic DNA
taacttgactcactatag

SEQ ID NO: 11559 - DNA, 18 bp, Artificial Sequence
  Synthetic DNA
taataagacttattatag

SEQ ID NO: 11560 - DNA, 18 bp, Artificial Sequence
  Synthetic DNA
taataagcctcacaatag

SEQ ID NO: 11561 - DNA, 18 bp, Artificial Sequence
  Synthetic DNA
taatacaactaactatcg

SEQ ID NO: 11562 - DNA, 18 bp, Artificial Sequence
  Synthetic DNA
taatacagttcactatag

SEQ ID NO: 11563 - DNA, 18 bp, Artificial Sequence
  Synthetic DNA
taataccactcactttcg

SEQ ID NO: 11564 - DNA, 18 bp, Artificial Sequence
  Synthetic DNA
taatacgacacagaatag

SEQ ID NO: 11565 - DNA, 18 bp, Artificial Sequence
  Synthetic DNA
taatacgacccacttcag

SEQ ID NO: 11566 - DNA, 18 bp, Artificial Sequence
  Synthetic DNA
taatacgacccataatag

SEQ ID NO: 11567 - DNA, 18 bp, Artificial Sequence
  Synthetic DNA
taatacgactccccattg

SEQ ID NO: 11568 - DNA, 18 bp, Artificial Sequence
  Synthetic DNA
taatacgattccatatag

SEQ ID NO: 11569 - DNA, 18 bp, Artificial Sequence
  Synthetic DNA
taatagcattcactatag

SEQ ID NO: 11570 - DNA, 18 bp, Artificial Sequence
  Synthetic DNA
taataggagtcacaatag

SEQ ID NO: 11571 - DNA, 18 bp, Artificial Sequence
  Synthetic DNA
taatatgactcgcaatag

SEQ ID NO: 11572 - DNA, 18 bp, Artificial Sequence
  Synthetic DNA
taatccgaatctctatag

SEQ ID NO: 11573 - DNA, 18 bp, Artificial Sequence
  Synthetic DNA
tactactactcacaatag

SEQ ID NO: 11574 - DNA, 18 bp, Artificial Sequence
  Synthetic DNA
tagaacgaatcactatag

SEQ ID NO: 11575 - DNA, 18 bp, Artificial Sequence
  Synthetic DNA
tagtatgactctctatag

SEQ ID NO: 11576 - DNA, 18 bp, Artificial Sequence
  Synthetic DNA
tatcacaactcactatag

SEQ ID NO: 11577 - DNA, 18 bp, Artificial Sequence
  Synthetic DNA
tcacacaactcactatag

SEQ ID NO: 11578 - DNA, 18 bp, Artificial Sequence
  Synthetic DNA
aaatactactcacaatag

SEQ ID NO: 11579 - DNA, 18 bp, Artificial Sequence
  Synthetic DNA
taatacgacttacattag

SEQ ID NO: 11580 - DNA, 18 bp, Artificial Sequence
  Synthetic DNA
tattactactcattatag

SEQ ID NO: 11581 - DNA, 18 bp, Artificial Sequence
  Synthetic DNA
tcatacgactctctttag

SEQ ID NO: 11582 - DNA, 18 bp, Artificial Sequence
  Synthetic DNA
aagtacgtctcactatag

SEQ ID NO: 11583 - DNA, 18 bp, Artificial Sequence
  Synthetic DNA
agatacgactctctatag

SEQ ID NO: 11584 - DNA, 18 bp, Artificial Sequence
  Synthetic DNA
taaatcaactcactatag

SEQ ID NO: 11585 - DNA, 18 bp, Artificial Sequence
  Synthetic DNA
taatacatctcactagag

SEQ ID NO: 11586 - DNA, 18 bp, Artificial Sequence
  Synthetic DNA
taataccactcattattg

SEQ ID NO: 11587 - DNA, 18 bp, Artificial Sequence
  Synthetic DNA
taatactatacactatag

SEQ ID NO: 11588 - DNA, 18 bp, Artificial Sequence
  Synthetic DNA
taataagatttactatag

SEQ ID NO: 11589 - DNA, 18 bp, Artificial Sequence
  Synthetic DNA
taatactactcacaatcg

SEQ ID NO: 11590 - DNA, 18 bp, Artificial Sequence
  Synthetic DNA
taatatgactaactaaag

SEQ ID NO: 11591 - DNA, 18 bp, Artificial Sequence
  Synthetic DNA
taatatgactctatatag

SEQ ID NO: 11592 - DNA, 18 bp, Artificial Sequence
  Synthetic DNA
taatatgtatcactatag

SEQ ID NO: 11593 - DNA, 18 bp, Artificial Sequence
  Synthetic DNA
tatttccactcactatag

SEQ ID NO: 11594 - DNA, 18 bp, Artificial Sequence
  Synthetic DNA
aactacaactcactatag

SEQ ID NO: 11595 - DNA, 18 bp, Artificial Sequence
  Synthetic DNA
agatacgactaactatag

SEQ ID NO: 11596 - DNA, 18 bp, Artificial Sequence
  Synthetic DNA
cacttcgactcactatag

SEQ ID NO: 11597 - DNA, 18 bp, Artificial Sequence
  Synthetic DNA
taaaacgaatcactacag

SEQ ID NO: 11598 - DNA, 18 bp, Artificial Sequence
  Synthetic DNA
taaaacgacacactagag

SEQ ID NO: 11599 - DNA, 18 bp, Artificial Sequence
  Synthetic DNA
taacacgacaccctatag

SEQ ID NO: 11600 - DNA, 18 bp, Artificial Sequence
  Synthetic DNA
taacacgactcactttcg

SEQ ID NO: 11601 - DNA, 18 bp, Artificial Sequence
  Synthetic DNA
taacgcgattcactatag

SEQ ID NO: 11602 - DNA, 18 bp, Artificial Sequence
  Synthetic DNA
taatacacatcactatag

SEQ ID NO: 11603 - DNA, 18 bp, Artificial Sequence
  Synthetic DNA
taataccaatctctatag

SEQ ID NO: 11604 - DNA, 18 bp, Artificial Sequence
  Synthetic DNA
taataccactcgcaatag

SEQ ID NO: 11605 - DNA, 18 bp, Artificial Sequence
  Synthetic DNA
taatacgaatctctacag

SEQ ID NO: 11606 - DNA, 18 bp, Artificial Sequence
  Synthetic DNA
taatacgactgaccaaag

SEQ ID NO: 11607 - DNA, 18 bp, Artificial Sequence
  Synthetic DNA
taatacgattctgtatag

SEQ ID NO: 11608 - DNA, 18 bp, Artificial Sequence
  Synthetic DNA
taatactaataactatag

SEQ ID NO: 11609 - DNA, 18 bp, Artificial Sequence
  Synthetic DNA
taatactactccatatag

SEQ ID NO: 11610 - DNA, 18 bp, Artificial Sequence
  Synthetic DNA
taatagtactcactattg

SEQ ID NO: 11611 - DNA, 18 bp, Artificial Sequence
  Synthetic DNA
taatatgacaccctatag

SEQ ID NO: 11612 - DNA, 18 bp, Artificial Sequence
  Synthetic DNA
taatgcgactgacaatag

SEQ ID NO: 11613 - DNA, 18 bp, Artificial Sequence
  Synthetic DNA
taatgcgacttactattg

SEQ ID NO: 11614 - DNA, 18 bp, Artificial Sequence
  Synthetic DNA
taattcgattccctatag

SEQ ID NO: 11615 - DNA, 18 bp, Artificial Sequence
  Synthetic DNA
tactacgaatcacaatag

SEQ ID NO: 11616 - DNA, 18 bp, Artificial Sequence
  Synthetic DNA
tactacgactccctattg

SEQ ID NO: 11617 - DNA, 18 bp, Artificial Sequence
  Synthetic DNA
tactacgactgtctatag

SEQ ID NO: 11618 - DNA, 18 bp, Artificial Sequence
  Synthetic DNA
tactacgacttactttag

SEQ ID NO: 11619 - DNA, 18 bp, Artificial Sequence
  Synthetic DNA
tattacggcttactatag

SEQ ID NO: 11620 - DNA, 18 bp, Artificial Sequence
  Synthetic DNA
tattatgacccactatag

SEQ ID NO: 11621 - DNA, 18 bp, Artificial Sequence
  Synthetic DNA
tgatacgtcccactatag

SEQ ID NO: 11622 - DNA, 18 bp, Artificial Sequence
  Synthetic DNA
ttatatgaatcactatag

SEQ ID NO: 11623 - DNA, 18 bp, Artificial Sequence
  Synthetic DNA
taatatgtctcaccatag

SEQ ID NO: 11624 - DNA, 18 bp, Artificial Sequence
  Synthetic DNA
tgttacgacacactatag

SEQ ID NO: 11625 - DNA, 18 bp, Artificial Sequence
  Synthetic DNA
ttatacgacacactattg

SEQ ID NO: 11626 - DNA, 18 bp, Artificial Sequence
  Synthetic DNA
ctatacgacacactatag

SEQ ID NO: 11627 - DNA, 18 bp, Artificial Sequence
  Synthetic DNA
taatacaactcactatta

SEQ ID NO: 11628 - DNA, 18 bp, Artificial Sequence
  Synthetic DNA
taatacgacactctatcg

SEQ ID NO: 11629 - DNA, 18 bp, Artificial Sequence
  Synthetic DNA
ttacacgactcacaatag

SEQ ID NO: 11630 - DNA, 18 bp, Artificial Sequence
  Synthetic DNA
aaatacgactctcgatag

SEQ ID NO: 11631 - DNA, 18 bp, Artificial Sequence
  Synthetic DNA
aaatactactcactatcg

SEQ ID NO: 11632 - DNA, 18 bp, Artificial Sequence
  Synthetic DNA
aaatatgactcactatcg

SEQ ID NO: 11633 - DNA, 18 bp, Artificial Sequence
  Synthetic DNA
caacacgactcactattg

SEQ ID NO: 11634 - DNA, 18 bp, Artificial Sequence
  Synthetic DNA
caataccattcactatag

SEQ ID NO: 11635 - DNA, 18 bp, Artificial Sequence
  Synthetic DNA
caatacgacccactaaag

SEQ ID NO: 11636 - DNA, 18 bp, Artificial Sequence
  Synthetic DNA
taatacaacacactgtag

SEQ ID NO: 11637 - DNA, 18 bp, Artificial Sequence
  Synthetic DNA
taatacaactcagaatag

SEQ ID NO: 11638 - DNA, 18 bp, Artificial Sequence
  Synthetic DNA
taatacgactctgaatag

SEQ ID NO: 11639 - DNA, 18 bp, Artificial Sequence
  Synthetic DNA
taatacgattcacaatgg

SEQ ID NO: 11640 - DNA, 18 bp, Artificial Sequence
  Synthetic DNA
taatacgattcaccatcg

SEQ ID NO: 11641 - DNA, 18 bp, Artificial Sequence
  Synthetic DNA
taatgcgacttattatag

SEQ ID NO: 11642 - DNA, 18 bp, Artificial Sequence
  Synthetic DNA
taattcgacacactatgg

SEQ ID NO: 11643 - DNA, 18 bp, Artificial Sequence
  Synthetic DNA
taattcgacaccctatag

SEQ ID NO: 11644 - DNA, 18 bp, Artificial Sequence
  Synthetic DNA
tactacgactaactttag

SEQ ID NO: 11645 - DNA, 18 bp, Artificial Sequence
  Synthetic DNA
tagtacgactcagtttag

SEQ ID NO: 11646 - DNA, 18 bp, Artificial Sequence
  Synthetic DNA
tagtattactcactatag

SEQ ID NO: 11647 - DNA, 18 bp, Artificial Sequence
  Synthetic DNA
tattacgacacactgtag

SEQ ID NO: 11648 - DNA, 18 bp, Artificial Sequence
  Synthetic DNA
tcatacgacacactttag

SEQ ID NO: 11649 - DNA, 18 bp, Artificial Sequence
  Synthetic DNA
tcatacgactcattttag

SEQ ID NO: 11650 - DNA, 18 bp, Artificial Sequence
  Synthetic DNA
taatacgaatctctttag

SEQ ID NO: 11651 - DNA, 18 bp, Artificial Sequence
  Synthetic DNA
taatacgtcttactattg

SEQ ID NO: 11652 - DNA, 18 bp, Artificial Sequence
  Synthetic DNA
taatacgactatcaatag

SEQ ID NO: 11653 - DNA, 18 bp, Artificial Sequence
  Synthetic DNA
tattacgactcaataaag

SEQ ID NO: 11654 - DNA, 18 bp, Artificial Sequence
  Synthetic DNA
taaaacgaaacactatag

SEQ ID NO: 11655 - DNA, 18 bp, Artificial Sequence
  Synthetic DNA
taaaacgcctctctatag

SEQ ID NO: 11656 - DNA, 18 bp, Artificial Sequence
  Synthetic DNA
acatacgactcacaatag

SEQ ID NO: 11657 - DNA, 18 bp, Artificial Sequence
  Synthetic DNA
taaaactaatcactatag

SEQ ID NO: 11658 - DNA, 18 bp, Artificial Sequence
  Synthetic DNA
taatacgactcataatcg

SEQ ID NO: 11659 - DNA, 18 bp, Artificial Sequence
  Synthetic DNA
taatacgactctcagtag

SEQ ID NO: 11660 - DNA, 18 bp, Artificial Sequence
  Synthetic DNA
taatactactcgctaaag

SEQ ID NO: 11661 - DNA, 18 bp, Artificial Sequence
  Synthetic DNA
taattcgatttactatag

SEQ ID NO: 11662 - DNA, 18 bp, Artificial Sequence
  Synthetic DNA
tacaacgaatcactatag

SEQ ID NO: 11663 - DNA, 18 bp, Artificial Sequence
  Synthetic DNA
tactactactcactttag

SEQ ID NO: 11664 - DNA, 18 bp, Artificial Sequence
  Synthetic DNA
aaatacgacacactatcg

SEQ ID NO: 11665 - DNA, 18 bp, Artificial Sequence
  Synthetic DNA
aaataggattcactatag

SEQ ID NO: 11666 - DNA, 18 bp, Artificial Sequence
  Synthetic DNA
caatactactctctatag

SEQ ID NO: 11667 - DNA, 18 bp, Artificial Sequence
  Synthetic DNA
gattacgtctcactatag

SEQ ID NO: 11668 - DNA, 18 bp, Artificial Sequence
  Synthetic DNA
taaaaagactcaccatag

SEQ ID NO: 11669 - DNA, 18 bp, Artificial Sequence
  Synthetic DNA
taaaacgacacactatgg

SEQ ID NO: 11670 - DNA, 18 bp, Artificial Sequence
  Synthetic DNA
taacaagactcaatatag

SEQ ID NO: 11671 - DNA, 18 bp, Artificial Sequence
  Synthetic DNA
taagacaactcactattg

SEQ ID NO: 11672 - DNA, 18 bp, Artificial Sequence
  Synthetic DNA
taataagactccttatag

SEQ ID NO: 11673 - DNA, 18 bp, Artificial Sequence
  Synthetic DNA
taatacaactcattacag

SEQ ID NO: 11674 - DNA, 18 bp, Artificial Sequence
  Synthetic DNA
taatacgacttattatcg

SEQ ID NO: 11675 - DNA, 18 bp, Artificial Sequence
  Synthetic DNA
taataggacacactaaag

SEQ ID NO: 11676 - DNA, 18 bp, Artificial Sequence
  Synthetic DNA
taatccgacttacaatag

SEQ ID NO: 11677 - DNA, 18 bp, Artificial Sequence
  Synthetic DNA
taatcctaatcactatag

SEQ ID NO: 11678 - DNA, 18 bp, Artificial Sequence
  Synthetic DNA
tactacgactctccatag

SEQ ID NO: 11679 - DNA, 18 bp, Artificial Sequence
  Synthetic DNA
tcatacgacacgctatag

SEQ ID NO: 11680 - DNA, 18 bp, Artificial Sequence
  Synthetic DNA
tgacacgactcactaaag

SEQ ID NO: 11681 - DNA, 18 bp, Artificial Sequence
  Synthetic DNA
tgatacgacacactacag

SEQ ID NO: 11682 - DNA, 18 bp, Artificial Sequence
  Synthetic DNA
tgatacgcctctctatag

SEQ ID NO: 11683 - DNA, 18 bp, Artificial Sequence
  Synthetic DNA
ttagacgactctctatag

SEQ ID NO: 11684 - DNA, 18 bp, Artificial Sequence
  Synthetic DNA
taattccactcactttag

SEQ ID NO: 11685 - DNA, 18 bp, Artificial Sequence
  Synthetic DNA
aaatacgattcaatatag

SEQ ID NO: 11686 - DNA, 18 bp, Artificial Sequence
  Synthetic DNA
taaaacgtctcactacag

SEQ ID NO: 11687 - DNA, 18 bp, Artificial Sequence
  Synthetic DNA
taatacgacacacaatgg

SEQ ID NO: 11688 - DNA, 18 bp, Artificial Sequence
  Synthetic DNA
taatacgaccctctaaag

SEQ ID NO: 11689 - DNA, 18 bp, Artificial Sequence
  Synthetic DNA
taatacaacacacaatag

SEQ ID NO: 11690 - DNA, 18 bp, Artificial Sequence
  Synthetic DNA
taatacgacatactattg

SEQ ID NO: 11691 - DNA, 18 bp, Artificial Sequence
  Synthetic DNA
taatatgattctctatag

SEQ ID NO: 11692 - DNA, 18 bp, Artificial Sequence
  Synthetic DNA
ttttacgacacactatag

SEQ ID NO: 11693 - DNA, 18 bp, Artificial Sequence
  Synthetic DNA
tagttcgacacactatag

SEQ ID NO: 11694 - DNA, 18 bp, Artificial Sequence
  Synthetic DNA
tgatacgactcacaattg

SEQ ID NO: 11695 - DNA, 18 bp, Artificial Sequence
  Synthetic DNA
aaatacgaatcaatatag

SEQ ID NO: 11696 - DNA, 18 bp, Artificial Sequence
  Synthetic DNA
taaaacgactccctatcg

SEQ ID NO: 11697 - DNA, 18 bp, Artificial Sequence
  Synthetic DNA
taacatgactcactaaag

SEQ ID NO: 11698 - DNA, 18 bp, Artificial Sequence
  Synthetic DNA
taatacaattcactatcg

SEQ ID NO: 11699 - DNA, 18 bp, Artificial Sequence
  Synthetic DNA
taatacgactccccttag

SEQ ID NO: 11700 - DNA, 18 bp, Artificial Sequence
  Synthetic DNA
taatacgattcattatcg

SEQ ID NO: 11701 - DNA, 18 bp, Artificial Sequence
  Synthetic DNA
taatacgatttactacag

SEQ ID NO: 11702 - DNA, 18 bp, Artificial Sequence
  Synthetic DNA
taatactgcttactatag

SEQ ID NO: 11703 - DNA, 18 bp, Artificial Sequence
  Synthetic DNA
taatagtattcactatag

SEQ ID NO: 11704 - DNA, 18 bp, Artificial Sequence
  Synthetic DNA
taatatgacacactatgg

SEQ ID NO: 11705 - DNA, 18 bp, Artificial Sequence
  Synthetic DNA
taatgctactcattatag

SEQ ID NO: 11706 - DNA, 18 bp, Artificial Sequence
  Synthetic DNA
taattcgattcaccatag

SEQ ID NO: 11707 - DNA, 18 bp, Artificial Sequence
  Synthetic DNA
tacaacgactcgctatag

SEQ ID NO: 11708 - DNA, 18 bp, Artificial Sequence
  Synthetic DNA
tactacgacacaatatag

SEQ ID NO: 11709 - DNA, 18 bp, Artificial Sequence
  Synthetic DNA
tactacgacacactttag

SEQ ID NO: 11710 - DNA, 18 bp, Artificial Sequence
  Synthetic DNA
tattacgacccaatatag

SEQ ID NO: 11711 - DNA, 18 bp, Artificial Sequence
  Synthetic DNA
tcatacgactcacttcag

SEQ ID NO: 11712 - DNA, 18 bp, Artificial Sequence
  Synthetic DNA
tcatatgactcactttag

SEQ ID NO: 11713 - DNA, 18 bp, Artificial Sequence
  Synthetic DNA
ttatacgacccactatgg

SEQ ID NO: 11714 - DNA, 18 bp, Artificial Sequence
  Synthetic DNA
ttataggactaactatag

SEQ ID NO: 11715 - DNA, 18 bp, Artificial Sequence
  Synthetic DNA
taattagacacactatag

SEQ ID NO: 11716 - DNA, 18 bp, Artificial Sequence
  Synthetic DNA
aaataccactcactaaag

SEQ ID NO: 11717 - DNA, 18 bp, Artificial Sequence
  Synthetic DNA
acattcgactcactatag

SEQ ID NO: 11718 - DNA, 18 bp, Artificial Sequence
  Synthetic DNA
taataagactcataatag

SEQ ID NO: 11719 - DNA, 18 bp, Artificial Sequence
  Synthetic DNA
taataccaatcactttag

SEQ ID NO: 11720 - DNA, 18 bp, Artificial Sequence
  Synthetic DNA
taatttgacttactatag

SEQ ID NO: 11721 - DNA, 18 bp, Artificial Sequence
  Synthetic DNA
tattaccactcattatag

SEQ ID NO: 11722 - DNA, 18 bp, Artificial Sequence
  Synthetic DNA
taattcgattcacaatag

SEQ ID NO: 11723 - DNA, 18 bp, Artificial Sequence
  Synthetic DNA
taatacgacttattattg

SEQ ID NO: 11724 - DNA, 18 bp, Artificial Sequence
  Synthetic DNA
taattccactcactaaag

SEQ ID NO: 11725 - DNA, 18 bp, Artificial Sequence
  Synthetic DNA
taatactactcacttaag

SEQ ID NO: 11726 - DNA, 18 bp, Artificial Sequence
  Synthetic DNA
taatacttctcacaatag

SEQ ID NO: 11727 - DNA, 18 bp, Artificial Sequence
  Synthetic DNA
taatacgacactctaaag

SEQ ID NO: 11728 - DNA, 18 bp, Artificial Sequence
  Synthetic DNA
taaaacgacttactaaag

SEQ ID NO: 11729 - DNA, 18 bp, Artificial Sequence
  Synthetic DNA
taataatactcactattg

SEQ ID NO: 11730 - DNA, 18 bp, Artificial Sequence
  Synthetic DNA
aaatacgattcactaaag

SEQ ID NO: 11731 - DNA, 18 bp, Artificial Sequence
  Synthetic DNA
taacacgacacactttag

SEQ ID NO: 11732 - DNA, 18 bp, Artificial Sequence
  Synthetic DNA
taactctactcactatag

SEQ ID NO: 11733 - DNA, 18 bp, Artificial Sequence
  Synthetic DNA
taataatacacactatag

SEQ ID NO: 11734 - DNA, 18 bp, Artificial Sequence
  Synthetic DNA
aaatccgactcactattg

SEQ ID NO: 11735 - DNA, 18 bp, Artificial Sequence
  Synthetic DNA
taaaacgactaaatatag

SEQ ID NO: 11736 - DNA, 18 bp, Artificial Sequence
  Synthetic DNA
taaagcaactcactatag

SEQ ID NO: 11737 - DNA, 18 bp, Artificial Sequence
  Synthetic DNA
taataagaccaactatag

SEQ ID NO: 11738 - DNA, 18 bp, Artificial Sequence
  Synthetic DNA
taataagattcactatcg

SEQ ID NO: 11739 - DNA, 18 bp, Artificial Sequence
  Synthetic DNA
taatacaactcaacatag

SEQ ID NO: 11740 - DNA, 18 bp, Artificial Sequence
  Synthetic DNA
taataccacttacaatag

SEQ ID NO: 11741 - DNA, 18 bp, Artificial Sequence
  Synthetic DNA
taatacgaatcccaatag

SEQ ID NO: 11742 - DNA, 18 bp, Artificial Sequence
  Synthetic DNA
taatacgaatccctaaag

SEQ ID NO: 11743 - DNA, 18 bp, Artificial Sequence
  Synthetic DNA
taatacgactaaataaag

SEQ ID NO: 11744 - DNA, 18 bp, Artificial Sequence
  Synthetic DNA
taatacgcctatctatag

SEQ ID NO: 11745 - DNA, 18 bp, Artificial Sequence
  Synthetic DNA
taataggactaacaatag

SEQ ID NO: 11746 - DNA, 18 bp, Artificial Sequence
  Synthetic DNA
taatccctctcactatag

SEQ ID NO: 11747 - DNA, 18 bp, Artificial Sequence
  Synthetic DNA
taatccgacacacaatag

SEQ ID NO: 11748 - DNA, 18 bp, Artificial Sequence
  Synthetic DNA
tcataggaatcactatag

SEQ ID NO: 11749 - DNA, 18 bp, Artificial Sequence
  Synthetic DNA
taatacgtatcactattg

SEQ ID NO: 11750 - DNA, 18 bp, Artificial Sequence
  Synthetic DNA
tattatgacacactatag

SEQ ID NO: 11751 - DNA, 18 bp, Artificial Sequence
  Synthetic DNA
taataggtctcacaatag

SEQ ID NO: 11752 - DNA, 18 bp, Artificial Sequence
  Synthetic DNA
tattaccacttactatag

SEQ ID NO: 11753 - DNA, 18 bp, Artificial Sequence
  Synthetic DNA
ttatatgactcaatatag

SEQ ID NO: 11754 - DNA, 18 bp, Artificial Sequence
  Synthetic DNA
atatacgactcattatag

SEQ ID NO: 11755 - DNA, 18 bp, Artificial Sequence
  Synthetic DNA
aaatacgactccctttag

SEQ ID NO: 11756 - DNA, 18 bp, Artificial Sequence
  Synthetic DNA
aaatacggctcacaatag

SEQ ID NO: 11757 - DNA, 18 bp, Artificial Sequence
  Synthetic DNA
caacacgactctctatag

SEQ ID NO: 11758 - DNA, 18 bp, Artificial Sequence
  Synthetic DNA
taacacgtctcattatag

SEQ ID NO: 11759 - DNA, 18 bp, Artificial Sequence
  Synthetic DNA
taatacatctcactatcg

SEQ ID NO: 11760 - DNA, 18 bp, Artificial Sequence
  Synthetic DNA
taatacgtgttactatag

SEQ ID NO: 11761 - DNA, 18 bp, Artificial Sequence
  Synthetic DNA
taattcaactccctatag

SEQ ID NO: 11762 - DNA, 18 bp, Artificial Sequence
  Synthetic DNA
tattaccactcactatcg

SEQ ID NO: 11763 - DNA, 18 bp, Artificial Sequence
  Synthetic DNA
tcatacgactccctattg

SEQ ID NO: 11764 - DNA, 18 bp, Artificial Sequence
  Synthetic DNA
tgatacctctcactatag

SEQ ID NO: 11765 - DNA, 18 bp, Artificial Sequence
  Synthetic DNA
tgatacgactctttatag

SEQ ID NO: 11766 - DNA, 18 bp, Artificial Sequence
  Synthetic DNA
ttatacgacccaccatag

SEQ ID NO: 11767 - DNA, 18 bp, Artificial Sequence
  Synthetic DNA
ttatacgagtcaatatag

SEQ ID NO: 11768 - DNA, 18 bp, Artificial Sequence
  Synthetic DNA
tattactactcactaaag

SEQ ID NO: 11769 - DNA, 18 bp, Artificial Sequence
  Synthetic DNA
aaataagtctcactatag

SEQ ID NO: 11770 - DNA, 18 bp, Artificial Sequence
  Synthetic DNA
taatacaactctccatag

SEQ ID NO: 11771 - DNA, 18 bp, Artificial Sequence
  Synthetic DNA
taatacgaatatctatag

SEQ ID NO: 11772 - DNA, 18 bp, Artificial Sequence
  Synthetic DNA
taatactacatactatag

SEQ ID NO: 11773 - DNA, 18 bp, Artificial Sequence
  Synthetic DNA
taatacatttcactatag

SEQ ID NO: 11774 - DNA, 18 bp, Artificial Sequence
  Synthetic DNA
tattacgactaactattg

SEQ ID NO: 11775 - DNA, 18 bp, Artificial Sequence
  Synthetic DNA
aaatacgacatactatag

SEQ ID NO: 11776 - DNA, 18 bp, Artificial Sequence
  Synthetic DNA
taatatgacttactttag

SEQ ID NO: 11777 - DNA, 18 bp, Artificial Sequence
  Synthetic DNA
taattcaactaactatag

SEQ ID NO: 11778 - DNA, 18 bp, Artificial Sequence
  Synthetic DNA
taattcgactcactaagg

SEQ ID NO: 11779 - DNA, 18 bp, Artificial Sequence
  Synthetic DNA
tattacgacaaactatag

SEQ ID NO: 11780 - DNA, 18 bp, Artificial Sequence
  Synthetic DNA
tgatacgactcacaaaag

SEQ ID NO: 11781 - DNA, 18 bp, Artificial Sequence
  Synthetic DNA
ttatacgacccactaaag

SEQ ID NO: 11782 - DNA, 18 bp, Artificial Sequence
  Synthetic DNA
aaatacgagtcacaatag

SEQ ID NO: 11783 - DNA, 18 bp, Artificial Sequence
  Synthetic DNA
cactacgactctctatag

SEQ ID NO: 11784 - DNA, 18 bp, Artificial Sequence
  Synthetic DNA
taacacgtctcactacag

SEQ ID NO: 11785 - DNA, 18 bp, Artificial Sequence
  Synthetic DNA
taataagaatcactatgg

SEQ ID NO: 11786 - DNA, 18 bp, Artificial Sequence
  Synthetic DNA
taatacgaatcaatatcg

SEQ ID NO: 11787 - DNA, 18 bp, Artificial Sequence
  Synthetic DNA
taatacgaatctctctag

SEQ ID NO: 11788 - DNA, 18 bp, Artificial Sequence
  Synthetic DNA
taatacgactcaattcag

SEQ ID NO: 11789 - DNA, 18 bp, Artificial Sequence
  Synthetic DNA
taatacgactcatcatcg

SEQ ID NO: 11790 - DNA, 18 bp, Artificial Sequence
  Synthetic DNA
taatactactcaatacag

SEQ ID NO: 11791 - DNA, 18 bp, Artificial Sequence
  Synthetic DNA
taatactactcagtaaag

SEQ ID NO: 11792 - DNA, 18 bp, Artificial Sequence
  Synthetic DNA
taatactactcattgtag

SEQ ID NO: 11793 - DNA, 18 bp, Artificial Sequence
  Synthetic DNA
taatatgattcactacag

SEQ ID NO: 11794 - DNA, 18 bp, Artificial Sequence
  Synthetic DNA
taccacgactcactttag

SEQ ID NO: 11795 - DNA, 18 bp, Artificial Sequence
  Synthetic DNA
tactacgaatcactacag

SEQ ID NO: 11796 - DNA, 18 bp, Artificial Sequence
  Synthetic DNA
tcataagactcaccatag

SEQ ID NO: 11797 - DNA, 18 bp, Artificial Sequence
  Synthetic DNA
tcatacgatttactatag

SEQ ID NO: 11798 - DNA, 18 bp, Artificial Sequence
  Synthetic DNA
tctcacgactcactatag

SEQ ID NO: 11799 - DNA, 18 bp, Artificial Sequence
  Synthetic DNA
tcttacgactcactacag

SEQ ID NO: 11800 - DNA, 18 bp, Artificial Sequence
  Synthetic DNA
taatacgtcacactttag

SEQ ID NO: 11801 - DNA, 18 bp, Artificial Sequence
  Synthetic DNA
aattacgacttactatag

SEQ ID NO: 11802 - DNA, 18 bp, Artificial Sequence
  Synthetic DNA
taatacgacacattaaag

SEQ ID NO: 11803 - DNA, 18 bp, Artificial Sequence
  Synthetic DNA
taatacaactcattattg

SEQ ID NO: 11804 - DNA, 18 bp, Artificial Sequence
  Synthetic DNA
taatacgtctttctatag

SEQ ID NO: 11805 - DNA, 18 bp, Artificial Sequence
  Synthetic DNA
taatactactaactattg

SEQ ID NO: 11806 - DNA, 18 bp, Artificial Sequence
  Synthetic DNA
taataagacacattatag

SEQ ID NO: 11807 - DNA, 18 bp, Artificial Sequence
  Synthetic DNA
taataagactctttatag

SEQ ID NO: 11808 - DNA, 18 bp, Artificial Sequence
  Synthetic DNA
ttatatgactcattatag

SEQ ID NO: 11809 - DNA, 18 bp, Artificial Sequence
  Synthetic DNA
ttattcgactcattatag

SEQ ID NO: 11810 - DNA, 18 bp, Artificial Sequence
  Synthetic DNA
aaatccgacacactatag

SEQ ID NO: 11811 - DNA, 18 bp, Artificial Sequence
  Synthetic DNA
aagtacgactcactttag

SEQ ID NO: 11812 - DNA, 18 bp, Artificial Sequence
  Synthetic DNA
agatacgattcactatag

SEQ ID NO: 11813 - DNA, 18 bp, Artificial Sequence
  Synthetic DNA
cattacgactaactatag

SEQ ID NO: 11814 - DNA, 18 bp, Artificial Sequence
  Synthetic DNA
taaaacgacctactatag

SEQ ID NO: 11815 - DNA, 18 bp, Artificial Sequence
  Synthetic DNA
taacacgactcactcttg

SEQ ID NO: 11816 - DNA, 18 bp, Artificial Sequence
  Synthetic DNA
taacacgtctcaccatag

SEQ ID NO: 11817 - DNA, 18 bp, Artificial Sequence
  Synthetic DNA
taataacactcactttag

SEQ ID NO: 11818 - DNA, 18 bp, Artificial Sequence
  Synthetic DNA
taataagacaccctatag

SEQ ID NO: 11819 - DNA, 18 bp, Artificial Sequence
  Synthetic DNA
taataatactaactatag

SEQ ID NO: 11820 - DNA, 18 bp, Artificial Sequence
  Synthetic DNA
taatacgacagactaaag

SEQ ID NO: 11821 - DNA, 18 bp, Artificial Sequence
  Synthetic DNA
taatacgacccattaaag

SEQ ID NO: 11822 - DNA, 18 bp, Artificial Sequence
  Synthetic DNA
taatacgattcagtctag

SEQ ID NO: 11823 - DNA, 18 bp, Artificial Sequence
  Synthetic DNA
taatacgcctcattttag

SEQ ID NO: 11824 - DNA, 18 bp, Artificial Sequence
  Synthetic DNA
taatatgacacactgtag

SEQ ID NO: 11825 - DNA, 18 bp, Artificial Sequence
  Synthetic DNA
taatccgacatactatag

SEQ ID NO: 11826 - DNA, 18 bp, Artificial Sequence
  Synthetic DNA
taatgccactcacaatag

SEQ ID NO: 11827 - DNA, 18 bp, Artificial Sequence
  Synthetic DNA
taattcgactcactatta

SEQ ID NO: 11828 - DNA, 18 bp, Artificial Sequence
  Synthetic DNA
tagtacgactctttatag

SEQ ID NO: 11829 - DNA, 18 bp, Artificial Sequence
  Synthetic DNA
tagtacgagacactatag

SEQ ID NO: 11830 - DNA, 18 bp, Artificial Sequence
  Synthetic DNA
tcatacgaatcattatag

SEQ ID NO: 11831 - DNA, 18 bp, Artificial Sequence
  Synthetic DNA
tgaaacaactcactatag

SEQ ID NO: 11832 - DNA, 18 bp, Artificial Sequence
  Synthetic DNA
tgaaacgacttactatag

SEQ ID NO: 11833 - DNA, 18 bp, Artificial Sequence
  Synthetic DNA
tgatactactcactacag

SEQ ID NO: 11834 - DNA, 18 bp, Artificial Sequence
  Synthetic DNA
ttatacgactccatatag

SEQ ID NO: 11835 - DNA, 18 bp, Artificial Sequence
  Synthetic DNA
ttatacgactgattatag

SEQ ID NO: 11836 - DNA, 18 bp, Artificial Sequence
  Synthetic DNA
ttatacgtcttactatag

SEQ ID NO: 11837 - DNA, 18 bp, Artificial Sequence
  Synthetic DNA
tattactattcactatag

SEQ ID NO: 11838 - DNA, 18 bp, Artificial Sequence
  Synthetic DNA
aattacgacacactatag

SEQ ID NO: 11839 - DNA, 18 bp, Artificial Sequence
  Synthetic DNA
taatacgactcacattac

SEQ ID NO: 11840 - DNA, 18 bp, Artificial Sequence
  Synthetic DNA
taataagactcattattg

SEQ ID NO: 11841 - DNA, 18 bp, Artificial Sequence
  Synthetic DNA
taataccacactctatag

SEQ ID NO: 11842 - DNA, 18 bp, Artificial Sequence
  Synthetic DNA
taatacgacttacttaag

SEQ ID NO: 11843 - DNA, 18 bp, Artificial Sequence
  Synthetic DNA
aaaaacgaatcactatag

SEQ ID NO: 11844 - DNA, 18 bp, Artificial Sequence
  Synthetic DNA
taaaacgacttactttag

SEQ ID NO: 11845 - DNA, 18 bp, Artificial Sequence
  Synthetic DNA
tattacggctcactttag

SEQ ID NO: 11846 - DNA, 18 bp, Artificial Sequence
  Synthetic DNA
aaatacgactcaatacag

SEQ ID NO: 11847 - DNA, 18 bp, Artificial Sequence
  Synthetic DNA
aaatatgacccactatag

SEQ ID NO: 11848 - DNA, 18 bp, Artificial Sequence
  Synthetic DNA
aacaacgactcactatag

SEQ ID NO: 11849 - DNA, 18 bp, Artificial Sequence
  Synthetic DNA
caattcgactaactatag

SEQ ID NO: 11850 - DNA, 18 bp, Artificial Sequence
  Synthetic DNA
taaaaccattcactatag

SEQ ID NO: 11851 - DNA, 18 bp, Artificial Sequence
  Synthetic DNA
taactagactcactatag

SEQ ID NO: 11852 - DNA, 18 bp, Artificial Sequence
  Synthetic DNA
taatacgaatcacactag

SEQ ID NO: 11853 - DNA, 18 bp, Artificial Sequence
  Synthetic DNA
taatacgactgaccattg

SEQ ID NO: 11854 - DNA, 18 bp, Artificial Sequence
  Synthetic DNA
taatacgagtctatatag

SEQ ID NO: 11855 - DNA, 18 bp, Artificial Sequence
  Synthetic DNA
taatacggctcattaaag

SEQ ID NO: 11856 - DNA, 18 bp, Artificial Sequence
  Synthetic DNA
taatcagaatcactatag

SEQ ID NO: 11857 - DNA, 18 bp, Artificial Sequence
  Synthetic DNA
taattcgacttactctag

SEQ ID NO: 11858 - DNA, 18 bp, Artificial Sequence
  Synthetic DNA
tcatatgacacactatag

SEQ ID NO: 11859 - DNA, 18 bp, Artificial Sequence
  Synthetic DNA
tgatacgattaactatag

SEQ ID NO: 11860 - DNA, 18 bp, Artificial Sequence
  Synthetic DNA
tattactactctctatag

SEQ ID NO: 11861 - DNA, 18 bp, Artificial Sequence
  Synthetic DNA
taatatgattcactttag

SEQ ID NO: 11862 - DNA, 18 bp, Artificial Sequence
  Synthetic DNA
taatacgttttactatag

SEQ ID NO: 11863 - DNA, 18 bp, Artificial Sequence
  Synthetic DNA
tagtacgactcacttaag

SEQ ID NO: 11864 - DNA, 18 bp, Artificial Sequence
  Synthetic DNA
aaatacgactcaatttag

SEQ ID NO: 11865 - DNA, 18 bp, Artificial Sequence
  Synthetic DNA
aaatccgactcaatatag

SEQ ID NO: 11866 - DNA, 18 bp, Artificial Sequence
  Synthetic DNA
taaaacgacttattatag

SEQ ID NO: 11867 - DNA, 18 bp, Artificial Sequence
  Synthetic DNA
taataagacacgctatag

SEQ ID NO: 11868 - DNA, 18 bp, Artificial Sequence
  Synthetic DNA
taatacgactaatcatag

SEQ ID NO: 11869 - DNA, 18 bp, Artificial Sequence
  Synthetic DNA
taatacgcctcaatttag

SEQ ID NO: 11870 - DNA, 18 bp, Artificial Sequence
  Synthetic DNA
taatacggcacactttag

SEQ ID NO: 11871 - DNA, 18 bp, Artificial Sequence
  Synthetic DNA
taatacggctcaataaag

SEQ ID NO: 11872 - DNA, 18 bp, Artificial Sequence
  Synthetic DNA
taatactactgactaaag

SEQ ID NO: 11873 - DNA, 18 bp, Artificial Sequence
  Synthetic DNA
taatatgattcagtatag

SEQ ID NO: 11874 - DNA, 18 bp, Artificial Sequence
  Synthetic DNA
tactattactcactatag

SEQ ID NO: 11875 - DNA, 18 bp, Artificial Sequence
  Synthetic DNA
tcatacgtctcattatag

SEQ ID NO: 11876 - DNA, 18 bp, Artificial Sequence
  Synthetic DNA
tcttacgacccactatag

SEQ ID NO: 11877 - DNA, 18 bp, Artificial Sequence
  Synthetic DNA
ttctacgactcaccatag

SEQ ID NO: 11878 - DNA, 18 bp, Artificial Sequence
  Synthetic DNA
ttattcgattcactatag

SEQ ID NO: 11879 - DNA, 18 bp, Artificial Sequence
  Synthetic DNA
taaatcgactaactatag

SEQ ID NO: 11880 - DNA, 18 bp, Artificial Sequence
  Synthetic DNA
tattacgacttaatatag

SEQ ID NO: 11881 - DNA, 18 bp, Artificial Sequence
  Synthetic DNA
aaataggactctctatag

SEQ ID NO: 11882 - DNA, 18 bp, Artificial Sequence
  Synthetic DNA
aaatatgactcgctatag

SEQ ID NO: 11883 - DNA, 18 bp, Artificial Sequence
  Synthetic DNA
aattacgagtcactatag

SEQ ID NO: 11884 - DNA, 18 bp, Artificial Sequence
  Synthetic DNA
acatacgaatcactatag

SEQ ID NO: 11885 - DNA, 18 bp, Artificial Sequence
  Synthetic DNA
caatacgacttactaaag

SEQ ID NO: 11886 - DNA, 18 bp, Artificial Sequence
  Synthetic DNA
taatacaagtcactattg

SEQ ID NO: 11887 - DNA, 18 bp, Artificial Sequence
  Synthetic DNA
taatacaattccctatag

SEQ ID NO: 11888 - DNA, 18 bp, Artificial Sequence
  Synthetic DNA
taatacgacccaacatag

SEQ ID NO: 11889 - DNA, 18 bp, Artificial Sequence
  Synthetic DNA
taatacgactccttaaag

SEQ ID NO: 11890 - DNA, 18 bp, Artificial Sequence
  Synthetic DNA
tattgcgacacactatag

SEQ ID NO: 11891 - DNA, 18 bp, Artificial Sequence
  Synthetic DNA
tgacacgtctcactatag

SEQ ID NO: 11892 - DNA, 18 bp, Artificial Sequence
  Synthetic DNA
tgttacgactcaatatag

SEQ ID NO: 11893 - DNA, 18 bp, Artificial Sequence
  Synthetic DNA
ttatacgattcactatcg

SEQ ID NO: 11894 - DNA, 18 bp, Artificial Sequence
  Synthetic DNA
ttatacggctcattatag

SEQ ID NO: 11895 - DNA, 18 bp, Artificial Sequence
  Synthetic DNA
ttatactactcgctatag

SEQ ID NO: 11896 - DNA, 18 bp, Artificial Sequence
  Synthetic DNA
taatacaattcacaatag

SEQ ID NO: 11897 - DNA, 18 bp, Artificial Sequence
  Synthetic DNA
aaaaacgactcattatag

SEQ ID NO: 11898 - DNA, 18 bp, Artificial Sequence
  Synthetic DNA
taacacgactcacaaaag

SEQ ID NO: 11899 - DNA, 18 bp, Artificial Sequence
  Synthetic DNA
taattcgaattactatag

SEQ ID NO: 11900 - DNA, 18 bp, Artificial Sequence
  Synthetic DNA
taatacgaccctcaatag

SEQ ID NO: 11901 - DNA, 18 bp, Artificial Sequence
  Synthetic DNA
taataggactcactatta

SEQ ID NO: 11902 - DNA, 18 bp, Artificial Sequence
  Synthetic DNA
tattacgaattactatag

SEQ ID NO: 11903 - DNA, 18 bp, Artificial Sequence
  Synthetic DNA
ttatacgattcactctag

SEQ ID NO: 11904 - DNA, 18 bp, Artificial Sequence
  Synthetic DNA
aaataagaatcactatag

SEQ ID NO: 11905 - DNA, 18 bp, Artificial Sequence
  Synthetic DNA
caatatgactcacaatag

SEQ ID NO: 11906 - DNA, 18 bp, Artificial Sequence
  Synthetic DNA
taaaacgactaactctag

SEQ ID NO: 11907 - DNA, 18 bp, Artificial Sequence
  Synthetic DNA
taataagacccacaatag

SEQ ID NO: 11908 - DNA, 18 bp, Artificial Sequence
  Synthetic DNA
taataagacttactctag

SEQ ID NO: 11909 - DNA, 18 bp, Artificial Sequence
  Synthetic DNA
taatacgacacgttatag

SEQ ID NO: 11910 - DNA, 18 bp, Artificial Sequence
  Synthetic DNA
taatacgactcaaaacag

SEQ ID NO: 11911 - DNA, 18 bp, Artificial Sequence
  Synthetic DNA
taatacgcctctatatag

SEQ ID NO: 11912 - DNA, 18 bp, Artificial Sequence
  Synthetic DNA
taatccgtctcaatatag

SEQ ID NO: 11913 - DNA, 18 bp, Artificial Sequence
  Synthetic DNA
tattacacctcactatag

SEQ ID NO: 11914 - DNA, 18 bp, Artificial Sequence
  Synthetic DNA
tcataccactcactttag

SEQ ID NO: 11915 - DNA, 18 bp, Artificial Sequence
  Synthetic DNA
tcatacgactctctctag

SEQ ID NO: 11916 - DNA, 18 bp, Artificial Sequence
  Synthetic DNA
tgatacgactatctatag

SEQ ID NO: 11917 - DNA, 18 bp, Artificial Sequence
  Synthetic DNA
taatacgaatcaatattg

SEQ ID NO: 11918 - DNA, 18 bp, Artificial Sequence
  Synthetic DNA
taatatgactaactattg

SEQ ID NO: 11919 - DNA, 18 bp, Artificial Sequence
  Synthetic DNA
taatatgattcactaaag

SEQ ID NO: 11920 - DNA, 18 bp, Artificial Sequence
  Synthetic DNA
tagttcgactcacaatag

SEQ ID NO: 11921 - DNA, 18 bp, Artificial Sequence
  Synthetic DNA
ttgtacgtctcactatag

SEQ ID NO: 11922 - DNA, 18 bp, Artificial Sequence
  Synthetic DNA
tagaacgactcacaatag

SEQ ID NO: 11923 - DNA, 18 bp, Artificial Sequence
  Synthetic DNA
aaatacgaatccctatag

SEQ ID NO: 11924 - DNA, 18 bp, Artificial Sequence
  Synthetic DNA
aaatccgactcactttag

SEQ ID NO: 11925 - DNA, 18 bp, Artificial Sequence
  Synthetic DNA
aacttcgactcactatag

SEQ ID NO: 11926 - DNA, 18 bp, Artificial Sequence
  Synthetic DNA
taaaactactgactatag

SEQ ID NO: 11927 - DNA, 18 bp, Artificial Sequence
  Synthetic DNA
taatacaactcccaatag

SEQ ID NO: 11928 - DNA, 18 bp, Artificial Sequence
  Synthetic DNA
taatacgacacgctaaag

SEQ ID NO: 11929 - DNA, 18 bp, Artificial Sequence
  Synthetic DNA
taatacggctcaatttag

SEQ ID NO: 11930 - DNA, 18 bp, Artificial Sequence
  Synthetic DNA
taataggacatactatag

SEQ ID NO: 11931 - DNA, 18 bp, Artificial Sequence
  Synthetic DNA
taatatgaatcattatag

SEQ ID NO: 11932 - DNA, 18 bp, Artificial Sequence
  Synthetic DNA
tagaacgactcaatatag

SEQ ID NO: 11933 - DNA, 18 bp, Artificial Sequence
  Synthetic DNA
tgaaacgactcaatatag

SEQ ID NO: 11934 - DNA, 18 bp, Artificial Sequence
  Synthetic DNA
ttatgcgactcattatag

SEQ ID NO: 11935 - DNA, 18 bp, Artificial Sequence
  Synthetic DNA
aaatactactcactttag

SEQ ID NO: 11936 - DNA, 18 bp, Artificial Sequence
  Synthetic DNA
taattcaactcaatatag

SEQ ID NO: 11937 - DNA, 18 bp, Artificial Sequence
  Synthetic DNA
tacttcaactcactatag

SEQ ID NO: 11938 - DNA, 18 bp, Artificial Sequence
  Synthetic DNA
tattacgaaacactatag

SEQ ID NO: 11939 - DNA, 18 bp, Artificial Sequence
  Synthetic DNA
tgatacgactcacattag

SEQ ID NO: 11940 - DNA, 18 bp, Artificial Sequence
  Synthetic DNA
ttatactactcactacag

SEQ ID NO: 11941 - DNA, 18 bp, Artificial Sequence
  Synthetic DNA
ttatacaattcactatag

SEQ ID NO: 11942 - DNA, 18 bp, Artificial Sequence
  Synthetic DNA
ttatactactcacaatag

SEQ ID NO: 11943 - DNA, 18 bp, Artificial Sequence
  Synthetic DNA
aaatacgtatcactatag

SEQ ID NO: 11944 - DNA, 18 bp, Artificial Sequence
  Synthetic DNA
taatactacttacaatag

SEQ ID NO: 11945 - DNA, 18 bp, Artificial Sequence
  Synthetic DNA
tcatacgattcacaatag

SEQ ID NO: 11946 - DNA, 18 bp, Artificial Sequence
  Synthetic DNA
aaagacgaatcactatag

SEQ ID NO: 11947 - DNA, 18 bp, Artificial Sequence
  Synthetic DNA
aaatacgacacactatgg

SEQ ID NO: 11948 - DNA, 18 bp, Artificial Sequence
  Synthetic DNA
taaaacgaaccactatag

SEQ ID NO: 11949 - DNA, 18 bp, Artificial Sequence
  Synthetic DNA
taaaatgattcactatag

SEQ ID NO: 11950 - DNA, 18 bp, Artificial Sequence
  Synthetic DNA
taataaaacttactatag

SEQ ID NO: 11951 - DNA, 18 bp, Artificial Sequence
  Synthetic DNA
taataatactcaccatag

SEQ ID NO: 11952 - DNA, 18 bp, Artificial Sequence
  Synthetic DNA
taatacaacacactacag

SEQ ID NO: 11953 - DNA, 18 bp, Artificial Sequence
  Synthetic DNA
taatacaactcagtgtag

SEQ ID NO: 11954 - DNA, 18 bp, Artificial Sequence
  Synthetic DNA
taatacagctcattatag

SEQ ID NO: 11955 - DNA, 18 bp, Artificial Sequence
  Synthetic DNA
taatacgcctctcaatag

SEQ ID NO: 11956 - DNA, 18 bp, Artificial Sequence
  Synthetic DNA
taataggactctcaatag

SEQ ID NO: 11957 - DNA, 18 bp, Artificial Sequence
  Synthetic DNA
taatccaactaactatag

SEQ ID NO: 11958 - DNA, 18 bp, Artificial Sequence
  Synthetic DNA
tacttagactcactatag

SEQ ID NO: 11959 - DNA, 18 bp, Artificial Sequence
  Synthetic DNA
tattacgatccactatag

SEQ ID NO: 11960 - DNA, 18 bp, Artificial Sequence
  Synthetic DNA
tcaaacgactcagtatag

SEQ ID NO: 11961 - DNA, 18 bp, Artificial Sequence
  Synthetic DNA
ttatacgtctgactatag

SEQ ID NO: 11962 - DNA, 18 bp, Artificial Sequence
  Synthetic DNA
taaatcgactcacaatag

SEQ ID NO: 11963 - DNA, 18 bp, Artificial Sequence
  Synthetic DNA
aaatacgattcactattg

SEQ ID NO: 11964 - DNA, 18 bp, Artificial Sequence
  Synthetic DNA
taataaaactctctatag

SEQ ID NO: 11965 - DNA, 18 bp, Artificial Sequence
  Synthetic DNA
taatacctctcactattg

SEQ ID NO: 11966 - DNA, 18 bp, Artificial Sequence
  Synthetic DNA
taatccgacactctatag

SEQ ID NO: 11967 - DNA, 18 bp, Artificial Sequence
  Synthetic DNA
tgatatgtctcactatag

SEQ ID NO: 11968 - DNA, 18 bp, Artificial Sequence
  Synthetic DNA
aaatacgacacactttag

SEQ ID NO: 11969 - DNA, 18 bp, Artificial Sequence
  Synthetic DNA
aaattccactcactatag

SEQ ID NO: 11970 - DNA, 18 bp, Artificial Sequence
  Synthetic DNA
taaaacgacaaactatag

SEQ ID NO: 11971 - DNA, 18 bp, Artificial Sequence
  Synthetic DNA
caatatgactcattatag

SEQ ID NO: 11972 - DNA, 18 bp, Artificial Sequence
  Synthetic DNA
cattacgactcaatatag

SEQ ID NO: 11973 - DNA, 18 bp, Artificial Sequence
  Synthetic DNA
ctatacaactcactatag

SEQ ID NO: 11974 - DNA, 18 bp, Artificial Sequence
  Synthetic DNA
taaaacgccttactatag

SEQ ID NO: 11975 - DNA, 18 bp, Artificial Sequence
  Synthetic DNA
taaaaggacacactatag

SEQ ID NO: 11976 - DNA, 18 bp, Artificial Sequence
  Synthetic DNA
taatacaacaccctatag

SEQ ID NO: 11977 - DNA, 18 bp, Artificial Sequence
  Synthetic DNA
taatacagctcactaaag

SEQ ID NO: 11978 - DNA, 18 bp, Artificial Sequence
  Synthetic DNA
taatacgacacaatctag

SEQ ID NO: 11979 - DNA, 18 bp, Artificial Sequence
  Synthetic DNA
taatacgcctttctatag

SEQ ID NO: 11980 - DNA, 18 bp, Artificial Sequence
  Synthetic DNA
taatacggctcataatag

SEQ ID NO: 11981 - DNA, 18 bp, Artificial Sequence
  Synthetic DNA
taattcgattcactctag

SEQ ID NO: 11982 - DNA, 18 bp, Artificial Sequence
  Synthetic DNA
taatttgactcattatag

SEQ ID NO: 11983 - DNA, 18 bp, Artificial Sequence
  Synthetic DNA
tactacgatttactatag

SEQ ID NO: 11984 - DNA, 18 bp, Artificial Sequence
  Synthetic DNA
tactactactcattatag

SEQ ID NO: 11985 - DNA, 18 bp, Artificial Sequence
  Synthetic DNA
tagtacgactaacaatag

SEQ ID NO: 11986 - DNA, 18 bp, Artificial Sequence
  Synthetic DNA
tattaagcctcactatag

SEQ ID NO: 11987 - DNA, 18 bp, Artificial Sequence
  Synthetic DNA
tattacgactcactgcag

SEQ ID NO: 11988 - DNA, 18 bp, Artificial Sequence
  Synthetic DNA
tcatacgactctatatag

SEQ ID NO: 11989 - DNA, 18 bp, Artificial Sequence
  Synthetic DNA
tcatacggctcactaaag

SEQ ID NO: 11990 - DNA, 18 bp, Artificial Sequence
  Synthetic DNA
tgatacgacttactaaag

SEQ ID NO: 11991 - DNA, 18 bp, Artificial Sequence
  Synthetic DNA
ttatactactgactatag

SEQ ID NO: 11992 - DNA, 18 bp, Artificial Sequence
  Synthetic DNA
taattcgacaaactatag

SEQ ID NO: 11993 - DNA, 18 bp, Artificial Sequence
  Synthetic DNA
ttatacgattcattatag

SEQ ID NO: 11994 - DNA, 18 bp, Artificial Sequence
  Synthetic DNA
aaatacgactcacgttag

SEQ ID NO: 11995 - DNA, 18 bp, Artificial Sequence
  Synthetic DNA
taatacaacagactatag

SEQ ID NO: 11996 - DNA, 18 bp, Artificial Sequence
  Synthetic DNA
taatacgaatcacttcag

SEQ ID NO: 11997 - DNA, 18 bp, Artificial Sequence
  Synthetic DNA
taatacgacacactttcg

SEQ ID NO: 11998 - DNA, 18 bp, Artificial Sequence
  Synthetic DNA
taatacgagtcattaaag

SEQ ID NO: 11999 - DNA, 18 bp, Artificial Sequence
  Synthetic DNA
taatacgattcacactag

SEQ ID NO: 12000 - DNA, 18 bp, Artificial Sequence
  Synthetic DNA
taatacgattcattgtag

SEQ ID NO: 12001 - DNA, 18 bp, Artificial Sequence
  Synthetic DNA
taatacgccttacaatag

SEQ ID NO: 12002 - DNA, 18 bp, Artificial Sequence
  Synthetic DNA
taatcagacacactatag

SEQ ID NO: 12003 - DNA, 18 bp, Artificial Sequence
  Synthetic DNA
tactacgacacattatag

SEQ ID NO: 12004 - DNA, 18 bp, Artificial Sequence
  Synthetic DNA
tactacgactcattttag

SEQ ID NO: 12005 - DNA, 18 bp, Artificial Sequence
  Synthetic DNA
tattacgactaagtatag

SEQ ID NO: 12006 - DNA, 18 bp, Artificial Sequence
  Synthetic DNA
tgatatgactcacaatag

SEQ ID NO: 12007 - DNA, 18 bp, Artificial Sequence
  Synthetic DNA
ttatacgactctctagag

SEQ ID NO: 12008 - DNA, 18 bp, Artificial Sequence
  Synthetic DNA
ttatacgacttactctag

SEQ ID NO: 12009 - DNA, 18 bp, Artificial Sequence
  Synthetic DNA
ttttacgacccactatag

SEQ ID NO: 12010 - DNA, 18 bp, Artificial Sequence
  Synthetic DNA
tattacgtttcactatag

SEQ ID NO: 12011 - DNA, 18 bp, Artificial Sequence
  Synthetic DNA
taatacatcttactatag

SEQ ID NO: 12012 - DNA, 18 bp, Artificial Sequence
  Synthetic DNA
taatattactctctatag

SEQ ID NO: 12013 - DNA, 18 bp, Artificial Sequence
  Synthetic DNA
atatacgattcactatag

SEQ ID NO: 12014 - DNA, 18 bp, Artificial Sequence
  Synthetic DNA
taattctactcactctag

SEQ ID NO: 12015 - DNA, 18 bp, Artificial Sequence
  Synthetic DNA
tattcctactcactatag

SEQ ID NO: 12016 - DNA, 18 bp, Artificial Sequence
  Synthetic DNA
tgatacgactctctaaag

SEQ ID NO: 12017 - DNA, 18 bp, Artificial Sequence
  Synthetic DNA
taatacggcttactttag

SEQ ID NO: 12018 - DNA, 18 bp, Artificial Sequence
  Synthetic DNA
tattacgaatcactctag

SEQ ID NO: 12019 - DNA, 18 bp, Artificial Sequence
  Synthetic DNA
tattacgactgactaaag

SEQ ID NO: 12020 - DNA, 18 bp, Artificial Sequence
  Synthetic DNA
tcaaacgactcaatatag

SEQ ID NO: 12021 - DNA, 18 bp, Artificial Sequence
  Synthetic DNA
taatacgactctcaacag

SEQ ID NO: 12022 - DNA, 18 bp, Artificial Sequence
  Synthetic DNA
tattacgactccctattg

SEQ ID NO: 12023 - DNA, 18 bp, Artificial Sequence
  Synthetic DNA
taaaacgactatctatag

SEQ ID NO: 12024 - DNA, 18 bp, Artificial Sequence
  Synthetic DNA
taatacgtcacacaatag

SEQ ID NO: 12025 - DNA, 18 bp, Artificial Sequence
  Synthetic DNA
taattctactcacaatag

SEQ ID NO: 12026 - DNA, 18 bp, Artificial Sequence
  Synthetic DNA
taatacgtctatctatag

SEQ ID NO: 12027 - DNA, 18 bp, Artificial Sequence
  Synthetic DNA
tcatacgacttacaatag

SEQ ID NO: 12028 - DNA, 18 bp, Artificial Sequence
  Synthetic DNA
aaataccactctctatag

SEQ ID NO: 12029 - DNA, 18 bp, Artificial Sequence
  Synthetic DNA
taacaggactcactattg

SEQ ID NO: 12030 - DNA, 18 bp, Artificial Sequence
  Synthetic DNA
taataagcctaactatag

SEQ ID NO: 12031 - DNA, 18 bp, Artificial Sequence
  Synthetic DNA
taatacaactcacaatgg

SEQ ID NO: 12032 - DNA, 18 bp, Artificial Sequence
  Synthetic DNA
taatacaactcactaagg

SEQ ID NO: 12033 - DNA, 18 bp, Artificial Sequence
  Synthetic DNA
taatacaagtcacaatag

SEQ ID NO: 12034 - DNA, 18 bp, Artificial Sequence
  Synthetic DNA
taatactattcactacag

SEQ ID NO: 12035 - DNA, 18 bp, Artificial Sequence
  Synthetic DNA
taatactcttcactatag

SEQ ID NO: 12036 - DNA, 18 bp, Artificial Sequence
  Synthetic DNA
taatatgcctaactatag

SEQ ID NO: 12037 - DNA, 18 bp, Artificial Sequence
  Synthetic DNA
tgaaaccactcactatag

SEQ ID NO: 12038 - DNA, 18 bp, Artificial Sequence
  Synthetic DNA
tgatacgacttactattg

SEQ ID NO: 12039 - DNA, 18 bp, Artificial Sequence
  Synthetic DNA
ttatacgcctcattatag

SEQ ID NO: 12040 - DNA, 18 bp, Artificial Sequence
  Synthetic DNA
taatacgacttacaaaag

SEQ ID NO: 12041 - DNA, 18 bp, Artificial Sequence
  Synthetic DNA
taataagtttcactatag

SEQ ID NO: 12042 - DNA, 18 bp, Artificial Sequence
  Synthetic DNA
taatacaaatcacaatag

SEQ ID NO: 12043 - DNA, 18 bp, Artificial Sequence
  Synthetic DNA
taataccactctctaaag

SEQ ID NO: 12044 - DNA, 18 bp, Artificial Sequence
  Synthetic DNA
caatacgactcataatag

SEQ ID NO: 12045 - DNA, 18 bp, Artificial Sequence
  Synthetic DNA
taaaacgaccctctatag

SEQ ID NO: 12046 - DNA, 18 bp, Artificial Sequence
  Synthetic DNA
taaaacgtctccctatag

SEQ ID NO: 12047 - DNA, 18 bp, Artificial Sequence
  Synthetic DNA
taatacctctaactatag

SEQ ID NO: 12048 - DNA, 18 bp, Artificial Sequence
  Synthetic DNA
taatacgaattaccatag

SEQ ID NO: 12049 - DNA, 18 bp, Artificial Sequence
  Synthetic DNA
taatacgacacagtttag

SEQ ID NO: 12050 - DNA, 18 bp, Artificial Sequence
  Synthetic DNA
taatacgattcactcaag

SEQ ID NO: 12051 - DNA, 18 bp, Artificial Sequence
  Synthetic DNA
taatacgtatccctatag

SEQ ID NO: 12052 - DNA, 18 bp, Artificial Sequence
  Synthetic DNA
taatacgtctcattgtag

SEQ ID NO: 12053 - DNA, 18 bp, Artificial Sequence
  Synthetic DNA
taataggactctccatag

SEQ ID NO: 12054 - DNA, 18 bp, Artificial Sequence
  Synthetic DNA
taatccgacaaactatag

SEQ ID NO: 12055 - DNA, 18 bp, Artificial Sequence
  Synthetic DNA
taattagactccctatag

SEQ ID NO: 12056 - DNA, 18 bp, Artificial Sequence
  Synthetic DNA
tgattcgattcactatag

SEQ ID NO: 12057 - DNA, 18 bp, Artificial Sequence
  Synthetic DNA
caattctactcactatag

SEQ ID NO: 12058 - DNA, 18 bp, Artificial Sequence
  Synthetic DNA
taataccattctctatag

SEQ ID NO: 12059 - DNA, 18 bp, Artificial Sequence
  Synthetic DNA
taattcgtatcactatag

SEQ ID NO: 12060 - DNA, 18 bp, Artificial Sequence
  Synthetic DNA
tattaagacttactatag

SEQ ID NO: 12061 - DNA, 18 bp, Artificial Sequence
  Synthetic DNA
caatacgtctcaatatag

SEQ ID NO: 12062 - DNA, 18 bp, Artificial Sequence
  Synthetic DNA
tactacgtctcactttag

SEQ ID NO: 12063 - DNA, 18 bp, Artificial Sequence
  Synthetic DNA
aaatacgactaaatatag

SEQ ID NO: 12064 - DNA, 18 bp, Artificial Sequence
  Synthetic DNA
taacacgattctctatag

SEQ ID NO: 12065 - DNA, 18 bp, Artificial Sequence
  Synthetic DNA
taataatactcactatgg

SEQ ID NO: 12066 - DNA, 18 bp, Artificial Sequence
  Synthetic DNA
taatacaacccactttag

SEQ ID NO: 12067 - DNA, 18 bp, Artificial Sequence
  Synthetic DNA
taatatgattcaccatag

SEQ ID NO: 12068 - DNA, 18 bp, Artificial Sequence
  Synthetic DNA
taatgcgattctctatag

SEQ ID NO: 12069 - DNA, 18 bp, Artificial Sequence
  Synthetic DNA
tattaagactcactatgg

SEQ ID NO: 12070 - DNA, 18 bp, Artificial Sequence
  Synthetic DNA
tattactacccactatag

SEQ ID NO: 12071 - DNA, 18 bp, Artificial Sequence
  Synthetic DNA
tcttacgactcactctag

SEQ ID NO: 12072 - DNA, 18 bp, Artificial Sequence
  Synthetic DNA
ttatacgattcgctatag

SEQ ID NO: 12073 - DNA, 18 bp, Artificial Sequence
  Synthetic DNA
atatacgacacactatag

SEQ ID NO: 12074 - DNA, 18 bp, Artificial Sequence
  Synthetic DNA
aaatacgacttactttag

SEQ ID NO: 12075 - DNA, 18 bp, Artificial Sequence
  Synthetic DNA
taatgcgtcacactatag

SEQ ID NO: 12076 - DNA, 18 bp, Artificial Sequence
  Synthetic DNA
taattcgactcaaaatag

SEQ ID NO: 12077 - DNA, 18 bp, Artificial Sequence
  Synthetic DNA
aaatacaactcaccatag

SEQ ID NO: 12078 - DNA, 18 bp, Artificial Sequence
  Synthetic DNA
caatacgattcacaatag

SEQ ID NO: 12079 - DNA, 18 bp, Artificial Sequence
  Synthetic DNA
cattacgacacactatag

SEQ ID NO: 12080 - DNA, 18 bp, Artificial Sequence
  Synthetic DNA
taacacgactcattaaag

SEQ ID NO: 12081 - DNA, 18 bp, Artificial Sequence
  Synthetic DNA
taataagactaacaatag

SEQ ID NO: 12082 - DNA, 18 bp, Artificial Sequence
  Synthetic DNA
taatacgacactctctag

SEQ ID NO: 12083 - DNA, 18 bp, Artificial Sequence
  Synthetic DNA
taatatggctcactattg

SEQ ID NO: 12084 - DNA, 18 bp, Artificial Sequence
  Synthetic DNA
taatattactaactatag

SEQ ID NO: 12085 - DNA, 18 bp, Artificial Sequence
  Synthetic DNA
taatccgacacactaaag

SEQ ID NO: 12086 - DNA, 18 bp, Artificial Sequence
  Synthetic DNA
taatctgtctcactatag

SEQ ID NO: 12087 - DNA, 18 bp, Artificial Sequence
  Synthetic DNA
taattcgattcactacag

SEQ ID NO: 12088 - DNA, 18 bp, Artificial Sequence
  Synthetic DNA
tactacaaatcactatag

SEQ ID NO: 12089 - DNA, 18 bp, Artificial Sequence
  Synthetic DNA
tcatacgactaactaaag

SEQ ID NO: 12090 - DNA, 18 bp, Artificial Sequence
  Synthetic DNA
tcattcgactcaatatag

SEQ ID NO: 12091 - DNA, 18 bp, Artificial Sequence
  Synthetic DNA
tgatacgactcattaaag

SEQ ID NO: 12092 - DNA, 18 bp, Artificial Sequence
  Synthetic DNA
tgttactactcactatag

SEQ ID NO: 12093 - DNA, 18 bp, Artificial Sequence
  Synthetic DNA
ttatacaactcattatag

SEQ ID NO: 12094 - DNA, 18 bp, Artificial Sequence
  Synthetic DNA
atatactactcactatag

SEQ ID NO: 12095 - DNA, 18 bp, Artificial Sequence
  Synthetic DNA
tattacgtctcacaatag

SEQ ID NO: 12096 - DNA, 18 bp, Artificial Sequence
  Synthetic DNA
aaaaacgacacactatag

SEQ ID NO: 12097 - DNA, 18 bp, Artificial Sequence
  Synthetic DNA
taatacgactcccaattg

SEQ ID NO: 12098 - DNA, 18 bp, Artificial Sequence
  Synthetic DNA
ttttacgactcattatag

SEQ ID NO: 12099 - DNA, 18 bp, Artificial Sequence
  Synthetic DNA
taaaacgactgtctatag

SEQ ID NO: 12100 - DNA, 18 bp, Artificial Sequence
  Synthetic DNA
taacaagtctcactatag

SEQ ID NO: 12101 - DNA, 18 bp, Artificial Sequence
  Synthetic DNA
taatacctctcattatag

SEQ ID NO: 12102 - DNA, 18 bp, Artificial Sequence
  Synthetic DNA
taatacgaatccatatag

SEQ ID NO: 12103 - DNA, 18 bp, Artificial Sequence
  Synthetic DNA
taatccgactttctatag

SEQ ID NO: 12104 - DNA, 18 bp, Artificial Sequence
  Synthetic DNA
taattcgactgtctatag

SEQ ID NO: 12105 - DNA, 18 bp, Artificial Sequence
  Synthetic DNA
tagtaagactaactatag

SEQ ID NO: 12106 - DNA, 18 bp, Artificial Sequence
  Synthetic DNA
tagttcgactcactaaag

SEQ ID NO: 12107 - DNA, 18 bp, Artificial Sequence
  Synthetic DNA
tcatacgtctaactatag

SEQ ID NO: 12108 - DNA, 18 bp, Artificial Sequence
  Synthetic DNA
tcttacgacttactatag

SEQ ID NO: 12109 - DNA, 18 bp, Artificial Sequence
  Synthetic DNA
taattcgtcacactatag

SEQ ID NO: 12110 - DNA, 18 bp, Artificial Sequence
  Synthetic DNA
aaatacaacacactatag

SEQ ID NO: 12111 - DNA, 18 bp, Artificial Sequence
  Synthetic DNA
aactacgacacactatag

SEQ ID NO: 12112 - DNA, 18 bp, Artificial Sequence
  Synthetic DNA
taaaacgacgcactaaag

SEQ ID NO: 12113 - DNA, 18 bp, Artificial Sequence
  Synthetic DNA
taaaacgactcccaatag

SEQ ID NO: 12114 - DNA, 18 bp, Artificial Sequence
  Synthetic DNA
taactcgactcaatatag

SEQ ID NO: 12115 - DNA, 18 bp, Artificial Sequence
  Synthetic DNA
taataccactaactttag

SEQ ID NO: 12116 - DNA, 18 bp, Artificial Sequence
  Synthetic DNA
taatactaccctctatag

SEQ ID NO: 12117 - DNA, 18 bp, Artificial Sequence
  Synthetic DNA
taattcgacttaccatag

SEQ ID NO: 12118 - DNA, 18 bp, Artificial Sequence
  Synthetic DNA
taattcgagtctctatag

SEQ ID NO: 12119 - DNA, 18 bp, Artificial Sequence
  Synthetic DNA
tagtacgtctcaatatag

SEQ ID NO: 12120 - DNA, 18 bp, Artificial Sequence
  Synthetic DNA
tattacgacgctctatag

SEQ ID NO: 12121 - DNA, 18 bp, Artificial Sequence
  Synthetic DNA
ttataagactccctatag

SEQ ID NO: 12122 - DNA, 18 bp, Artificial Sequence
  Synthetic DNA
taatacgtcacactattg

SEQ ID NO: 12123 - DNA, 18 bp, Artificial Sequence
  Synthetic DNA
aaatacgactcaaaatag

SEQ ID NO: 12124 - DNA, 18 bp, Artificial Sequence
  Synthetic DNA
taatacgtctctccatag

SEQ ID NO: 12125 - DNA, 18 bp, Artificial Sequence
  Synthetic DNA
taaaacggctaactatag

SEQ ID NO: 12126 - DNA, 18 bp, Artificial Sequence
  Synthetic DNA
taatacggcactctatag

SEQ ID NO: 12127 - DNA, 18 bp, Artificial Sequence
  Synthetic DNA
taatacttctccctatag

SEQ ID NO: 12128 - DNA, 18 bp, Artificial Sequence
  Synthetic DNA
taatccgatacactatag

SEQ ID NO: 12129 - DNA, 18 bp, Artificial Sequence
  Synthetic DNA
taattctactccctatag

SEQ ID NO: 12130 - DNA, 18 bp, Artificial Sequence
  Synthetic DNA
tattacaactcaccatag

SEQ ID NO: 12131 - DNA, 18 bp, Artificial Sequence
  Synthetic DNA
tcatacgacaaactatag

SEQ ID NO: 12132 - DNA, 18 bp, Artificial Sequence
  Synthetic DNA
tcatacgactcattaaag

SEQ ID NO: 12133 - DNA, 18 bp, Artificial Sequence
  Synthetic DNA
tgatattactcactatag

SEQ ID NO: 12134 - DNA, 18 bp, Artificial Sequence
  Synthetic DNA
aaatacgacactctatag

SEQ ID NO: 12135 - DNA, 18 bp, Artificial Sequence
  Synthetic DNA
ttataccactcactattg

SEQ ID NO: 12136 - DNA, 18 bp, Artificial Sequence
  Synthetic DNA
taaaatgactctctatag

SEQ ID NO: 12137 - DNA, 18 bp, Artificial Sequence
  Synthetic DNA
taaaacaactccctatag

SEQ ID NO: 12138 - DNA, 18 bp, Artificial Sequence
  Synthetic DNA
taacacgactcacactag

SEQ ID NO: 12139 - DNA, 18 bp, Artificial Sequence
  Synthetic DNA
taataccacttactaaag

SEQ ID NO: 12140 - DNA, 18 bp, Artificial Sequence
  Synthetic DNA
taatacggcacacaatag

SEQ ID NO: 12141 - DNA, 18 bp, Artificial Sequence
  Synthetic DNA
taatactattaactatag

SEQ ID NO: 12142 - DNA, 18 bp, Artificial Sequence
  Synthetic DNA
taattcgatccactatag

SEQ ID NO: 12143 - DNA, 18 bp, Artificial Sequence
  Synthetic DNA
tactactacacactatag

SEQ ID NO: 12144 - DNA, 18 bp, Artificial Sequence
  Synthetic DNA
tgatacgactcaccaaag

SEQ ID NO: 12145 - DNA, 18 bp, Artificial Sequence
  Synthetic DNA
aaatacaactcacaatag

SEQ ID NO: 12146 - DNA, 18 bp, Artificial Sequence
  Synthetic DNA
caataccacacactatag

SEQ ID NO: 12147 - DNA, 18 bp, Artificial Sequence
  Synthetic DNA
caatacgaatcactattg

SEQ ID NO: 12148 - DNA, 18 bp, Artificial Sequence
  Synthetic DNA
taaaacgactcactatta

SEQ ID NO: 12149 - DNA, 18 bp, Artificial Sequence
  Synthetic DNA
taatacgaatcactcttg

SEQ ID NO: 12150 - DNA, 18 bp, Artificial Sequence
  Synthetic DNA
taatacgacccacattag

SEQ ID NO: 12151 - DNA, 18 bp, Artificial Sequence
  Synthetic DNA
taatacgactcataacag

SEQ ID NO: 12152 - DNA, 18 bp, Artificial Sequence
  Synthetic DNA
taattcgactcagtaaag

SEQ ID NO: 12153 - DNA, 18 bp, Artificial Sequence
  Synthetic DNA
tatcacgactcaatatag

SEQ ID NO: 12154 - DNA, 18 bp, Artificial Sequence
  Synthetic DNA
ttatacgactcatcatag

SEQ ID NO: 12155 - DNA, 18 bp, Artificial Sequence
  Synthetic DNA
aaatacgacacactacag

SEQ ID NO: 12156 - DNA, 18 bp, Artificial Sequence
  Synthetic DNA
aaattcgactcactatgg

SEQ ID NO: 12157 - DNA, 18 bp, Artificial Sequence
  Synthetic DNA
agatacgactcacaatag

SEQ ID NO: 12158 - DNA, 18 bp, Artificial Sequence
  Synthetic DNA
ccatacgactcacaatag

SEQ ID NO: 12159 - DNA, 18 bp, Artificial Sequence
  Synthetic DNA
taatacgtctcaccacag

SEQ ID NO: 12160 - DNA, 18 bp, Artificial Sequence
  Synthetic DNA
taataggactctttatag

SEQ ID NO: 12161 - DNA, 18 bp, Artificial Sequence
  Synthetic DNA
tatcacgattcactatag

SEQ ID NO: 12162 - DNA, 18 bp, Artificial Sequence
  Synthetic DNA
ttaaacgagtcactatag

SEQ ID NO: 12163 - DNA, 18 bp, Artificial Sequence
  Synthetic DNA
ttacacgaatcactatag

SEQ ID NO: 12164 - DNA, 18 bp, Artificial Sequence
  Synthetic DNA
taatatgtctcactaaag

SEQ ID NO: 12165 - DNA, 18 bp, Artificial Sequence
  Synthetic DNA
tattacgattcaatatag

SEQ ID NO: 12166 - DNA, 18 bp, Artificial Sequence
  Synthetic DNA
taataagtctcactatgg

SEQ ID NO: 12167 - DNA, 18 bp, Artificial Sequence
  Synthetic DNA
taatacaaccctctatag

SEQ ID NO: 12168 - DNA, 18 bp, Artificial Sequence
  Synthetic DNA
taatacatctgactatag

SEQ ID NO: 12169 - DNA, 18 bp, Artificial Sequence
  Synthetic DNA
taatactacccactaaag

SEQ ID NO: 12170 - DNA, 18 bp, Artificial Sequence
  Synthetic DNA
tactacgactaactaaag

SEQ ID NO: 12171 - DNA, 18 bp, Artificial Sequence
  Synthetic DNA
tattacgactcaatattg

SEQ ID NO: 12172 - DNA, 18 bp, Artificial Sequence
  Synthetic DNA
taataccactctatatag

SEQ ID NO: 12173 - DNA, 18 bp, Artificial Sequence
  Synthetic DNA
taccacgtctcactatag

SEQ ID NO: 12174 - DNA, 18 bp, Artificial Sequence
  Synthetic DNA
tcatacgactcacaattg

SEQ ID NO: 12175 - DNA, 18 bp, Artificial Sequence
  Synthetic DNA
taatacgaatcactgaag

SEQ ID NO: 12176 - DNA, 18 bp, Artificial Sequence
  Synthetic DNA
taatactactcactgttg

SEQ ID NO: 12177 - DNA, 18 bp, Artificial Sequence
  Synthetic DNA
tgatactactctctatag

SEQ ID NO: 12178 - DNA, 18 bp, Artificial Sequence
  Synthetic DNA
taaaacgactctcaatag

SEQ ID NO: 12179 - DNA, 18 bp, Artificial Sequence
  Synthetic DNA
taacacgactctctaaag

SEQ ID NO: 12180 - DNA, 18 bp, Artificial Sequence
  Synthetic DNA
taatacgaaacactaaag

SEQ ID NO: 12181 - DNA, 18 bp, Artificial Sequence
  Synthetic DNA
taatatgattcactattg

SEQ ID NO: 12182 - DNA, 18 bp, Artificial Sequence
  Synthetic DNA
taaaacgactcactaacg

SEQ ID NO: 12183 - DNA, 18 bp, Artificial Sequence
  Synthetic DNA
taatacaactcatcatag

SEQ ID NO: 12184 - DNA, 18 bp, Artificial Sequence
  Synthetic DNA
taatacgaataactaaag

SEQ ID NO: 12185 - DNA, 18 bp, Artificial Sequence
  Synthetic DNA
taatacgacacgctttag

SEQ ID NO: 12186 - DNA, 18 bp, Artificial Sequence
  Synthetic DNA
taatacgatttgctatag

SEQ ID NO: 12187 - DNA, 18 bp, Artificial Sequence
  Synthetic DNA
taatactactctctacag

SEQ ID NO: 12188 - DNA, 18 bp, Artificial Sequence
  Synthetic DNA
taatactattcgctatag

SEQ ID NO: 12189 - DNA, 18 bp, Artificial Sequence
  Synthetic DNA
tagttagactcactatag

SEQ ID NO: 12190 - DNA, 18 bp, Artificial Sequence
  Synthetic DNA
tatttcgactgactatag

SEQ ID NO: 12191 - DNA, 18 bp, Artificial Sequence
  Synthetic DNA
ttctacgaatcactatag

SEQ ID NO: 12192 - DNA, 18 bp, Artificial Sequence
  Synthetic DNA
taaaacgactttctatag

SEQ ID NO: 12193 - DNA, 18 bp, Artificial Sequence
  Synthetic DNA
ttataagacacactatag

SEQ ID NO: 12194 - DNA, 18 bp, Artificial Sequence
  Synthetic DNA
aaatatgagtcactatag

SEQ ID NO: 12195 - DNA, 18 bp, Artificial Sequence
  Synthetic DNA
taatacaactcaccaaag

SEQ ID NO: 12196 - DNA, 18 bp, Artificial Sequence
  Synthetic DNA
taatacgaatcaccaaag

SEQ ID NO: 12197 - DNA, 18 bp, Artificial Sequence
  Synthetic DNA
taatacgccttactttag

SEQ ID NO: 12198 - DNA, 18 bp, Artificial Sequence
  Synthetic DNA
taatactaatcaatatag

SEQ ID NO: 12199 - DNA, 18 bp, Artificial Sequence
  Synthetic DNA
tcatacaactcactattg

SEQ ID NO: 12200 - DNA, 18 bp, Artificial Sequence
  Synthetic DNA
taatacgatacactaaag

SEQ ID NO: 12201 - DNA, 18 bp, Artificial Sequence
  Synthetic DNA
aaatgcgactctctatag

SEQ ID NO: 12202 - DNA, 18 bp, Artificial Sequence
  Synthetic DNA
taataagaaacactatag

SEQ ID NO: 12203 - DNA, 18 bp, Artificial Sequence
  Synthetic DNA
taatacgatatactatag

SEQ ID NO: 12204 - DNA, 18 bp, Artificial Sequence
  Synthetic DNA
taattctactaactatag

SEQ ID NO: 12205 - DNA, 18 bp, Artificial Sequence
  Synthetic DNA
taatacgtcacaccatag

SEQ ID NO: 12206 - DNA, 18 bp, Artificial Sequence
  Synthetic DNA
ttatacaactaactatag

SEQ ID NO: 12207 - DNA, 18 bp, Artificial Sequence
  Synthetic DNA
ttatacttctcactatag

SEQ ID NO: 12208 - DNA, 18 bp, Artificial Sequence
  Synthetic DNA
aaatacgactgactttag

SEQ ID NO: 12209 - DNA, 18 bp, Artificial Sequence
  Synthetic DNA
taatacgactatttatag

SEQ ID NO: 12210 - DNA, 18 bp, Artificial Sequence
  Synthetic DNA
taatacgactctttatgg

SEQ ID NO: 12211 - DNA, 18 bp, Artificial Sequence
  Synthetic DNA
taatacgtctacctatag

SEQ ID NO: 12212 - DNA, 18 bp, Artificial Sequence
  Synthetic DNA
taatacgtctctcgatag

SEQ ID NO: 12213 - DNA, 18 bp, Artificial Sequence
  Synthetic DNA
taatactactgacaatag

SEQ ID NO: 12214 - DNA, 18 bp, Artificial Sequence
  Synthetic DNA
ttacacgacttactatag

SEQ ID NO: 12215 - DNA, 18 bp, Artificial Sequence
  Synthetic DNA
ttatacgacctactatag

SEQ ID NO: 12216 - DNA, 18 bp, Artificial Sequence
  Synthetic DNA
taatacgtctaactttag

SEQ ID NO: 12217 - DNA, 18 bp, Artificial Sequence
  Synthetic DNA
taatacgtcttactttag

SEQ ID NO: 12218 - DNA, 18 bp, Artificial Sequence
  Synthetic DNA
taatatgacacactttag

SEQ ID NO: 12219 - DNA, 18 bp, Artificial Sequence
  Synthetic DNA
taatacgattcaatattg

SEQ ID NO: 12220 - DNA, 18 bp, Artificial Sequence
  Synthetic DNA
taatacaactaactaaag

SEQ ID NO: 12221 - DNA, 18 bp, Artificial Sequence
  Synthetic DNA
taataccactatctatag

SEQ ID NO: 12222 - DNA, 18 bp, Artificial Sequence
  Synthetic DNA
taatacgaataactttag

SEQ ID NO: 12223 - DNA, 18 bp, Artificial Sequence
  Synthetic DNA
taatacgactaaccttag

SEQ ID NO: 12224 - DNA, 18 bp, Artificial Sequence
  Synthetic DNA
taattcgacttactacag

SEQ ID NO: 12225 - DNA, 18 bp, Artificial Sequence
  Synthetic DNA
taattctactcaatatag

SEQ ID NO: 12226 - DNA, 18 bp, Artificial Sequence
  Synthetic DNA
tcatacgactcactgaag

SEQ ID NO: 12227 - DNA, 18 bp, Artificial Sequence
  Synthetic DNA
ttctacgactcacaatag

SEQ ID NO: 12228 - DNA, 18 bp, Artificial Sequence
  Synthetic DNA
taatacgattaactattg

SEQ ID NO: 12229 - DNA, 18 bp, Artificial Sequence
  Synthetic DNA
taatacgactcatattag

SEQ ID NO: 12230 - DNA, 18 bp, Artificial Sequence
  Synthetic DNA
aaatacgagtcactttag

SEQ ID NO: 12231 - DNA, 18 bp, Artificial Sequence
  Synthetic DNA
taatacaactccctttag

SEQ ID NO: 12232 - DNA, 18 bp, Artificial Sequence
  Synthetic DNA
taatacgacttaatattg

SEQ ID NO: 12233 - DNA, 18 bp, Artificial Sequence
  Synthetic DNA
taattcgaaacactatag

SEQ ID NO: 12234 - DNA, 18 bp, Artificial Sequence
  Synthetic DNA
tactatgtctcactatag

SEQ ID NO: 12235 - DNA, 18 bp, Artificial Sequence
  Synthetic DNA
tagtacgagtcactattg

SEQ ID NO: 12236 - DNA, 18 bp, Artificial Sequence
  Synthetic DNA
tcatactacttactatag

SEQ ID NO: 12237 - DNA, 18 bp, Artificial Sequence
  Synthetic DNA
taataagacactctatag

SEQ ID NO: 12238 - DNA, 18 bp, Artificial Sequence
  Synthetic DNA
tattacgacacacaatag

SEQ ID NO: 12239 - DNA, 18 bp, Artificial Sequence
  Synthetic DNA
aaatacgaatctctatag

SEQ ID NO: 12240 - DNA, 18 bp, Artificial Sequence
  Synthetic DNA
taaaacgactcgcaatag

SEQ ID NO: 12241 - DNA, 18 bp, Artificial Sequence
  Synthetic DNA
tcataccacacactatag

SEQ ID NO: 12242 - DNA, 18 bp, Artificial Sequence
  Synthetic DNA
caatatgattcactatag

SEQ ID NO: 12243 - DNA, 18 bp, Artificial Sequence
  Synthetic DNA
taaaacgagtctctatag

SEQ ID NO: 12244 - DNA, 18 bp, Artificial Sequence
  Synthetic DNA
taataccactcattaaag

SEQ ID NO: 12245 - DNA, 18 bp, Artificial Sequence
  Synthetic DNA
taatacgactacttatag

SEQ ID NO: 12246 - DNA, 18 bp, Artificial Sequence
  Synthetic DNA
taatacgactatccatag

SEQ ID NO: 12247 - DNA, 18 bp, Artificial Sequence
  Synthetic DNA
taattcgattaactatag

SEQ ID NO: 12248 - DNA, 18 bp, Artificial Sequence
  Synthetic DNA
tcatacgattcattatag

SEQ ID NO: 12249 - DNA, 18 bp, Artificial Sequence
  Synthetic DNA
ttatacgacccactattg

SEQ ID NO: 12250 - DNA, 18 bp, Artificial Sequence
  Synthetic DNA
aaatacgaaacactatag

SEQ ID NO: 12251 - DNA, 18 bp, Artificial Sequence
  Synthetic DNA
taatacgaatctatatag

SEQ ID NO: 12252 - DNA, 18 bp, Artificial Sequence
  Synthetic DNA
taatacggctcacttaag

SEQ ID NO: 12253 - DNA, 18 bp, Artificial Sequence
  Synthetic DNA
taatacgtctaaatatag

SEQ ID NO: 12254 - DNA, 18 bp, Artificial Sequence
  Synthetic DNA
tacttcgactctctatag

SEQ ID NO: 12255 - DNA, 18 bp, Artificial Sequence
  Synthetic DNA
tattaagactaactatag

SEQ ID NO: 12256 - DNA, 18 bp, Artificial Sequence
  Synthetic DNA
tattatgattcactatag

SEQ ID NO: 12257 - DNA, 18 bp, Artificial Sequence
  Synthetic DNA
aaatacgacacacaatag

SEQ ID NO: 12258 - DNA, 18 bp, Artificial Sequence
  Synthetic DNA
ttatagtactcactatag

SEQ ID NO: 12259 - DNA, 18 bp, Artificial Sequence
  Synthetic DNA
taacacgacactctatag

SEQ ID NO: 12260 - DNA, 18 bp, Artificial Sequence
  Synthetic DNA
taataccaatcacaatag

SEQ ID NO: 12261 - DNA, 18 bp, Artificial Sequence
  Synthetic DNA
taatacggctaactattg

SEQ ID NO: 12262 - DNA, 18 bp, Artificial Sequence
  Synthetic DNA
taatacggctctctttag

SEQ ID NO: 12263 - DNA, 18 bp, Artificial Sequence
  Synthetic DNA
taatactactcataatag

SEQ ID NO: 12264 - DNA, 18 bp, Artificial Sequence
  Synthetic DNA
tattatgactcactatgg

SEQ ID NO: 12265 - DNA, 18 bp, Artificial Sequence
  Synthetic DNA
tgatacgattctctatag

SEQ ID NO: 12266 - DNA, 18 bp, Artificial Sequence
  Synthetic DNA
ttatacgaatcactatgg

SEQ ID NO: 12267 - DNA, 18 bp, Artificial Sequence
  Synthetic DNA
ttatccgattcactatag

SEQ ID NO: 12268 - DNA, 18 bp, Artificial Sequence
  Synthetic DNA
taaaactactcactaaag

SEQ ID NO: 12269 - DNA, 18 bp, Artificial Sequence
  Synthetic DNA
taaaacgtctctctatag

SEQ ID NO: 12270 - DNA, 18 bp, Artificial Sequence
  Synthetic DNA
aaatacgactaactacag

SEQ ID NO: 12271 - DNA, 18 bp, Artificial Sequence
  Synthetic DNA
taaaacgacacactacag

SEQ ID NO: 12272 - DNA, 18 bp, Artificial Sequence
  Synthetic DNA
taatactactcaatatcg

SEQ ID NO: 12273 - DNA, 18 bp, Artificial Sequence
  Synthetic DNA
taataggattcactttag

SEQ ID NO: 12274 - DNA, 18 bp, Artificial Sequence
  Synthetic DNA
ttgtacgaatcactatag

SEQ ID NO: 12275 - DNA, 18 bp, Artificial Sequence
  Synthetic DNA
taaaacaacttactatag

SEQ ID NO: 12276 - DNA, 18 bp, Artificial Sequence
  Synthetic DNA
taacacgattcactaaag

SEQ ID NO: 12277 - DNA, 18 bp, Artificial Sequence
  Synthetic DNA
taatacggctctctaaag

SEQ ID NO: 12278 - DNA, 18 bp, Artificial Sequence
  Synthetic DNA
ttctacgtctcactatag

SEQ ID NO: 12279 - DNA, 18 bp, Artificial Sequence
  Synthetic DNA
aaatacgattaactatag

SEQ ID NO: 12280 - DNA, 18 bp, Artificial Sequence
  Synthetic DNA
caatacttctcactatag

SEQ ID NO: 12281 - DNA, 18 bp, Artificial Sequence
  Synthetic DNA
taaaacgattcaatatag

SEQ ID NO: 12282 - DNA, 18 bp, Artificial Sequence
  Synthetic DNA
taacacaactctctatag

SEQ ID NO: 12283 - DNA, 18 bp, Artificial Sequence
  Synthetic DNA
taatatgactctctatcg

SEQ ID NO: 12284 - DNA, 18 bp, Artificial Sequence
  Synthetic DNA
tatttcgactccctatag

SEQ ID NO: 12285 - DNA, 18 bp, Artificial Sequence
  Synthetic DNA
tcattcgacacactatag

SEQ ID NO: 12286 - DNA, 18 bp, Artificial Sequence
  Synthetic DNA
tcttacgactcaatatag

SEQ ID NO: 12287 - DNA, 18 bp, Artificial Sequence
  Synthetic DNA
ttatacgagttactatag

SEQ ID NO: 12288 - DNA, 18 bp, Artificial Sequence
  Synthetic DNA
caatacgattcactaaag

SEQ ID NO: 12289 - DNA, 18 bp, Artificial Sequence
  Synthetic DNA
taatacgtttcactctag

SEQ ID NO: 12290 - DNA, 18 bp, Artificial Sequence
  Synthetic DNA
taattcgacttaatatag

SEQ ID NO: 12291 - DNA, 18 bp, Artificial Sequence
  Synthetic DNA
aaatatgattcactatag

SEQ ID NO: 12292 - DNA, 18 bp, Artificial Sequence
  Synthetic DNA
taacacgattcacaatag

SEQ ID NO: 12293 - DNA, 18 bp, Artificial Sequence
  Synthetic DNA
tactacgaataactatag

SEQ ID NO: 12294 - DNA, 18 bp, Artificial Sequence
  Synthetic DNA
tatcacgactcactacag

SEQ ID NO: 12295 - DNA, 18 bp, Artificial Sequence
  Synthetic DNA
tattactactcactttag

SEQ ID NO: 12296 - DNA, 18 bp, Artificial Sequence
  Synthetic DNA
caataatactcactatag

SEQ ID NO: 12297 - DNA, 18 bp, Artificial Sequence
  Synthetic DNA
taatacgtcaccctatag

SEQ ID NO: 12298 - DNA, 18 bp, Artificial Sequence
  Synthetic DNA
taattccactcactattg

SEQ ID NO: 12299 - DNA, 18 bp, Artificial Sequence
  Synthetic DNA
taattccactctctatag

SEQ ID NO: 12300 - DNA, 18 bp, Artificial Sequence
  Synthetic DNA
taattcgacacagtatag

SEQ ID NO: 12301 - DNA, 18 bp, Artificial Sequence
  Synthetic DNA
taattcgaccctctatag

SEQ ID NO: 12302 - DNA, 18 bp, Artificial Sequence
  Synthetic DNA
tattacgactgtctatag

SEQ ID NO: 12303 - DNA, 18 bp, Artificial Sequence
  Synthetic DNA
taatacaacactctatag

SEQ ID NO: 12304 - DNA, 18 bp, Artificial Sequence
  Synthetic DNA
aagtacgactctctatag

SEQ ID NO: 12305 - DNA, 18 bp, Artificial Sequence
  Synthetic DNA
taacactactcactaaag

SEQ ID NO: 12306 - DNA, 18 bp, Artificial Sequence
  Synthetic DNA
taatacaaatcaatatag

SEQ ID NO: 12307 - DNA, 18 bp, Artificial Sequence
  Synthetic DNA
taataccacacactattg

SEQ ID NO: 12308 - DNA, 18 bp, Artificial Sequence
  Synthetic DNA
taatacgacataatatag

SEQ ID NO: 12309 - DNA, 18 bp, Artificial Sequence
  Synthetic DNA
ttatacgactcaatatcg

SEQ ID NO: 12310 - DNA, 18 bp, Artificial Sequence
  Synthetic DNA
taataagactcaaaatag

SEQ ID NO: 12311 - DNA, 18 bp, Artificial Sequence
  Synthetic DNA
taatacaactgtctatag

SEQ ID NO: 12312 - DNA, 18 bp, Artificial Sequence
  Synthetic DNA
taatacgtctcagtattg

SEQ ID NO: 12313 - DNA, 18 bp, Artificial Sequence
  Synthetic DNA
taatccgaatcactattg

SEQ ID NO: 12314 - DNA, 18 bp, Artificial Sequence
  Synthetic DNA
ttattccactcactatag

SEQ ID NO: 12315 - DNA, 18 bp, Artificial Sequence
  Synthetic DNA
taatacgactagcaatag

SEQ ID NO: 12316 - DNA, 18 bp, Artificial Sequence
  Synthetic DNA
tattaacactcactatag

SEQ ID NO: 12317 - DNA, 18 bp, Artificial Sequence
  Synthetic DNA
tattatgactcattatag

SEQ ID NO: 12318 - DNA, 18 bp, Artificial Sequence
  Synthetic DNA
ttatacgactccctaaag

SEQ ID NO: 12319 - DNA, 18 bp, Artificial Sequence
  Synthetic DNA
aaatacgactctatatag

SEQ ID NO: 12320 - DNA, 18 bp, Artificial Sequence
  Synthetic DNA
taaaacgattcactctag

SEQ ID NO: 12321 - DNA, 18 bp, Artificial Sequence
  Synthetic DNA
taacacgactcaatttag

SEQ ID NO: 12322 - DNA, 18 bp, Artificial Sequence
  Synthetic DNA
taatatgactctccatag

SEQ ID NO: 12323 - DNA, 18 bp, Artificial Sequence
  Synthetic DNA
taattcgacttattatag

SEQ ID NO: 12324 - DNA, 18 bp, Artificial Sequence
  Synthetic DNA
tcatacgtctcaatatag

SEQ ID NO: 12325 - DNA, 18 bp, Artificial Sequence
  Synthetic DNA
ttatacggctctctatag

SEQ ID NO: 12326 - DNA, 18 bp, Artificial Sequence
  Synthetic DNA
aaataagactcattatag

SEQ ID NO: 12327 - DNA, 18 bp, Artificial Sequence
  Synthetic DNA
taatacgattcacaacag

SEQ ID NO: 12328 - DNA, 18 bp, Artificial Sequence
  Synthetic DNA
tagtacgacttactttag

SEQ ID NO: 12329 - DNA, 18 bp, Artificial Sequence
  Synthetic DNA
ttatacgactcaacatag

SEQ ID NO: 12330 - DNA, 18 bp, Artificial Sequence
  Synthetic DNA
taatacgatacactttag

SEQ ID NO: 12331 - DNA, 18 bp, Artificial Sequence
  Synthetic DNA
aaatacgactaactaaag

SEQ ID NO: 12332 - DNA, 18 bp, Artificial Sequence
  Synthetic DNA
taaaatgacacactatag

SEQ ID NO: 12333 - DNA, 18 bp, Artificial Sequence
  Synthetic DNA
taatacgtcttactctag

SEQ ID NO: 12334 - DNA, 18 bp, Artificial Sequence
  Synthetic DNA
tattacgacacactatcg

SEQ ID NO: 12335 - DNA, 18 bp, Artificial Sequence
  Synthetic DNA
tattacgacacattatag

SEQ ID NO: 12336 - DNA, 18 bp, Artificial Sequence
  Synthetic DNA
tgatacgactcattttag

SEQ ID NO: 12337 - DNA, 18 bp, Artificial Sequence
  Synthetic DNA
ttatacgagtcacaatag

SEQ ID NO: 12338 - DNA, 18 bp, Artificial Sequence
  Synthetic DNA
taaaacaattcactatag

SEQ ID NO: 12339 - DNA, 18 bp, Artificial Sequence
  Synthetic DNA
aaatgcgactcattatag

SEQ ID NO: 12340 - DNA, 18 bp, Artificial Sequence
  Synthetic DNA
taaatcgactcaccatag

SEQ ID NO: 12341 - DNA, 18 bp, Artificial Sequence
  Synthetic DNA
taacactactcactattg

SEQ ID NO: 12342 - DNA, 18 bp, Artificial Sequence
  Synthetic DNA
taataagactatctatag

SEQ ID NO: 12343 - DNA, 18 bp, Artificial Sequence
  Synthetic DNA
taataagattcactaaag

SEQ ID NO: 12344 - DNA, 18 bp, Artificial Sequence
  Synthetic DNA
ttatacgattcactatgg

SEQ ID NO: 12345 - DNA, 18 bp, Artificial Sequence
  Synthetic DNA
ttatacgtcccactatag

SEQ ID NO: 12346 - DNA, 18 bp, Artificial Sequence
  Synthetic DNA
aaatacgacacattatag

SEQ ID NO: 12347 - DNA, 18 bp, Artificial Sequence
  Synthetic DNA
taatacgactatatatag

SEQ ID NO: 12348 - DNA, 18 bp, Artificial Sequence
  Synthetic DNA
taatacgactctatctag

SEQ ID NO: 12349 - DNA, 18 bp, Artificial Sequence
  Synthetic DNA
taatccatctcactatag

SEQ ID NO: 12350 - DNA, 18 bp, Artificial Sequence
  Synthetic DNA
tcatacgtctcacaatag

SEQ ID NO: 12351 - DNA, 18 bp, Artificial Sequence
  Synthetic DNA
taatacgaatcacaaaag

SEQ ID NO: 12352 - DNA, 18 bp, Artificial Sequence
  Synthetic DNA
taattcgattctctatag

SEQ ID NO: 12353 - DNA, 18 bp, Artificial Sequence
  Synthetic DNA
taatacgtcacactagag

SEQ ID NO: 12354 - DNA, 18 bp, Artificial Sequence
  Synthetic DNA
tgattcgacacactatag

SEQ ID NO: 12355 - DNA, 18 bp, Artificial Sequence
  Synthetic DNA
ttatatgactcaccatag

SEQ ID NO: 12356 - DNA, 18 bp, Artificial Sequence
  Synthetic DNA
ctatacgactcattatag

SEQ ID NO: 12357 - DNA, 18 bp, Artificial Sequence
  Synthetic DNA
tacaacgactcactattg

SEQ ID NO: 12358 - DNA, 18 bp, Artificial Sequence
  Synthetic DNA
aaatacgactctctaaag

SEQ ID NO: 12359 - DNA, 18 bp, Artificial Sequence
  Synthetic DNA
taatacgacacattattg

SEQ ID NO: 12360 - DNA, 18 bp, Artificial Sequence
  Synthetic DNA
taatacgattaacaatag

SEQ ID NO: 12361 - DNA, 18 bp, Artificial Sequence
  Synthetic DNA
taatacgtctcactcttg

SEQ ID NO: 12362 - DNA, 18 bp, Artificial Sequence
  Synthetic DNA
taataactctcactatag

SEQ ID NO: 12363 - DNA, 18 bp, Artificial Sequence
  Synthetic DNA
taatacgacttactttcg

SEQ ID NO: 12364 - DNA, 18 bp, Artificial Sequence
  Synthetic DNA
taatacgattcattacag

SEQ ID NO: 12365 - DNA, 18 bp, Artificial Sequence
  Synthetic DNA
taatacgattccctttag

SEQ ID NO: 12366 - DNA, 18 bp, Artificial Sequence
  Synthetic DNA
taatactactctccatag

SEQ ID NO: 12367 - DNA, 18 bp, Artificial Sequence
  Synthetic DNA
ctatacgattcactatag

SEQ ID NO: 12368 - DNA, 18 bp, Artificial Sequence
  Synthetic DNA
taatacgactaaatttag

SEQ ID NO: 12369 - DNA, 18 bp, Artificial Sequence
  Synthetic DNA
tgatacgtctcacaatag

SEQ ID NO: 12370 - DNA, 18 bp, Artificial Sequence
  Synthetic DNA
taataagactcacattag

SEQ ID NO: 12371 - DNA, 18 bp, Artificial Sequence
  Synthetic DNA
taacactactcactttag

SEQ ID NO: 12372 - DNA, 18 bp, Artificial Sequence
  Synthetic DNA
taatacgtttcactacag

SEQ ID NO: 12373 - DNA, 18 bp, Artificial Sequence
  Synthetic DNA
taataggtttcactatag

SEQ ID NO: 12374 - DNA, 18 bp, Artificial Sequence
  Synthetic DNA
taatatgatacactatag

SEQ ID NO: 12375 - DNA, 18 bp, Artificial Sequence
  Synthetic DNA
tactacttctcactatag

SEQ ID NO: 12376 - DNA, 18 bp, Artificial Sequence
  Synthetic DNA
tcaaacgactcactttag

SEQ ID NO: 12377 - DNA, 18 bp, Artificial Sequence
  Synthetic DNA
ttatccgactcattatag

SEQ ID NO: 12378 - DNA, 18 bp, Artificial Sequence
  Synthetic DNA
ttatacgactcattttag

SEQ ID NO: 12379 - DNA, 18 bp, Artificial Sequence
  Synthetic DNA
taattccacttactatag

SEQ ID NO: 12380 - DNA, 18 bp, Artificial Sequence
  Synthetic DNA
aaataagactcactattg

SEQ ID NO: 12381 - DNA, 18 bp, Artificial Sequence
  Synthetic DNA
acatacgtctcactatag

SEQ ID NO: 12382 - DNA, 18 bp, Artificial Sequence
  Synthetic DNA
ttatacgacacactatgg

SEQ ID NO: 12383 - DNA, 18 bp, Artificial Sequence
  Synthetic DNA
aaatatgactcactaaag

SEQ ID NO: 12384 - DNA, 18 bp, Artificial Sequence
  Synthetic DNA
taaaccgactcacaatag

SEQ ID NO: 12385 - DNA, 18 bp, Artificial Sequence
  Synthetic DNA
ttatacgactaattatag

SEQ ID NO: 12386 - DNA, 18 bp, Artificial Sequence
  Synthetic DNA
taatacatcacactatag

SEQ ID NO: 12387 - DNA, 18 bp, Artificial Sequence
  Synthetic DNA
taactcgactctctatag

SEQ ID NO: 12388 - DNA, 18 bp, Artificial Sequence
  Synthetic DNA
taattcgactcccaatag

SEQ ID NO: 12389 - DNA, 18 bp, Artificial Sequence
  Synthetic DNA
taaatcgacttactatag

SEQ ID NO: 12390 - DNA, 18 bp, Artificial Sequence
  Synthetic DNA
taatatgattcaatatag

SEQ ID NO: 12391 - DNA, 18 bp, Artificial Sequence
  Synthetic DNA
taatccgactctcaatag

SEQ ID NO: 12392 - DNA, 18 bp, Artificial Sequence
  Synthetic DNA
ttcttcgactcactatag

SEQ ID NO: 12393 - DNA, 18 bp, Artificial Sequence
  Synthetic DNA
taaaacgacacattatag

SEQ ID NO: 12394 - DNA, 18 bp, Artificial Sequence
  Synthetic DNA
tgatacgacacacaatag

SEQ ID NO: 12395 - DNA, 18 bp, Artificial Sequence
  Synthetic DNA
taatacaattcactttag

SEQ ID NO: 12396 - DNA, 18 bp, Artificial Sequence
  Synthetic DNA
tattacaactcattatag

SEQ ID NO: 12397 - DNA, 18 bp, Artificial Sequence
  Synthetic DNA
tattactactcactatcg

SEQ ID NO: 12398 - DNA, 18 bp, Artificial Sequence
  Synthetic DNA
taatacgactgactaatg

SEQ ID NO: 12399 - DNA, 18 bp, Artificial Sequence
  Synthetic DNA
ctatactactcactatag

SEQ ID NO: 12400 - DNA, 18 bp, Artificial Sequence
  Synthetic DNA
tataacgactcaccatag

SEQ ID NO: 12401 - DNA, 18 bp, Artificial Sequence
  Synthetic DNA
tcttacgactctctatag

SEQ ID NO: 12402 - DNA, 18 bp, Artificial Sequence
  Synthetic DNA
ttatactactccctatag

SEQ ID NO: 12403 - DNA, 18 bp, Artificial Sequence
  Synthetic DNA
tattaatactcactatag

SEQ ID NO: 12404 - DNA, 18 bp, Artificial Sequence
  Synthetic DNA
taaaatgactcattatag

SEQ ID NO: 12405 - DNA, 18 bp, Artificial Sequence
  Synthetic DNA
ttattcgacttactatag

SEQ ID NO: 12406 - DNA, 18 bp, Artificial Sequence
  Synthetic DNA
taatacaacatactatag

SEQ ID NO: 12407 - DNA, 18 bp, Artificial Sequence
  Synthetic DNA
taatacgatttattatag

SEQ ID NO: 12408 - DNA, 18 bp, Artificial Sequence
  Synthetic DNA
tattataactcactatag

SEQ ID NO: 12409 - DNA, 18 bp, Artificial Sequence
  Synthetic DNA
tattaagactcattatag

SEQ ID NO: 12410 - DNA, 18 bp, Artificial Sequence
  Synthetic DNA
ttataagattcactatag

SEQ ID NO: 12411 - DNA, 18 bp, Artificial Sequence
  Synthetic DNA
ttatacgattaactatag

SEQ ID NO: 12412 - DNA, 18 bp, Artificial Sequence
  Synthetic DNA
taatacgaaacactattg

SEQ ID NO: 12413 - DNA, 18 bp, Artificial Sequence
  Synthetic DNA
taatacgactcacacaag

SEQ ID NO: 12414 - DNA, 18 bp, Artificial Sequence
  Synthetic DNA
tcatacgactttctatag

SEQ ID NO: 12415 - DNA, 18 bp, Artificial Sequence
  Synthetic DNA
taatacaaatctctatag

SEQ ID NO: 12416 - DNA, 18 bp, Artificial Sequence
  Synthetic DNA
taatacgtcttattatag

SEQ ID NO: 12417 - DNA, 18 bp, Artificial Sequence
  Synthetic DNA
ttacactactcactatag

SEQ ID NO: 12418 - DNA, 18 bp, Artificial Sequence
  Synthetic DNA
aaaaactactcactatag

SEQ ID NO: 12419 - DNA, 18 bp, Artificial Sequence
  Synthetic DNA
taatacgattcattaaag

SEQ ID NO: 12420 - DNA, 18 bp, Artificial Sequence
  Synthetic DNA
ttgtacgactcactttag

SEQ ID NO: 12421 - DNA, 18 bp, Artificial Sequence
  Synthetic DNA
taatacgaaacactttag

SEQ ID NO: 12422 - DNA, 18 bp, Artificial Sequence
  Synthetic DNA
taatacgacatcctatag

SEQ ID NO: 12423 - DNA, 18 bp, Artificial Sequence
  Synthetic DNA
taataccactctctttag

SEQ ID NO: 12424 - DNA, 18 bp, Artificial Sequence
  Synthetic DNA
tattacgtcttactatag

SEQ ID NO: 12425 - DNA, 18 bp, Artificial Sequence
  Synthetic DNA
aaatacgaatcacaatag

SEQ ID NO: 12426 - DNA, 18 bp, Artificial Sequence
  Synthetic DNA
taatatgtctcacaatag

SEQ ID NO: 12427 - DNA, 18 bp, Artificial Sequence
  Synthetic DNA
taatacaactatctatag

SEQ ID NO: 12428 - DNA, 18 bp, Artificial Sequence
  Synthetic DNA
taaaacgaatcacaatag

SEQ ID NO: 12429 - DNA, 18 bp, Artificial Sequence
  Synthetic DNA
tactacgtctcactaaag

SEQ ID NO: 12430 - DNA, 18 bp, Artificial Sequence
  Synthetic DNA
taaaacgactcattttag

SEQ ID NO: 12431 - DNA, 18 bp, Artificial Sequence
  Synthetic DNA
taataccactcacattag

SEQ ID NO: 12432 - DNA, 18 bp, Artificial Sequence
  Synthetic DNA
taatacgacacaataaag

SEQ ID NO: 12433 - DNA, 18 bp, Artificial Sequence
  Synthetic DNA
taataccattcactattg

SEQ ID NO: 12434 - DNA, 18 bp, Artificial Sequence
  Synthetic DNA
aaaaacgattcactatag

SEQ ID NO: 12435 - DNA, 18 bp, Artificial Sequence
  Synthetic DNA
taattcgactctatatag

SEQ ID NO: 12436 - DNA, 18 bp, Artificial Sequence
  Synthetic DNA
ttatactactaactatag

SEQ ID NO: 12437 - DNA, 18 bp, Artificial Sequence
  Synthetic DNA
taatacgactctcaatcg

SEQ ID NO: 12438 - DNA, 18 bp, Artificial Sequence
  Synthetic DNA
tatcacgactcacaatag

SEQ ID NO: 12439 - DNA, 18 bp, Artificial Sequence
  Synthetic DNA
tattacgattcattatag

SEQ ID NO: 12440 - DNA, 18 bp, Artificial Sequence
  Synthetic DNA
taatacgactcataattg

SEQ ID NO: 12441 - DNA, 18 bp, Artificial Sequence
  Synthetic DNA
taatacgtcaaactatag

SEQ ID NO: 12442 - DNA, 18 bp, Artificial Sequence
  Synthetic DNA
ttatatgattcactatag

SEQ ID NO: 12443 - DNA, 18 bp, Artificial Sequence
  Synthetic DNA
taatacgacaaactaaag

SEQ ID NO: 12444 - DNA, 18 bp, Artificial Sequence
  Synthetic DNA
taatacaaatcactattg

SEQ ID NO: 12445 - DNA, 18 bp, Artificial Sequence
  Synthetic DNA
taatacgtctcattaaag

SEQ ID NO: 12446 - DNA, 18 bp, Artificial Sequence
  Synthetic DNA
taatacgtttcacaatag

SEQ ID NO: 12447 - DNA, 18 bp, Artificial Sequence
  Synthetic DNA
taatacgactcactgtcc

SEQ ID NO: 12448 - DNA, 18 bp, Artificial Sequence
  Synthetic DNA
tagtacggcgcactaaag

SEQ ID NO: 12449 - DNA, 18 bp, Artificial Sequence
  Synthetic DNA
taataaggctcactactg

SEQ ID NO: 12450 - DNA, 18 bp, Artificial Sequence
  Synthetic DNA
taattcgactcgccatcg

SEQ ID NO: 12451 - DNA, 18 bp, Artificial Sequence
  Synthetic DNA
taacgagagtcactatag

SEQ ID NO: 12452 - DNA, 18 bp, Artificial Sequence
  Synthetic DNA
ttatacgcatcactatcg

SEQ ID NO: 12453 - DNA, 18 bp, Artificial Sequence
  Synthetic DNA
taatgcgagccactaaag

SEQ ID NO: 12454 - DNA, 18 bp, Artificial Sequence
  Synthetic DNA
taatacaacgcgctattg

SEQ ID NO: 12455 - DNA, 18 bp, Artificial Sequence
  Synthetic DNA
taatacgcgacactttag

SEQ ID NO: 12456 - DNA, 18 bp, Artificial Sequence
  Synthetic DNA
taatctgactctctgtag

SEQ ID NO: 12457 - DNA, 18 bp, Artificial Sequence
  Synthetic DNA
tgttaggactcactaaag

SEQ ID NO: 12458 - DNA, 18 bp, Artificial Sequence
  Synthetic DNA
taaattgactcactatgg

SEQ ID NO: 12459 - DNA, 18 bp, Artificial Sequence
  Synthetic DNA
tgatacgacttagtacag

SEQ ID NO: 12460 - DNA, 18 bp, Artificial Sequence
  Synthetic DNA
taatatgacgcactaccg

SEQ ID NO: 12461 - DNA, 18 bp, Artificial Sequence
  Synthetic DNA
taatacgcctctccatcg

SEQ ID NO: 12462 - DNA, 18 bp, Artificial Sequence
  Synthetic DNA
aagtacagctcactatag

SEQ ID NO: 12463 - DNA, 18 bp, Artificial Sequence
  Synthetic DNA
taattcgactcacggttg

SEQ ID NO: 12464 - DNA, 18 bp, Artificial Sequence
  Synthetic DNA
taattcgactaactgcag

SEQ ID NO: 12465 - DNA, 18 bp, Artificial Sequence
  Synthetic DNA
taatacgcgtcactactg

SEQ ID NO: 12466 - DNA, 18 bp, Artificial Sequence
  Synthetic DNA
ttaaacgactcactaggg

SEQ ID NO: 12467 - DNA, 18 bp, Artificial Sequence
  Synthetic DNA
tgatatgtctcactatcg

SEQ ID NO: 12468 - DNA, 18 bp, Artificial Sequence
  Synthetic DNA
taatacaacacgctatcg

SEQ ID NO: 12469 - DNA, 18 bp, Artificial Sequence
  Synthetic DNA
ttattcgactcgctattg

SEQ ID NO: 12470 - DNA, 18 bp, Artificial Sequence
  Synthetic DNA
caatacgcctcgccatag

SEQ ID NO: 12471 - DNA, 18 bp, Artificial Sequence
  Synthetic DNA
taattggactcacttcag

SEQ ID NO: 12472 - DNA, 18 bp, Artificial Sequence
  Synthetic DNA
tactacgattcactgaag

SEQ ID NO: 12473 - DNA, 18 bp, Artificial Sequence
  Synthetic DNA
tactactactcactccag

SEQ ID NO: 12474 - DNA, 18 bp, Artificial Sequence
  Synthetic DNA
taattgaactcactctag

SEQ ID NO: 12475 - DNA, 18 bp, Artificial Sequence
  Synthetic DNA
cgttacgactcactaaag

SEQ ID NO: 12476 - DNA, 18 bp, Artificial Sequence
  Synthetic DNA
taaaacgactcaccaccg

SEQ ID NO: 12477 - DNA, 18 bp, Artificial Sequence
  Synthetic DNA
tcgtacgactctctatcg

SEQ ID NO: 12478 - DNA, 18 bp, Artificial Sequence
  Synthetic DNA
tgagaccactcgctatag

SEQ ID NO: 12479 - DNA, 18 bp, Artificial Sequence
  Synthetic DNA
ttttacgactcgctatcg

SEQ ID NO: 12480 - DNA, 18 bp, Artificial Sequence
  Synthetic DNA
ttattcgactcgccatag

SEQ ID NO: 12481 - DNA, 18 bp, Artificial Sequence
  Synthetic DNA
taatctgactcgctatcg

SEQ ID NO: 12482 - DNA, 18 bp, Artificial Sequence
  Synthetic DNA
taagacaactctctctag

SEQ ID NO: 12483 - DNA, 18 bp, Artificial Sequence
  Synthetic DNA
tgatacgactaacactag

SEQ ID NO: 12484 - DNA, 18 bp, Artificial Sequence
  Synthetic DNA
tggaacgactctctatag

SEQ ID NO: 12485 - DNA, 18 bp, Artificial Sequence
  Synthetic DNA
tcaatcgactcactatcg

SEQ ID NO: 12486 - DNA, 18 bp, Artificial Sequence
  Synthetic DNA
tcaatcgagtcactatag

SEQ ID NO: 12487 - DNA, 18 bp, Artificial Sequence
  Synthetic DNA
caattcgactcgctattg

SEQ ID NO: 12488 - DNA, 18 bp, Artificial Sequence
  Synthetic DNA
taatacaacacacactag

SEQ ID NO: 12489 - DNA, 18 bp, Artificial Sequence
  Synthetic DNA
taattcgactagctattg

SEQ ID NO: 12490 - DNA, 18 bp, Artificial Sequence
  Synthetic DNA
tgattcgactcgctattg

SEQ ID NO: 12491 - DNA, 18 bp, Artificial Sequence
  Synthetic DNA
gatatcgactcactatag

SEQ ID NO: 12492 - DNA, 18 bp, Artificial Sequence
  Synthetic DNA
tacttcgactcactaccg

SEQ ID NO: 12493 - DNA, 18 bp, Artificial Sequence
  Synthetic DNA
taatacgaatgacaacag

SEQ ID NO: 12494 - DNA, 18 bp, Artificial Sequence
  Synthetic DNA
taatacgcatcactaagg

SEQ ID NO: 12495 - DNA, 18 bp, Artificial Sequence
  Synthetic DNA
taataggactcactcagg

SEQ ID NO: 12496 - DNA, 18 bp, Artificial Sequence
  Synthetic DNA
tgattcgtcgcactatag

SEQ ID NO: 12497 - DNA, 18 bp, Artificial Sequence
  Synthetic DNA
taattagactcgctacag

SEQ ID NO: 12498 - DNA, 18 bp, Artificial Sequence
  Synthetic DNA
gtaaacgactcactagag

SEQ ID NO: 12499 - DNA, 18 bp, Artificial Sequence
  Synthetic DNA
taaaacgacgctctatcg

SEQ ID NO: 12500 - DNA, 18 bp, Artificial Sequence
  Synthetic DNA
ttaagcgactcactatcg

SEQ ID NO: 12501 - DNA, 18 bp, Artificial Sequence
  Synthetic DNA
taaaatgactcgctatcg

SEQ ID NO: 12502 - DNA, 18 bp, Artificial Sequence
  Synthetic DNA
ttattcgactcactaccg

SEQ ID NO: 12503 - DNA, 18 bp, Artificial Sequence
  Synthetic DNA
taaaaagtctcactatcg

SEQ ID NO: 12504 - DNA, 18 bp, Artificial Sequence
  Synthetic DNA
taatgcgcctcacttttg

SEQ ID NO: 12505 - DNA, 18 bp, Artificial Sequence
  Synthetic DNA
tattacgactcgctactg

SEQ ID NO: 12506 - DNA, 18 bp, Artificial Sequence
  Synthetic DNA
taatgcgtatcactttag

SEQ ID NO: 12507 - DNA, 18 bp, Artificial Sequence
  Synthetic DNA
ttttacgcctcactagag

SEQ ID NO: 12508 - DNA, 18 bp, Artificial Sequence
  Synthetic DNA
taataggtctgactattg

SEQ ID NO: 12509 - DNA, 18 bp, Artificial Sequence
  Synthetic DNA
taatgcgactcaccaatg

SEQ ID NO: 12510 - DNA, 18 bp, Artificial Sequence
  Synthetic DNA
taatacgtgtcactaaaa

SEQ ID NO: 12511 - DNA, 18 bp, Artificial Sequence
  Synthetic DNA
tactacgtcaaactatag

SEQ ID NO: 12512 - DNA, 18 bp, Artificial Sequence
  Synthetic DNA
tagtactactgactacag

SEQ ID NO: 12513 - DNA, 18 bp, Artificial Sequence
  Synthetic DNA
taatactgctcgctattg

SEQ ID NO: 12514 - DNA, 18 bp, Artificial Sequence
  Synthetic DNA
tattaagactcgctatcg

SEQ ID NO: 12515 - DNA, 18 bp, Artificial Sequence
  Synthetic DNA
taatgcgcatcactattg

SEQ ID NO: 12516 - DNA, 18 bp, Artificial Sequence
  Synthetic DNA
ctatacgactcactgaag

SEQ ID NO: 12517 - DNA, 18 bp, Artificial Sequence
  Synthetic DNA
aaattcgactcgctattg

SEQ ID NO: 12518 - DNA, 18 bp, Artificial Sequence
  Synthetic DNA
taaatcgactcaccatcg

SEQ ID NO: 12519 - DNA, 18 bp, Artificial Sequence
  Synthetic DNA
taatttgcatcactatag

SEQ ID NO: 12520 - DNA, 18 bp, Artificial Sequence
  Synthetic DNA
tgttaccactcacaatag

SEQ ID NO: 12521 - DNA, 18 bp, Artificial Sequence
  Synthetic DNA
taaggcgactcactactg

SEQ ID NO: 12522 - DNA, 18 bp, Artificial Sequence
  Synthetic DNA
ttacacgactcgctattg

SEQ ID NO: 12523 - DNA, 18 bp, Artificial Sequence
  Synthetic DNA
tatcaagaatcactatag

SEQ ID NO: 12524 - DNA, 18 bp, Artificial Sequence
  Synthetic DNA
ttttgcgactcactgtag

SEQ ID NO: 12525 - DNA, 18 bp, Artificial Sequence
  Synthetic DNA
taaatagactcactatcg

SEQ ID NO: 12526 - DNA, 18 bp, Artificial Sequence
  Synthetic DNA
taattcaactcactcaag

SEQ ID NO: 12527 - DNA, 18 bp, Artificial Sequence
  Synthetic DNA
ggagaagactcactatag

SEQ ID NO: 12528 - DNA, 18 bp, Artificial Sequence
  Synthetic DNA
taatacgactcttcgtag

SEQ ID NO: 12529 - DNA, 18 bp, Artificial Sequence
  Synthetic DNA
tagcacgattcactttag

SEQ ID NO: 12530 - DNA, 18 bp, Artificial Sequence
  Synthetic DNA
tagtacgtcttagtatag

SEQ ID NO: 12531 - DNA, 18 bp, Artificial Sequence
  Synthetic DNA
tataacgactcacgctag

SEQ ID NO: 12532 - DNA, 18 bp, Artificial Sequence
  Synthetic DNA
ttatacgaatctctgtag

SEQ ID NO: 12533 - DNA, 18 bp, Artificial Sequence
  Synthetic DNA
taattagactcactctgg

SEQ ID NO: 12534 - DNA, 18 bp, Artificial Sequence
  Synthetic DNA
taattggactcagtatcg

SEQ ID NO: 12535 - DNA, 18 bp, Artificial Sequence
  Synthetic DNA
taatacggcacgcaatag

SEQ ID NO: 12536 - DNA, 18 bp, Artificial Sequence
  Synthetic DNA
taattcgactcgatattg

SEQ ID NO: 12537 - DNA, 18 bp, Artificial Sequence
  Synthetic DNA
taataagactagccatag

SEQ ID NO: 12538 - DNA, 18 bp, Artificial Sequence
  Synthetic DNA
tcatgcgactcaaaatag

SEQ ID NO: 12539 - DNA, 18 bp, Artificial Sequence
  Synthetic DNA
ctatacgactcgccatag

SEQ ID NO: 12540 - DNA, 18 bp, Artificial Sequence
  Synthetic DNA
taataagacgcaatattg

SEQ ID NO: 12541 - DNA, 18 bp, Artificial Sequence
  Synthetic DNA
caatacgactcaggaaag

SEQ ID NO: 12542 - DNA, 18 bp, Artificial Sequence
  Synthetic DNA
taattcgagccactttag

SEQ ID NO: 12543 - DNA, 18 bp, Artificial Sequence
  Synthetic DNA
ttattcgactcactactg

SEQ ID NO: 12544 - DNA, 18 bp, Artificial Sequence
  Synthetic DNA
taatatggctcgctacag

SEQ ID NO: 12545 - DNA, 18 bp, Artificial Sequence
  Synthetic DNA
tagtgcgtctcactatgg

SEQ ID NO: 12546 - DNA, 18 bp, Artificial Sequence
  Synthetic DNA
ttatacaactcgctattg

SEQ ID NO: 12547 - DNA, 18 bp, Artificial Sequence
  Synthetic DNA
taattcgtctcgctattg

SEQ ID NO: 12548 - DNA, 18 bp, Artificial Sequence
  Synthetic DNA
taattggactcgccatag

SEQ ID NO: 12549 - DNA, 18 bp, Artificial Sequence
  Synthetic DNA
caatacgactcgctactg

SEQ ID NO: 12550 - DNA, 18 bp, Artificial Sequence
  Synthetic DNA
taatacgcctcgatattg

SEQ ID NO: 12551 - DNA, 18 bp, Artificial Sequence
  Synthetic DNA
caattcgcctcactaaag

SEQ ID NO: 12552 - DNA, 18 bp, Artificial Sequence
  Synthetic DNA
gaaatcgcctcactatag

SEQ ID NO: 12553 - DNA, 18 bp, Artificial Sequence
  Synthetic DNA
taacaggactctctattg

SEQ ID NO: 12554 - DNA, 18 bp, Artificial Sequence
  Synthetic DNA
taattgaactcactatcg

SEQ ID NO: 12555 - DNA, 18 bp, Artificial Sequence
  Synthetic DNA
ttatacaactcgctgtag

SEQ ID NO: 12556 - DNA, 18 bp, Artificial Sequence
  Synthetic DNA
ttgtacgactcactactg

SEQ ID NO: 12557 - DNA, 18 bp, Artificial Sequence
  Synthetic DNA
aattacgactcactcgag

SEQ ID NO: 12558 - DNA, 18 bp, Artificial Sequence
  Synthetic DNA
caatgcaactcactacag

SEQ ID NO: 12559 - DNA, 18 bp, Artificial Sequence
  Synthetic DNA
gaaagcgactcactaaag

SEQ ID NO: 12560 - DNA, 18 bp, Artificial Sequence
  Synthetic DNA
taatatcgctcactatcg

SEQ ID NO: 12561 - DNA, 18 bp, Artificial Sequence
  Synthetic DNA
tagtacgactcccttaag

SEQ ID NO: 12562 - DNA, 18 bp, Artificial Sequence
  Synthetic DNA
tattaagtgtcactatag

SEQ ID NO: 12563 - DNA, 18 bp, Artificial Sequence
  Synthetic DNA
tattatgactccctaaag

SEQ ID NO: 12564 - DNA, 18 bp, Artificial Sequence
  Synthetic DNA
taattcgactcgctacaa

SEQ ID NO: 12565 - DNA, 18 bp, Artificial Sequence
  Synthetic DNA
taatatctctcgctatag

SEQ ID NO: 12566 - DNA, 18 bp, Artificial Sequence
  Synthetic DNA
tattgcgactcaccaaag

SEQ ID NO: 12567 - DNA, 18 bp, Artificial Sequence
  Synthetic DNA
ttattcggctcactattg

SEQ ID NO: 12568 - DNA, 18 bp, Artificial Sequence
  Synthetic DNA
taatacacctcgctaaag

SEQ ID NO: 12569 - DNA, 18 bp, Artificial Sequence
  Synthetic DNA
taaaataactcactctag

SEQ ID NO: 12570 - DNA, 18 bp, Artificial Sequence
  Synthetic DNA
taatagccatcactatag

SEQ ID NO: 12571 - DNA, 18 bp, Artificial Sequence
  Synthetic DNA
tattgcgactgtctatag

SEQ ID NO: 12572 - DNA, 18 bp, Artificial Sequence
  Synthetic DNA
gaattcgactcactactg

SEQ ID NO: 12573 - DNA, 18 bp, Artificial Sequence
  Synthetic DNA
taattcgtctcactgttg

SEQ ID NO: 12574 - DNA, 18 bp, Artificial Sequence
  Synthetic DNA
tgattcgactcgctacag

SEQ ID NO: 12575 - DNA, 18 bp, Artificial Sequence
  Synthetic DNA
taataggtgtcactttag

SEQ ID NO: 12576 - DNA, 18 bp, Artificial Sequence
  Synthetic DNA
taattcggcccactaaag

SEQ ID NO: 12577 - DNA, 18 bp, Artificial Sequence
  Synthetic DNA
ttatttgactcactagag

SEQ ID NO: 12578 - DNA, 18 bp, Artificial Sequence
  Synthetic DNA
tatcgcgactcactgtag

SEQ ID NO: 12579 - DNA, 18 bp, Artificial Sequence
  Synthetic DNA
taaaacgtctcacttgag

SEQ ID NO: 12580 - DNA, 18 bp, Artificial Sequence
  Synthetic DNA
taatatgactcgctactg

SEQ ID NO: 12581 - DNA, 18 bp, Artificial Sequence
  Synthetic DNA
ttacacggctcactattg

SEQ ID NO: 12582 - DNA, 18 bp, Artificial Sequence
  Synthetic DNA
taatgctactctcgatag

SEQ ID NO: 12583 - DNA, 18 bp, Artificial Sequence
  Synthetic DNA
ctatacgactcgctatcg

SEQ ID NO: 12584 - DNA, 18 bp, Artificial Sequence
  Synthetic DNA
ttatgcgattcactttag

SEQ ID NO: 12585 - DNA, 18 bp, Artificial Sequence
  Synthetic DNA
taattcaactcgctattg

SEQ ID NO: 12586 - DNA, 18 bp, Artificial Sequence
  Synthetic DNA
taataagactcaatcttg

SEQ ID NO: 12587 - DNA, 18 bp, Artificial Sequence
  Synthetic DNA
ttttgcgactcactaaag

SEQ ID NO: 12588 - DNA, 18 bp, Artificial Sequence
  Synthetic DNA
tgattcgactcacaaaag

SEQ ID NO: 12589 - DNA, 18 bp, Artificial Sequence
  Synthetic DNA
ttatacgactcgctactg

SEQ ID NO: 12590 - DNA, 18 bp, Artificial Sequence
  Synthetic DNA
taataggactaactgttg

SEQ ID NO: 12591 - DNA, 18 bp, Artificial Sequence
  Synthetic DNA
taatacaacagactaaag

SEQ ID NO: 12592 - DNA, 18 bp, Artificial Sequence
  Synthetic DNA
taatacgaatcgctgttg

SEQ ID NO: 12593 - DNA, 18 bp, Artificial Sequence
  Synthetic DNA
taatcagactcgctattg

SEQ ID NO: 12594 - DNA, 18 bp, Artificial Sequence
  Synthetic DNA
taattcgactcactactt

SEQ ID NO: 12595 - DNA, 18 bp, Artificial Sequence
  Synthetic DNA
tatttcgactcgctatcg

SEQ ID NO: 12596 - DNA, 18 bp, Artificial Sequence
  Synthetic DNA
taattcgactcaaactag

SEQ ID NO: 12597 - DNA, 18 bp, Artificial Sequence
  Synthetic DNA
taattggactcactttgg

SEQ ID NO: 12598 - DNA, 18 bp, Artificial Sequence
  Synthetic DNA
tagaacgactcactagtg

SEQ ID NO: 12599 - DNA, 18 bp, Artificial Sequence
  Synthetic DNA
ttgttcgactcactgtag

SEQ ID NO: 12600 - DNA, 18 bp, Artificial Sequence
  Synthetic DNA
aaataaaactcactacag

SEQ ID NO: 12601 - DNA, 18 bp, Artificial Sequence
  Synthetic DNA
aaatgagactcactagag

SEQ ID NO: 12602 - DNA, 18 bp, Artificial Sequence
  Synthetic DNA
aagtacgacacaccatag

SEQ ID NO: 12603 - DNA, 18 bp, Artificial Sequence
  Synthetic DNA
taatacgacactctctcg

SEQ ID NO: 12604 - DNA, 18 bp, Artificial Sequence
  Synthetic DNA
taatacgactctttaccg

SEQ ID NO: 12605 - DNA, 18 bp, Artificial Sequence
  Synthetic DNA
tagtacgaatctctctag

SEQ ID NO: 12606 - DNA, 18 bp, Artificial Sequence
  Synthetic DNA
ttaagcgactcactctag

SEQ ID NO: 12607 - DNA, 18 bp, Artificial Sequence
  Synthetic DNA
ttacacgactcagtaaag

SEQ ID NO: 12608 - DNA, 18 bp, Artificial Sequence
  Synthetic DNA
ttacgcgactcactacag

SEQ ID NO: 12609 - DNA, 18 bp, Artificial Sequence
  Synthetic DNA
ttatgcgactcactgttg

SEQ ID NO: 12610 - DNA, 18 bp, Artificial Sequence
  Synthetic DNA
taatacgtttcaccatcg

SEQ ID NO: 12611 - DNA, 18 bp, Artificial Sequence
  Synthetic DNA
tagcacgtctcactaaag

SEQ ID NO: 12612 - DNA, 18 bp, Artificial Sequence
  Synthetic DNA
tcattcgactcgctaaag

SEQ ID NO: 12613 - DNA, 18 bp, Artificial Sequence
  Synthetic DNA
ttaagcgactcactaaag

SEQ ID NO: 12614 - DNA, 18 bp, Artificial Sequence
  Synthetic DNA
taattcgcctcactatta

SEQ ID NO: 12615 - DNA, 18 bp, Artificial Sequence
  Synthetic DNA
taattcgtctcactactg

SEQ ID NO: 12616 - DNA, 18 bp, Artificial Sequence
  Synthetic DNA
ttattcgactcgctaaag

SEQ ID NO: 12617 - DNA, 18 bp, Artificial Sequence
  Synthetic DNA
tagttcgactcgctatcg

SEQ ID NO: 12618 - DNA, 18 bp, Artificial Sequence
  Synthetic DNA
taatacgcatcactaatg

SEQ ID NO: 12619 - DNA, 18 bp, Artificial Sequence
  Synthetic DNA
aaattcgactcaccacag

SEQ ID NO: 12620 - DNA, 18 bp, Artificial Sequence
  Synthetic DNA
atatgcgactcactacag

SEQ ID NO: 12621 - DNA, 18 bp, Artificial Sequence
  Synthetic DNA
taaaacaactcactctgg

SEQ ID NO: 12622 - DNA, 18 bp, Artificial Sequence
  Synthetic DNA
taatacgaatgattatgg

SEQ ID NO: 12623 - DNA, 18 bp, Artificial Sequence
  Synthetic DNA
taatgagacctactatag

SEQ ID NO: 12624 - DNA, 18 bp, Artificial Sequence
  Synthetic DNA
taatgcgcctcacttaag

SEQ ID NO: 12625 - DNA, 18 bp, Artificial Sequence
  Synthetic DNA
taaaacgactcactcatg

SEQ ID NO: 12626 - DNA, 18 bp, Artificial Sequence
  Synthetic DNA
ttatcggactcgctatag

SEQ ID NO: 12627 - DNA, 18 bp, Artificial Sequence
  Synthetic DNA
taataggactctcgatgg

SEQ ID NO: 12628 - DNA, 18 bp, Artificial Sequence
  Synthetic DNA
ttttaggactcactgtag

SEQ ID NO: 12629 - DNA, 18 bp, Artificial Sequence
  Synthetic DNA
taaaacgactcgccattg

SEQ ID NO: 12630 - DNA, 18 bp, Artificial Sequence
  Synthetic DNA
taaaacggctcacattag

SEQ ID NO: 12631 - DNA, 18 bp, Artificial Sequence
  Synthetic DNA
ttaaacgcatcactatag

SEQ ID NO: 12632 - DNA, 18 bp, Artificial Sequence
  Synthetic DNA
taattagactcgccatag

SEQ ID NO: 12633 - DNA, 18 bp, Artificial Sequence
  Synthetic DNA
tactatgactaacgatag

SEQ ID NO: 12634 - DNA, 18 bp, Artificial Sequence
  Synthetic DNA
ttataggcatcactatag

SEQ ID NO: 12635 - DNA, 18 bp, Artificial Sequence
  Synthetic DNA
taatgcgcctcactaatg

SEQ ID NO: 12636 - DNA, 18 bp, Artificial Sequence
  Synthetic DNA
taattcaactcgctatcg

SEQ ID NO: 12637 - DNA, 18 bp, Artificial Sequence
  Synthetic DNA
taatatgacttattttag

SEQ ID NO: 12638 - DNA, 18 bp, Artificial Sequence
  Synthetic DNA
taaatcgactcgctaaag

SEQ ID NO: 12639 - DNA, 18 bp, Artificial Sequence
  Synthetic DNA
caattcgactcgccatag

SEQ ID NO: 12640 - DNA, 18 bp, Artificial Sequence
  Synthetic DNA
taattggactcggtatag

SEQ ID NO: 12641 - DNA, 18 bp, Artificial Sequence
  Synthetic DNA
aaatacgagccactattg

SEQ ID NO: 12642 - DNA, 18 bp, Artificial Sequence
  Synthetic DNA
taattggactcactccag

SEQ ID NO: 12643 - DNA, 18 bp, Artificial Sequence
  Synthetic DNA
taatccgtgtcattatag

SEQ ID NO: 12644 - DNA, 18 bp, Artificial Sequence
  Synthetic DNA
tgaaaagactcactctag

SEQ ID NO: 12645 - DNA, 18 bp, Artificial Sequence
  Synthetic DNA
taattcgactcgcttaag

SEQ ID NO: 12646 - DNA, 18 bp, Artificial Sequence
  Synthetic DNA
tgttacgactcgctattg

SEQ ID NO: 12647 - DNA, 18 bp, Artificial Sequence
  Synthetic DNA
cattaggactcacgatag

SEQ ID NO: 12648 - DNA, 18 bp, Artificial Sequence
  Synthetic DNA
aaattcgactcactactg

SEQ ID NO: 12649 - DNA, 18 bp, Artificial Sequence
  Synthetic DNA
ttattcgactcgctttag

SEQ ID NO: 12650 - DNA, 18 bp, Artificial Sequence
  Synthetic DNA
tttctcgactcactatag

SEQ ID NO: 12651 - DNA, 18 bp, Artificial Sequence
  Synthetic DNA
taatccgcgacactatag

SEQ ID NO: 12652 - DNA, 18 bp, Artificial Sequence
  Synthetic DNA
ttaaacgactcaatacag

SEQ ID NO: 12653 - DNA, 18 bp, Artificial Sequence
  Synthetic DNA
ttgtaagacgcactatag

SEQ ID NO: 12654 - DNA, 18 bp, Artificial Sequence
  Synthetic DNA
taacgcgtctcactattg

SEQ ID NO: 12655 - DNA, 18 bp, Artificial Sequence
  Synthetic DNA
tatttggactcactctag

SEQ ID NO: 12656 - DNA, 18 bp, Artificial Sequence
  Synthetic DNA
aaatacgcctcactactg

SEQ ID NO: 12657 - DNA, 18 bp, Artificial Sequence
  Synthetic DNA
tattacgagccactattg

SEQ ID NO: 12658 - DNA, 18 bp, Artificial Sequence
  Synthetic DNA
ttttacgactcactaccg

SEQ ID NO: 12659 - DNA, 18 bp, Artificial Sequence
  Synthetic DNA
tacttcgactcgctattg

SEQ ID NO: 12660 - DNA, 18 bp, Artificial Sequence
  Synthetic DNA
tattacgactcactctta

SEQ ID NO: 12661 - DNA, 18 bp, Artificial Sequence
  Synthetic DNA
agatacgactcactttcg

SEQ ID NO: 12662 - DNA, 18 bp, Artificial Sequence
  Synthetic DNA
taatataactcaccatcg

SEQ ID NO: 12663 - DNA, 18 bp, Artificial Sequence
  Synthetic DNA
aaattctactcgctatag

SEQ ID NO: 12664 - DNA, 18 bp, Artificial Sequence
  Synthetic DNA
aatttcgactcgctatag

SEQ ID NO: 12665 - DNA, 18 bp, Artificial Sequence
  Synthetic DNA
caattcgactcgctaaag

SEQ ID NO: 12666 - DNA, 18 bp, Artificial Sequence
  Synthetic DNA
taatgcgactagctattg

SEQ ID NO: 12667 - DNA, 18 bp, Artificial Sequence
  Synthetic DNA
taattcgactcgctgaag

SEQ ID NO: 12668 - DNA, 18 bp, Artificial Sequence
  Synthetic DNA
taattcgtctcactattt

SEQ ID NO: 12669 - DNA, 18 bp, Artificial Sequence
  Synthetic DNA
taattcgtctcgctacag

SEQ ID NO: 12670 - DNA, 18 bp, Artificial Sequence
  Synthetic DNA
tacttcgacgcactattg

SEQ ID NO: 12671 - DNA, 18 bp, Artificial Sequence
  Synthetic DNA
aaatacgcctcgctacag

SEQ ID NO: 12672 - DNA, 18 bp, Artificial Sequence
  Synthetic DNA
aatttcgactcactagag

SEQ ID NO: 12673 - DNA, 18 bp, Artificial Sequence
  Synthetic DNA
caatgcgactcactagtg

SEQ ID NO: 12674 - DNA, 18 bp, Artificial Sequence
  Synthetic DNA
caattagactcactagag

SEQ ID NO: 12675 - DNA, 18 bp, Artificial Sequence
  Synthetic DNA
cattacgactcgctacag

SEQ ID NO: 12676 - DNA, 18 bp, Artificial Sequence
  Synthetic DNA
cattccgactcgctatag

SEQ ID NO: 12677 - DNA, 18 bp, Artificial Sequence
  Synthetic DNA
gaataagactcacaattg

SEQ ID NO: 12678 - DNA, 18 bp, Artificial Sequence
  Synthetic DNA
taataaaactcgctatcg

SEQ ID NO: 12679 - DNA, 18 bp, Artificial Sequence
  Synthetic DNA
taatacgagccactcttg

SEQ ID NO: 12680 - DNA, 18 bp, Artificial Sequence
  Synthetic DNA
taataggacttgctatgg

SEQ ID NO: 12681 - DNA, 18 bp, Artificial Sequence
  Synthetic DNA
taatccgactcgatatcg

SEQ ID NO: 12682 - DNA, 18 bp, Artificial Sequence
  Synthetic DNA
taattaaactcactacag

SEQ ID NO: 12683 - DNA, 18 bp, Artificial Sequence
  Synthetic DNA
taattagactcactgaag

SEQ ID NO: 12684 - DNA, 18 bp, Artificial Sequence
  Synthetic DNA
taattcgaaccactatcg

SEQ ID NO: 12685 - DNA, 18 bp, Artificial Sequence
  Synthetic DNA
taattcgcgtcactctag

SEQ ID NO: 12686 - DNA, 18 bp, Artificial Sequence
  Synthetic DNA
taattggactcaaaatag

SEQ ID NO: 12687 - DNA, 18 bp, Artificial Sequence
  Synthetic DNA
tagaacgcctcgctatag

SEQ ID NO: 12688 - DNA, 18 bp, Artificial Sequence
  Synthetic DNA
tagttcgactctctatcg

SEQ ID NO: 12689 - DNA, 18 bp, Artificial Sequence
  Synthetic DNA
tattaagactcgccatag

SEQ ID NO: 12690 - DNA, 18 bp, Artificial Sequence
  Synthetic DNA
tattacggctcgctaaag

SEQ ID NO: 12691 - DNA, 18 bp, Artificial Sequence
  Synthetic DNA
tattaggactcactcttg

SEQ ID NO: 12692 - DNA, 18 bp, Artificial Sequence
  Synthetic DNA
tattccgactcgctatcg

SEQ ID NO: 12693 - DNA, 18 bp, Artificial Sequence
  Synthetic DNA
tattgcgactcgctaaag

SEQ ID NO: 12694 - DNA, 18 bp, Artificial Sequence
  Synthetic DNA
tatttcgactcactaccg

SEQ ID NO: 12695 - DNA, 18 bp, Artificial Sequence
  Synthetic DNA
tgttacgactcaccattg

SEQ ID NO: 12696 - DNA, 18 bp, Artificial Sequence
  Synthetic DNA
aaatacgactcactcagg

SEQ ID NO: 12697 - DNA, 18 bp, Artificial Sequence
  Synthetic DNA
aaatgcgactcactgtcg

SEQ ID NO: 12698 - DNA, 18 bp, Artificial Sequence
  Synthetic DNA
aattgcgactcactatcg

SEQ ID NO: 12699 - DNA, 18 bp, Artificial Sequence
  Synthetic DNA
acctgcgactcactatag

SEQ ID NO: 12700 - DNA, 18 bp, Artificial Sequence
  Synthetic DNA
atatgcgactcactgtag

SEQ ID NO: 12701 - DNA, 18 bp, Artificial Sequence
  Synthetic DNA
caaagcgactcactagag

SEQ ID NO: 12702 - DNA, 18 bp, Artificial Sequence
  Synthetic DNA
ccatacgactcagtatcg

SEQ ID NO: 12703 - DNA, 18 bp, Artificial Sequence
  Synthetic DNA
ctataccactcactatcg

SEQ ID NO: 12704 - DNA, 18 bp, Artificial Sequence
  Synthetic DNA
gaaaacgacttactgtag

SEQ ID NO: 12705 - DNA, 18 bp, Artificial Sequence
  Synthetic DNA
gaataggactcagtagag

SEQ ID NO: 12706 - DNA, 18 bp, Artificial Sequence
  Synthetic DNA
gaatgcgcctcactctag

SEQ ID NO: 12707 - DNA, 18 bp, Artificial Sequence
  Synthetic DNA
gattgcgtctcactatag

SEQ ID NO: 12708 - DNA, 18 bp, Artificial Sequence
  Synthetic DNA
taaaacgactcactcacg

SEQ ID NO: 12709 - DNA, 18 bp, Artificial Sequence
  Synthetic DNA
taaaacgagtcaacatag

SEQ ID NO: 12710 - DNA, 18 bp, Artificial Sequence
  Synthetic DNA
taaaaggactcactacgg

SEQ ID NO: 12711 - DNA, 18 bp, Artificial Sequence
  Synthetic DNA
taacactaatcaatatag

SEQ ID NO: 12712 - DNA, 18 bp, Artificial Sequence
  Synthetic DNA
taacatgactcagaatag

SEQ ID NO: 12713 - DNA, 18 bp, Artificial Sequence
  Synthetic DNA
taatacaactcacattaa

SEQ ID NO: 12714 - DNA, 18 bp, Artificial Sequence
  Synthetic DNA
taatacaacttactccag

SEQ ID NO: 12715 - DNA, 18 bp, Artificial Sequence
  Synthetic DNA
taatacgactcattgcgg

SEQ ID NO: 12716 - DNA, 18 bp, Artificial Sequence
  Synthetic DNA
taatacgagtcacatcag

SEQ ID NO: 12717 - DNA, 18 bp, Artificial Sequence
  Synthetic DNA
taatacgtcccactaagg

SEQ ID NO: 12718 - DNA, 18 bp, Artificial Sequence
  Synthetic DNA
taatactacttcctatgg

SEQ ID NO: 12719 - DNA, 18 bp, Artificial Sequence
  Synthetic DNA
taatatgactcaccgtcg

SEQ ID NO: 12720 - DNA, 18 bp, Artificial Sequence
  Synthetic DNA
taatcggccacactatag

SEQ ID NO: 12721 - DNA, 18 bp, Artificial Sequence
  Synthetic DNA
taatgcgtctctctataa

SEQ ID NO: 12722 - DNA, 18 bp, Artificial Sequence
  Synthetic DNA
taatgtgccttactatag

SEQ ID NO: 12723 - DNA, 18 bp, Artificial Sequence
  Synthetic DNA
tagaaggacacactatag

SEQ ID NO: 12724 - DNA, 18 bp, Artificial Sequence
  Synthetic DNA
tagtacgagttactttag

SEQ ID NO: 12725 - DNA, 18 bp, Artificial Sequence
  Synthetic DNA
tagtatgactcactgaag

SEQ ID NO: 12726 - DNA, 18 bp, Artificial Sequence
  Synthetic DNA
tataagaactcactatag

SEQ ID NO: 12727 - DNA, 18 bp, Artificial Sequence
  Synthetic DNA
tatcgcgagtcactatag

SEQ ID NO: 12728 - DNA, 18 bp, Artificial Sequence
  Synthetic DNA
tattaggactcacagtag

SEQ ID NO: 12729 - DNA, 18 bp, Artificial Sequence
  Synthetic DNA
tcatacgactctgaatag

SEQ ID NO: 12730 - DNA, 18 bp, Artificial Sequence
  Synthetic DNA
tcgtaccactcaatatag

SEQ ID NO: 12731 - DNA, 18 bp, Artificial Sequence
  Synthetic DNA
tcttacgtctcactacag

SEQ ID NO: 12732 - DNA, 18 bp, Artificial Sequence
  Synthetic DNA
tgatacgagtcagtttag

SEQ ID NO: 12733 - DNA, 18 bp, Artificial Sequence
  Synthetic DNA
tgtcacgactcactttag

SEQ ID NO: 12734 - DNA, 18 bp, Artificial Sequence
  Synthetic DNA
tgttacgactcagtacag

SEQ ID NO: 12735 - DNA, 18 bp, Artificial Sequence
  Synthetic DNA
ttatacgaatcattctag

SEQ ID NO: 12736 - DNA, 18 bp, Artificial Sequence
  Synthetic DNA
ttatacgactaagtctag

SEQ ID NO: 12737 - DNA, 18 bp, Artificial Sequence
  Synthetic DNA
ttatacgcgtcactacag

SEQ ID NO: 12738 - DNA, 18 bp, Artificial Sequence
  Synthetic DNA
ttatagaactcagtatag

SEQ ID NO: 12739 - DNA, 18 bp, Artificial Sequence
  Synthetic DNA
ttatgcgactcaccaaag

SEQ ID NO: 12740 - DNA, 18 bp, Artificial Sequence
  Synthetic DNA
ttctacaactaactatag

SEQ ID NO: 12741 - DNA, 18 bp, Artificial Sequence
  Synthetic DNA
ttttacgactcactatga

SEQ ID NO: 12742 - DNA, 18 bp, Artificial Sequence
  Synthetic DNA
ttttgcgactcactctag

SEQ ID NO: 12743 - DNA, 18 bp, Artificial Sequence
  Synthetic DNA
tactacgactcagaacag

SEQ ID NO: 12744 - DNA, 18 bp, Artificial Sequence
  Synthetic DNA
taatgcgactcactgatg

SEQ ID NO: 12745 - DNA, 18 bp, Artificial Sequence
  Synthetic DNA
taattctactcgctattg

SEQ ID NO: 12746 - DNA, 18 bp, Artificial Sequence
  Synthetic DNA
tgatacgaatctctagag

SEQ ID NO: 12747 - DNA, 18 bp, Artificial Sequence
  Synthetic DNA
cactacgactttctatag

SEQ ID NO: 12748 - DNA, 18 bp, Artificial Sequence
  Synthetic DNA
taattcgactcaatcttg

SEQ ID NO: 12749 - DNA, 18 bp, Artificial Sequence
  Synthetic DNA
tattgcgcctcactgtag

SEQ ID NO: 12750 - DNA, 18 bp, Artificial Sequence
  Synthetic DNA
taattagactcgctattg

SEQ ID NO: 12751 - DNA, 18 bp, Artificial Sequence
  Synthetic DNA
ttttacgactcgctacag

SEQ ID NO: 12752 - DNA, 18 bp, Artificial Sequence
  Synthetic DNA
aaataagactcaccctag

SEQ ID NO: 12753 - DNA, 18 bp, Artificial Sequence
  Synthetic DNA
ttatgcgactcactaggg

SEQ ID NO: 12754 - DNA, 18 bp, Artificial Sequence
  Synthetic DNA
aaagacggctcactattg

SEQ ID NO: 12755 - DNA, 18 bp, Artificial Sequence
  Synthetic DNA
taaagcgcctcactttag

SEQ ID NO: 12756 - DNA, 18 bp, Artificial Sequence
  Synthetic DNA
taagaggactctgtatag

SEQ ID NO: 12757 - DNA, 18 bp, Artificial Sequence
  Synthetic DNA
ttataagactcactccag

SEQ ID NO: 12758 - DNA, 18 bp, Artificial Sequence
  Synthetic DNA
ttttatgactcactagag

SEQ ID NO: 12759 - DNA, 18 bp, Artificial Sequence
  Synthetic DNA
taatactaccctctaaag

SEQ ID NO: 12760 - DNA, 18 bp, Artificial Sequence
  Synthetic DNA
gaattcgactcgctaaag

SEQ ID NO: 12761 - DNA, 18 bp, Artificial Sequence
  Synthetic DNA
taattcgactcgctaccg

SEQ ID NO: 12762 - DNA, 18 bp, Artificial Sequence
  Synthetic DNA
ttatataactcactaaag

SEQ ID NO: 12763 - DNA, 18 bp, Artificial Sequence
  Synthetic DNA
ttattcgcctcactttag

SEQ ID NO: 12764 - DNA, 18 bp, Artificial Sequence
  Synthetic DNA
cattaggactcactacag

SEQ ID NO: 12765 - DNA, 18 bp, Artificial Sequence
  Synthetic DNA
taatacgtcacgccatag

SEQ ID NO: 12766 - DNA, 18 bp, Artificial Sequence
  Synthetic DNA
taataaagctcactatcg

SEQ ID NO: 12767 - DNA, 18 bp, Artificial Sequence
  Synthetic DNA
ttataagactcgctattg

SEQ ID NO: 12768 - DNA, 18 bp, Artificial Sequence
  Synthetic DNA
taatacgactaacgccag

SEQ ID NO: 12769 - DNA, 18 bp, Artificial Sequence
  Synthetic DNA
taaatcgtctcactaaag

SEQ ID NO: 12770 - DNA, 18 bp, Artificial Sequence
  Synthetic DNA
taatacgccttaccatcg

SEQ ID NO: 12771 - DNA, 18 bp, Artificial Sequence
  Synthetic DNA
taatccgtctgactaaag

SEQ ID NO: 12772 - DNA, 18 bp, Artificial Sequence
  Synthetic DNA
taattcgactcgccaaag

SEQ ID NO: 12773 - DNA, 18 bp, Artificial Sequence
  Synthetic DNA
tagtacaaatcactattg

SEQ ID NO: 12774 - DNA, 18 bp, Artificial Sequence
  Synthetic DNA
ttatactcgtcactatag

SEQ ID NO: 12775 - DNA, 18 bp, Artificial Sequence
  Synthetic DNA
tattacgactcatttcag

SEQ ID NO: 12776 - DNA, 18 bp, Artificial Sequence
  Synthetic DNA
tatcacggctcactattg

SEQ ID NO: 12777 - DNA, 18 bp, Artificial Sequence
  Synthetic DNA
taaaccgactcgctattg

SEQ ID NO: 12778 - DNA, 18 bp, Artificial Sequence
  Synthetic DNA
tgattcgactcactactg

SEQ ID NO: 12779 - DNA, 18 bp, Artificial Sequence
  Synthetic DNA
tattacgacatgctatag

SEQ ID NO: 12780 - DNA, 18 bp, Artificial Sequence
  Synthetic DNA
aaattggactcactattg

SEQ ID NO: 12781 - DNA, 18 bp, Artificial Sequence
  Synthetic DNA
ttattcgactcactagtg

SEQ ID NO: 12782 - DNA, 18 bp, Artificial Sequence
  Synthetic DNA
taatacgtctcgttattg

SEQ ID NO: 12783 - DNA, 18 bp, Artificial Sequence
  Synthetic DNA
taattcgactaactactg

SEQ ID NO: 12784 - DNA, 18 bp, Artificial Sequence
  Synthetic DNA
taattctactcgctaaag

SEQ ID NO: 12785 - DNA, 18 bp, Artificial Sequence
  Synthetic DNA
aaatgcaactcgctatag

SEQ ID NO: 12786 - DNA, 18 bp, Artificial Sequence
  Synthetic DNA
caatgcgactcacttttg

SEQ ID NO: 12787 - DNA, 18 bp, Artificial Sequence
  Synthetic DNA
caattcgtttcactatag

SEQ ID NO: 12788 - DNA, 18 bp, Artificial Sequence
  Synthetic DNA
taataagtctcactactg

SEQ ID NO: 12789 - DNA, 18 bp, Artificial Sequence
  Synthetic DNA
taattagactcactcaag

SEQ ID NO: 12790 - DNA, 18 bp, Artificial Sequence
  Synthetic DNA
tcatatgactcactgttg

SEQ ID NO: 12791 - DNA, 18 bp, Artificial Sequence
  Synthetic DNA
aaatccgactaactacag

SEQ ID NO: 12792 - DNA, 18 bp, Artificial Sequence
  Synthetic DNA
cgaaacgacgcactatag

SEQ ID NO: 12793 - DNA, 18 bp, Artificial Sequence
  Synthetic DNA
ctttaggactcactatag

SEQ ID NO: 12794 - DNA, 18 bp, Artificial Sequence
  Synthetic DNA
taacacaactcactaacg

SEQ ID NO: 12795 - DNA, 18 bp, Artificial Sequence
  Synthetic DNA
taacatgacgtactatag

SEQ ID NO: 12796 - DNA, 18 bp, Artificial Sequence
  Synthetic DNA
taatacacgccactatag

SEQ ID NO: 12797 - DNA, 18 bp, Artificial Sequence
  Synthetic DNA
taataccgctcacttcag

SEQ ID NO: 12798 - DNA, 18 bp, Artificial Sequence
  Synthetic DNA
taatacctctcacaatcg

SEQ ID NO: 12799 - DNA, 18 bp, Artificial Sequence
  Synthetic DNA
taatacgatccagtttag

SEQ ID NO: 12800 - DNA, 18 bp, Artificial Sequence
  Synthetic DNA
taatcagactcacgaaag

SEQ ID NO: 12801 - DNA, 18 bp, Artificial Sequence
  Synthetic DNA
taatctgattcactaaag

SEQ ID NO: 12802 - DNA, 18 bp, Artificial Sequence
  Synthetic DNA
taatgcgcgtcacaatag

SEQ ID NO: 12803 - DNA, 18 bp, Artificial Sequence
  Synthetic DNA
tactatgacatactatag

SEQ ID NO: 12804 - DNA, 18 bp, Artificial Sequence
  Synthetic DNA
tagtacgagtcacaagag

SEQ ID NO: 12805 - DNA, 18 bp, Artificial Sequence
  Synthetic DNA
tattgcgactcacttgag

SEQ ID NO: 12806 - DNA, 18 bp, Artificial Sequence
  Synthetic DNA
tgataccactcattatcg

SEQ ID NO: 12807 - DNA, 18 bp, Artificial Sequence
  Synthetic DNA
tttcgcgactcactatag

SEQ ID NO: 12808 - DNA, 18 bp, Artificial Sequence
  Synthetic DNA
ttttaagactcactgtag

SEQ ID NO: 12809 - DNA, 18 bp, Artificial Sequence
  Synthetic DNA
tattgcgactcacttttg

SEQ ID NO: 12810 - DNA, 18 bp, Artificial Sequence
  Synthetic DNA
ttaaacgactcgctatcg

SEQ ID NO: 12811 - DNA, 18 bp, Artificial Sequence
  Synthetic DNA
taaaacaactcgctattg

SEQ ID NO: 12812 - DNA, 18 bp, Artificial Sequence
  Synthetic DNA
ttatgcgactcactactg

SEQ ID NO: 12813 - DNA, 18 bp, Artificial Sequence
  Synthetic DNA
tcatacgaatctctaaag

SEQ ID NO: 12814 - DNA, 18 bp, Artificial Sequence
  Synthetic DNA
tattacttctgactatag

SEQ ID NO: 12815 - DNA, 18 bp, Artificial Sequence
  Synthetic DNA
tattgcgactcactaatg

SEQ ID NO: 12816 - DNA, 18 bp, Artificial Sequence
  Synthetic DNA
tatttggactcactgtag

SEQ ID NO: 12817 - DNA, 18 bp, Artificial Sequence
  Synthetic DNA
taatgtgactcactacgg

SEQ ID NO: 12818 - DNA, 18 bp, Artificial Sequence
  Synthetic DNA
taattcgactcgctaatg

SEQ ID NO: 12819 - DNA, 18 bp, Artificial Sequence
  Synthetic DNA
tgtttcgactcgctatag

SEQ ID NO: 12820 - DNA, 18 bp, Artificial Sequence
  Synthetic DNA
tgaaacgaatcactttag

SEQ ID NO: 12821 - DNA, 18 bp, Artificial Sequence
  Synthetic DNA
ttatgcgactcactcttg

SEQ ID NO: 12822 - DNA, 18 bp, Artificial Sequence
  Synthetic DNA
taatatgactcaaaaaag

SEQ ID NO: 12823 - DNA, 18 bp, Artificial Sequence
  Synthetic DNA
actttcgactcactatag

SEQ ID NO: 12824 - DNA, 18 bp, Artificial Sequence
  Synthetic DNA
gaattcgactgaccatag

SEQ ID NO: 12825 - DNA, 18 bp, Artificial Sequence
  Synthetic DNA
ttataggactcgctaaag

SEQ ID NO: 12826 - DNA, 18 bp, Artificial Sequence
  Synthetic DNA
ttaatcgactcactctag

SEQ ID NO: 12827 - DNA, 18 bp, Artificial Sequence
  Synthetic DNA
aaaaaggactcactctag

SEQ ID NO: 12828 - DNA, 18 bp, Artificial Sequence
  Synthetic DNA
taatacggttaactatcg

SEQ ID NO: 12829 - DNA, 18 bp, Artificial Sequence
  Synthetic DNA
taaaaagactcgctattg

SEQ ID NO: 12830 - DNA, 18 bp, Artificial Sequence
  Synthetic DNA
caaaacgcatcactatag

SEQ ID NO: 12831 - DNA, 18 bp, Artificial Sequence
  Synthetic DNA
ctatacgactcacttttg

SEQ ID NO: 12832 - DNA, 18 bp, Artificial Sequence
  Synthetic DNA
taacacgactcgctaatg

SEQ ID NO: 12833 - DNA, 18 bp, Artificial Sequence
  Synthetic DNA
aaattcgactcactaccg

SEQ ID NO: 12834 - DNA, 18 bp, Artificial Sequence
  Synthetic DNA
ttattggactcactacag

SEQ ID NO: 12835 - DNA, 18 bp, Artificial Sequence
  Synthetic DNA
aaatacaactcactttcg

SEQ ID NO: 12836 - DNA, 18 bp, Artificial Sequence
  Synthetic DNA
taaaacgactcaccctaa

SEQ ID NO: 12837 - DNA, 18 bp, Artificial Sequence
  Synthetic DNA
taatacgcatcagtgtag

SEQ ID NO: 12838 - DNA, 18 bp, Artificial Sequence
  Synthetic DNA
taatcggcctcactctag

SEQ ID NO: 12839 - DNA, 18 bp, Artificial Sequence
  Synthetic DNA
tgataggactcagtaaag

SEQ ID NO: 12840 - DNA, 18 bp, Artificial Sequence
  Synthetic DNA
ttatgcgactcactaatg

SEQ ID NO: 12841 - DNA, 18 bp, Artificial Sequence
  Synthetic DNA
tcattcgactcacgattg

SEQ ID NO: 12842 - DNA, 18 bp, Artificial Sequence
  Synthetic DNA
gaaatcgactcactttag

SEQ ID NO: 12843 - DNA, 18 bp, Artificial Sequence
  Synthetic DNA
ttttacgactcactcttg

SEQ ID NO: 12844 - DNA, 18 bp, Artificial Sequence
  Synthetic DNA
aatagcgactcactatag

SEQ ID NO: 12845 - DNA, 18 bp, Artificial Sequence
  Synthetic DNA
ttattcgtctcgctatag

SEQ ID NO: 12846 - DNA, 18 bp, Artificial Sequence
  Synthetic DNA
ttttgcgactcactttag

SEQ ID NO: 12847 - DNA, 18 bp, Artificial Sequence
  Synthetic DNA
taattcgcctcactactg

SEQ ID NO: 12848 - DNA, 18 bp, Artificial Sequence
  Synthetic DNA
taatacgactcggtaatg

SEQ ID NO: 12849 - DNA, 18 bp, Artificial Sequence
  Synthetic DNA
tagtacgactcactacta

SEQ ID NO: 12850 - DNA, 18 bp, Artificial Sequence
  Synthetic DNA
tatttggactcactacag

SEQ ID NO: 12851 - DNA, 18 bp, Artificial Sequence
  Synthetic DNA
tgttacaactcgctatag

SEQ ID NO: 12852 - DNA, 18 bp, Artificial Sequence
  Synthetic DNA
ttatacgtctcgctatcg

SEQ ID NO: 12853 - DNA, 18 bp, Artificial Sequence
  Synthetic DNA
tagtacgacttactaacg

SEQ ID NO: 12854 - DNA, 18 bp, Artificial Sequence
  Synthetic DNA
tataaggagtcactatag

SEQ ID NO: 12855 - DNA, 18 bp, Artificial Sequence
  Synthetic DNA
tattactactgaccatag

SEQ ID NO: 12856 - DNA, 18 bp, Artificial Sequence
  Synthetic DNA
tgatacaactccctttag

SEQ ID NO: 12857 - DNA, 18 bp, Artificial Sequence
  Synthetic DNA
ttaaacgactaactgtag

SEQ ID NO: 12858 - DNA, 18 bp, Artificial Sequence
  Synthetic DNA
taagacaactcatcatag

SEQ ID NO: 12859 - DNA, 18 bp, Artificial Sequence
  Synthetic DNA
taatacgccgctctatcg

SEQ ID NO: 12860 - DNA, 18 bp, Artificial Sequence
  Synthetic DNA
tctggcgactcactatag

SEQ ID NO: 12861 - DNA, 18 bp, Artificial Sequence
  Synthetic DNA
ttatgcgcctcactaaag

SEQ ID NO: 12862 - DNA, 18 bp, Artificial Sequence
  Synthetic DNA
taattcgtctcgctaaag

SEQ ID NO: 12863 - DNA, 18 bp, Artificial Sequence
  Synthetic DNA
taatatgacgtgctatag

SEQ ID NO: 12864 - DNA, 18 bp, Artificial Sequence
  Synthetic DNA
cattacgactcgctattg

SEQ ID NO: 12865 - DNA, 18 bp, Artificial Sequence
  Synthetic DNA
caacacatctcactatag

SEQ ID NO: 12866 - DNA, 18 bp, Artificial Sequence
  Synthetic DNA
ttatgcgcctcacaatag

SEQ ID NO: 12867 - DNA, 18 bp, Artificial Sequence
  Synthetic DNA
ttctacgagtcactaaag

SEQ ID NO: 12868 - DNA, 18 bp, Artificial Sequence
  Synthetic DNA
tattgcgtctcactaaag

SEQ ID NO: 12869 - DNA, 18 bp, Artificial Sequence
  Synthetic DNA
taaatcgacacgctatag

SEQ ID NO: 12870 - DNA, 18 bp, Artificial Sequence
  Synthetic DNA
taataagacttattattg

SEQ ID NO: 12871 - DNA, 18 bp, Artificial Sequence
  Synthetic DNA
taatacaactcgctaatg

SEQ ID NO: 12872 - DNA, 18 bp, Artificial Sequence
  Synthetic DNA
tattgcgtttcactatag

SEQ ID NO: 12873 - DNA, 18 bp, Artificial Sequence
  Synthetic DNA
tctcatgactcactatag

SEQ ID NO: 12874 - DNA, 18 bp, Artificial Sequence
  Synthetic DNA
tgatacgactaacattag

SEQ ID NO: 12875 - DNA, 18 bp, Artificial Sequence
  Synthetic DNA
aaaagcgactcactttag

SEQ ID NO: 12876 - DNA, 18 bp, Artificial Sequence
  Synthetic DNA
tttaacgactcactctag

SEQ ID NO: 12877 - DNA, 18 bp, Artificial Sequence
  Synthetic DNA
ttttacgactcaccttag

SEQ ID NO: 12878 - DNA, 18 bp, Artificial Sequence
  Synthetic DNA
atataggactcactttag

SEQ ID NO: 12879 - DNA, 18 bp, Artificial Sequence
  Synthetic DNA
tatttcgactcaatttag

SEQ ID NO: 12880 - DNA, 18 bp, Artificial Sequence
  Synthetic DNA
taataagactcggtattg

SEQ ID NO: 12881 - DNA, 18 bp, Artificial Sequence
  Synthetic DNA
taatacgactcgcttctg

SEQ ID NO: 12882 - DNA, 18 bp, Artificial Sequence
  Synthetic DNA
ttatacgcctcacactag

SEQ ID NO: 12883 - DNA, 18 bp, Artificial Sequence
  Synthetic DNA
taacacgactcgctactg

SEQ ID NO: 12884 - DNA, 18 bp, Artificial Sequence
  Synthetic DNA
taaaccgactcactcttg

SEQ ID NO: 12885 - DNA, 18 bp, Artificial Sequence
  Synthetic DNA
taatactacgcgctctag

SEQ ID NO: 12886 - DNA, 18 bp, Artificial Sequence
  Synthetic DNA
ttatgcgactcaccattg

SEQ ID NO: 12887 - DNA, 18 bp, Artificial Sequence
  Synthetic DNA
tgttacgagtcacaatag

SEQ ID NO: 12888 - DNA, 18 bp, Artificial Sequence
  Synthetic DNA
tttttcgactcactgtag

SEQ ID NO: 12889 - DNA, 18 bp, Artificial Sequence
  Synthetic DNA
ttttaggactcactttag

SEQ ID NO: 12890 - DNA, 18 bp, Artificial Sequence
  Synthetic DNA
taataggactcacaaagg

SEQ ID NO: 12891 - DNA, 18 bp, Artificial Sequence
  Synthetic DNA
ttattcaactcactctag

SEQ ID NO: 12892 - DNA, 18 bp, Artificial Sequence
  Synthetic DNA
aattaggactcacgatag

SEQ ID NO: 12893 - DNA, 18 bp, Artificial Sequence
  Synthetic DNA
tcatgcgtctcactctag

SEQ ID NO: 12894 - DNA, 18 bp, Artificial Sequence
  Synthetic DNA
ttaaatgactcactatcg

SEQ ID NO: 12895 - DNA, 18 bp, Artificial Sequence
  Synthetic DNA
taattggactcactactg

SEQ ID NO: 12896 - DNA, 18 bp, Artificial Sequence
  Synthetic DNA
tgattcgactaactaaag

SEQ ID NO: 12897 - DNA, 18 bp, Artificial Sequence
  Synthetic DNA
ctataggactcactttag

SEQ ID NO: 12898 - DNA, 18 bp, Artificial Sequence
  Synthetic DNA
taatgcttgtcactatag

SEQ ID NO: 12899 - DNA, 18 bp, Artificial Sequence
  Synthetic DNA
taatacgtctcacatcag

SEQ ID NO: 12900 - DNA, 18 bp, Artificial Sequence
  Synthetic DNA
cattaagactcactattg

SEQ ID NO: 12901 - DNA, 18 bp, Artificial Sequence
  Synthetic DNA
caattggactcactacag

SEQ ID NO: 12902 - DNA, 18 bp, Artificial Sequence
  Synthetic DNA
ttattggactcactgtag

SEQ ID NO: 12903 - DNA, 18 bp, Artificial Sequence
  Synthetic DNA
ttataggactcactcaag

SEQ ID NO: 12904 - DNA, 18 bp, Artificial Sequence
  Synthetic DNA
ttatatgactcacttttg

SEQ ID NO: 12905 - DNA, 18 bp, Artificial Sequence
  Synthetic DNA
ttatacaactcactccag

SEQ ID NO: 12906 - DNA, 18 bp, Artificial Sequence
  Synthetic DNA
ttttaagactcactctag

SEQ ID NO: 12907 - DNA, 18 bp, Artificial Sequence
  Synthetic DNA
ttattcgactcagtattg

SEQ ID NO: 12908 - DNA, 18 bp, Artificial Sequence
  Synthetic DNA
tttttcgactcactacag

SEQ ID NO: 12909 - DNA, 18 bp, Artificial Sequence
  Synthetic DNA
tttttcgactcgctatag

SEQ ID NO: 12910 - DNA, 18 bp, Artificial Sequence
  Synthetic DNA
taatccgactcgctactg

SEQ ID NO: 12911 - DNA, 18 bp, Artificial Sequence
  Synthetic DNA
taatttaactcactacag

SEQ ID NO: 12912 - DNA, 18 bp, Artificial Sequence
  Synthetic DNA
taccacgactcactaatg

SEQ ID NO: 12913 - DNA, 18 bp, Artificial Sequence
  Synthetic DNA
tattacgcctcaccattg

SEQ ID NO: 12914 - DNA, 18 bp, Artificial Sequence
  Synthetic DNA
aaaaagaactcactatag

SEQ ID NO: 12915 - DNA, 18 bp, Artificial Sequence
  Synthetic DNA
taaaacgagtcactccag

SEQ ID NO: 12916 - DNA, 18 bp, Artificial Sequence
  Synthetic DNA
taaagcgcctcactacag

SEQ ID NO: 12917 - DNA, 18 bp, Artificial Sequence
  Synthetic DNA
taagaaaactcactgtag

SEQ ID NO: 12918 - DNA, 18 bp, Artificial Sequence
  Synthetic DNA
taatcaaacgcactatag

SEQ ID NO: 12919 - DNA, 18 bp, Artificial Sequence
  Synthetic DNA
taattcgactcgctactg

SEQ ID NO: 12920 - DNA, 18 bp, Artificial Sequence
  Synthetic DNA
taattcgactcgctagtg

SEQ ID NO: 12921 - DNA, 18 bp, Artificial Sequence
  Synthetic DNA
taattcgactcgctcttg

SEQ ID NO: 12922 - DNA, 18 bp, Artificial Sequence
  Synthetic DNA
taattcgactcggtattg

SEQ ID NO: 12923 - DNA, 18 bp, Artificial Sequence
  Synthetic DNA
aaatacgactagctattg

SEQ ID NO: 12924 - DNA, 18 bp, Artificial Sequence
  Synthetic DNA
taaatagactcgctatag

SEQ ID NO: 12925 - DNA, 18 bp, Artificial Sequence
  Synthetic DNA
taacacgactcgatattg

SEQ ID NO: 12926 - DNA, 18 bp, Artificial Sequence
  Synthetic DNA
taactcgtctcgctatag

SEQ ID NO: 12927 - DNA, 18 bp, Artificial Sequence
  Synthetic DNA
taataaaactcgctattg

SEQ ID NO: 12928 - DNA, 18 bp, Artificial Sequence
  Synthetic DNA
taatacgagtcgccattg

SEQ ID NO: 12929 - DNA, 18 bp, Artificial Sequence
  Synthetic DNA
taatacgtctcgctattt

SEQ ID NO: 12930 - DNA, 18 bp, Artificial Sequence
  Synthetic DNA
taatactcctcgctattg

SEQ ID NO: 12931 - DNA, 18 bp, Artificial Sequence
  Synthetic DNA
taataggactcgctactg

SEQ ID NO: 12932 - DNA, 18 bp, Artificial Sequence
  Synthetic DNA
taattagactcgctaaag

SEQ ID NO: 12933 - DNA, 18 bp, Artificial Sequence
  Synthetic DNA
taattcgaatcacgattg

SEQ ID NO: 12934 - DNA, 18 bp, Artificial Sequence
  Synthetic DNA
taattcgacccgccatag

SEQ ID NO: 12935 - DNA, 18 bp, Artificial Sequence
  Synthetic DNA
taattcgactcaaaattg

SEQ ID NO: 12936 - DNA, 18 bp, Artificial Sequence
  Synthetic DNA
taattcgactcacgtttg

SEQ ID NO: 12937 - DNA, 18 bp, Artificial Sequence
  Synthetic DNA
taattcgactcacttgtg

SEQ ID NO: 12938 - DNA, 18 bp, Artificial Sequence
  Synthetic DNA
taattcgactcgcgacag

SEQ ID NO: 12939 - DNA, 18 bp, Artificial Sequence
  Synthetic DNA
taattcgactcgctacgg

SEQ ID NO: 12940 - DNA, 18 bp, Artificial Sequence
  Synthetic DNA
taattggactcactagtg

SEQ ID NO: 12941 - DNA, 18 bp, Artificial Sequence
  Synthetic DNA
tacttcgactcacgattg

SEQ ID NO: 12942 - DNA, 18 bp, Artificial Sequence
  Synthetic DNA
tacttcgactccctattg

SEQ ID NO: 12943 - DNA, 18 bp, Artificial Sequence
  Synthetic DNA
tattacgactcgctaatg

SEQ ID NO: 12944 - DNA, 18 bp, Artificial Sequence
  Synthetic DNA
tatttcgactcgcgatag

SEQ ID NO: 12945 - DNA, 18 bp, Artificial Sequence
  Synthetic DNA
tatttcgactcgctacag

SEQ ID NO: 12946 - DNA, 18 bp, Artificial Sequence
  Synthetic DNA
tatttcgactcgctatac

SEQ ID NO: 12947 - DNA, 18 bp, Artificial Sequence
  Synthetic DNA
tatttcgactcgctatat

SEQ ID NO: 12948 - DNA, 18 bp, Artificial Sequence
  Synthetic DNA
tcattcgactcgctgtag

SEQ ID NO: 12949 - DNA, 18 bp, Artificial Sequence
  Synthetic DNA
tcattcgtctcgctatag

SEQ ID NO: 12950 - DNA, 18 bp, Artificial Sequence
  Synthetic DNA
ttatacggctcgctattg

SEQ ID NO: 12951 - DNA, 18 bp, Artificial Sequence
  Synthetic DNA
ttattcgactcactattt

SEQ ID NO: 12952 - DNA, 18 bp, Artificial Sequence
  Synthetic DNA
ttattcgactcgctatat

SEQ ID NO: 12953 - DNA, 18 bp, Artificial Sequence
  Synthetic DNA
ttattcgactcgctatcg

SEQ ID NO: 12954 - DNA, 18 bp, Artificial Sequence
  Synthetic DNA
aaaaacgactcactcttg

SEQ ID NO: 12955 - DNA, 18 bp, Artificial Sequence
  Synthetic DNA
aaaaacgactcactgttg

SEQ ID NO: 12956 - DNA, 18 bp, Artificial Sequence
  Synthetic DNA
aaaatcgactcactgtag

SEQ ID NO: 12957 - DNA, 18 bp, Artificial Sequence
  Synthetic DNA
aaatacaactcgcaatag

SEQ ID NO: 12958 - DNA, 18 bp, Artificial Sequence
  Synthetic DNA
aaataccacttactattg

SEQ ID NO: 12959 - DNA, 18 bp, Artificial Sequence
  Synthetic DNA
aaatacgtctcggtatag

SEQ ID NO: 12960 - DNA, 18 bp, Artificial Sequence
  Synthetic DNA
aaatactactcacgattg

SEQ ID NO: 12961 - DNA, 18 bp, Artificial Sequence
  Synthetic DNA
aaattcaactcactacag

SEQ ID NO: 12962 - DNA, 18 bp, Artificial Sequence
  Synthetic DNA
aaattcgaagcactatag

SEQ ID NO: 12963 - DNA, 18 bp, Artificial Sequence
  Synthetic DNA
aaattcgactccctctag

SEQ ID NO: 12964 - DNA, 18 bp, Artificial Sequence
  Synthetic DNA
aaatttgactgactatag

SEQ ID NO: 12965 - DNA, 18 bp, Artificial Sequence
  Synthetic DNA
caaatcgacgcactatag

SEQ ID NO: 12966 - DNA, 18 bp, Artificial Sequence
  Synthetic DNA
caataccactcacaattg

SEQ ID NO: 12967 - DNA, 18 bp, Artificial Sequence
  Synthetic DNA
caatacgactcagtaatg

SEQ ID NO: 12968 - DNA, 18 bp, Artificial Sequence
  Synthetic DNA
caatacgcctcacaattg

SEQ ID NO: 12969 - DNA, 18 bp, Artificial Sequence
  Synthetic DNA
caatccgactcacttttg

SEQ ID NO: 12970 - DNA, 18 bp, Artificial Sequence
  Synthetic DNA
caatgcgactcgctttag

SEQ ID NO: 12971 - DNA, 18 bp, Artificial Sequence
  Synthetic DNA
caattcgacgaactatag

SEQ ID NO: 12972 - DNA, 18 bp, Artificial Sequence
  Synthetic DNA
caattcgactcaagatag

SEQ ID NO: 12973 - DNA, 18 bp, Artificial Sequence
  Synthetic DNA
caattcgactcaatacag

SEQ ID NO: 12974 - DNA, 18 bp, Artificial Sequence
  Synthetic DNA
caattcgactcacaatcg

SEQ ID NO: 12975 - DNA, 18 bp, Artificial Sequence
  Synthetic DNA
caattcgagccactatag

SEQ ID NO: 12976 - DNA, 18 bp, Artificial Sequence
  Synthetic DNA
cattacgactcgatatag

SEQ ID NO: 12977 - DNA, 18 bp, Artificial Sequence
  Synthetic DNA
ctatacgactcgatatag

SEQ ID NO: 12978 - DNA, 18 bp, Artificial Sequence
  Synthetic DNA
ctatacgactcgctagag

SEQ ID NO: 12979 - DNA, 18 bp, Artificial Sequence
  Synthetic DNA
gaatacggctcacttttg

SEQ ID NO: 12980 - DNA, 18 bp, Artificial Sequence
  Synthetic DNA
gaatacgtctcattattg

SEQ ID NO: 12981 - DNA, 18 bp, Artificial Sequence
  Synthetic DNA
gaatactactcactattc

SEQ ID NO: 12982 - DNA, 18 bp, Artificial Sequence
  Synthetic DNA
gaatactgctcactattg

SEQ ID NO: 12983 - DNA, 18 bp, Artificial Sequence
  Synthetic DNA
gaatcggactcactattg

SEQ ID NO: 12984 - DNA, 18 bp, Artificial Sequence
  Synthetic DNA
gaattcgactcactttgg

SEQ ID NO: 12985 - DNA, 18 bp, Artificial Sequence
  Synthetic DNA
gactacgactcgctacag

SEQ ID NO: 12986 - DNA, 18 bp, Artificial Sequence
  Synthetic DNA
gactactactcactattg

SEQ ID NO: 12987 - DNA, 18 bp, Artificial Sequence
  Synthetic DNA
gtaaacgactcgctatag

SEQ ID NO: 12988 - DNA, 18 bp, Artificial Sequence
  Synthetic DNA
gtatacgactcattattg

SEQ ID NO: 12989 - DNA, 18 bp, Artificial Sequence
  Synthetic DNA
gtatgcgactcgctatag

SEQ ID NO: 12990 - DNA, 18 bp, Artificial Sequence
  Synthetic DNA
taaaaagactagctatag

SEQ ID NO: 12991 - DNA, 18 bp, Artificial Sequence
  Synthetic DNA
taaaaagactcgccatag

SEQ ID NO: 12992 - DNA, 18 bp, Artificial Sequence
  Synthetic DNA
taaagcgactcactaatg

SEQ ID NO: 12993 - DNA, 18 bp, Artificial Sequence
  Synthetic DNA
taaagcgactcactactg

SEQ ID NO: 12994 - DNA, 18 bp, Artificial Sequence
  Synthetic DNA
taaagcgactcactgttg

SEQ ID NO: 12995 - DNA, 18 bp, Artificial Sequence
  Synthetic DNA
taaatcaacccactatag

SEQ ID NO: 12996 - DNA, 18 bp, Artificial Sequence
  Synthetic DNA
taaatcgactcactatgt

SEQ ID NO: 12997 - DNA, 18 bp, Artificial Sequence
  Synthetic DNA
taaatcgactcactctcg

SEQ ID NO: 12998 - DNA, 18 bp, Artificial Sequence
  Synthetic DNA
taaatggactcactatgg

SEQ ID NO: 12999 - DNA, 18 bp, Artificial Sequence
  Synthetic DNA
taaattgactcagtatag

SEQ ID NO: 13000 - DNA, 18 bp, Artificial Sequence
  Synthetic DNA
taacacgactagttatag

SEQ ID NO: 13001 - DNA, 18 bp, Artificial Sequence
  Synthetic DNA
taacaggacgcactattg

SEQ ID NO: 13002 - DNA, 18 bp, Artificial Sequence
  Synthetic DNA
taactcgactaactacag

SEQ ID NO: 13003 - DNA, 18 bp, Artificial Sequence
  Synthetic DNA
taagaagactctctattg

SEQ ID NO: 13004 - DNA, 18 bp, Artificial Sequence
  Synthetic DNA
taagccgacttactattg

SEQ ID NO: 13005 - DNA, 18 bp, Artificial Sequence
  Synthetic DNA
taataagacccacgattg

SEQ ID NO: 13006 - DNA, 18 bp, Artificial Sequence
  Synthetic DNA
taataagactcaccactg

SEQ ID NO: 13007 - DNA, 18 bp, Artificial Sequence
  Synthetic DNA
taataagactcgacatag

SEQ ID NO: 13008 - DNA, 18 bp, Artificial Sequence
  Synthetic DNA
taataagagtcactatta

SEQ ID NO: 13009 - DNA, 18 bp, Artificial Sequence
  Synthetic DNA
taatacaactcgcaacag

SEQ ID NO: 13010 - DNA, 18 bp, Artificial Sequence
  Synthetic DNA
taatacaactcggtaaag

SEQ ID NO: 13011 - DNA, 18 bp, Artificial Sequence
  Synthetic DNA
taatacatctcgctatcg

SEQ ID NO: 13012 - DNA, 18 bp, Artificial Sequence
  Synthetic DNA
taataccacacgctttag

SEQ ID NO: 13013 - DNA, 18 bp, Artificial Sequence
  Synthetic DNA
taataccactaactgttg

SEQ ID NO: 13014 - DNA, 18 bp, Artificial Sequence
  Synthetic DNA
taataccactcaacattg

SEQ ID NO: 13015 - DNA, 18 bp, Artificial Sequence
  Synthetic DNA
taataccactcgctttaa

SEQ ID NO: 13016 - DNA, 18 bp, Artificial Sequence
  Synthetic DNA
taataccactctctgttg

SEQ ID NO: 13017 - DNA, 18 bp, Artificial Sequence
  Synthetic DNA
taataccacttgctacag

SEQ ID NO: 13018 - DNA, 18 bp, Artificial Sequence
  Synthetic DNA
taataccgctcaatattg

SEQ ID NO: 13019 - DNA, 18 bp, Artificial Sequence
  Synthetic DNA
taataccgctcgatatag

SEQ ID NO: 13020 - DNA, 18 bp, Artificial Sequence
  Synthetic DNA
taatacgaaacagtattg

SEQ ID NO: 13021 - DNA, 18 bp, Artificial Sequence
  Synthetic DNA
taatacgaatagctacag

SEQ ID NO: 13022 - DNA, 18 bp, Artificial Sequence
  Synthetic DNA
taatacgacccaatcttg

SEQ ID NO: 13023 - DNA, 18 bp, Artificial Sequence
  Synthetic DNA
taatacgacgcaatattc

SEQ ID NO: 13024 - DNA, 18 bp, Artificial Sequence
  Synthetic DNA
taatacgactagctagcg

SEQ ID NO: 13025 - DNA, 18 bp, Artificial Sequence
  Synthetic DNA
taatacgactcaatgtta

SEQ ID NO: 13026 - DNA, 18 bp, Artificial Sequence
  Synthetic DNA
taatacgactcacaaatc

SEQ ID NO: 13027 - DNA, 18 bp, Artificial Sequence
  Synthetic DNA
taatacgactcctcattg

SEQ ID NO: 13028 - DNA, 18 bp, Artificial Sequence
  Synthetic DNA
taatacgactcgataacg

SEQ ID NO: 13029 - DNA, 18 bp, Artificial Sequence
  Synthetic DNA
taatacgactcgttttat

SEQ ID NO: 13030 - DNA, 18 bp, Artificial Sequence
  Synthetic DNA
taatacgactctttattt

SEQ ID NO: 13031 - DNA, 18 bp, Artificial Sequence
  Synthetic DNA
taatacgagtcagtcttg

SEQ ID NO: 13032 - DNA, 18 bp, Artificial Sequence
  Synthetic DNA
taatacgatacactagtg

SEQ ID NO: 13033 - DNA, 18 bp, Artificial Sequence
  Synthetic DNA
taatacgattcgccctag

SEQ ID NO: 13034 - DNA, 18 bp, Artificial Sequence
  Synthetic DNA
taatacgattcgctaaaa

SEQ ID NO: 13035 - DNA, 18 bp, Artificial Sequence
  Synthetic DNA
taatacgattcgtaatag

SEQ ID NO: 13036 - DNA, 18 bp, Artificial Sequence
  Synthetic DNA
taatacgatttactagtg

SEQ ID NO: 13037 - DNA, 18 bp, Artificial Sequence
  Synthetic DNA
taatacgcctcgttatcg

SEQ ID NO: 13038 - DNA, 18 bp, Artificial Sequence
  Synthetic DNA
taatacgcctctctcttg

SEQ ID NO: 13039 - DNA, 18 bp, Artificial Sequence
  Synthetic DNA
taatacgtctcaatatta

SEQ ID NO: 13040 - DNA, 18 bp, Artificial Sequence
  Synthetic DNA
taatacgtctcactgtta

SEQ ID NO: 13041 - DNA, 18 bp, Artificial Sequence
  Synthetic DNA
taatactactaacgattg

SEQ ID NO: 13042 - DNA, 18 bp, Artificial Sequence
  Synthetic DNA
taatactactcactaatt

SEQ ID NO: 13043 - DNA, 18 bp, Artificial Sequence
  Synthetic DNA
taatactactcccgattg

SEQ ID NO: 13044 - DNA, 18 bp, Artificial Sequence
  Synthetic DNA
taataggactcaatatta

SEQ ID NO: 13045 - DNA, 18 bp, Artificial Sequence
  Synthetic DNA
taataggactcactactt

SEQ ID NO: 13046 - DNA, 18 bp, Artificial Sequence
  Synthetic DNA
taataggactcactggtg

SEQ ID NO: 13047 - DNA, 18 bp, Artificial Sequence
  Synthetic DNA
taataggagtcgcaatag

SEQ ID NO: 13048 - DNA, 18 bp, Artificial Sequence
  Synthetic DNA
taataggcttcactattg

SEQ ID NO: 13049 - DNA, 18 bp, Artificial Sequence
  Synthetic DNA
taatagggctcactcttg

SEQ ID NO: 13050 - DNA, 18 bp, Artificial Sequence
  Synthetic DNA
taataggtctcgccatag

SEQ ID NO: 13051 - DNA, 18 bp, Artificial Sequence
  Synthetic DNA
taatataacacgctatag

SEQ ID NO: 13052 - DNA, 18 bp, Artificial Sequence
  Synthetic DNA
taatatgactaagtattg

SEQ ID NO: 13053 - DNA, 18 bp, Artificial Sequence
  Synthetic DNA
taatatgactcactctta

SEQ ID NO: 13054 - DNA, 18 bp, Artificial Sequence
  Synthetic DNA
taatatgactcgcttcag

SEQ ID NO: 13055 - DNA, 18 bp, Artificial Sequence
  Synthetic DNA
taatatgactgacttttg

SEQ ID NO: 13056 - DNA, 18 bp, Artificial Sequence
  Synthetic DNA
taatatgagtgactattg

SEQ ID NO: 13057 - DNA, 18 bp, Artificial Sequence
  Synthetic DNA
taatatgagttgctatag

SEQ ID NO: 13058 - DNA, 18 bp, Artificial Sequence
  Synthetic DNA
taatatgtctcactatta

SEQ ID NO: 13059 - DNA, 18 bp, Artificial Sequence
  Synthetic DNA
taatccgacacactactg

SEQ ID NO: 13060 - DNA, 18 bp, Artificial Sequence
  Synthetic DNA
taatccgactcacaatta

SEQ ID NO: 13061 - DNA, 18 bp, Artificial Sequence
  Synthetic DNA
taatccgactcgctacaa

SEQ ID NO: 13062 - DNA, 18 bp, Artificial Sequence
  Synthetic DNA
taatccgcctcactactg

SEQ ID NO: 13063 - DNA, 18 bp, Artificial Sequence
  Synthetic DNA
taatccggctcaatattg

SEQ ID NO: 13064 - DNA, 18 bp, Artificial Sequence
  Synthetic DNA
taatccggcttactattg

SEQ ID NO: 13065 - DNA, 18 bp, Artificial Sequence
  Synthetic DNA
taatgccactcgctacag

SEQ ID NO: 13066 - DNA, 18 bp, Artificial Sequence
  Synthetic DNA
taatgcgaatcgctctag

SEQ ID NO: 13067 - DNA, 18 bp, Artificial Sequence
  Synthetic DNA
taatgcgacacacttttg

SEQ ID NO: 13068 - DNA, 18 bp, Artificial Sequence
  Synthetic DNA
taatgcgactaactcttg

SEQ ID NO: 13069 - DNA, 18 bp, Artificial Sequence
  Synthetic DNA
taatgcgactcaacattg

SEQ ID NO: 13070 - DNA, 18 bp, Artificial Sequence
  Synthetic DNA
taatgcgactcaatgttg

SEQ ID NO: 13071 - DNA, 18 bp, Artificial Sequence
  Synthetic DNA
taatgcgactcaccagtg

SEQ ID NO: 13072 - DNA, 18 bp, Artificial Sequence
  Synthetic DNA
taatgcgactcattatta

SEQ ID NO: 13073 - DNA, 18 bp, Artificial Sequence
  Synthetic DNA
taatgcgactcgcactag

SEQ ID NO: 13074 - DNA, 18 bp, Artificial Sequence
  Synthetic DNA
taatgcgacttgctaaag

SEQ ID NO: 13075 - DNA, 18 bp, Artificial Sequence
  Synthetic DNA
taattagactcacaagag

SEQ ID NO: 13076 - DNA, 18 bp, Artificial Sequence
  Synthetic DNA
taattagactcaccacag

SEQ ID NO: 13077 - DNA, 18 bp, Artificial Sequence
  Synthetic DNA
taattagactcacggtag

SEQ ID NO: 13078 - DNA, 18 bp, Artificial Sequence
  Synthetic DNA
taattagattcactataa

SEQ ID NO: 13079 - DNA, 18 bp, Artificial Sequence
  Synthetic DNA
taattcaacgccctatag

SEQ ID NO: 13080 - DNA, 18 bp, Artificial Sequence
  Synthetic DNA
taattcaactcactttat

SEQ ID NO: 13081 - DNA, 18 bp, Artificial Sequence
  Synthetic DNA
taattcaacttactataa

SEQ ID NO: 13082 - DNA, 18 bp, Artificial Sequence
  Synthetic DNA
taattccaatcattatag

SEQ ID NO: 13083 - DNA, 18 bp, Artificial Sequence
  Synthetic DNA
taattccactcaccagag

SEQ ID NO: 13084 - DNA, 18 bp, Artificial Sequence
  Synthetic DNA
taattccactcaccatcg

SEQ ID NO: 13085 - DNA, 18 bp, Artificial Sequence
  Synthetic DNA
taattcgaaacaccatag

SEQ ID NO: 13086 - DNA, 18 bp, Artificial Sequence
  Synthetic DNA
taattcgacacactaccg

SEQ ID NO: 13087 - DNA, 18 bp, Artificial Sequence
  Synthetic DNA
taattcgacccactctgg

SEQ ID NO: 13088 - DNA, 18 bp, Artificial Sequence
  Synthetic DNA
taattcgactaactcgag

SEQ ID NO: 13089 - DNA, 18 bp, Artificial Sequence
  Synthetic DNA
taattcgactaagtgtag

SEQ ID NO: 13090 - DNA, 18 bp, Artificial Sequence
  Synthetic DNA
taattcgactcaccaccg

SEQ ID NO: 13091 - DNA, 18 bp, Artificial Sequence
  Synthetic DNA
taattcgactcagtttcg

SEQ ID NO: 13092 - DNA, 18 bp, Artificial Sequence
  Synthetic DNA
taattcgactccatctag

SEQ ID NO: 13093 - DNA, 18 bp, Artificial Sequence
  Synthetic DNA
taattcgactccgtctag

SEQ ID NO: 13094 - DNA, 18 bp, Artificial Sequence
  Synthetic DNA
taattcgactctctaaac

SEQ ID NO: 13095 - DNA, 18 bp, Artificial Sequence
  Synthetic DNA
taattcgactctctaccg

SEQ ID NO: 13096 - DNA, 18 bp, Artificial Sequence
  Synthetic DNA
taattcgagtcacgttag

SEQ ID NO: 13097 - DNA, 18 bp, Artificial Sequence
  Synthetic DNA
taattcgattcactgtgg

SEQ ID NO: 13098 - DNA, 18 bp, Artificial Sequence
  Synthetic DNA
taattcgcaacactatag

SEQ ID NO: 13099 - DNA, 18 bp, Artificial Sequence
  Synthetic DNA
taattcggctcactacat

SEQ ID NO: 13100 - DNA, 18 bp, Artificial Sequence
  Synthetic DNA
taattcgtcgcactttag

SEQ ID NO: 13101 - DNA, 18 bp, Artificial Sequence
  Synthetic DNA
taattctgctcactatcg

SEQ ID NO: 13102 - DNA, 18 bp, Artificial Sequence
  Synthetic DNA
taattggactaaccatag

SEQ ID NO: 13103 - DNA, 18 bp, Artificial Sequence
  Synthetic DNA
taattggactcacactag

SEQ ID NO: 13104 - DNA, 18 bp, Artificial Sequence
  Synthetic DNA
taattggactcacgctag

SEQ ID NO: 13105 - DNA, 18 bp, Artificial Sequence
  Synthetic DNA
taattggacttactatgg

SEQ ID NO: 13106 - DNA, 18 bp, Artificial Sequence
  Synthetic DNA
taatttgaatcactctag

SEQ ID NO: 13107 - DNA, 18 bp, Artificial Sequence
  Synthetic DNA
taatttgacgctctatag

SEQ ID NO: 13108 - DNA, 18 bp, Artificial Sequence
  Synthetic DNA
taatttgactcaagatag

SEQ ID NO: 13109 - DNA, 18 bp, Artificial Sequence
  Synthetic DNA
taatttgactcacaacag

SEQ ID NO: 13110 - DNA, 18 bp, Artificial Sequence
  Synthetic DNA
taatttgactcactttgg

SEQ ID NO: 13111 - DNA, 18 bp, Artificial Sequence
  Synthetic DNA
taatttgactctcgatag

SEQ ID NO: 13112 - DNA, 18 bp, Artificial Sequence
  Synthetic DNA
taatttgattcaccatag

SEQ ID NO: 13113 - DNA, 18 bp, Artificial Sequence
  Synthetic DNA
tacaccgactcgctatag

SEQ ID NO: 13114 - DNA, 18 bp, Artificial Sequence
  Synthetic DNA
tacatcgactcactagag

SEQ ID NO: 13115 - DNA, 18 bp, Artificial Sequence
  Synthetic DNA
tactaagactcactatta

SEQ ID NO: 13116 - DNA, 18 bp, Artificial Sequence
  Synthetic DNA
tactacgactcaatgttg

SEQ ID NO: 13117 - DNA, 18 bp, Artificial Sequence
  Synthetic DNA
tactacgactgacgattg

SEQ ID NO: 13118 - DNA, 18 bp, Artificial Sequence
  Synthetic DNA
tactatgactcgctaaag

SEQ ID NO: 13119 - DNA, 18 bp, Artificial Sequence
  Synthetic DNA
tacttagagtcactatag

SEQ ID NO: 13120 - DNA, 18 bp, Artificial Sequence
  Synthetic DNA
tacttcgacgctctatag

SEQ ID NO: 13121 - DNA, 18 bp, Artificial Sequence
  Synthetic DNA
tacttcgactaagtatag

SEQ ID NO: 13122 - DNA, 18 bp, Artificial Sequence
  Synthetic DNA
tactttgactcactctag

SEQ ID NO: 13123 - DNA, 18 bp, Artificial Sequence
  Synthetic DNA
tagtacaactcactatta

SEQ ID NO: 13124 - DNA, 18 bp, Artificial Sequence
  Synthetic DNA
tagtacgactcaccaatg

SEQ ID NO: 13125 - DNA, 18 bp, Artificial Sequence
  Synthetic DNA
tagtacgactcaggattg

SEQ ID NO: 13126 - DNA, 18 bp, Artificial Sequence
  Synthetic DNA
tagtatgactcactactg

SEQ ID NO: 13127 - DNA, 18 bp, Artificial Sequence
  Synthetic DNA
tagtattactcgctatag

SEQ ID NO: 13128 - DNA, 18 bp, Artificial Sequence
  Synthetic DNA
tagttcgacacactagag

SEQ ID NO: 13129 - DNA, 18 bp, Artificial Sequence
  Synthetic DNA
tagttcgactcaccagag

SEQ ID NO: 13130 - DNA, 18 bp, Artificial Sequence
  Synthetic DNA
tagttcgaggcactatag

SEQ ID NO: 13131 - DNA, 18 bp, Artificial Sequence
  Synthetic DNA
tagttggactcactctag

SEQ ID NO: 13132 - DNA, 18 bp, Artificial Sequence
  Synthetic DNA
tatatcgactcactatat

SEQ ID NO: 13133 - DNA, 18 bp, Artificial Sequence
  Synthetic DNA
tattacgaatcgcgatag

SEQ ID NO: 13134 - DNA, 18 bp, Artificial Sequence
  Synthetic DNA
tattacgacacggtatag

SEQ ID NO: 13135 - DNA, 18 bp, Artificial Sequence
  Synthetic DNA
tattacgactcaccactg

SEQ ID NO: 13136 - DNA, 18 bp, Artificial Sequence
  Synthetic DNA
tattacgactcgctaacg

SEQ ID NO: 13137 - DNA, 18 bp, Artificial Sequence
  Synthetic DNA
tattaggactaactattg

SEQ ID NO: 13138 - DNA, 18 bp, Artificial Sequence
  Synthetic DNA
tattaggactgactattg

SEQ ID NO: 13139 - DNA, 18 bp, Artificial Sequence
  Synthetic DNA
tattccgactcacgattg

SEQ ID NO: 13140 - DNA, 18 bp, Artificial Sequence
  Synthetic DNA
tatttagactcactaaag

SEQ ID NO: 13141 - DNA, 18 bp, Artificial Sequence
  Synthetic DNA
tatttcaacccactatag

SEQ ID NO: 13142 - DNA, 18 bp, Artificial Sequence
  Synthetic DNA
tatttcgagtcactctag

SEQ ID NO: 13143 - DNA, 18 bp, Artificial Sequence
  Synthetic DNA
tcaggcgactcactattg

SEQ ID NO: 13144 - DNA, 18 bp, Artificial Sequence
  Synthetic DNA
tcatacgactcaggattg

SEQ ID NO: 13145 - DNA, 18 bp, Artificial Sequence
  Synthetic DNA
tcatacgactcgacatag

SEQ ID NO: 13146 - DNA, 18 bp, Artificial Sequence
  Synthetic DNA
tcatacgagacactattg

SEQ ID NO: 13147 - DNA, 18 bp, Artificial Sequence
  Synthetic DNA
tcatacgagtcgcaatag

SEQ ID NO: 13148 - DNA, 18 bp, Artificial Sequence
  Synthetic DNA
tcattcgactcagtaaag

SEQ ID NO: 13149 - DNA, 18 bp, Artificial Sequence
  Synthetic DNA
tcgtacgactcaatattg

SEQ ID NO: 13150 - DNA, 18 bp, Artificial Sequence
  Synthetic DNA
tgacacgactcagtattg

SEQ ID NO: 13151 - DNA, 18 bp, Artificial Sequence
  Synthetic DNA
tgatacaattcgctatag

SEQ ID NO: 13152 - DNA, 18 bp, Artificial Sequence
  Synthetic DNA
tgatacgactcaatactg

SEQ ID NO: 13153 - DNA, 18 bp, Artificial Sequence
  Synthetic DNA
tgataggactcactagtg

SEQ ID NO: 13154 - DNA, 18 bp, Artificial Sequence
  Synthetic DNA
tgatatgactcactactg

SEQ ID NO: 13155 - DNA, 18 bp, Artificial Sequence
  Synthetic DNA
tgatgcaactcactattg

SEQ ID NO: 13156 - DNA, 18 bp, Artificial Sequence
  Synthetic DNA
tgatgccactcactattg

SEQ ID NO: 13157 - DNA, 18 bp, Artificial Sequence
  Synthetic DNA
tgatgcgactcactatta

SEQ ID NO: 13158 - DNA, 18 bp, Artificial Sequence
  Synthetic DNA
tgattcgacttcctatag

SEQ ID NO: 13159 - DNA, 18 bp, Artificial Sequence
  Synthetic DNA
tgattcgcgtcactatag

SEQ ID NO: 13160 - DNA, 18 bp, Artificial Sequence
  Synthetic DNA
tgattcggctcaccatag

SEQ ID NO: 13161 - DNA, 18 bp, Artificial Sequence
  Synthetic DNA
tgattggactcactatgg

SEQ ID NO: 13162 - DNA, 18 bp, Artificial Sequence
  Synthetic DNA
tgctacgactcactgttg

SEQ ID NO: 13163 - DNA, 18 bp, Artificial Sequence
  Synthetic DNA
tgttacgactggctatag

SEQ ID NO: 13164 - DNA, 18 bp, Artificial Sequence
  Synthetic DNA
tgttacgacttgctatag

SEQ ID NO: 13165 - DNA, 18 bp, Artificial Sequence
  Synthetic DNA
tgtttcgactcacgatag

SEQ ID NO: 13166 - DNA, 18 bp, Artificial Sequence
  Synthetic DNA
ttacgcgactcactattg

SEQ ID NO: 13167 - DNA, 18 bp, Artificial Sequence
  Synthetic DNA
ttataagactcgctaaag

SEQ ID NO: 13168 - DNA, 18 bp, Artificial Sequence
  Synthetic DNA
ttataagactcgctacag

SEQ ID NO: 13169 - DNA, 18 bp, Artificial Sequence
  Synthetic DNA
ttataccactcgctatcg

SEQ ID NO: 13170 - DNA, 18 bp, Artificial Sequence
  Synthetic DNA
ttatacccctcactattg

SEQ ID NO: 13171 - DNA, 18 bp, Artificial Sequence
  Synthetic DNA
ttatacgacacactatta

SEQ ID NO: 13172 - DNA, 18 bp, Artificial Sequence
  Synthetic DNA
ttatacgactcacttttc

SEQ ID NO: 13173 - DNA, 18 bp, Artificial Sequence
  Synthetic DNA
ttatacgactcgttacag

SEQ ID NO: 13174 - DNA, 18 bp, Artificial Sequence
  Synthetic DNA
ttatacgagtcagtattg

SEQ ID NO: 13175 - DNA, 18 bp, Artificial Sequence
  Synthetic DNA
ttatacgattcgccatag

SEQ ID NO: 13176 - DNA, 18 bp, Artificial Sequence
  Synthetic DNA
ttatacggctcactagtg

SEQ ID NO: 13177 - DNA, 18 bp, Artificial Sequence
  Synthetic DNA
ttatactactcgctatcg

SEQ ID NO: 13178 - DNA, 18 bp, Artificial Sequence
  Synthetic DNA
ttataggactcgatatag

SEQ ID NO: 13179 - DNA, 18 bp, Artificial Sequence
  Synthetic DNA
ttatatgactcactagtg

SEQ ID NO: 13180 - DNA, 18 bp, Artificial Sequence
  Synthetic DNA
ttatatggctcactattg

SEQ ID NO: 13181 - DNA, 18 bp, Artificial Sequence
  Synthetic DNA
ttatgcgactggctatag

SEQ ID NO: 13182 - DNA, 18 bp, Artificial Sequence
  Synthetic DNA
ttatgcgagtcgctatag

SEQ ID NO: 13183 - DNA, 18 bp, Artificial Sequence
  Synthetic DNA
ttatgcgtctcactattg

SEQ ID NO: 13184 - DNA, 18 bp, Artificial Sequence
  Synthetic DNA
ttattcaactcagtatag

SEQ ID NO: 13185 - DNA, 18 bp, Artificial Sequence
  Synthetic DNA
ttattcgactcactctcg

SEQ ID NO: 13186 - DNA, 18 bp, Artificial Sequence
  Synthetic DNA
ttattcgactcactgtcg

SEQ ID NO: 13187 - DNA, 18 bp, Artificial Sequence
  Synthetic DNA
ttattcgcctcactatat

SEQ ID NO: 13188 - DNA, 18 bp, Artificial Sequence
  Synthetic DNA
ttattcgcctcactgtag

SEQ ID NO: 13189 - DNA, 18 bp, Artificial Sequence
  Synthetic DNA
ttcttcgactcactatgg

SEQ ID NO: 13190 - DNA, 18 bp, Artificial Sequence
  Synthetic DNA
ttcttcggctcactatag

SEQ ID NO: 13191 - DNA, 18 bp, Artificial Sequence
  Synthetic DNA
ttgtaagactcgctatag

SEQ ID NO: 13192 - DNA, 18 bp, Artificial Sequence
  Synthetic DNA
ttttacggctcgctatag

SEQ ID NO: 13193 - DNA, 18 bp, Artificial Sequence
  Synthetic DNA
aaaaaccacccactatag

SEQ ID NO: 13194 - DNA, 18 bp, Artificial Sequence
  Synthetic DNA
aaaaacgagtcactacag

SEQ ID NO: 13195 - DNA, 18 bp, Artificial Sequence
  Synthetic DNA
aaaagcgactcacgatag

SEQ ID NO: 13196 - DNA, 18 bp, Artificial Sequence
  Synthetic DNA
aaaagcgactcactctag

SEQ ID NO: 13197 - DNA, 18 bp, Artificial Sequence
  Synthetic DNA
aaacacgactccctctag

SEQ ID NO: 13198 - DNA, 18 bp, Artificial Sequence
  Synthetic DNA
aaagacgaatcactatcg

SEQ ID NO: 13199 - DNA, 18 bp, Artificial Sequence
  Synthetic DNA
aaataagacgcacaatag

SEQ ID NO: 13200 - DNA, 18 bp, Artificial Sequence
  Synthetic DNA
aaataagactcactaaac

SEQ ID NO: 13201 - DNA, 18 bp, Artificial Sequence
  Synthetic DNA
aaataagagtcactttag

SEQ ID NO: 13202 - DNA, 18 bp, Artificial Sequence
  Synthetic DNA
aaatacaactcacgttag

SEQ ID NO: 13203 - DNA, 18 bp, Artificial Sequence
  Synthetic DNA
aaatacaactctctatcg

SEQ ID NO: 13204 - DNA, 18 bp, Artificial Sequence
  Synthetic DNA
aaatacatctccctatag

SEQ ID NO: 13205 - DNA, 18 bp, Artificial Sequence
  Synthetic DNA
aaatacgaatcacaagag

SEQ ID NO: 13206 - DNA, 18 bp, Artificial Sequence
  Synthetic DNA
aaatacgaattacgatag

SEQ ID NO: 13207 - DNA, 18 bp, Artificial Sequence
  Synthetic DNA
aaatacgacacactggag

SEQ ID NO: 13208 - DNA, 18 bp, Artificial Sequence
  Synthetic DNA
aaatacgaccacctatag

SEQ ID NO: 13209 - DNA, 18 bp, Artificial Sequence
  Synthetic DNA
aaatacgacgcattatcg

SEQ ID NO: 13210 - DNA, 18 bp, Artificial Sequence
  Synthetic DNA
aaatacgatacactatgg

SEQ ID NO: 13211 - DNA, 18 bp, Artificial Sequence
  Synthetic DNA
aaatactactgactaaag

SEQ ID NO: 13212 - DNA, 18 bp, Artificial Sequence
  Synthetic DNA
aaatactcgtcactatag

SEQ ID NO: 13213 - DNA, 18 bp, Artificial Sequence
  Synthetic DNA
aaatagaactcaatatag

SEQ ID NO: 13214 - DNA, 18 bp, Artificial Sequence
  Synthetic DNA
aaatagcattcactatag

SEQ ID NO: 13215 - DNA, 18 bp, Artificial Sequence
  Synthetic DNA
aaataggactcactagcg

SEQ ID NO: 13216 - DNA, 18 bp, Artificial Sequence
  Synthetic DNA
aaataggactctctctag

SEQ ID NO: 13217 - DNA, 18 bp, Artificial Sequence
  Synthetic DNA
aaatataacgcactatag

SEQ ID NO: 13218 - DNA, 18 bp, Artificial Sequence
  Synthetic DNA
aaatatcactcactaaag

SEQ ID NO: 13219 - DNA, 18 bp, Artificial Sequence
  Synthetic DNA
aaatattagtcactatag

SEQ ID NO: 13220 - DNA, 18 bp, Artificial Sequence
  Synthetic DNA
aaatcaggctcactatag

SEQ ID NO: 13221 - DNA, 18 bp, Artificial Sequence
  Synthetic DNA
aaatccgactcaatctag

SEQ ID NO: 13222 - DNA, 18 bp, Artificial Sequence
  Synthetic DNA
aaatccgactcattgtag

SEQ ID NO: 13223 - DNA, 18 bp, Artificial Sequence
  Synthetic DNA
aaatgagagtcactatag

SEQ ID NO: 13224 - DNA, 18 bp, Artificial Sequence
  Synthetic DNA
aaatgcgactcaataaag

SEQ ID NO: 13225 - DNA, 18 bp, Artificial Sequence
  Synthetic DNA
aaatgcgactcaatacag

SEQ ID NO: 13226 - DNA, 18 bp, Artificial Sequence
  Synthetic DNA
aaatgcgactcaccctag

SEQ ID NO: 13227 - DNA, 18 bp, Artificial Sequence
  Synthetic DNA
aaatgcgactcagtacag

SEQ ID NO: 13228 - DNA, 18 bp, Artificial Sequence
  Synthetic DNA
aaatgcgacttactacag

SEQ ID NO: 13229 - DNA, 18 bp, Artificial Sequence
  Synthetic DNA
aaatgggactcactctag

SEQ ID NO: 13230 - DNA, 18 bp, Artificial Sequence
  Synthetic DNA
aacaacgactcactctag

SEQ ID NO: 13231 - DNA, 18 bp, Artificial Sequence
  Synthetic DNA
aactaagattcactatag

SEQ ID NO: 13232 - DNA, 18 bp, Artificial Sequence
  Synthetic DNA
aactacgactcaccaaag

SEQ ID NO: 13233 - DNA, 18 bp, Artificial Sequence
  Synthetic DNA
aactacgattgactatag

SEQ ID NO: 13234 - DNA, 18 bp, Artificial Sequence
  Synthetic DNA
aactacggctcactaaag

SEQ ID NO: 13235 - DNA, 18 bp, Artificial Sequence
  Synthetic DNA
aactactactcactttag

SEQ ID NO: 13236 - DNA, 18 bp, Artificial Sequence
  Synthetic DNA
aaggaccactcactatag

SEQ ID NO: 13237 - DNA, 18 bp, Artificial Sequence
  Synthetic DNA
aaggacgactcactttag

SEQ ID NO: 13238 - DNA, 18 bp, Artificial Sequence
  Synthetic DNA
aagtacgactccatatag

SEQ ID NO: 13239 - DNA, 18 bp, Artificial Sequence
  Synthetic DNA
aagtccggctcactatag

SEQ ID NO: 13240 - DNA, 18 bp, Artificial Sequence
  Synthetic DNA
aattacgactaactgtag

SEQ ID NO: 13241 - DNA, 18 bp, Artificial Sequence
  Synthetic DNA
aattatgcctcactatag

SEQ ID NO: 13242 - DNA, 18 bp, Artificial Sequence
  Synthetic DNA
acatatgacacactatag

SEQ ID NO: 13243 - DNA, 18 bp, Artificial Sequence
  Synthetic DNA
agatacaactcactgtag

SEQ ID NO: 13244 - DNA, 18 bp, Artificial Sequence
  Synthetic DNA
agatacgagtcactatcg

SEQ ID NO: 13245 - DNA, 18 bp, Artificial Sequence
  Synthetic DNA
agatacggcacactatag

SEQ ID NO: 13246 - DNA, 18 bp, Artificial Sequence
  Synthetic DNA
agctacgactcattatag

SEQ ID NO: 13247 - DNA, 18 bp, Artificial Sequence
  Synthetic DNA
atatacaactcactagag

SEQ ID NO: 13248 - DNA, 18 bp, Artificial Sequence
  Synthetic DNA
atatgctactcactatag

SEQ ID NO: 13249 - DNA, 18 bp, Artificial Sequence
  Synthetic DNA
atatgggactcactatag

SEQ ID NO: 13250 - DNA, 18 bp, Artificial Sequence
  Synthetic DNA
atctacgactcagtatag

SEQ ID NO: 13251 - DNA, 18 bp, Artificial Sequence
  Synthetic DNA
caaaacgacttcctatag

SEQ ID NO: 13252 - DNA, 18 bp, Artificial Sequence
  Synthetic DNA
caaaatgactcactgtag

SEQ ID NO: 13253 - DNA, 18 bp, Artificial Sequence
  Synthetic DNA
caaagcgactcactttag

SEQ ID NO: 13254 - DNA, 18 bp, Artificial Sequence
  Synthetic DNA
caacaagactcactaaag

SEQ ID NO: 13255 - DNA, 18 bp, Artificial Sequence
  Synthetic DNA
caacacgactaactatcg

SEQ ID NO: 13256 - DNA, 18 bp, Artificial Sequence
  Synthetic DNA
caacaggactcactttag

SEQ ID NO: 13257 - DNA, 18 bp, Artificial Sequence
  Synthetic DNA
caagaggagtcactatag

SEQ ID NO: 13258 - DNA, 18 bp, Artificial Sequence
  Synthetic DNA
caataagactcagtaaag

SEQ ID NO: 13259 - DNA, 18 bp, Artificial Sequence
  Synthetic DNA
caatacaactcactttgg

SEQ ID NO: 13260 - DNA, 18 bp, Artificial Sequence
  Synthetic DNA
caataccactaactaaag

SEQ ID NO: 13261 - DNA, 18 bp, Artificial Sequence
  Synthetic DNA
caatacgacacagtacag

SEQ ID NO: 13262 - DNA, 18 bp, Artificial Sequence
  Synthetic DNA
caatacgacccatcatag

SEQ ID NO: 13263 - DNA, 18 bp, Artificial Sequence
  Synthetic DNA
caatacgactcaggttag

SEQ ID NO: 13264 - DNA, 18 bp, Artificial Sequence
  Synthetic DNA
caatacgactcatcatat

SEQ ID NO: 13265 - DNA, 18 bp, Artificial Sequence
  Synthetic DNA
caatacgactccctttcg

SEQ ID NO: 13266 - DNA, 18 bp, Artificial Sequence
  Synthetic DNA
caatacgacttactttgg

SEQ ID NO: 13267 - DNA, 18 bp, Artificial Sequence
  Synthetic DNA
caatacgattaattatag

SEQ ID NO: 13268 - DNA, 18 bp, Artificial Sequence
  Synthetic DNA
caatacgcgtcactacag

SEQ ID NO: 13269 - DNA, 18 bp, Artificial Sequence
  Synthetic DNA
caatacggctcactaggg

SEQ ID NO: 13270 - DNA, 18 bp, Artificial Sequence
  Synthetic DNA
caatacgtcccactaaag

SEQ ID NO: 13271 - DNA, 18 bp, Artificial Sequence
  Synthetic DNA
caatacgtctcaacatag

SEQ ID NO: 13272 - DNA, 18 bp, Artificial Sequence
  Synthetic DNA
caatacgtctcactgcag

SEQ ID NO: 13273 - DNA, 18 bp, Artificial Sequence
  Synthetic DNA
caatacgtctcactttac

SEQ ID NO: 13274 - DNA, 18 bp, Artificial Sequence
  Synthetic DNA
caatacgtctcaggatag

SEQ ID NO: 13275 - DNA, 18 bp, Artificial Sequence
  Synthetic DNA
caatacgtctcagtaaag

SEQ ID NO: 13276 - DNA, 18 bp, Artificial Sequence
  Synthetic DNA
caataggactgactttag

SEQ ID NO: 13277 - DNA, 18 bp, Artificial Sequence
  Synthetic DNA
caatagggctcattatag

SEQ ID NO: 13278 - DNA, 18 bp, Artificial Sequence
  Synthetic DNA
caatccgattcacaatag

SEQ ID NO: 13279 - DNA, 18 bp, Artificial Sequence
  Synthetic DNA
caatccgattccctatag

SEQ ID NO: 13280 - DNA, 18 bp, Artificial Sequence
  Synthetic DNA
caatgcgattcactaaag

SEQ ID NO: 13281 - DNA, 18 bp, Artificial Sequence
  Synthetic DNA
caatgcgtctctctatag

SEQ ID NO: 13282 - DNA, 18 bp, Artificial Sequence
  Synthetic DNA
cactacggctcactatcg

SEQ ID NO: 13283 - DNA, 18 bp, Artificial Sequence
  Synthetic DNA
cagtacgacccactctag

SEQ ID NO: 13284 - DNA, 18 bp, Artificial Sequence
  Synthetic DNA
cagtacgcatcactatag

SEQ ID NO: 13285 - DNA, 18 bp, Artificial Sequence
  Synthetic DNA
cagtccgactcaccatag

SEQ ID NO: 13286 - DNA, 18 bp, Artificial Sequence
  Synthetic DNA
cattacgactcattacag

SEQ ID NO: 13287 - DNA, 18 bp, Artificial Sequence
  Synthetic DNA
cattccgactcactatcg

SEQ ID NO: 13288 - DNA, 18 bp, Artificial Sequence
  Synthetic DNA
ccataagactcactttag

SEQ ID NO: 13289 - DNA, 18 bp, Artificial Sequence
  Synthetic DNA
ccatacgactccctttag

SEQ ID NO: 13290 - DNA, 18 bp, Artificial Sequence
  Synthetic DNA
cgataccaatcactatag

SEQ ID NO: 13291 - DNA, 18 bp, Artificial Sequence
  Synthetic DNA
ctatacgactcacactag

SEQ ID NO: 13292 - DNA, 18 bp, Artificial Sequence
  Synthetic DNA
ctatacgatccactatag

SEQ ID NO: 13293 - DNA, 18 bp, Artificial Sequence
  Synthetic DNA
ctatactacgcactatag

SEQ ID NO: 13294 - DNA, 18 bp, Artificial Sequence
  Synthetic DNA
ctataggactcactctag

SEQ ID NO: 13295 - DNA, 18 bp, Artificial Sequence
  Synthetic DNA
ctatgggactcactatag

SEQ ID NO: 13296 - DNA, 18 bp, Artificial Sequence
  Synthetic DNA
gaaaacgcatcactatag

SEQ ID NO: 13297 - DNA, 18 bp, Artificial Sequence
  Synthetic DNA
gaataagacccactacag

SEQ ID NO: 13298 - DNA, 18 bp, Artificial Sequence
  Synthetic DNA
gaatacaactatctatag

SEQ ID NO: 13299 - DNA, 18 bp, Artificial Sequence
  Synthetic DNA
gaatacgactcaaaaaag

SEQ ID NO: 13300 - DNA, 18 bp, Artificial Sequence
  Synthetic DNA
gaatatgactcactgaag

SEQ ID NO: 13301 - DNA, 18 bp, Artificial Sequence
  Synthetic DNA
gattacgtcacactatag

SEQ ID NO: 13302 - DNA, 18 bp, Artificial Sequence
  Synthetic DNA
gattactattcactatag

SEQ ID NO: 13303 - DNA, 18 bp, Artificial Sequence
  Synthetic DNA
gattatgacacactatag

SEQ ID NO: 13304 - DNA, 18 bp, Artificial Sequence
  Synthetic DNA
gcatacggctcactttag

SEQ ID NO: 13305 - DNA, 18 bp, Artificial Sequence
  Synthetic DNA
ggataggattcactatag

SEQ ID NO: 13306 - DNA, 18 bp, Artificial Sequence
  Synthetic DNA
gtatacgactcactctcg

SEQ ID NO: 13307 - DNA, 18 bp, Artificial Sequence
  Synthetic DNA
gtatgcgacccactatag

SEQ ID NO: 13308 - DNA, 18 bp, Artificial Sequence
  Synthetic DNA
gtatgcgactcactacag

SEQ ID NO: 13309 - DNA, 18 bp, Artificial Sequence
  Synthetic DNA
gtttacgactaactatag

SEQ ID NO: 13310 - DNA, 18 bp, Artificial Sequence
  Synthetic DNA
taaaacaacttactgtag

SEQ ID NO: 13311 - DNA, 18 bp, Artificial Sequence
  Synthetic DNA
taaaaccactaactgtag

SEQ ID NO: 13312 - DNA, 18 bp, Artificial Sequence
  Synthetic DNA
taaaaccactcaaaatag

SEQ ID NO: 13313 - DNA, 18 bp, Artificial Sequence
  Synthetic DNA
taaaaccgctcactaaag

SEQ ID NO: 13314 - DNA, 18 bp, Artificial Sequence
  Synthetic DNA
taaaacgactcacggcag

SEQ ID NO: 13315 - DNA, 18 bp, Artificial Sequence
  Synthetic DNA
taaaacgactcactgacg

SEQ ID NO: 13316 - DNA, 18 bp, Artificial Sequence
  Synthetic DNA
taaaacgactcactgccg

SEQ ID NO: 13317 - DNA, 18 bp, Artificial Sequence
  Synthetic DNA
taaaacgactcataagag

SEQ ID NO: 13318 - DNA, 18 bp, Artificial Sequence
  Synthetic DNA
taaaacgactcccaatcg

SEQ ID NO: 13319 - DNA, 18 bp, Artificial Sequence
  Synthetic DNA
taaaacgactctccagag

SEQ ID NO: 13320 - DNA, 18 bp, Artificial Sequence
  Synthetic DNA
taaaacgagttaccatag

SEQ ID NO: 13321 - DNA, 18 bp, Artificial Sequence
  Synthetic DNA
taaaacgtctcagtataa

SEQ ID NO: 13322 - DNA, 18 bp, Artificial Sequence
  Synthetic DNA
taaaactactcactctcg

SEQ ID NO: 13323 - DNA, 18 bp, Artificial Sequence
  Synthetic DNA
taaaactcctcactacag

SEQ ID NO: 13324 - DNA, 18 bp, Artificial Sequence
  Synthetic DNA
taaaaggaaccactatag

SEQ ID NO: 13325 - DNA, 18 bp, Artificial Sequence
  Synthetic DNA
taaaatgaatcaatatag

SEQ ID NO: 13326 - DNA, 18 bp, Artificial Sequence
  Synthetic DNA
taaaatgactgactctag

SEQ ID NO: 13327 - DNA, 18 bp, Artificial Sequence
  Synthetic DNA
taaaccgacttactatcg

SEQ ID NO: 13328 - DNA, 18 bp, Artificial Sequence
  Synthetic DNA
taaaccgtctcactatcg

SEQ ID NO: 13329 - DNA, 18 bp, Artificial Sequence
  Synthetic DNA
taaacttactcactatag

SEQ ID NO: 13330 - DNA, 18 bp, Artificial Sequence
  Synthetic DNA
taaagagactcactctag

SEQ ID NO: 13331 - DNA, 18 bp, Artificial Sequence
  Synthetic DNA
taaagcaactcagtatag

SEQ ID NO: 13332 - DNA, 18 bp, Artificial Sequence
  Synthetic DNA
taaagcgactcactaacg

SEQ ID NO: 13333 - DNA, 18 bp, Artificial Sequence
  Synthetic DNA
taaagcgactcactatcc

SEQ ID NO: 13334 - DNA, 18 bp, Artificial Sequence
  Synthetic DNA
taaagcgtatcactatag

SEQ ID NO: 13335 - DNA, 18 bp, Artificial Sequence
  Synthetic DNA
taaagtgactcaccatag

SEQ ID NO: 13336 - DNA, 18 bp, Artificial Sequence
  Synthetic DNA
taacaactctcactatag

SEQ ID NO: 13337 - DNA, 18 bp, Artificial Sequence
  Synthetic DNA
taacaagacgcactttag

SEQ ID NO: 13338 - DNA, 18 bp, Artificial Sequence
  Synthetic DNA
taacaagactcccgatag

SEQ ID NO: 13339 - DNA, 18 bp, Artificial Sequence
  Synthetic DNA
taacacaactcaagatag

SEQ ID NO: 13340 - DNA, 18 bp, Artificial Sequence
  Synthetic DNA
taacacacctcacaatag

SEQ ID NO: 13341 - DNA, 18 bp, Artificial Sequence
  Synthetic DNA
taacaccactcactcaag

SEQ ID NO: 13342 - DNA, 18 bp, Artificial Sequence
  Synthetic DNA
taacacgacaaactctag

SEQ ID NO: 13343 - DNA, 18 bp, Artificial Sequence
  Synthetic DNA
taacacgaccctctatcg

SEQ ID NO: 13344 - DNA, 18 bp, Artificial Sequence
  Synthetic DNA
taacacgactaactcaag

SEQ ID NO: 13345 - DNA, 18 bp, Artificial Sequence
  Synthetic DNA
taacacgactcactcacg

SEQ ID NO: 13346 - DNA, 18 bp, Artificial Sequence
  Synthetic DNA
taacacgactcacttaaa

SEQ ID NO: 13347 - DNA, 18 bp, Artificial Sequence
  Synthetic DNA
taacacgactcctaatag

SEQ ID NO: 13348 - DNA, 18 bp, Artificial Sequence
  Synthetic DNA
taacacgattcaatatcg

SEQ ID NO: 13349 - DNA, 18 bp, Artificial Sequence
  Synthetic DNA
taacacgattctcgatag

SEQ ID NO: 13350 - DNA, 18 bp, Artificial Sequence
  Synthetic DNA
taacacgcctcacagtag

SEQ ID NO: 13351 - DNA, 18 bp, Artificial Sequence
  Synthetic DNA
taacacgtctccctagag

SEQ ID NO: 13352 - DNA, 18 bp, Artificial Sequence
  Synthetic DNA
taacacgtgttactatag

SEQ ID NO: 13353 - DNA, 18 bp, Artificial Sequence
  Synthetic DNA
taacaggactcaataaag

SEQ ID NO: 13354 - DNA, 18 bp, Artificial Sequence
  Synthetic DNA
taacaggactcagtaaag

SEQ ID NO: 13355 - DNA, 18 bp, Artificial Sequence
  Synthetic DNA
taacatgactccctttag

SEQ ID NO: 13356 - DNA, 18 bp, Artificial Sequence
  Synthetic DNA
taacatgagtccctatag

SEQ ID NO: 13357 - DNA, 18 bp, Artificial Sequence
  Synthetic DNA
taacccaactcacaatag

SEQ ID NO: 13358 - DNA, 18 bp, Artificial Sequence
  Synthetic DNA
taacccgacacacaatag

SEQ ID NO: 13359 - DNA, 18 bp, Artificial Sequence
  Synthetic DNA
taacctgactctctatag

SEQ ID NO: 13360 - DNA, 18 bp, Artificial Sequence
  Synthetic DNA
taacgcgactcacaatgg

SEQ ID NO: 13361 - DNA, 18 bp, Artificial Sequence
  Synthetic DNA
taagacaacccactttag

SEQ ID NO: 13362 - DNA, 18 bp, Artificial Sequence
  Synthetic DNA
taagacgacatactttag

SEQ ID NO: 13363 - DNA, 18 bp, Artificial Sequence
  Synthetic DNA
taagacgacgcagcatag

SEQ ID NO: 13364 - DNA, 18 bp, Artificial Sequence
  Synthetic DNA
taagacgataccctatag

SEQ ID NO: 13365 - DNA, 18 bp, Artificial Sequence
  Synthetic DNA
taagacgtctcattatgg

SEQ ID NO: 13366 - DNA, 18 bp, Artificial Sequence
  Synthetic DNA
taagacgtctctccatag

SEQ ID NO: 13367 - DNA, 18 bp, Artificial Sequence
  Synthetic DNA
taagaggacccactttag

SEQ ID NO: 13368 - DNA, 18 bp, Artificial Sequence
  Synthetic DNA
taagccgacttcctatag

SEQ ID NO: 13369 - DNA, 18 bp, Artificial Sequence
  Synthetic DNA
taaggcgacttacaatag

SEQ ID NO: 13370 - DNA, 18 bp, Artificial Sequence
  Synthetic DNA
taataacactcaatatgg

SEQ ID NO: 13371 - DNA, 18 bp, Artificial Sequence
  Synthetic DNA
taataagactcaaactag

SEQ ID NO: 13372 - DNA, 18 bp, Artificial Sequence
  Synthetic DNA
taataagactcacaaccg

SEQ ID NO: 13373 - DNA, 18 bp, Artificial Sequence
  Synthetic DNA
taataagactcacaccag

SEQ ID NO: 13374 - DNA, 18 bp, Artificial Sequence
  Synthetic DNA
taataagactcactgaaa

SEQ ID NO: 13375 - DNA, 18 bp, Artificial Sequence
  Synthetic DNA
taataagactcatcaaag

SEQ ID NO: 13376 - DNA, 18 bp, Artificial Sequence
  Synthetic DNA
taataagactcattttgg

SEQ ID NO: 13377 - DNA, 18 bp, Artificial Sequence
  Synthetic DNA
taataagactctatataa

SEQ ID NO: 13378 - DNA, 18 bp, Artificial Sequence
  Synthetic DNA
taataagactctccatcg

SEQ ID NO: 13379 - DNA, 18 bp, Artificial Sequence
  Synthetic DNA
taataagactctccttag

SEQ ID NO: 13380 - DNA, 18 bp, Artificial Sequence
  Synthetic DNA
taataagactgagtatcg

SEQ ID NO: 13381 - DNA, 18 bp, Artificial Sequence
  Synthetic DNA
taataagagtcaataaag

SEQ ID NO: 13382 - DNA, 18 bp, Artificial Sequence
  Synthetic DNA
taataagagttaatatag

SEQ ID NO: 13383 - DNA, 18 bp, Artificial Sequence
  Synthetic DNA
taataagccacactatgg

SEQ ID NO: 13384 - DNA, 18 bp, Artificial Sequence
  Synthetic DNA
taataagcttcactaaag

SEQ ID NO: 13385 - DNA, 18 bp, Artificial Sequence
  Synthetic DNA
taataagtctcacgttag

SEQ ID NO: 13386 - DNA, 18 bp, Artificial Sequence
  Synthetic DNA
taataagtctgagtatag

SEQ ID NO: 13387 - DNA, 18 bp, Artificial Sequence
  Synthetic DNA
taataatagtcaccatag

SEQ ID NO: 13388 - DNA, 18 bp, Artificial Sequence
  Synthetic DNA
taatacaaatcacgctag

SEQ ID NO: 13389 - DNA, 18 bp, Artificial Sequence
  Synthetic DNA
taatacaacacacggtag

SEQ ID NO: 13390 - DNA, 18 bp, Artificial Sequence
  Synthetic DNA
taatacaacacactgcag

SEQ ID NO: 13391 - DNA, 18 bp, Artificial Sequence
  Synthetic DNA
taatacaactacctatcg

SEQ ID NO: 13392 - DNA, 18 bp, Artificial Sequence
  Synthetic DNA
taatacaactcacaacaa

SEQ ID NO: 13393 - DNA, 18 bp, Artificial Sequence
  Synthetic DNA
taatacaactgacaacag

SEQ ID NO: 13394 - DNA, 18 bp, Artificial Sequence
  Synthetic DNA
taatacaactgaccctag

SEQ ID NO: 13395 - DNA, 18 bp, Artificial Sequence
  Synthetic DNA
taatacaagtaactaaag

SEQ ID NO: 13396 - DNA, 18 bp, Artificial Sequence
  Synthetic DNA
taatacacgtcactacag

SEQ ID NO: 13397 - DNA, 18 bp, Artificial Sequence
  Synthetic DNA
taatacagcccactttag

SEQ ID NO: 13398 - DNA, 18 bp, Artificial Sequence
  Synthetic DNA
taataccacatactacag

SEQ ID NO: 13399 - DNA, 18 bp, Artificial Sequence
  Synthetic DNA
taataccactacatatag

SEQ ID NO: 13400 - DNA, 18 bp, Artificial Sequence
  Synthetic DNA
taataccactctctaagg

SEQ ID NO: 13401 - DNA, 18 bp, Artificial Sequence
  Synthetic DNA
taataccccacactacag

SEQ ID NO: 13402 - DNA, 18 bp, Artificial Sequence
  Synthetic DNA
taataccgctaactacag

SEQ ID NO: 13403 - DNA, 18 bp, Artificial Sequence
  Synthetic DNA
taataccgctcaccaaag

SEQ ID NO: 13404 - DNA, 18 bp, Artificial Sequence
  Synthetic DNA
taatacctctcactttcg

SEQ ID NO: 13405 - DNA, 18 bp, Artificial Sequence
  Synthetic DNA
taatacgaataaccatcg

SEQ ID NO: 13406 - DNA, 18 bp, Artificial Sequence
  Synthetic DNA
taatacgaatcacccaag

SEQ ID NO: 13407 - DNA, 18 bp, Artificial Sequence
  Synthetic DNA
taatacgaatcatcctag

SEQ ID NO: 13408 - DNA, 18 bp, Artificial Sequence
  Synthetic DNA
taatacgaatctgaatag

SEQ ID NO: 13409 - DNA, 18 bp, Artificial Sequence
  Synthetic DNA
taatacgaatctgtataa

SEQ ID NO: 13410 - DNA, 18 bp, Artificial Sequence
  Synthetic DNA
taatacgaatgcctttag

SEQ ID NO: 13411 - DNA, 18 bp, Artificial Sequence
  Synthetic DNA
taatacgaattattgtag

SEQ ID NO: 13412 - DNA, 18 bp, Artificial Sequence
  Synthetic DNA
taatacgacacacactat

SEQ ID NO: 13413 - DNA, 18 bp, Artificial Sequence
  Synthetic DNA
taatacgacactgcatag

SEQ ID NO: 13414 - DNA, 18 bp, Artificial Sequence
  Synthetic DNA
taatacgacactgtctag

SEQ ID NO: 13415 - DNA, 18 bp, Artificial Sequence
  Synthetic DNA
taatacgacagaccatgg

SEQ ID NO: 13416 - DNA, 18 bp, Artificial Sequence
  Synthetic DNA
taatacgacatacaataa

SEQ ID NO: 13417 - DNA, 18 bp, Artificial Sequence
  Synthetic DNA
taatacgaccctttgtag

SEQ ID NO: 13418 - DNA, 18 bp, Artificial Sequence
  Synthetic DNA
taatacgaccgacttgag

SEQ ID NO: 13419 - DNA, 18 bp, Artificial Sequence
  Synthetic DNA
taatacgacgctttatcg

SEQ ID NO: 13420 - DNA, 18 bp, Artificial Sequence
  Synthetic DNA
taatacgactaacaaaat

SEQ ID NO: 13421 - DNA, 18 bp, Artificial Sequence
  Synthetic DNA
taatacgactaacagtcg

SEQ ID NO: 13422 - DNA, 18 bp, Artificial Sequence
  Synthetic DNA
taatacgactaactgaac

SEQ ID NO: 13423 - DNA, 18 bp, Artificial Sequence
  Synthetic DNA
taatacgactaactgacg

SEQ ID NO: 13424 - DNA, 18 bp, Artificial Sequence
  Synthetic DNA
taatacgactaactgtgc

SEQ ID NO: 13425 - DNA, 18 bp, Artificial Sequence
  Synthetic DNA
taatacgactatccataa

SEQ ID NO: 13426 - DNA, 18 bp, Artificial Sequence
  Synthetic DNA
taatacgactcaatcacg

SEQ ID NO: 13427 - DNA, 18 bp, Artificial Sequence
  Synthetic DNA
taatacgactcaattaac

SEQ ID NO: 13428 - DNA, 18 bp, Artificial Sequence
  Synthetic DNA
taatacgactcacgcccg

SEQ ID NO: 13429 - DNA, 18 bp, Artificial Sequence
  Synthetic DNA
taatacgactcagttaat

SEQ ID NO: 13430 - DNA, 18 bp, Artificial Sequence
  Synthetic DNA
taatacgactctcgggag

SEQ ID NO: 13431 - DNA, 18 bp, Artificial Sequence
  Synthetic DNA
taatacgactctctaaca

SEQ ID NO: 13432 - DNA, 18 bp, Artificial Sequence
  Synthetic DNA
taatacgactctctgtgc

SEQ ID NO: 13433 - DNA, 18 bp, Artificial Sequence
  Synthetic DNA
taatacgactgtctccag

SEQ ID NO: 13434 - DNA, 18 bp, Artificial Sequence
  Synthetic DNA
taatacgacttaccgcag

SEQ ID NO: 13435 - DNA, 18 bp, Artificial Sequence
  Synthetic DNA
taatacgacttcggatag

SEQ ID NO: 13436 - DNA, 18 bp, Artificial Sequence
  Synthetic DNA
taatacgactttttagag

SEQ ID NO: 13437 - DNA, 18 bp, Artificial Sequence
  Synthetic DNA
taatacgagcaacaatag

SEQ ID NO: 13438 - DNA, 18 bp, Artificial Sequence
  Synthetic DNA
taatacgagccacagtag

SEQ ID NO: 13439 - DNA, 18 bp, Artificial Sequence
  Synthetic DNA
taatacgagctaccatag

SEQ ID NO: 13440 - DNA, 18 bp, Artificial Sequence
  Synthetic DNA
taatacgagggactgtag

SEQ ID NO: 13441 - DNA, 18 bp, Artificial Sequence
  Synthetic DNA
taatacgatacattgtag

SEQ ID NO: 13442 - DNA, 18 bp, Artificial Sequence
  Synthetic DNA
taatacgattcacagcag

SEQ ID NO: 13443 - DNA, 18 bp, Artificial Sequence
  Synthetic DNA
taatacgattcactcgcg

SEQ ID NO: 13444 - DNA, 18 bp, Artificial Sequence
  Synthetic DNA
taatacgattccttacag

SEQ ID NO: 13445 - DNA, 18 bp, Artificial Sequence
  Synthetic DNA
taatacgatttagtatcg

SEQ ID NO: 13446 - DNA, 18 bp, Artificial Sequence
  Synthetic DNA
taatacgcatccatatag

SEQ ID NO: 13447 - DNA, 18 bp, Artificial Sequence
  Synthetic DNA
taatacgcatctctacag

SEQ ID NO: 13448 - DNA, 18 bp, Artificial Sequence
  Synthetic DNA
taatacgccgcaccacag

SEQ ID NO: 13449 - DNA, 18 bp, Artificial Sequence
  Synthetic DNA
taatacgcctcaccaacg

SEQ ID NO: 13450 - DNA, 18 bp, Artificial Sequence
  Synthetic DNA
taatacgcctcactgagg

SEQ ID NO: 13451 - DNA, 18 bp, Artificial Sequence
  Synthetic DNA
taatacgccttagaatag

SEQ ID NO: 13452 - DNA, 18 bp, Artificial Sequence
  Synthetic DNA
taatacgcgacactatcg

SEQ ID NO: 13453 - DNA, 18 bp, Artificial Sequence
  Synthetic DNA
taatacgcttcacgttag

SEQ ID NO: 13454 - DNA, 18 bp, Artificial Sequence
  Synthetic DNA
taatacggataagtatag

SEQ ID NO: 13455 - DNA, 18 bp, Artificial Sequence
  Synthetic DNA
taatacggcccactgaag

SEQ ID NO: 13456 - DNA, 18 bp, Artificial Sequence
  Synthetic DNA
taatacggccctttatag

SEQ ID NO: 13457 - DNA, 18 bp, Artificial Sequence
  Synthetic DNA
taatacggctacctgtag

SEQ ID NO: 13458 - DNA, 18 bp, Artificial Sequence
  Synthetic DNA
taatacggctcactcagg

SEQ ID NO: 13459 - DNA, 18 bp, Artificial Sequence
  Synthetic DNA
taatacggctcagcttag

SEQ ID NO: 13460 - DNA, 18 bp, Artificial Sequence
  Synthetic DNA
taatacggcttagcatag

SEQ ID NO: 13461 - DNA, 18 bp, Artificial Sequence
  Synthetic DNA
taatacgtatgactacag

SEQ ID NO: 13462 - DNA, 18 bp, Artificial Sequence
  Synthetic DNA
taatacgtcgcactttgg

SEQ ID NO: 13463 - DNA, 18 bp, Artificial Sequence
  Synthetic DNA
taatacgtctcactttcc

SEQ ID NO: 13464 - DNA, 18 bp, Artificial Sequence
  Synthetic DNA
taatacgtctcagtgtac

SEQ ID NO: 13465 - DNA, 18 bp, Artificial Sequence
  Synthetic DNA
taatacgtctcataatac

SEQ ID NO: 13466 - DNA, 18 bp, Artificial Sequence
  Synthetic DNA
taatacgtctcattgtcg

SEQ ID NO: 13467 - DNA, 18 bp, Artificial Sequence
  Synthetic DNA
taatacgtctccccctag

SEQ ID NO: 13468 - DNA, 18 bp, Artificial Sequence
  Synthetic DNA
taatacgtctctctatca

SEQ ID NO: 13469 - DNA, 18 bp, Artificial Sequence
  Synthetic DNA
taatacgtctgattatcg

SEQ ID NO: 13470 - DNA, 18 bp, Artificial Sequence
  Synthetic DNA
taatacgtttcactttaa

SEQ ID NO: 13471 - DNA, 18 bp, Artificial Sequence
  Synthetic DNA
taatactaatgactatcg

SEQ ID NO: 13472 - DNA, 18 bp, Artificial Sequence
  Synthetic DNA
taatactacagagtatag

SEQ ID NO: 13473 - DNA, 18 bp, Artificial Sequence
  Synthetic DNA
taatactacgccctacag

SEQ ID NO: 13474 - DNA, 18 bp, Artificial Sequence
  Synthetic DNA
taatactactcagcaaag

SEQ ID NO: 13475 - DNA, 18 bp, Artificial Sequence
  Synthetic DNA
taatactagtctttatag

SEQ ID NO: 13476 - DNA, 18 bp, Artificial Sequence
  Synthetic DNA
taatactccccactttag

SEQ ID NO: 13477 - DNA, 18 bp, Artificial Sequence
  Synthetic DNA
taatactgctacctatag

SEQ ID NO: 13478 - DNA, 18 bp, Artificial Sequence
  Synthetic DNA
taatactgctccttatag

SEQ ID NO: 13479 - DNA, 18 bp, Artificial Sequence
  Synthetic DNA
taatacttctcactaaaa

SEQ ID NO: 13480 - DNA, 18 bp, Artificial Sequence
  Synthetic DNA
taatagaaatcaccatag

SEQ ID NO: 13481 - DNA, 18 bp, Artificial Sequence
  Synthetic DNA
taatagaactcaccttag

SEQ ID NO: 13482 - DNA, 18 bp, Artificial Sequence
  Synthetic DNA
taatagaactctctctag

SEQ ID NO: 13483 - DNA, 18 bp, Artificial Sequence
  Synthetic DNA
taatagaactgactaaag

SEQ ID NO: 13484 - DNA, 18 bp, Artificial Sequence
  Synthetic DNA
taatagcagccactatag

SEQ ID NO: 13485 - DNA, 18 bp, Artificial Sequence
  Synthetic DNA
taataggaacctctatag

SEQ ID NO: 13486 - DNA, 18 bp, Artificial Sequence
  Synthetic DNA
taataggaatgattatag

SEQ ID NO: 13487 - DNA, 18 bp, Artificial Sequence
  Synthetic DNA
taataggaccttctatag

SEQ ID NO: 13488 - DNA, 18 bp, Artificial Sequence
  Synthetic DNA
taataggactcaaggtag

SEQ ID NO: 13489 - DNA, 18 bp, Artificial Sequence
  Synthetic DNA
taataggactcacttaat

SEQ ID NO: 13490 - DNA, 18 bp, Artificial Sequence
  Synthetic DNA
taataggactcattctcg

SEQ ID NO: 13491 - DNA, 18 bp, Artificial Sequence
  Synthetic DNA
taataggattctatatag

SEQ ID NO: 13492 - DNA, 18 bp, Artificial Sequence
  Synthetic DNA
taataggcctcaccaaag

SEQ ID NO: 13493 - DNA, 18 bp, Artificial Sequence
  Synthetic DNA
taatagtactccctttag

SEQ ID NO: 13494 - DNA, 18 bp, Artificial Sequence
  Synthetic DNA
taatagtcctcacgatag

SEQ ID NO: 13495 - DNA, 18 bp, Artificial Sequence
  Synthetic DNA
taatataactcactctcg

SEQ ID NO: 13496 - DNA, 18 bp, Artificial Sequence
  Synthetic DNA
taatataactccctgtag

SEQ ID NO: 13497 - DNA, 18 bp, Artificial Sequence
  Synthetic DNA
taatatagctcactacag

SEQ ID NO: 13498 - DNA, 18 bp, Artificial Sequence
  Synthetic DNA
taatatcactcactctgg

SEQ ID NO: 13499 - DNA, 18 bp, Artificial Sequence
  Synthetic DNA
taatatcattgactatag

SEQ ID NO: 13500 - DNA, 18 bp, Artificial Sequence
  Synthetic DNA
taatatgaatcaccctag

SEQ ID NO: 13501 - DNA, 18 bp, Artificial Sequence
  Synthetic DNA
taatatgaatctctgtag

SEQ ID NO: 13502 - DNA, 18 bp, Artificial Sequence
  Synthetic DNA
taatatgaatgaatatag

SEQ ID NO: 13503 - DNA, 18 bp, Artificial Sequence
  Synthetic DNA
taatatgacagagtatag

SEQ ID NO: 13504 - DNA, 18 bp, Artificial Sequence
  Synthetic DNA
taatatgaccctctatcg

SEQ ID NO: 13505 - DNA, 18 bp, Artificial Sequence
  Synthetic DNA
taatatgacggtctatag

SEQ ID NO: 13506 - DNA, 18 bp, Artificial Sequence
  Synthetic DNA
taatatgactcaagttag

SEQ ID NO: 13507 - DNA, 18 bp, Artificial Sequence
  Synthetic DNA
taatatgactccatgtag

SEQ ID NO: 13508 - DNA, 18 bp, Artificial Sequence
  Synthetic DNA
taatatgactctcgatcg

SEQ ID NO: 13509 - DNA, 18 bp, Artificial Sequence
  Synthetic DNA
taatatgactctctgtcg

SEQ ID NO: 13510 - DNA, 18 bp, Artificial Sequence
  Synthetic DNA
taatatgactctttctag

SEQ ID NO: 13511 - DNA, 18 bp, Artificial Sequence
  Synthetic DNA
taatatgacttagtacag

SEQ ID NO: 13512 - DNA, 18 bp, Artificial Sequence
  Synthetic DNA
taatatgagtcatgatag

SEQ ID NO: 13513 - DNA, 18 bp, Artificial Sequence
  Synthetic DNA
taatatgatgcaccatag

SEQ ID NO: 13514 - DNA, 18 bp, Artificial Sequence
  Synthetic DNA
taatatgcatcaatatag

SEQ ID NO: 13515 - DNA, 18 bp, Artificial Sequence
  Synthetic DNA
taatatgcctaagtatag

SEQ ID NO: 13516 - DNA, 18 bp, Artificial Sequence
  Synthetic DNA
taatatgcctcacgttag

SEQ ID NO: 13517 - DNA, 18 bp, Artificial Sequence
  Synthetic DNA
taatatgcctcactgtcg

SEQ ID NO: 13518 - DNA, 18 bp, Artificial Sequence
  Synthetic DNA
taatatgcttcactctag

SEQ ID NO: 13519 - DNA, 18 bp, Artificial Sequence
  Synthetic DNA
taatattacgctctatag

SEQ ID NO: 13520 - DNA, 18 bp, Artificial Sequence
  Synthetic DNA
taatattactcaatatcg

SEQ ID NO: 13521 - DNA, 18 bp, Artificial Sequence
  Synthetic DNA
taatattactcactccag

SEQ ID NO: 13522 - DNA, 18 bp, Artificial Sequence
  Synthetic DNA
taatattacttactagag

SEQ ID NO: 13523 - DNA, 18 bp, Artificial Sequence
  Synthetic DNA
taatccaactcactgcag

SEQ ID NO: 13524 - DNA, 18 bp, Artificial Sequence
  Synthetic DNA
taatcccaatcactatcg

SEQ ID NO: 13525 - DNA, 18 bp, Artificial Sequence
  Synthetic DNA
taatccgaaccactatgg

SEQ ID NO: 13526 - DNA, 18 bp, Artificial Sequence
  Synthetic DNA
taatccgaatcaatttag

SEQ ID NO: 13527 - DNA, 18 bp, Artificial Sequence
  Synthetic DNA
taatccgaccccctatcg

SEQ ID NO: 13528 - DNA, 18 bp, Artificial Sequence
  Synthetic DNA
taatccgactaacagtag

SEQ ID NO: 13529 - DNA, 18 bp, Artificial Sequence
  Synthetic DNA
taatccgactcactgacg

SEQ ID NO: 13530 - DNA, 18 bp, Artificial Sequence
  Synthetic DNA
taatccgactgacaaaag

SEQ ID NO: 13531 - DNA, 18 bp, Artificial Sequence
  Synthetic DNA
taatccgacttactctcg

SEQ ID NO: 13532 - DNA, 18 bp, Artificial Sequence
  Synthetic DNA
taatccgagtctctacag

SEQ ID NO: 13533 - DNA, 18 bp, Artificial Sequence
  Synthetic DNA
taatccgatgcacaatag

SEQ ID NO: 13534 - DNA, 18 bp, Artificial Sequence
  Synthetic DNA
taatccgcctcaataaag

SEQ ID NO: 13535 - DNA, 18 bp, Artificial Sequence
  Synthetic DNA
taatccgcctcactctcg

SEQ ID NO: 13536 - DNA, 18 bp, Artificial Sequence
  Synthetic DNA
taatccgtatcactttag

SEQ ID NO: 13537 - DNA, 18 bp, Artificial Sequence
  Synthetic DNA
taatccgtctcactctcg

SEQ ID NO: 13538 - DNA, 18 bp, Artificial Sequence
  Synthetic DNA
taatccgtctcactgtaa

SEQ ID NO: 13539 - DNA, 18 bp, Artificial Sequence
  Synthetic DNA
taatcctagacactatag

SEQ ID NO: 13540 - DNA, 18 bp, Artificial Sequence
  Synthetic DNA
taatcggactcaatacag

SEQ ID NO: 13541 - DNA, 18 bp, Artificial Sequence
  Synthetic DNA
taatcggactcaatatcg

SEQ ID NO: 13542 - DNA, 18 bp, Artificial Sequence
  Synthetic DNA
taatctaactcactatgg

SEQ ID NO: 13543 - DNA, 18 bp, Artificial Sequence
  Synthetic DNA
taatgagaatgactatag

SEQ ID NO: 13544 - DNA, 18 bp, Artificial Sequence
  Synthetic DNA
taatgatcctcactatag

SEQ ID NO: 13545 - DNA, 18 bp, Artificial Sequence
  Synthetic DNA
taatgcaacacattatag

SEQ ID NO: 13546 - DNA, 18 bp, Artificial Sequence
  Synthetic DNA
taatgcaactcactctgg

SEQ ID NO: 13547 - DNA, 18 bp, Artificial Sequence
  Synthetic DNA
taatgcagttcactatag

SEQ ID NO: 13548 - DNA, 18 bp, Artificial Sequence
  Synthetic DNA
taatgccaatcaatatag

SEQ ID NO: 13549 - DNA, 18 bp, Artificial Sequence
  Synthetic DNA
taatgcgactaactcaag

SEQ ID NO: 13550 - DNA, 18 bp, Artificial Sequence
  Synthetic DNA
taatgcgactaacttaag

SEQ ID NO: 13551 - DNA, 18 bp, Artificial Sequence
  Synthetic DNA
taatgcgactcagaaaag

SEQ ID NO: 13552 - DNA, 18 bp, Artificial Sequence
  Synthetic DNA
taatgcgactcattccag

SEQ ID NO: 13553 - DNA, 18 bp, Artificial Sequence
  Synthetic DNA
taatgcgactctcaatcg

SEQ ID NO: 13554 - DNA, 18 bp, Artificial Sequence
  Synthetic DNA
taatgcgactgtcaatag

SEQ ID NO: 13555 - DNA, 18 bp, Artificial Sequence
  Synthetic DNA
taatgcgacttcctaaag

SEQ ID NO: 13556 - DNA, 18 bp, Artificial Sequence
  Synthetic DNA
taatgcgattcaacatag

SEQ ID NO: 13557 - DNA, 18 bp, Artificial Sequence
  Synthetic DNA
taatgcgatttattatag

SEQ ID NO: 13558 - DNA, 18 bp, Artificial Sequence
  Synthetic DNA
taatgcgtataactatag

SEQ ID NO: 13559 - DNA, 18 bp, Artificial Sequence
  Synthetic DNA
taatgcgtatcactaaag

SEQ ID NO: 13560 - DNA, 18 bp, Artificial Sequence
  Synthetic DNA
taatgctacttacgatag

SEQ ID NO: 13561 - DNA, 18 bp, Artificial Sequence
  Synthetic DNA
taatgggactaactaaag

SEQ ID NO: 13562 - DNA, 18 bp, Artificial Sequence
  Synthetic DNA
taatgggactaattatag

SEQ ID NO: 13563 - DNA, 18 bp, Artificial Sequence
  Synthetic DNA
taatgggactcaccacag

SEQ ID NO: 13564 - DNA, 18 bp, Artificial Sequence
  Synthetic DNA
taatgggactcactaccg

SEQ ID NO: 13565 - DNA, 18 bp, Artificial Sequence
  Synthetic DNA
taatgggactcagaatag

SEQ ID NO: 13566 - DNA, 18 bp, Artificial Sequence
  Synthetic DNA
taatgtgactcactcaag

SEQ ID NO: 13567 - DNA, 18 bp, Artificial Sequence
  Synthetic DNA
tacaacaactcattatag

SEQ ID NO: 13568 - DNA, 18 bp, Artificial Sequence
  Synthetic DNA
tacaacgacgctctatag

SEQ ID NO: 13569 - DNA, 18 bp, Artificial Sequence
  Synthetic DNA
tacaacggctcactgtag

SEQ ID NO: 13570 - DNA, 18 bp, Artificial Sequence
  Synthetic DNA
taccacgcctcaatatag

SEQ ID NO: 13571 - DNA, 18 bp, Artificial Sequence
  Synthetic DNA
taccacgtctcactatcg

SEQ ID NO: 13572 - DNA, 18 bp, Artificial Sequence
  Synthetic DNA
taccgcgactcactagag

SEQ ID NO: 13573 - DNA, 18 bp, Artificial Sequence
  Synthetic DNA
tactaagactcaatatcg

SEQ ID NO: 13574 - DNA, 18 bp, Artificial Sequence
  Synthetic DNA
tactacaacacactatcg

SEQ ID NO: 13575 - DNA, 18 bp, Artificial Sequence
  Synthetic DNA
tactacaacccactatcg

SEQ ID NO: 13576 - DNA, 18 bp, Artificial Sequence
  Synthetic DNA
tactacaacccattatag

SEQ ID NO: 13577 - DNA, 18 bp, Artificial Sequence
  Synthetic DNA
tactacgaaacactagag

SEQ ID NO: 13578 - DNA, 18 bp, Artificial Sequence
  Synthetic DNA
tactacgacacacaagag

SEQ ID NO: 13579 - DNA, 18 bp, Artificial Sequence
  Synthetic DNA
tactacgacaccctttag

SEQ ID NO: 13580 - DNA, 18 bp, Artificial Sequence
  Synthetic DNA
tactacgactcacatgag

SEQ ID NO: 13581 - DNA, 18 bp, Artificial Sequence
  Synthetic DNA
tactacgactcacccaag

SEQ ID NO: 13582 - DNA, 18 bp, Artificial Sequence
  Synthetic DNA
tactacgagacagtatag

SEQ ID NO: 13583 - DNA, 18 bp, Artificial Sequence
  Synthetic DNA
tactacggcacacaatag

SEQ ID NO: 13584 - DNA, 18 bp, Artificial Sequence
  Synthetic DNA
tactacggcacattatag

SEQ ID NO: 13585 - DNA, 18 bp, Artificial Sequence
  Synthetic DNA
tactacgtctcaccatcg

SEQ ID NO: 13586 - DNA, 18 bp, Artificial Sequence
  Synthetic DNA
tactacgtctcactacgg

SEQ ID NO: 13587 - DNA, 18 bp, Artificial Sequence
  Synthetic DNA
tactactacgcactgtag

SEQ ID NO: 13588 - DNA, 18 bp, Artificial Sequence
  Synthetic DNA
tactaggactcactaacg

SEQ ID NO: 13589 - DNA, 18 bp, Artificial Sequence
  Synthetic DNA
tactaggactcactgaag

SEQ ID NO: 13590 - DNA, 18 bp, Artificial Sequence
  Synthetic DNA
tactaggcctcactaaag

SEQ ID NO: 13591 - DNA, 18 bp, Artificial Sequence
  Synthetic DNA
tactatgactcaccatcg

SEQ ID NO: 13592 - DNA, 18 bp, Artificial Sequence
  Synthetic DNA
tactattactcactagag

SEQ ID NO: 13593 - DNA, 18 bp, Artificial Sequence
  Synthetic DNA
tactccgacacactatgg

SEQ ID NO: 13594 - DNA, 18 bp, Artificial Sequence
  Synthetic DNA
tactccgactctatatag

SEQ ID NO: 13595 - DNA, 18 bp, Artificial Sequence
  Synthetic DNA
tactgcgacgcaccatag

SEQ ID NO: 13596 - DNA, 18 bp, Artificial Sequence
  Synthetic DNA
tactgcgattcactaaag

SEQ ID NO: 13597 - DNA, 18 bp, Artificial Sequence
  Synthetic DNA
tactgctactcactaaag

SEQ ID NO: 13598 - DNA, 18 bp, Artificial Sequence
  Synthetic DNA
tagaaagactcactgtag

SEQ ID NO: 13599 - DNA, 18 bp, Artificial Sequence
  Synthetic DNA
tagaacaactcactacag

SEQ ID NO: 13600 - DNA, 18 bp, Artificial Sequence
  Synthetic DNA
tagaacgactcaatacag

SEQ ID NO: 13601 - DNA, 18 bp, Artificial Sequence
  Synthetic DNA
tagaacgactgacaatag

SEQ ID NO: 13602 - DNA, 18 bp, Artificial Sequence
  Synthetic DNA
tagaacgcctcactaaag

SEQ ID NO: 13603 - DNA, 18 bp, Artificial Sequence
  Synthetic DNA
tagaaggactcactagag

SEQ ID NO: 13604 - DNA, 18 bp, Artificial Sequence
  Synthetic DNA
taggatgacgcactatag

SEQ ID NO: 13605 - DNA, 18 bp, Artificial Sequence
  Synthetic DNA
tagtacaactcacgacag

SEQ ID NO: 13606 - DNA, 18 bp, Artificial Sequence
  Synthetic DNA
tagtacgacgcactcaag

SEQ ID NO: 13607 - DNA, 18 bp, Artificial Sequence
  Synthetic DNA
tagtacgactaaataaag

SEQ ID NO: 13608 - DNA, 18 bp, Artificial Sequence
  Synthetic DNA
tagtacgactcattaacg

SEQ ID NO: 13609 - DNA, 18 bp, Artificial Sequence
  Synthetic DNA
tagtacgactccgtacag

SEQ ID NO: 13610 - DNA, 18 bp, Artificial Sequence
  Synthetic DNA
tagtacgactctatatcg

SEQ ID NO: 13611 - DNA, 18 bp, Artificial Sequence
  Synthetic DNA
tagtacgactctctcaag

SEQ ID NO: 13612 - DNA, 18 bp, Artificial Sequence
  Synthetic DNA
tagtacgactctctgaag

SEQ ID NO: 13613 - DNA, 18 bp, Artificial Sequence
  Synthetic DNA
tagtacgtcgcaatatag

SEQ ID NO: 13614 - DNA, 18 bp, Artificial Sequence
  Synthetic DNA
tagtactgttcactatag

SEQ ID NO: 13615 - DNA, 18 bp, Artificial Sequence
  Synthetic DNA
tagtaggactcaatgtag

SEQ ID NO: 13616 - DNA, 18 bp, Artificial Sequence
  Synthetic DNA
tagtatgactctctttag

SEQ ID NO: 13617 - DNA, 18 bp, Artificial Sequence
  Synthetic DNA
tagtgcgactcactaacg

SEQ ID NO: 13618 - DNA, 18 bp, Artificial Sequence
  Synthetic DNA
tataacgaatcactataa

SEQ ID NO: 13619 - DNA, 18 bp, Artificial Sequence
  Synthetic DNA
tataacgactcactctaa

SEQ ID NO: 13620 - DNA, 18 bp, Artificial Sequence
  Synthetic DNA
tataacgactcagtatgg

SEQ ID NO: 13621 - DNA, 18 bp, Artificial Sequence
  Synthetic DNA
tataacgcgtcactatag

SEQ ID NO: 13622 - DNA, 18 bp, Artificial Sequence
  Synthetic DNA
tatagcgactcactatcg

SEQ ID NO: 13623 - DNA, 18 bp, Artificial Sequence
  Synthetic DNA
tatcacgacccaatatag

SEQ ID NO: 13624 - DNA, 18 bp, Artificial Sequence
  Synthetic DNA
tatcacgactcactctcg

SEQ ID NO: 13625 - DNA, 18 bp, Artificial Sequence
  Synthetic DNA
tatcacgactcatgatag

SEQ ID NO: 13626 - DNA, 18 bp, Artificial Sequence
  Synthetic DNA
tatcacgagacactatag

SEQ ID NO: 13627 - DNA, 18 bp, Artificial Sequence
  Synthetic DNA
tatcaggactcacaatag

SEQ ID NO: 13628 - DNA, 18 bp, Artificial Sequence
  Synthetic DNA
tatcgcgactcactttag

SEQ ID NO: 13629 - DNA, 18 bp, Artificial Sequence
  Synthetic DNA
tatgacgacttactatcg

SEQ ID NO: 13630 - DNA, 18 bp, Artificial Sequence
  Synthetic DNA
tatgacgacttactctag

SEQ ID NO: 13631 - DNA, 18 bp, Artificial Sequence
  Synthetic DNA
tatgactacgcactatag

SEQ ID NO: 13632 - DNA, 18 bp, Artificial Sequence
  Synthetic DNA
tattaagacgcaatatag

SEQ ID NO: 13633 - DNA, 18 bp, Artificial Sequence
  Synthetic DNA
tattacaactaactacag

SEQ ID NO: 13634 - DNA, 18 bp, Artificial Sequence
  Synthetic DNA
tattaccacttactgtag

SEQ ID NO: 13635 - DNA, 18 bp, Artificial Sequence
  Synthetic DNA
tattacgacccaccacag

SEQ ID NO: 13636 - DNA, 18 bp, Artificial Sequence
  Synthetic DNA
tattacgacccagtataa

SEQ ID NO: 13637 - DNA, 18 bp, Artificial Sequence
  Synthetic DNA
tattacgacgcaacatag

SEQ ID NO: 13638 - DNA, 18 bp, Artificial Sequence
  Synthetic DNA
tattacgactcaatttat

SEQ ID NO: 13639 - DNA, 18 bp, Artificial Sequence
  Synthetic DNA
tattacgactcacaagcg

SEQ ID NO: 13640 - DNA, 18 bp, Artificial Sequence
  Synthetic DNA
tattacgactcacaaggg

SEQ ID NO: 13641 - DNA, 18 bp, Artificial Sequence
  Synthetic DNA
tattacgactcactcggg

SEQ ID NO: 13642 - DNA, 18 bp, Artificial Sequence
  Synthetic DNA
tattacgactcagcgtag

SEQ ID NO: 13643 - DNA, 18 bp, Artificial Sequence
  Synthetic DNA
tattacgactcagtaagg

SEQ ID NO: 13644 - DNA, 18 bp, Artificial Sequence
  Synthetic DNA
tattacgactgattatgg

SEQ ID NO: 13645 - DNA, 18 bp, Artificial Sequence
  Synthetic DNA
tattacgattcactatca

SEQ ID NO: 13646 - DNA, 18 bp, Artificial Sequence
  Synthetic DNA
tattacgcatcactaaag

SEQ ID NO: 13647 - DNA, 18 bp, Artificial Sequence
  Synthetic DNA
tattacgcctcactaacg

SEQ ID NO: 13648 - DNA, 18 bp, Artificial Sequence
  Synthetic DNA
tattacgcctcactctcg

SEQ ID NO: 13649 - DNA, 18 bp, Artificial Sequence
  Synthetic DNA
tattacgcctcactgcag

SEQ ID NO: 13650 - DNA, 18 bp, Artificial Sequence
  Synthetic DNA
tattacgcctcactgtcg

SEQ ID NO: 13651 - DNA, 18 bp, Artificial Sequence
  Synthetic DNA
tattacgcctgtctatag

SEQ ID NO: 13652 - DNA, 18 bp, Artificial Sequence
  Synthetic DNA
tattacggatcactctag

SEQ ID NO: 13653 - DNA, 18 bp, Artificial Sequence
  Synthetic DNA
tattacgtctcactagcg

SEQ ID NO: 13654 - DNA, 18 bp, Artificial Sequence
  Synthetic DNA
tattacgtctctctataa

SEQ ID NO: 13655 - DNA, 18 bp, Artificial Sequence
  Synthetic DNA
tattactgctaactatag

SEQ ID NO: 13656 - DNA, 18 bp, Artificial Sequence
  Synthetic DNA
tattagaactcactgtag

SEQ ID NO: 13657 - DNA, 18 bp, Artificial Sequence
  Synthetic DNA
tattaggactcagtacag

SEQ ID NO: 13658 - DNA, 18 bp, Artificial Sequence
  Synthetic DNA
tattaggactctgtatag

SEQ ID NO: 13659 - DNA, 18 bp, Artificial Sequence
  Synthetic DNA
tattaggagtcacaatag

SEQ ID NO: 13660 - DNA, 18 bp, Artificial Sequence
  Synthetic DNA
tattaggattcactatgg

SEQ ID NO: 13661 - DNA, 18 bp, Artificial Sequence
  Synthetic DNA
tattatgacccactatcg

SEQ ID NO: 13662 - DNA, 18 bp, Artificial Sequence
  Synthetic DNA
tattatgactcactatca

SEQ ID NO: 13663 - DNA, 18 bp, Artificial Sequence
  Synthetic DNA
tattatgactcagtgtag

SEQ ID NO: 13664 - DNA, 18 bp, Artificial Sequence
  Synthetic DNA
tattatgagtcactctag

SEQ ID NO: 13665 - DNA, 18 bp, Artificial Sequence
  Synthetic DNA
tattccgacccaatatag

SEQ ID NO: 13666 - DNA, 18 bp, Artificial Sequence
  Synthetic DNA
tattccgactcaatgtag

SEQ ID NO: 13667 - DNA, 18 bp, Artificial Sequence
  Synthetic DNA
tattccgactcaccatcg

SEQ ID NO: 13668 - DNA, 18 bp, Artificial Sequence
  Synthetic DNA
tattgcgactaactctag

SEQ ID NO: 13669 - DNA, 18 bp, Artificial Sequence
  Synthetic DNA
tattgcgaggcactatag

SEQ ID NO: 13670 - DNA, 18 bp, Artificial Sequence
  Synthetic DNA
tcagacttctcactatag

SEQ ID NO: 13671 - DNA, 18 bp, Artificial Sequence
  Synthetic DNA
tcaggctactcactatag

SEQ ID NO: 13672 - DNA, 18 bp, Artificial Sequence
  Synthetic DNA
tcataagactcaccaaag

SEQ ID NO: 13673 - DNA, 18 bp, Artificial Sequence
  Synthetic DNA
tcatacaattcaatatag

SEQ ID NO: 13674 - DNA, 18 bp, Artificial Sequence
  Synthetic DNA
tcataccacttactacag

SEQ ID NO: 13675 - DNA, 18 bp, Artificial Sequence
  Synthetic DNA
tcatacctctcactatcg

SEQ ID NO: 13676 - DNA, 18 bp, Artificial Sequence
  Synthetic DNA
tcatacgaatcacaatcg

SEQ ID NO: 13677 - DNA, 18 bp, Artificial Sequence
  Synthetic DNA
tcatacgaatctctgtag

SEQ ID NO: 13678 - DNA, 18 bp, Artificial Sequence
  Synthetic DNA
tcatacgacactctatcg

SEQ ID NO: 13679 - DNA, 18 bp, Artificial Sequence
  Synthetic DNA
tcatacgactctcgttag

SEQ ID NO: 13680 - DNA, 18 bp, Artificial Sequence
  Synthetic DNA
tcatacggatcattatag

SEQ ID NO: 13681 - DNA, 18 bp, Artificial Sequence
  Synthetic DNA
tcatacgtcttactagag

SEQ ID NO: 13682 - DNA, 18 bp, Artificial Sequence
  Synthetic DNA
tcatactacttactatcg

SEQ ID NO: 13683 - DNA, 18 bp, Artificial Sequence
  Synthetic DNA
tcatactgctcaatatag

SEQ ID NO: 13684 - DNA, 18 bp, Artificial Sequence
  Synthetic DNA
tcataggaatcaatatag

SEQ ID NO: 13685 - DNA, 18 bp, Artificial Sequence
  Synthetic DNA
tcataggacacattatag

SEQ ID NO: 13686 - DNA, 18 bp, Artificial Sequence
  Synthetic DNA
tcatatgacacactatgg

SEQ ID NO: 13687 - DNA, 18 bp, Artificial Sequence
  Synthetic DNA
tcatattactgactatag

SEQ ID NO: 13688 - DNA, 18 bp, Artificial Sequence
  Synthetic DNA
tcatccgacttacaatag

SEQ ID NO: 13689 - DNA, 18 bp, Artificial Sequence
  Synthetic DNA
tcctacgaatcacgatag

SEQ ID NO: 13690 - DNA, 18 bp, Artificial Sequence
  Synthetic DNA
tcctacgactcactgtgg

SEQ ID NO: 13691 - DNA, 18 bp, Artificial Sequence
  Synthetic DNA
tcctactactcactatgg

SEQ ID NO: 13692 - DNA, 18 bp, Artificial Sequence
  Synthetic DNA
tcgtaccactctctatag

SEQ ID NO: 13693 - DNA, 18 bp, Artificial Sequence
  Synthetic DNA
tcgtacgactcataatag

SEQ ID NO: 13694 - DNA, 18 bp, Artificial Sequence
  Synthetic DNA
tcgtacgtcgcactatag

SEQ ID NO: 13695 - DNA, 18 bp, Artificial Sequence
  Synthetic DNA
tcgtatgactcactaaag

SEQ ID NO: 13696 - DNA, 18 bp, Artificial Sequence
  Synthetic DNA
tcgtccgactcaatatag

SEQ ID NO: 13697 - DNA, 18 bp, Artificial Sequence
  Synthetic DNA
tctcgcgactcactatag

SEQ ID NO: 13698 - DNA, 18 bp, Artificial Sequence
  Synthetic DNA
tcttacgaccgactatag

SEQ ID NO: 13699 - DNA, 18 bp, Artificial Sequence
  Synthetic DNA
tcttacgagtcactaaag

SEQ ID NO: 13700 - DNA, 18 bp, Artificial Sequence
  Synthetic DNA
tcttccgactcactaaag

SEQ ID NO: 13701 - DNA, 18 bp, Artificial Sequence
  Synthetic DNA
tgaaacaacttactatag

SEQ ID NO: 13702 - DNA, 18 bp, Artificial Sequence
  Synthetic DNA
tgaaacgactcactgtcg

SEQ ID NO: 13703 - DNA, 18 bp, Artificial Sequence
  Synthetic DNA
tgaaactactcagtatag

SEQ ID NO: 13704 - DNA, 18 bp, Artificial Sequence
  Synthetic DNA
tgaaccgactcactacag

SEQ ID NO: 13705 - DNA, 18 bp, Artificial Sequence
  Synthetic DNA
tgagacgaatcaatatag

SEQ ID NO: 13706 - DNA, 18 bp, Artificial Sequence
  Synthetic DNA
tgagacgactcaataaag

SEQ ID NO: 13707 - DNA, 18 bp, Artificial Sequence
  Synthetic DNA
tgataaggctcactttag

SEQ ID NO: 13708 - DNA, 18 bp, Artificial Sequence
  Synthetic DNA
tgatacaacccactacag

SEQ ID NO: 13709 - DNA, 18 bp, Artificial Sequence
  Synthetic DNA
tgatacaactcaccatcg

SEQ ID NO: 13710 - DNA, 18 bp, Artificial Sequence
  Synthetic DNA
tgatacaactccctgtag

SEQ ID NO: 13711 - DNA, 18 bp, Artificial Sequence
  Synthetic DNA
tgatacaagtcactacag

SEQ ID NO: 13712 - DNA, 18 bp, Artificial Sequence
  Synthetic DNA
tgataccacgcactacag

SEQ ID NO: 13713 - DNA, 18 bp, Artificial Sequence
  Synthetic DNA
tgataccactcacttgag

SEQ ID NO: 13714 - DNA, 18 bp, Artificial Sequence
  Synthetic DNA
tgatacccctcactaaag

SEQ ID NO: 13715 - DNA, 18 bp, Artificial Sequence
  Synthetic DNA
tgataccgctcactaaag

SEQ ID NO: 13716 - DNA, 18 bp, Artificial Sequence
  Synthetic DNA
tgatacgactctacatag

SEQ ID NO: 13717 - DNA, 18 bp, Artificial Sequence
  Synthetic DNA
tgatacgactctctccag

SEQ ID NO: 13718 - DNA, 18 bp, Artificial Sequence
  Synthetic DNA
tgatacgagtcactgtgg

SEQ ID NO: 13719 - DNA, 18 bp, Artificial Sequence
  Synthetic DNA
tgatacgtgtcactacag

SEQ ID NO: 13720 - DNA, 18 bp, Artificial Sequence
  Synthetic DNA
tgatactactccctctag

SEQ ID NO: 13721 - DNA, 18 bp, Artificial Sequence
  Synthetic DNA
tgatactacttagtatag

SEQ ID NO: 13722 - DNA, 18 bp, Artificial Sequence
  Synthetic DNA
tgatacttctcactacag

SEQ ID NO: 13723 - DNA, 18 bp, Artificial Sequence
  Synthetic DNA
tgatatgacatactatag

SEQ ID NO: 13724 - DNA, 18 bp, Artificial Sequence
  Synthetic DNA
tgatgcgactctctatgg

SEQ ID NO: 13725 - DNA, 18 bp, Artificial Sequence
  Synthetic DNA
tgatgttactcactatag

SEQ ID NO: 13726 - DNA, 18 bp, Artificial Sequence
  Synthetic DNA
tgctactactcacaatag

SEQ ID NO: 13727 - DNA, 18 bp, Artificial Sequence
  Synthetic DNA
tggtacgactcacattag

SEQ ID NO: 13728 - DNA, 18 bp, Artificial Sequence
  Synthetic DNA
tggtacgacttattatag

SEQ ID NO: 13729 - DNA, 18 bp, Artificial Sequence
  Synthetic DNA
tgtcacgactgactatag

SEQ ID NO: 13730 - DNA, 18 bp, Artificial Sequence
  Synthetic DNA
tgtcaggactcactatag

SEQ ID NO: 13731 - DNA, 18 bp, Artificial Sequence
  Synthetic DNA
tgttaagacacactatag

SEQ ID NO: 13732 - DNA, 18 bp, Artificial Sequence
  Synthetic DNA
tgttacgactcactccag

SEQ ID NO: 13733 - DNA, 18 bp, Artificial Sequence
  Synthetic DNA
tgttacgactcactgtcg

SEQ ID NO: 13734 - DNA, 18 bp, Artificial Sequence
  Synthetic DNA
tgttacggctcactttag

SEQ ID NO: 13735 - DNA, 18 bp, Artificial Sequence
  Synthetic DNA
tgttacgtctcaccatag

SEQ ID NO: 13736 - DNA, 18 bp, Artificial Sequence
  Synthetic DNA
tgttgcgactcactctag

SEQ ID NO: 13737 - DNA, 18 bp, Artificial Sequence
  Synthetic DNA
ttaaaagcctcactatag

SEQ ID NO: 13738 - DNA, 18 bp, Artificial Sequence
  Synthetic DNA
ttaaacgacccaatatag

SEQ ID NO: 13739 - DNA, 18 bp, Artificial Sequence
  Synthetic DNA
ttaaacgactcactttgg

SEQ ID NO: 13740 - DNA, 18 bp, Artificial Sequence
  Synthetic DNA
ttaaacgcctcactctag

SEQ ID NO: 13741 - DNA, 18 bp, Artificial Sequence
  Synthetic DNA
ttaaacgtctcactataa

SEQ ID NO: 13742 - DNA, 18 bp, Artificial Sequence
  Synthetic DNA
ttaaatgactcactataa

SEQ ID NO: 13743 - DNA, 18 bp, Artificial Sequence
  Synthetic DNA
ttacaccactcactgtag

SEQ ID NO: 13744 - DNA, 18 bp, Artificial Sequence
  Synthetic DNA
ttacaggacttactatag

SEQ ID NO: 13745 - DNA, 18 bp, Artificial Sequence
  Synthetic DNA
ttacatgactcactatcg

SEQ ID NO: 13746 - DNA, 18 bp, Artificial Sequence
  Synthetic DNA
ttagacgactcactgaag

SEQ ID NO: 13747 - DNA, 18 bp, Artificial Sequence
  Synthetic DNA
ttagacggctctctatag

SEQ ID NO: 13748 - DNA, 18 bp, Artificial Sequence
  Synthetic DNA
ttataagactcactacaa

SEQ ID NO: 13749 - DNA, 18 bp, Artificial Sequence
  Synthetic DNA
ttataagactcattctag

SEQ ID NO: 13750 - DNA, 18 bp, Artificial Sequence
  Synthetic DNA
ttataagattccctatag

SEQ ID NO: 13751 - DNA, 18 bp, Artificial Sequence
  Synthetic DNA
ttatacaactctctataa

SEQ ID NO: 13752 - DNA, 18 bp, Artificial Sequence
  Synthetic DNA
ttatacacctcactctag

SEQ ID NO: 13753 - DNA, 18 bp, Artificial Sequence
  Synthetic DNA
ttataccactcactgtcg

SEQ ID NO: 13754 - DNA, 18 bp, Artificial Sequence
  Synthetic DNA
ttatacgaagtactatag

SEQ ID NO: 13755 - DNA, 18 bp, Artificial Sequence
  Synthetic DNA
ttatacgaatgattatag

SEQ ID NO: 13756 - DNA, 18 bp, Artificial Sequence
  Synthetic DNA
ttatacgaccaaatatag

SEQ ID NO: 13757 - DNA, 18 bp, Artificial Sequence
  Synthetic DNA
ttatacgacccagtttag

SEQ ID NO: 13758 - DNA, 18 bp, Artificial Sequence
  Synthetic DNA
ttatacgactaactgtcg

SEQ ID NO: 13759 - DNA, 18 bp, Artificial Sequence
  Synthetic DNA
ttatacgactcactaaca

SEQ ID NO: 13760 - DNA, 18 bp, Artificial Sequence
  Synthetic DNA
ttatacgactcactaacc

SEQ ID NO: 13761 - DNA, 18 bp, Artificial Sequence
  Synthetic DNA
ttatacgactcagtctcg

SEQ ID NO: 13762 - DNA, 18 bp, Artificial Sequence
  Synthetic DNA
ttatacgcctaacaatag

SEQ ID NO: 13763 - DNA, 18 bp, Artificial Sequence
  Synthetic DNA
ttatacgcctcacttcag

SEQ ID NO: 13764 - DNA, 18 bp, Artificial Sequence
  Synthetic DNA
ttatacgcgtcacaatag

SEQ ID NO: 13765 - DNA, 18 bp, Artificial Sequence
  Synthetic DNA
ttatacgtgtcacgatag

SEQ ID NO: 13766 - DNA, 18 bp, Artificial Sequence
  Synthetic DNA
ttatagaactcaccatag

SEQ ID NO: 13767 - DNA, 18 bp, Artificial Sequence
  Synthetic DNA
ttataggactcaatatgg

SEQ ID NO: 13768 - DNA, 18 bp, Artificial Sequence
  Synthetic DNA
ttatatgactcactggag

SEQ ID NO: 13769 - DNA, 18 bp, Artificial Sequence
  Synthetic DNA
ttatatggatcactatag

SEQ ID NO: 13770 - DNA, 18 bp, Artificial Sequence
  Synthetic DNA
ttatccgacccactctag

SEQ ID NO: 13771 - DNA, 18 bp, Artificial Sequence
  Synthetic DNA
ttatccgacgctctatag

SEQ ID NO: 13772 - DNA, 18 bp, Artificial Sequence
  Synthetic DNA
ttatccgactcattagag

SEQ ID NO: 13773 - DNA, 18 bp, Artificial Sequence
  Synthetic DNA
ttatccgactccctatgg

SEQ ID NO: 13774 - DNA, 18 bp, Artificial Sequence
  Synthetic DNA
ttatccgagtcaccatag

SEQ ID NO: 13775 - DNA, 18 bp, Artificial Sequence
  Synthetic DNA
ttatccgcctcaccatag

SEQ ID NO: 13776 - DNA, 18 bp, Artificial Sequence
  Synthetic DNA
ttatgcgactcactgaag

SEQ ID NO: 13777 - DNA, 18 bp, Artificial Sequence
  Synthetic DNA
ttatgcgccccactatag

SEQ ID NO: 13778 - DNA, 18 bp, Artificial Sequence
  Synthetic DNA
ttatgtgactcactctag

SEQ ID NO: 13779 - DNA, 18 bp, Artificial Sequence
  Synthetic DNA
ttctacaacgcactatag

SEQ ID NO: 13780 - DNA, 18 bp, Artificial Sequence
  Synthetic DNA
ttctacgtctcactgtag

SEQ ID NO: 13781 - DNA, 18 bp, Artificial Sequence
  Synthetic DNA
ttgtacgactcattatcg

SEQ ID NO: 13782 - DNA, 18 bp, Artificial Sequence
  Synthetic DNA
ttgtctgactcactatag

SEQ ID NO: 13783 - DNA, 18 bp, Artificial Sequence
  Synthetic DNA
ttttaagactcacgatag

SEQ ID NO: 13784 - DNA, 18 bp, Artificial Sequence
  Synthetic DNA
ttttacgaagcactatag

SEQ ID NO: 13785 - DNA, 18 bp, Artificial Sequence
  Synthetic DNA
ttttacgactcactatct

SEQ ID NO: 13786 - DNA, 18 bp, Artificial Sequence
  Synthetic DNA
ttttacgactcactccag

SEQ ID NO: 13787 - DNA, 18 bp, Artificial Sequence
  Synthetic DNA
ttttacgagtcactatat

SEQ ID NO: 13788 - DNA, 18 bp, Artificial Sequence
  Synthetic DNA
ttttatgcctcactatag

SEQ ID NO: 13789 - DNA, 18 bp, Artificial Sequence
  Synthetic DNA
ttttgcgcctcactatag

SEQ ID NO: 13790 - DNA, 18 bp, Artificial Sequence
  Synthetic DNA
taaatggactctctatag

SEQ ID NO: 13791 - DNA, 18 bp, Artificial Sequence
  Synthetic DNA
caaaacgtctcactaaag

SEQ ID NO: 13792 - DNA, 18 bp, Artificial Sequence
  Synthetic DNA
ttatgcgactcacttaag

SEQ ID NO: 13793 - DNA, 18 bp, Artificial Sequence
  Synthetic DNA
aaattcgactcgctttag

SEQ ID NO: 13794 - DNA, 18 bp, Artificial Sequence
  Synthetic DNA
ttattggactcactctag

SEQ ID NO: 13795 - DNA, 18 bp, Artificial Sequence
  Synthetic DNA
taattagactcactgcag

SEQ ID NO: 13796 - DNA, 18 bp, Artificial Sequence
  Synthetic DNA
ttattggactcactattg

SEQ ID NO: 13797 - DNA, 18 bp, Artificial Sequence
  Synthetic DNA
tatatcgactcactaaag

SEQ ID NO: 13798 - DNA, 18 bp, Artificial Sequence
  Synthetic DNA
aaataggactcacttcag

SEQ ID NO: 13799 - DNA, 18 bp, Artificial Sequence
  Synthetic DNA
ctttatgactcactatag

SEQ ID NO: 13800 - DNA, 18 bp, Artificial Sequence
  Synthetic DNA
tactacgtatctctatag

SEQ ID NO: 13801 - DNA, 18 bp, Artificial Sequence
  Synthetic DNA
tatcatgactcactatgg

SEQ ID NO: 13802 - DNA, 18 bp, Artificial Sequence
  Synthetic DNA
taatactactagttatag

SEQ ID NO: 13803 - DNA, 18 bp, Artificial Sequence
  Synthetic DNA
aagtacgcgtcactatag

SEQ ID NO: 13804 - DNA, 18 bp, Artificial Sequence
  Synthetic DNA
tttcacgactcactctag

SEQ ID NO: 13805 - DNA, 18 bp, Artificial Sequence
  Synthetic DNA
taattggactcgctattg

SEQ ID NO: 13806 - DNA, 18 bp, Artificial Sequence
  Synthetic DNA
ttattcgcctcactaaag

SEQ ID NO: 13807 - DNA, 18 bp, Artificial Sequence
  Synthetic DNA
taaaccgcatcactatag

SEQ ID NO: 13808 - DNA, 18 bp, Artificial Sequence
  Synthetic DNA
tgttacgactcactttgg

SEQ ID NO: 13809 - DNA, 18 bp, Artificial Sequence
  Synthetic DNA
tagaacgtctcactctag

SEQ ID NO: 13810 - DNA, 18 bp, Artificial Sequence
  Synthetic DNA
ttatatgactcatgatag

SEQ ID NO: 13811 - DNA, 18 bp, Artificial Sequence
  Synthetic DNA
ttttgcgactcaccatag

SEQ ID NO: 13812 - DNA, 18 bp, Artificial Sequence
  Synthetic DNA
taatgcgtctcgctattg

SEQ ID NO: 13813 - DNA, 18 bp, Artificial Sequence
  Synthetic DNA
caattcaactcactacag

SEQ ID NO: 13814 - DNA, 18 bp, Artificial Sequence
  Synthetic DNA
taaaatgtctcactttag

SEQ ID NO: 13815 - DNA, 18 bp, Artificial Sequence
  Synthetic DNA
taatacaacagcctatag

SEQ ID NO: 13816 - DNA, 18 bp, Artificial Sequence
  Synthetic DNA
aattacgactcgctatcg

SEQ ID NO: 13817 - DNA, 18 bp, Artificial Sequence
  Synthetic DNA
ttaagcgactcactacag

SEQ ID NO: 13818 - DNA, 18 bp, Artificial Sequence
  Synthetic DNA
tatttcgactcaccatcg

SEQ ID NO: 13819 - DNA, 18 bp, Artificial Sequence
  Synthetic DNA
ttatgcgactcacttcag

SEQ ID NO: 13820 - DNA, 18 bp, Artificial Sequence
  Synthetic DNA
aaatgcgcctcactattg

SEQ ID NO: 13821 - DNA, 18 bp, Artificial Sequence
  Synthetic DNA
taataaaactcacaagag

SEQ ID NO: 13822 - DNA, 18 bp, Artificial Sequence
  Synthetic DNA
taatataactctctacag

SEQ ID NO: 13823 - DNA, 18 bp, Artificial Sequence
  Synthetic DNA
tattaggactcactcaag

SEQ ID NO: 13824 - DNA, 18 bp, Artificial Sequence
  Synthetic DNA
ctttgcgactcactatag

SEQ ID NO: 13825 - DNA, 18 bp, Artificial Sequence
  Synthetic DNA
ttatgcgtctcactaaag

SEQ ID NO: 13826 - DNA, 18 bp, Artificial Sequence
  Synthetic DNA
ttatatgactcgctacag

SEQ ID NO: 13827 - DNA, 18 bp, Artificial Sequence
  Synthetic DNA
ttttacgcctcactgtag

SEQ ID NO: 13828 - DNA, 18 bp, Artificial Sequence
  Synthetic DNA
ttttgcgactcactagag

SEQ ID NO: 13829 - DNA, 18 bp, Artificial Sequence
  Synthetic DNA
taaatcgactcgctattg

SEQ ID NO: 13830 - DNA, 18 bp, Artificial Sequence
  Synthetic DNA
aaatcagactcactatcg

SEQ ID NO: 13831 - DNA, 18 bp, Artificial Sequence
  Synthetic DNA
taattcgtctcaccattg

SEQ ID NO: 13832 - DNA, 18 bp, Artificial Sequence
  Synthetic DNA
taaaacgtcgcactacag

SEQ ID NO: 13833 - DNA, 18 bp, Artificial Sequence
  Synthetic DNA
taatcgaactcactttag

SEQ ID NO: 13834 - DNA, 18 bp, Artificial Sequence
  Synthetic DNA
taattcgcatcactattg

SEQ ID NO: 13835 - DNA, 18 bp, Artificial Sequence
  Synthetic DNA
taaatagactcactacag

SEQ ID NO: 13836 - DNA, 18 bp, Artificial Sequence
  Synthetic DNA
taataaaactcaccaaag

SEQ ID NO: 13837 - DNA, 18 bp, Artificial Sequence
  Synthetic DNA
gaatgcgactcacactag

SEQ ID NO: 13838 - DNA, 18 bp, Artificial Sequence
  Synthetic DNA
tatatcgactcactctag

SEQ ID NO: 13839 - DNA, 18 bp, Artificial Sequence
  Synthetic DNA
ttattcgtctcacgatag

SEQ ID NO: 13840 - DNA, 18 bp, Artificial Sequence
  Synthetic DNA
ttaaacgactcgctattg

SEQ ID NO: 13841 - DNA, 18 bp, Artificial Sequence
  Synthetic DNA
agattcgactcactatcg

SEQ ID NO: 13842 - DNA, 18 bp, Artificial Sequence
  Synthetic DNA
caatatgactcactcttg

SEQ ID NO: 13843 - DNA, 18 bp, Artificial Sequence
  Synthetic DNA
gtattcgactcactctag

SEQ ID NO: 13844 - DNA, 18 bp, Artificial Sequence
  Synthetic DNA
taatacgactcacctctg

SEQ ID NO: 13845 - DNA, 18 bp, Artificial Sequence
  Synthetic DNA
taattcggttcactaaag

SEQ ID NO: 13846 - DNA, 18 bp, Artificial Sequence
  Synthetic DNA
aaaaacgactccctttag

SEQ ID NO: 13847 - DNA, 18 bp, Artificial Sequence
  Synthetic DNA
ctatacgactcactaagg

SEQ ID NO: 13848 - DNA, 18 bp, Artificial Sequence
  Synthetic DNA
taaaatgagacactatag

SEQ ID NO: 13849 - DNA, 18 bp, Artificial Sequence
  Synthetic DNA
taatacgtttcactcgag

SEQ ID NO: 13850 - DNA, 18 bp, Artificial Sequence
  Synthetic DNA
taatgcgtctctctctag

SEQ ID NO: 13851 - DNA, 18 bp, Artificial Sequence
  Synthetic DNA
tcaaacgactaactacag

SEQ ID NO: 13852 - DNA, 18 bp, Artificial Sequence
  Synthetic DNA
tgatacgagccactagag

SEQ ID NO: 13853 - DNA, 18 bp, Artificial Sequence
  Synthetic DNA
cttttcgactcactatag

SEQ ID NO: 13854 - DNA, 18 bp, Artificial Sequence
  Synthetic DNA
aaacgcgactcactaaag

SEQ ID NO: 13855 - DNA, 18 bp, Artificial Sequence
  Synthetic DNA
tattacgactcagttttg

SEQ ID NO: 13856 - DNA, 18 bp, Artificial Sequence
  Synthetic DNA
taattcagctcgctatag

SEQ ID NO: 13857 - DNA, 18 bp, Artificial Sequence
  Synthetic DNA
aaaaacgactcactactg

SEQ ID NO: 13858 - DNA, 18 bp, Artificial Sequence
  Synthetic DNA
caattagactcactacag

SEQ ID NO: 13859 - DNA, 18 bp, Artificial Sequence
  Synthetic DNA
aaatacgactcaattgag

SEQ ID NO: 13860 - DNA, 18 bp, Artificial Sequence
  Synthetic DNA
atttacgactcagtatag

SEQ ID NO: 13861 - DNA, 18 bp, Artificial Sequence
  Synthetic DNA
taatgcgactcacaccag

SEQ ID NO: 13862 - DNA, 18 bp, Artificial Sequence
  Synthetic DNA
tagtatgactcacttgag

SEQ ID NO: 13863 - DNA, 18 bp, Artificial Sequence
  Synthetic DNA
taatgcgactcacttatg

SEQ ID NO: 13864 - DNA, 18 bp, Artificial Sequence
  Synthetic DNA
taatacgactctgttcag

SEQ ID NO: 13865 - DNA, 18 bp, Artificial Sequence
  Synthetic DNA
aaataagactcagtatcg

SEQ ID NO: 13866 - DNA, 18 bp, Artificial Sequence
  Synthetic DNA
ctatacaactcactacag

SEQ ID NO: 13867 - DNA, 18 bp, Artificial Sequence
  Synthetic DNA
taattcgactcacttctg

SEQ ID NO: 13868 - DNA, 18 bp, Artificial Sequence
  Synthetic DNA
tttaacgcctcactatag

SEQ ID NO: 13869 - DNA, 18 bp, Artificial Sequence
  Synthetic DNA
aaatgcgactcgctaaag

SEQ ID NO: 13870 - DNA, 18 bp, Artificial Sequence
  Synthetic DNA
taaatagcctcactatag

SEQ ID NO: 13871 - DNA, 18 bp, Artificial Sequence
  Synthetic DNA
aattccgactcactgtag

SEQ ID NO: 13872 - DNA, 18 bp, Artificial Sequence
  Synthetic DNA
atataggactcacgatag

SEQ ID NO: 13873 - DNA, 18 bp, Artificial Sequence
  Synthetic DNA
tattagaactcactttag

SEQ ID NO: 13874 - DNA, 18 bp, Artificial Sequence
  Synthetic DNA
tattctaactcactatag

SEQ ID NO: 13875 - DNA, 18 bp, Artificial Sequence
  Synthetic DNA
taaaatgactcgctattg

SEQ ID NO: 13876 - DNA, 18 bp, Artificial Sequence
  Synthetic DNA
taattcgactcgctcaag

SEQ ID NO: 13877 - DNA, 18 bp, Artificial Sequence
  Synthetic DNA
taatttgactccctattg

SEQ ID NO: 13878 - DNA, 18 bp, Artificial Sequence
  Synthetic DNA
caaattgactcactatag

SEQ ID NO: 13879 - DNA, 18 bp, Artificial Sequence
  Synthetic DNA
tattacgactcagtaatg

SEQ ID NO: 13880 - DNA, 18 bp, Artificial Sequence
  Synthetic DNA
ttatacaactcgctatcg

SEQ ID NO: 13881 - DNA, 18 bp, Artificial Sequence
  Synthetic DNA
ttatcggactcactattg

SEQ ID NO: 13882 - DNA, 18 bp, Artificial Sequence
  Synthetic DNA
caatagaactctctatag

SEQ ID NO: 13883 - DNA, 18 bp, Artificial Sequence
  Synthetic DNA
cgaaacgactcacgatag

SEQ ID NO: 13884 - DNA, 18 bp, Artificial Sequence
  Synthetic DNA
taaaatgacgcactttag

SEQ ID NO: 13885 - DNA, 18 bp, Artificial Sequence
  Synthetic DNA
taatactgttcactttag

SEQ ID NO: 13886 - DNA, 18 bp, Artificial Sequence
  Synthetic DNA
tatcaggactcactacag

SEQ ID NO: 13887 - DNA, 18 bp, Artificial Sequence
  Synthetic DNA
ttatgttactcactatag

SEQ ID NO: 13888 - DNA, 18 bp, Artificial Sequence
  Synthetic DNA
ttttacgactcactttcg

SEQ ID NO: 13889 - DNA, 18 bp, Artificial Sequence
  Synthetic DNA
ttaagcgactcactttag

SEQ ID NO: 13890 - DNA, 18 bp, Artificial Sequence
  Synthetic DNA
taattggactcgctaaag

SEQ ID NO: 13891 - DNA, 18 bp, Artificial Sequence
  Synthetic DNA
taatacgtatcgctaaag

SEQ ID NO: 13892 - DNA, 18 bp, Artificial Sequence
  Synthetic DNA
tcttacgactcgctatcg

SEQ ID NO: 13893 - DNA, 18 bp, Artificial Sequence
  Synthetic DNA
ttatacgcatcactattg

SEQ ID NO: 13894 - DNA, 18 bp, Artificial Sequence
  Synthetic DNA
taatacaactcacttagg

SEQ ID NO: 13895 - DNA, 18 bp, Artificial Sequence
  Synthetic DNA
caatacaactctctaaag

SEQ ID NO: 13896 - DNA, 18 bp, Artificial Sequence
  Synthetic DNA
taactggactcactattg

SEQ ID NO: 13897 - DNA, 18 bp, Artificial Sequence
  Synthetic DNA
taattgaactcactttag

SEQ ID NO: 13898 - DNA, 18 bp, Artificial Sequence
  Synthetic DNA
ctatgcgactcactaaag

SEQ ID NO: 13899 - DNA, 18 bp, Artificial Sequence
  Synthetic DNA
tataacaactcactctag

SEQ ID NO: 13900 - DNA, 18 bp, Artificial Sequence
  Synthetic DNA
ttaaacgactcacttttg

SEQ ID NO: 13901 - DNA, 18 bp, Artificial Sequence
  Synthetic DNA
taattcgactcgcttttg

SEQ ID NO: 13902 - DNA, 18 bp, Artificial Sequence
  Synthetic DNA
aattacggctcgctatag

SEQ ID NO: 13903 - DNA, 18 bp, Artificial Sequence
  Synthetic DNA
taatataactcgctatcg

SEQ ID NO: 13904 - DNA, 18 bp, Artificial Sequence
  Synthetic DNA
taattcggatcaccatag

SEQ ID NO: 13905 - DNA, 18 bp, Artificial Sequence
  Synthetic DNA
tattgcgcctcactattg

SEQ ID NO: 13906 - DNA, 18 bp, Artificial Sequence
  Synthetic DNA
aaatgcgactcactgaag

SEQ ID NO: 13907 - DNA, 18 bp, Artificial Sequence
  Synthetic DNA
taatacaactcactgccg

SEQ ID NO: 13908 - DNA, 18 bp, Artificial Sequence
  Synthetic DNA
tagtacgacactctatcg

SEQ ID NO: 13909 - DNA, 18 bp, Artificial Sequence
  Synthetic DNA
taatgcgcctcaccattg

SEQ ID NO: 13910 - DNA, 18 bp, Artificial Sequence
  Synthetic DNA
taatataactctctaaag

SEQ ID NO: 13911 - DNA, 18 bp, Artificial Sequence
  Synthetic DNA
tattagaactcactacag

SEQ ID NO: 13912 - DNA, 18 bp, Artificial Sequence
  Synthetic DNA
ttatacggctctctattg

SEQ ID NO: 13913 - DNA, 18 bp, Artificial Sequence
  Synthetic DNA
taattcgtctcgctgtag

SEQ ID NO: 13914 - DNA, 18 bp, Artificial Sequence
  Synthetic DNA
taattaaactcactctag

SEQ ID NO: 13915 - DNA, 18 bp, Artificial Sequence
  Synthetic DNA
tacaacgtctcactctag

SEQ ID NO: 13916 - DNA, 18 bp, Artificial Sequence
  Synthetic DNA
ttattgcactcactatag

SEQ ID NO: 13917 - DNA, 18 bp, Artificial Sequence
  Synthetic DNA
ttattcgactcacttcag

SEQ ID NO: 13918 - DNA, 18 bp, Artificial Sequence
  Synthetic DNA
atatgcgactcaccatag

SEQ ID NO: 13919 - DNA, 18 bp, Artificial Sequence
  Synthetic DNA
tataacaactcactatgg

SEQ ID NO: 13920 - DNA, 18 bp, Artificial Sequence
  Synthetic DNA
ttatgcgactcactcaag

SEQ ID NO: 13921 - DNA, 18 bp, Artificial Sequence
  Synthetic DNA
taaatcgcctcactaaag

SEQ ID NO: 13922 - DNA, 18 bp, Artificial Sequence
  Synthetic DNA
aaaagcgactcactattg

SEQ ID NO: 13923 - DNA, 18 bp, Artificial Sequence
  Synthetic DNA
taatatgcatcactattg

SEQ ID NO: 13924 - DNA, 18 bp, Artificial Sequence
  Synthetic DNA
ttaaacgtctcactaaag

SEQ ID NO: 13925 - DNA, 18 bp, Artificial Sequence
  Synthetic DNA
taatgcaactcactactg

SEQ ID NO: 13926 - DNA, 18 bp, Artificial Sequence
  Synthetic DNA
ttttgcgactcactattg

SEQ ID NO: 13927 - DNA, 18 bp, Artificial Sequence
  Synthetic DNA
taatacgcctcacttagg

SEQ ID NO: 13928 - DNA, 18 bp, Artificial Sequence
  Synthetic DNA
taattcgaatcgctattg

SEQ ID NO: 13929 - DNA, 18 bp, Artificial Sequence
  Synthetic DNA
taatacgaatcgatattg

SEQ ID NO: 13930 - DNA, 18 bp, Artificial Sequence
  Synthetic DNA
taattcgacgcaatattg

SEQ ID NO: 13931 - DNA, 18 bp, Artificial Sequence
  Synthetic DNA
taattcgactagctctag

SEQ ID NO: 13932 - DNA, 18 bp, Artificial Sequence
  Synthetic DNA
taattcgattcgcaatag

SEQ ID NO: 13933 - DNA, 18 bp, Artificial Sequence
  Synthetic DNA
taattggactcactgttg

SEQ ID NO: 13934 - DNA, 18 bp, Artificial Sequence
  Synthetic DNA
tcattcgactcaccattg

SEQ ID NO: 13935 - DNA, 18 bp, Artificial Sequence
  Synthetic DNA
tcattcgagtcgctatag

SEQ ID NO: 13936 - DNA, 18 bp, Artificial Sequence
  Synthetic DNA
atattcgacccactatag

SEQ ID NO: 13937 - DNA, 18 bp, Artificial Sequence
  Synthetic DNA
caaaacgactcgctttag

SEQ ID NO: 13938 - DNA, 18 bp, Artificial Sequence
  Synthetic DNA
caataccacccactattg

SEQ ID NO: 13939 - DNA, 18 bp, Artificial Sequence
  Synthetic DNA
taacaggactcgctctag

SEQ ID NO: 13940 - DNA, 18 bp, Artificial Sequence
  Synthetic DNA
taataagactcactttta

SEQ ID NO: 13941 - DNA, 18 bp, Artificial Sequence
  Synthetic DNA
taataagactctccattg

SEQ ID NO: 13942 - DNA, 18 bp, Artificial Sequence
  Synthetic DNA
taatacatctcactgttg

SEQ ID NO: 13943 - DNA, 18 bp, Artificial Sequence
  Synthetic DNA
taatacgacacgtgatag

SEQ ID NO: 13944 - DNA, 18 bp, Artificial Sequence
  Synthetic DNA
taatacgtctctctatta

SEQ ID NO: 13945 - DNA, 18 bp, Artificial Sequence
  Synthetic DNA
taataggactcgttaaag

SEQ ID NO: 13946 - DNA, 18 bp, Artificial Sequence
  Synthetic DNA
taattcgactccctcaag

SEQ ID NO: 13947 - DNA, 18 bp, Artificial Sequence
  Synthetic DNA
taattcgcctcactgaag

SEQ ID NO: 13948 - DNA, 18 bp, Artificial Sequence
  Synthetic DNA
taattctactctgtatag

SEQ ID NO: 13949 - DNA, 18 bp, Artificial Sequence
  Synthetic DNA
taattgaacgcactatag

SEQ ID NO: 13950 - DNA, 18 bp, Artificial Sequence
  Synthetic DNA
tattacgactcactaata

SEQ ID NO: 13951 - DNA, 18 bp, Artificial Sequence
  Synthetic DNA
ttattggactcacgatag

SEQ ID NO: 13952 - DNA, 18 bp, Artificial Sequence
  Synthetic DNA
aaatacgaaccactagag

SEQ ID NO: 13953 - DNA, 18 bp, Artificial Sequence
  Synthetic DNA
aaatacgactaatcatag

SEQ ID NO: 13954 - DNA, 18 bp, Artificial Sequence
  Synthetic DNA
aaatacgagacactgtag

SEQ ID NO: 13955 - DNA, 18 bp, Artificial Sequence
  Synthetic DNA
aaatacgatgcacaatag

SEQ ID NO: 13956 - DNA, 18 bp, Artificial Sequence
  Synthetic DNA
aaatactagtgactatag

SEQ ID NO: 13957 - DNA, 18 bp, Artificial Sequence
  Synthetic DNA
aaatcggactcactatcg

SEQ ID NO: 13958 - DNA, 18 bp, Artificial Sequence
  Synthetic DNA
aagcacgactcactaaag

SEQ ID NO: 13959 - DNA, 18 bp, Artificial Sequence
  Synthetic DNA
aattctgactcactatag

SEQ ID NO: 13960 - DNA, 18 bp, Artificial Sequence
  Synthetic DNA
caatacaactctctctag

SEQ ID NO: 13961 - DNA, 18 bp, Artificial Sequence
  Synthetic DNA
caatacacctcagtatag

SEQ ID NO: 13962 - DNA, 18 bp, Artificial Sequence
  Synthetic DNA
caatacgaagctctatag

SEQ ID NO: 13963 - DNA, 18 bp, Artificial Sequence
  Synthetic DNA
caatacgactcacttagg

SEQ ID NO: 13964 - DNA, 18 bp, Artificial Sequence
  Synthetic DNA
caatacgcgtcactaaag

SEQ ID NO: 13965 - DNA, 18 bp, Artificial Sequence
  Synthetic DNA
cattacaacttactatag

SEQ ID NO: 13966 - DNA, 18 bp, Artificial Sequence
  Synthetic DNA
cattgcaactcactatag

SEQ ID NO: 13967 - DNA, 18 bp, Artificial Sequence
  Synthetic DNA
cgatacgactcactgtcg

SEQ ID NO: 13968 - DNA, 18 bp, Artificial Sequence
  Synthetic DNA
ctatacgactctcgatag

SEQ ID NO: 13969 - DNA, 18 bp, Artificial Sequence
  Synthetic DNA
ctatacgactgattatag

SEQ ID NO: 13970 - DNA, 18 bp, Artificial Sequence
  Synthetic DNA
gaatccgattcacaatag

SEQ ID NO: 13971 - DNA, 18 bp, Artificial Sequence
  Synthetic DNA
taaaacgacataccatag

SEQ ID NO: 13972 - DNA, 18 bp, Artificial Sequence
  Synthetic DNA
taaagagactcactttag

SEQ ID NO: 13973 - DNA, 18 bp, Artificial Sequence
  Synthetic DNA
taaagcgactcacaacag

SEQ ID NO: 13974 - DNA, 18 bp, Artificial Sequence
  Synthetic DNA
taacacgaaatactatag

SEQ ID NO: 13975 - DNA, 18 bp, Artificial Sequence
  Synthetic DNA
taacacgactatttatag

SEQ ID NO: 13976 - DNA, 18 bp, Artificial Sequence
  Synthetic DNA
taataaaactcactaagg

SEQ ID NO: 13977 - DNA, 18 bp, Artificial Sequence
  Synthetic DNA
taataagacacactcaag

SEQ ID NO: 13978 - DNA, 18 bp, Artificial Sequence
  Synthetic DNA
taatacaacactcgatag

SEQ ID NO: 13979 - DNA, 18 bp, Artificial Sequence
  Synthetic DNA
taatacaattgactgtag

SEQ ID NO: 13980 - DNA, 18 bp, Artificial Sequence
  Synthetic DNA
taataccgctaagtatag

SEQ ID NO: 13981 - DNA, 18 bp, Artificial Sequence
  Synthetic DNA
taatacgaatacctatcg

SEQ ID NO: 13982 - DNA, 18 bp, Artificial Sequence
  Synthetic DNA
taatacgactacatgtag

SEQ ID NO: 13983 - DNA, 18 bp, Artificial Sequence
  Synthetic DNA
taatacgactcaaccaag

SEQ ID NO: 13984 - DNA, 18 bp, Artificial Sequence
  Synthetic DNA
taatacgcatcaatatgg

SEQ ID NO: 13985 - DNA, 18 bp, Artificial Sequence
  Synthetic DNA
taatactacacactgcag

SEQ ID NO: 13986 - DNA, 18 bp, Artificial Sequence
  Synthetic DNA
taatactacagactctag

SEQ ID NO: 13987 - DNA, 18 bp, Artificial Sequence
  Synthetic DNA
taatagaactcaacatag

SEQ ID NO: 13988 - DNA, 18 bp, Artificial Sequence
  Synthetic DNA
taataggtctctctagag

SEQ ID NO: 13989 - DNA, 18 bp, Artificial Sequence
  Synthetic DNA
taatatacctcactaaag

SEQ ID NO: 13990 - DNA, 18 bp, Artificial Sequence
  Synthetic DNA
taatcagattcactgtag

SEQ ID NO: 13991 - DNA, 18 bp, Artificial Sequence
  Synthetic DNA
taatccgactccctttcg

SEQ ID NO: 13992 - DNA, 18 bp, Artificial Sequence
  Synthetic DNA
taatccgcctcactttgg

SEQ ID NO: 13993 - DNA, 18 bp, Artificial Sequence
  Synthetic DNA
taatccgtctcaccaaag

SEQ ID NO: 13994 - DNA, 18 bp, Artificial Sequence
  Synthetic DNA
taatgcaactcactaacg

SEQ ID NO: 13995 - DNA, 18 bp, Artificial Sequence
  Synthetic DNA
taatgcgccacactacag

SEQ ID NO: 13996 - DNA, 18 bp, Artificial Sequence
  Synthetic DNA
taatgctactcacaatgg

SEQ ID NO: 13997 - DNA, 18 bp, Artificial Sequence
  Synthetic DNA
tactaccactccgtatag

SEQ ID NO: 13998 - DNA, 18 bp, Artificial Sequence
  Synthetic DNA
tactatgacttactctag

SEQ ID NO: 13999 - DNA, 18 bp, Artificial Sequence
  Synthetic DNA
tagtacgcctcactaagg

SEQ ID NO: 14000 - DNA, 18 bp, Artificial Sequence
  Synthetic DNA
tagtactacttactacag

SEQ ID NO: 14001 - DNA, 18 bp, Artificial Sequence
  Synthetic DNA
tatcccaactcactatag

SEQ ID NO: 14002 - DNA, 18 bp, Artificial Sequence
  Synthetic DNA
tattccgactcattttag

SEQ ID NO: 14003 - DNA, 18 bp, Artificial Sequence
  Synthetic DNA
tcagacgattcactacag

SEQ ID NO: 14004 - DNA, 18 bp, Artificial Sequence
  Synthetic DNA
tcataagtctcactaaag

SEQ ID NO: 14005 - DNA, 18 bp, Artificial Sequence
  Synthetic DNA
tcatacgcctcacaatgg

SEQ ID NO: 14006 - DNA, 18 bp, Artificial Sequence
  Synthetic DNA
tcatacgtctcacgctag

SEQ ID NO: 14007 - DNA, 18 bp, Artificial Sequence
  Synthetic DNA
tgacatgactcagtatag

SEQ ID NO: 14008 - DNA, 18 bp, Artificial Sequence
  Synthetic DNA
ttagacgactcaccaaag

SEQ ID NO: 14009 - DNA, 18 bp, Artificial Sequence
  Synthetic DNA
ttatatgactcactgtgg

SEQ ID NO: 14010 - DNA, 18 bp, Artificial Sequence
  Synthetic DNA
ttatccgacgcactctag

SEQ ID NO: 14011 - DNA, 18 bp, Artificial Sequence
  Synthetic DNA
ttatcggactcactacag

SEQ ID NO: 14012 - DNA, 18 bp, Artificial Sequence
  Synthetic DNA
aattgcgactcactaaag

SEQ ID NO: 14013 - DNA, 18 bp, Artificial Sequence
  Synthetic DNA
taattggtctcactaaag

SEQ ID NO: 14014 - DNA, 18 bp, Artificial Sequence
  Synthetic DNA
tgattcaactcactacag

SEQ ID NO: 14015 - DNA, 18 bp, Artificial Sequence
  Synthetic DNA
ctattcaactcactatag

SEQ ID NO: 14016 - DNA, 18 bp, Artificial Sequence
  Synthetic DNA
tgatatcactcactttag

SEQ ID NO: 14017 - DNA, 18 bp, Artificial Sequence
  Synthetic DNA
tataaggactcactaaag

SEQ ID NO: 14018 - DNA, 18 bp, Artificial Sequence
  Synthetic DNA
aagttcgactcactttag

SEQ ID NO: 14019 - DNA, 18 bp, Artificial Sequence
  Synthetic DNA
taattaaactcactttag

SEQ ID NO: 14020 - DNA, 18 bp, Artificial Sequence
  Synthetic DNA
ttaatcgactcactgtag

SEQ ID NO: 14021 - DNA, 18 bp, Artificial Sequence
  Synthetic DNA
taattagactcactcttg

SEQ ID NO: 14022 - DNA, 18 bp, Artificial Sequence
  Synthetic DNA
gtatgcgactcactaaag

SEQ ID NO: 14023 - DNA, 18 bp, Artificial Sequence
  Synthetic DNA
taataggactcacctaag

SEQ ID NO: 14024 - DNA, 18 bp, Artificial Sequence
  Synthetic DNA
tgttacaactcactaaag

SEQ ID NO: 14025 - DNA, 18 bp, Artificial Sequence
  Synthetic DNA
ttatgcgtctcactagag

SEQ ID NO: 14026 - DNA, 18 bp, Artificial Sequence
  Synthetic DNA
aattacgactcgctattg

SEQ ID NO: 14027 - DNA, 18 bp, Artificial Sequence
  Synthetic DNA
taatgcgactcactcatg

SEQ ID NO: 14028 - DNA, 18 bp, Artificial Sequence
  Synthetic DNA
tagtacgatccactaaag

SEQ ID NO: 14029 - DNA, 18 bp, Artificial Sequence
  Synthetic DNA
aaatataactcactatgg

SEQ ID NO: 14030 - DNA, 18 bp, Artificial Sequence
  Synthetic DNA
tatagcgactcactaaag

SEQ ID NO: 14031 - DNA, 18 bp, Artificial Sequence
  Synthetic DNA
tggaacgactcactacag

SEQ ID NO: 14032 - DNA, 18 bp, Artificial Sequence
  Synthetic DNA
ttatacgactcacttagg

SEQ ID NO: 14033 - DNA, 18 bp, Artificial Sequence
  Synthetic DNA
taatactcctctctgtag

SEQ ID NO: 14034 - DNA, 18 bp, Artificial Sequence
  Synthetic DNA
ttataggtctcactctag

SEQ ID NO: 14035 - DNA, 18 bp, Artificial Sequence
  Synthetic DNA
ttatgcgtctcactttag

SEQ ID NO: 14036 - DNA, 18 bp, Artificial Sequence
  Synthetic DNA
caactcgactcactattg

SEQ ID NO: 14037 - DNA, 18 bp, Artificial Sequence
  Synthetic DNA
taattcgtctcacgctag

SEQ ID NO: 14038 - DNA, 18 bp, Artificial Sequence
  Synthetic DNA
tattccgactcacttaag

SEQ ID NO: 14039 - DNA, 18 bp, Artificial Sequence
  Synthetic DNA
ttatacgactcaataacg

SEQ ID NO: 14040 - DNA, 18 bp, Artificial Sequence
  Synthetic DNA
tatttcgactcaccattg

SEQ ID NO: 14041 - DNA, 18 bp, Artificial Sequence
  Synthetic DNA
ttaatcgcctcactatag

SEQ ID NO: 14042 - DNA, 18 bp, Artificial Sequence
  Synthetic DNA
taatccggcacactattg

SEQ ID NO: 14043 - DNA, 18 bp, Artificial Sequence
  Synthetic DNA
caaagcgactcactaaag

SEQ ID NO: 14044 - DNA, 18 bp, Artificial Sequence
  Synthetic DNA
ttatacgtctcactaagg

SEQ ID NO: 14045 - DNA, 18 bp, Artificial Sequence
  Synthetic DNA
taatactacttgctattg

SEQ ID NO: 14046 - DNA, 18 bp, Artificial Sequence
  Synthetic DNA
tatttcgactcgctaaag

SEQ ID NO: 14047 - DNA, 18 bp, Artificial Sequence
  Synthetic DNA
tgtttcgactcactattg

SEQ ID NO: 14048 - DNA, 18 bp, Artificial Sequence
  Synthetic DNA
taatgccacacactattg

SEQ ID NO: 14049 - DNA, 18 bp, Artificial Sequence
  Synthetic DNA
taatatgtgtcactaaag

SEQ ID NO: 14050 - DNA, 18 bp, Artificial Sequence
  Synthetic DNA
tattagtactcaccatag

SEQ ID NO: 14051 - DNA, 18 bp, Artificial Sequence
  Synthetic DNA
tatttcggctcactattg

SEQ ID NO: 14052 - DNA, 18 bp, Artificial Sequence
  Synthetic DNA
tattgcgactcacttcag

SEQ ID NO: 14053 - DNA, 18 bp, Artificial Sequence
  Synthetic DNA
aaattcgactcgctaaag

SEQ ID NO: 14054 - DNA, 18 bp, Artificial Sequence
  Synthetic DNA
caattcgactcgctatcg

SEQ ID NO: 14055 - DNA, 18 bp, Artificial Sequence
  Synthetic DNA
taattcggcttactattg

SEQ ID NO: 14056 - DNA, 18 bp, Artificial Sequence
  Synthetic DNA
tatttcgactcgctagag

SEQ ID NO: 14057 - DNA, 18 bp, Artificial Sequence
  Synthetic DNA
aaattggactcactatcg

SEQ ID NO: 14058 - DNA, 18 bp, Artificial Sequence
  Synthetic DNA
caatacgactctctcttg

SEQ ID NO: 14059 - DNA, 18 bp, Artificial Sequence
  Synthetic DNA
caatacgactgattattg

SEQ ID NO: 14060 - DNA, 18 bp, Artificial Sequence
  Synthetic DNA
caattcgatccactatag

SEQ ID NO: 14061 - DNA, 18 bp, Artificial Sequence
  Synthetic DNA
ccatacgactcgctttag

SEQ ID NO: 14062 - DNA, 18 bp, Artificial Sequence
  Synthetic DNA
taatacgatttactgttg

SEQ ID NO: 14063 - DNA, 18 bp, Artificial Sequence
  Synthetic DNA
taatatgtgtcactattg

SEQ ID NO: 14064 - DNA, 18 bp, Artificial Sequence
  Synthetic DNA
taatttggctcactatgg

SEQ ID NO: 14065 - DNA, 18 bp, Artificial Sequence
  Synthetic DNA
ttatgcgactcgctaaag

SEQ ID NO: 14066 - DNA, 18 bp, Artificial Sequence
  Synthetic DNA
ttattcgcctcactatcg

SEQ ID NO: 14067 - DNA, 18 bp, Artificial Sequence
  Synthetic DNA
ttctacgactcactaatg

SEQ ID NO: 14068 - DNA, 18 bp, Artificial Sequence
  Synthetic DNA
tttttcgacgcactatag

SEQ ID NO: 14069 - DNA, 18 bp, Artificial Sequence
  Synthetic DNA
atttacgactcactagag

SEQ ID NO: 14070 - DNA, 18 bp, Artificial Sequence
  Synthetic DNA
ctatacgactcactgcag

SEQ ID NO: 14071 - DNA, 18 bp, Artificial Sequence
  Synthetic DNA
taatagacgtcactatag

SEQ ID NO: 14072 - DNA, 18 bp, Artificial Sequence
  Synthetic DNA
tactacgtcccactctag

SEQ ID NO: 14073 - DNA, 18 bp, Artificial Sequence
  Synthetic DNA
tagtccgagacactatag

SEQ ID NO: 14074 - DNA, 18 bp, Artificial Sequence
  Synthetic DNA
tcataagtctcaatatag

SEQ ID NO: 14075 - DNA, 18 bp, Artificial Sequence
  Synthetic DNA
tcatacgagtccttatag

SEQ ID NO: 14076 - DNA, 18 bp, Artificial Sequence
  Synthetic DNA
tgttacgcctcactctag

SEQ ID NO: 14077 - DNA, 18 bp, Artificial Sequence
  Synthetic DNA
ttatcggactcacaatag

SEQ ID NO: 14078 - DNA, 18 bp, Artificial Sequence
  Synthetic DNA
ttttacgaccgactatag

SEQ ID NO: 14079 - DNA, 18 bp, Artificial Sequence
  Synthetic DNA
ttttacgacttactgtag

SEQ ID NO: 14080 - DNA, 18 bp, Artificial Sequence
  Synthetic DNA
tattatgactctctgtag

SEQ ID NO: 14081 - DNA, 18 bp, Artificial Sequence
  Synthetic DNA
taatgcgactcacatcag

SEQ ID NO: 14082 - DNA, 18 bp, Artificial Sequence
  Synthetic DNA
tgttacgcctcactttag

SEQ ID NO: 14083 - DNA, 18 bp, Artificial Sequence
  Synthetic DNA
ttttacgtctcaccatag

SEQ ID NO: 14084 - DNA, 18 bp, Artificial Sequence
  Synthetic DNA
ttttacgactcgctattg

SEQ ID NO: 14085 - DNA, 18 bp, Artificial Sequence
  Synthetic DNA
taaacgaactcactatag

SEQ ID NO: 14086 - DNA, 18 bp, Artificial Sequence
  Synthetic DNA
taatacgtctcgctactg

SEQ ID NO: 14087 - DNA, 18 bp, Artificial Sequence
  Synthetic DNA
taaaccgactcactactg

SEQ ID NO: 14088 - DNA, 18 bp, Artificial Sequence
  Synthetic DNA
taatacaactcagtaatg

SEQ ID NO: 14089 - DNA, 18 bp, Artificial Sequence
  Synthetic DNA
tataacgcctcactacag

SEQ ID NO: 14090 - DNA, 18 bp, Artificial Sequence
  Synthetic DNA
agatgcgactcactaaag

SEQ ID NO: 14091 - DNA, 18 bp, Artificial Sequence
  Synthetic DNA
taattcgactcgcaattg

SEQ ID NO: 14092 - DNA, 18 bp, Artificial Sequence
  Synthetic DNA
aaattcaactcgctatag

SEQ ID NO: 14093 - DNA, 18 bp, Artificial Sequence
  Synthetic DNA
tatttggactcgctatag

SEQ ID NO: 14094 - DNA, 18 bp, Artificial Sequence
  Synthetic DNA
taatagaactcgctaaag

SEQ ID NO: 14095 - DNA, 18 bp, Artificial Sequence
  Synthetic DNA
taattcgtctcagtacag

SEQ ID NO: 14096 - DNA, 18 bp, Artificial Sequence
  Synthetic DNA
aagtaggactcacaatag

SEQ ID NO: 14097 - DNA, 18 bp, Artificial Sequence
  Synthetic DNA
taaaccgtctcactaaag

SEQ ID NO: 14098 - DNA, 18 bp, Artificial Sequence
  Synthetic DNA
taatgagtctcactctag

SEQ ID NO: 14099 - DNA, 18 bp, Artificial Sequence
  Synthetic DNA
ttaaaggactcactatgg

SEQ ID NO: 14100 - DNA, 18 bp, Artificial Sequence
  Synthetic DNA
ttatcagtctcactatag

SEQ ID NO: 14101 - DNA, 18 bp, Artificial Sequence
  Synthetic DNA
tattacgcctcgctattg

SEQ ID NO: 14102 - DNA, 18 bp, Artificial Sequence
  Synthetic DNA
aattaggactcactaaag

SEQ ID NO: 14103 - DNA, 18 bp, Artificial Sequence
  Synthetic DNA
taataggtctcactcttg

SEQ ID NO: 14104 - DNA, 18 bp, Artificial Sequence
  Synthetic DNA
ttatacgactcaccactg

SEQ ID NO: 14105 - DNA, 18 bp, Artificial Sequence
  Synthetic DNA
taatacgtcgcacattag

SEQ ID NO: 14106 - DNA, 18 bp, Artificial Sequence
  Synthetic DNA
ttatacaactcactcaag

SEQ ID NO: 14107 - DNA, 18 bp, Artificial Sequence
  Synthetic DNA
ttatacgactcgatattg

SEQ ID NO: 14108 - DNA, 18 bp, Artificial Sequence
  Synthetic DNA
taattagactcacactag

SEQ ID NO: 14109 - DNA, 18 bp, Artificial Sequence
  Synthetic DNA
ttatacgactcgctaccg

SEQ ID NO: 14110 - DNA, 18 bp, Artificial Sequence
  Synthetic DNA
aaatacaactctctttag

SEQ ID NO: 14111 - DNA, 18 bp, Artificial Sequence
  Synthetic DNA
taatgcgcatcactgtag

SEQ ID NO: 14112 - DNA, 18 bp, Artificial Sequence
  Synthetic DNA
tattaggactcaccctag

SEQ ID NO: 14113 - DNA, 18 bp, Artificial Sequence
  Synthetic DNA
ctatacgcctcactaaag

SEQ ID NO: 14114 - DNA, 18 bp, Artificial Sequence
  Synthetic DNA
ttattcgactcacactag

SEQ ID NO: 14115 - DNA, 18 bp, Artificial Sequence
  Synthetic DNA
tagttcgactcactaatg

SEQ ID NO: 14116 - DNA, 18 bp, Artificial Sequence
  Synthetic DNA
aaattcgactcacaatcg

SEQ ID NO: 14117 - DNA, 18 bp, Artificial Sequence
  Synthetic DNA
aaataggactcactctgg

SEQ ID NO: 14118 - DNA, 18 bp, Artificial Sequence
  Synthetic DNA
tgttgcgactcactaaag

SEQ ID NO: 14119 - DNA, 18 bp, Artificial Sequence
  Synthetic DNA
ttaaacgtctcactatcg

SEQ ID NO: 14120 - DNA, 18 bp, Artificial Sequence
  Synthetic DNA
tgattcgactctctttag

SEQ ID NO: 14121 - DNA, 18 bp, Artificial Sequence
  Synthetic DNA
caattagactcactttag

SEQ ID NO: 14122 - DNA, 18 bp, Artificial Sequence
  Synthetic DNA
taaaacgcctcactgttg

SEQ ID NO: 14123 - DNA, 18 bp, Artificial Sequence
  Synthetic DNA
taattcaactcgctacag

SEQ ID NO: 14124 - DNA, 18 bp, Artificial Sequence
  Synthetic DNA
atttacgactcactgtag

SEQ ID NO: 14125 - DNA, 18 bp, Artificial Sequence
  Synthetic DNA
tattagaactcactaaag

SEQ ID NO: 14126 - DNA, 18 bp, Artificial Sequence
  Synthetic DNA
taaatcgactctgtatag

SEQ ID NO: 14127 - DNA, 18 bp, Artificial Sequence
  Synthetic DNA
acttaggactcactatag

SEQ ID NO: 14128 - DNA, 18 bp, Artificial Sequence
  Synthetic DNA
ccatacgacactctatag

SEQ ID NO: 14129 - DNA, 18 bp, Artificial Sequence
  Synthetic DNA
ttttaggactcactaaag

SEQ ID NO: 14130 - DNA, 18 bp, Artificial Sequence
  Synthetic DNA
atattcgactcactattg

SEQ ID NO: 14131 - DNA, 18 bp, Artificial Sequence
  Synthetic DNA
ttatacgtctcgctattg

SEQ ID NO: 14132 - DNA, 18 bp, Artificial Sequence
  Synthetic DNA
taaaacgactcactcctg

SEQ ID NO: 14133 - DNA, 18 bp, Artificial Sequence
  Synthetic DNA
taaagcgtctcactattg

SEQ ID NO: 14134 - DNA, 18 bp, Artificial Sequence
  Synthetic DNA
ttttacgtctcactacag

SEQ ID NO: 14135 - DNA, 18 bp, Artificial Sequence
  Synthetic DNA
ctatacgactcactcttg

SEQ ID NO: 14136 - DNA, 18 bp, Artificial Sequence
  Synthetic DNA
taatacgcctcacttatg

SEQ ID NO: 14137 - DNA, 18 bp, Artificial Sequence
  Synthetic DNA
ttttacgactcacactag

SEQ ID NO: 14138 - DNA, 18 bp, Artificial Sequence
  Synthetic DNA
taatttgtctcactacag

SEQ ID NO: 14139 - DNA, 18 bp, Artificial Sequence
  Synthetic DNA
tattacgtcccactttag

SEQ ID NO: 14140 - DNA, 18 bp, Artificial Sequence
  Synthetic DNA
taataagactcactgatg

SEQ ID NO: 14141 - DNA, 18 bp, Artificial Sequence
  Synthetic DNA
taataagactcagaattg

SEQ ID NO: 14142 - DNA, 18 bp, Artificial Sequence
  Synthetic DNA
ttaaacgactcgctgtag

SEQ ID NO: 14143 - DNA, 18 bp, Artificial Sequence
  Synthetic DNA
taatgcaattctctatag

SEQ ID NO: 14144 - DNA, 18 bp, Artificial Sequence
  Synthetic DNA
caatacgactcgcttttg

SEQ ID NO: 14145 - DNA, 18 bp, Artificial Sequence
  Synthetic DNA
taaaacgactcgatattg

SEQ ID NO: 14146 - DNA, 18 bp, Artificial Sequence
  Synthetic DNA
taaagcgactcgctattg

SEQ ID NO: 14147 - DNA, 18 bp, Artificial Sequence
  Synthetic DNA
taaatagactcactattg

SEQ ID NO: 14148 - DNA, 18 bp, Artificial Sequence
  Synthetic DNA
taactcgactcggtatag

SEQ ID NO: 14149 - DNA, 18 bp, Artificial Sequence
  Synthetic DNA
taagtcgactcactactg

SEQ ID NO: 14150 - DNA, 18 bp, Artificial Sequence
  Synthetic DNA
taataagactcgttattg

SEQ ID NO: 14151 - DNA, 18 bp, Artificial Sequence
  Synthetic DNA
taatacgactagccattg

SEQ ID NO: 14152 - DNA, 18 bp, Artificial Sequence
  Synthetic DNA
taatacgactagctactg

SEQ ID NO: 14153 - DNA, 18 bp, Artificial Sequence
  Synthetic DNA
taatacgtcccgctattg

SEQ ID NO: 14154 - DNA, 18 bp, Artificial Sequence
  Synthetic DNA
taatactaatcgctattg

SEQ ID NO: 14155 - DNA, 18 bp, Artificial Sequence
  Synthetic DNA
taataggactcgctaatg

SEQ ID NO: 14156 - DNA, 18 bp, Artificial Sequence
  Synthetic DNA
taatccgactcggtattg

SEQ ID NO: 14157 - DNA, 18 bp, Artificial Sequence
  Synthetic DNA
taatgcgactcgccattg

SEQ ID NO: 14158 - DNA, 18 bp, Artificial Sequence
  Synthetic DNA
taatgcggctcgctattg

SEQ ID NO: 14159 - DNA, 18 bp, Artificial Sequence
  Synthetic DNA
taattagactcgctataa

SEQ ID NO: 14160 - DNA, 18 bp, Artificial Sequence
  Synthetic DNA
taattcgactaactcttg

SEQ ID NO: 14161 - DNA, 18 bp, Artificial Sequence
  Synthetic DNA
taattcgactagctttag

SEQ ID NO: 14162 - DNA, 18 bp, Artificial Sequence
  Synthetic DNA
taattcgactcgataaag

SEQ ID NO: 14163 - DNA, 18 bp, Artificial Sequence
  Synthetic DNA
taattcgactcgctaaaa

SEQ ID NO: 14164 - DNA, 18 bp, Artificial Sequence
  Synthetic DNA
taattcgactcgttttag

SEQ ID NO: 14165 - DNA, 18 bp, Artificial Sequence
  Synthetic DNA
taattcgactgactcttg

SEQ ID NO: 14166 - DNA, 18 bp, Artificial Sequence
  Synthetic DNA
tactacgactcgcaattg

SEQ ID NO: 14167 - DNA, 18 bp, Artificial Sequence
  Synthetic DNA
tactacgactcgcttttg

SEQ ID NO: 14168 - DNA, 18 bp, Artificial Sequence
  Synthetic DNA
tatttcgactcactattc

SEQ ID NO: 14169 - DNA, 18 bp, Artificial Sequence
  Synthetic DNA
tgattcgactcgatatag

SEQ ID NO: 14170 - DNA, 18 bp, Artificial Sequence
  Synthetic DNA
tgattcgtctcgctatag

SEQ ID NO: 14171 - DNA, 18 bp, Artificial Sequence
  Synthetic DNA
ttattcaactcgctatag

SEQ ID NO: 14172 - DNA, 18 bp, Artificial Sequence
  Synthetic DNA
aaataccactcactcttg

SEQ ID NO: 14173 - DNA, 18 bp, Artificial Sequence
  Synthetic DNA
aaataccactcgctttag

SEQ ID NO: 14174 - DNA, 18 bp, Artificial Sequence
  Synthetic DNA
aaatacgactcgctcaag

SEQ ID NO: 14175 - DNA, 18 bp, Artificial Sequence
  Synthetic DNA
aaatacggctggctatag

SEQ ID NO: 14176 - DNA, 18 bp, Artificial Sequence
  Synthetic DNA
aaatacgtctcgctatcg

SEQ ID NO: 14177 - DNA, 18 bp, Artificial Sequence
  Synthetic DNA
aaataggactcagtattg

SEQ ID NO: 14178 - DNA, 18 bp, Artificial Sequence
  Synthetic DNA
aaatcagactcactattg

SEQ ID NO: 14179 - DNA, 18 bp, Artificial Sequence
  Synthetic DNA
aaatgcgactcgctacag

SEQ ID NO: 14180 - DNA, 18 bp, Artificial Sequence
  Synthetic DNA
aaattcgactcaatgtag

SEQ ID NO: 14181 - DNA, 18 bp, Artificial Sequence
  Synthetic DNA
aaattcgactgaccatag

SEQ ID NO: 14182 - DNA, 18 bp, Artificial Sequence
  Synthetic DNA
aaattctacgcactatag

SEQ ID NO: 14183 - DNA, 18 bp, Artificial Sequence
  Synthetic DNA
aaatttgactcactatcg

SEQ ID NO: 14184 - DNA, 18 bp, Artificial Sequence
  Synthetic DNA
agaaacgactcactattg

SEQ ID NO: 14185 - DNA, 18 bp, Artificial Sequence
  Synthetic DNA
agatacgcctcactattg

SEQ ID NO: 14186 - DNA, 18 bp, Artificial Sequence
  Synthetic DNA
caaaacgactgactattg

SEQ ID NO: 14187 - DNA, 18 bp, Artificial Sequence
  Synthetic DNA
caagacgactcacttttg

SEQ ID NO: 14188 - DNA, 18 bp, Artificial Sequence
  Synthetic DNA
caataagactcactcttg

SEQ ID NO: 14189 - DNA, 18 bp, Artificial Sequence
  Synthetic DNA
caatatgactcgctttag

SEQ ID NO: 14190 - DNA, 18 bp, Artificial Sequence
  Synthetic DNA
caattagactaactatag

SEQ ID NO: 14191 - DNA, 18 bp, Artificial Sequence
  Synthetic DNA
caattcgattcactgtag

SEQ ID NO: 14192 - DNA, 18 bp, Artificial Sequence
  Synthetic DNA
caattcgcatcactatag

SEQ ID NO: 14193 - DNA, 18 bp, Artificial Sequence
  Synthetic DNA
caattgaactcactatag

SEQ ID NO: 14194 - DNA, 18 bp, Artificial Sequence
  Synthetic DNA
caattggactcactaaag

SEQ ID NO: 14195 - DNA, 18 bp, Artificial Sequence
  Synthetic DNA
caattggactcactatgg

SEQ ID NO: 14196 - DNA, 18 bp, Artificial Sequence
  Synthetic DNA
cactacgactcgctctag

SEQ ID NO: 14197 - DNA, 18 bp, Artificial Sequence
  Synthetic DNA
cagtaagactcactattg

SEQ ID NO: 14198 - DNA, 18 bp, Artificial Sequence
  Synthetic DNA
catttcgactcactgtag

SEQ ID NO: 14199 - DNA, 18 bp, Artificial Sequence
  Synthetic DNA
gaaaacaactcactattg

SEQ ID NO: 14200 - DNA, 18 bp, Artificial Sequence
  Synthetic DNA
gaatatgagtcactattg

SEQ ID NO: 14201 - DNA, 18 bp, Artificial Sequence
  Synthetic DNA
gaattagactcactttag

SEQ ID NO: 14202 - DNA, 18 bp, Artificial Sequence
  Synthetic DNA
gaatttgactcactctag

SEQ ID NO: 14203 - DNA, 18 bp, Artificial Sequence
  Synthetic DNA
gattacgacgcgctatag

SEQ ID NO: 14204 - DNA, 18 bp, Artificial Sequence
  Synthetic DNA
gtattcgactcactatcg

SEQ ID NO: 14205 - DNA, 18 bp, Artificial Sequence
  Synthetic DNA
gtattcgactcactatgg

SEQ ID NO: 14206 - DNA, 18 bp, Artificial Sequence
  Synthetic DNA
taaaaagactcactagtg

SEQ ID NO: 14207 - DNA, 18 bp, Artificial Sequence
  Synthetic DNA
taaaacgaatcaccattg

SEQ ID NO: 14208 - DNA, 18 bp, Artificial Sequence
  Synthetic DNA
taaaacgaatcgctatgg

SEQ ID NO: 14209 - DNA, 18 bp, Artificial Sequence
  Synthetic DNA
taaaacgacccgcaatag

SEQ ID NO: 14210 - DNA, 18 bp, Artificial Sequence
  Synthetic DNA
taaaacgacgcgctataa

SEQ ID NO: 14211 - DNA, 18 bp, Artificial Sequence
  Synthetic DNA
taaaacgactcaccactg

SEQ ID NO: 14212 - DNA, 18 bp, Artificial Sequence
  Synthetic DNA
taaaacgactcactgctg

SEQ ID NO: 14213 - DNA, 18 bp, Artificial Sequence
  Synthetic DNA
taaaacgactcgatacag

SEQ ID NO: 14214 - DNA, 18 bp, Artificial Sequence
  Synthetic DNA
taaaacgactggctaaag

SEQ ID NO: 14215 - DNA, 18 bp, Artificial Sequence
  Synthetic DNA
taaaacgcctcactatta

SEQ ID NO: 14216 - DNA, 18 bp, Artificial Sequence
  Synthetic DNA
taaaatgcctcgctatag

SEQ ID NO: 14217 - DNA, 18 bp, Artificial Sequence
  Synthetic DNA
taaaccgactcaccattg

SEQ ID NO: 14218 - DNA, 18 bp, Artificial Sequence
  Synthetic DNA
taaatagactcactaaag

SEQ ID NO: 14219 - DNA, 18 bp, Artificial Sequence
  Synthetic DNA
taaatcgacgctctatag

SEQ ID NO: 14220 - DNA, 18 bp, Artificial Sequence
  Synthetic DNA
taaatcgactcacgaaag

SEQ ID NO: 14221 - DNA, 18 bp, Artificial Sequence
  Synthetic DNA
taaatcgactcactaacg

SEQ ID NO: 14222 - DNA, 18 bp, Artificial Sequence
  Synthetic DNA
taaatcgactcagcatag

SEQ ID NO: 14223 - DNA, 18 bp, Artificial Sequence
  Synthetic DNA
taaatcgtctgactatag

SEQ ID NO: 14224 - DNA, 18 bp, Artificial Sequence
  Synthetic DNA
taaatctactcactctag

SEQ ID NO: 14225 - DNA, 18 bp, Artificial Sequence
  Synthetic DNA
taaattgactcactatcg

SEQ ID NO: 14226 - DNA, 18 bp, Artificial Sequence
  Synthetic DNA
taacacaactcactatta

SEQ ID NO: 14227 - DNA, 18 bp, Artificial Sequence
  Synthetic DNA
taacacaactcgctatcg

SEQ ID NO: 14228 - DNA, 18 bp, Artificial Sequence
  Synthetic DNA
taacacgactctatattg

SEQ ID NO: 14229 - DNA, 18 bp, Artificial Sequence
  Synthetic DNA
taacatgacacgctatag

SEQ ID NO: 14230 - DNA, 18 bp, Artificial Sequence
  Synthetic DNA
taactagacttactatag

SEQ ID NO: 14231 - DNA, 18 bp, Artificial Sequence
  Synthetic DNA
taagaggactcggtatag

SEQ ID NO: 14232 - DNA, 18 bp, Artificial Sequence
  Synthetic DNA
taagttgacacactatag

SEQ ID NO: 14233 - DNA, 18 bp, Artificial Sequence
  Synthetic DNA
taatacaacctactattg

SEQ ID NO: 14234 - DNA, 18 bp, Artificial Sequence
  Synthetic DNA
taatacaactcaatcttg

SEQ ID NO: 14235 - DNA, 18 bp, Artificial Sequence
  Synthetic DNA
taatacaactcgttatcg

SEQ ID NO: 14236 - DNA, 18 bp, Artificial Sequence
  Synthetic DNA
taatacaactggcaatag

SEQ ID NO: 14237 - DNA, 18 bp, Artificial Sequence
  Synthetic DNA
taatacaactggctacag

SEQ ID NO: 14238 - DNA, 18 bp, Artificial Sequence
  Synthetic DNA
taataccacagactattg

SEQ ID NO: 14239 - DNA, 18 bp, Artificial Sequence
  Synthetic DNA
taatacgaataagtattg

SEQ ID NO: 14240 - DNA, 18 bp, Artificial Sequence
  Synthetic DNA
taatacgacactctatta

SEQ ID NO: 14241 - DNA, 18 bp, Artificial Sequence
  Synthetic DNA
taatacgactcacttctt

SEQ ID NO: 14242 - DNA, 18 bp, Artificial Sequence
  Synthetic DNA
taatacgactccaaattg

SEQ ID NO: 14243 - DNA, 18 bp, Artificial Sequence
  Synthetic DNA
taatacgactccctaata

SEQ ID NO: 14244 - DNA, 18 bp, Artificial Sequence
  Synthetic DNA
taatacgactccctgatg

SEQ ID NO: 14245 - DNA, 18 bp, Artificial Sequence
  Synthetic DNA
taatacgactcgatctcg

SEQ ID NO: 14246 - DNA, 18 bp, Artificial Sequence
  Synthetic DNA
taatacgactctccatta

SEQ ID NO: 14247 - DNA, 18 bp, Artificial Sequence
  Synthetic DNA
taatacgactctctttta

SEQ ID NO: 14248 - DNA, 18 bp, Artificial Sequence
  Synthetic DNA
taatacgactgaccaatg

SEQ ID NO: 14249 - DNA, 18 bp, Artificial Sequence
  Synthetic DNA
taatacgagttgttatag

SEQ ID NO: 14250 - DNA, 18 bp, Artificial Sequence
  Synthetic DNA
taatacgattagctaaag

SEQ ID NO: 14251 - DNA, 18 bp, Artificial Sequence
  Synthetic DNA
taatacgattcactgttc

SEQ ID NO: 14252 - DNA, 18 bp, Artificial Sequence
  Synthetic DNA
taatacgatttgctatcg

SEQ ID NO: 14253 - DNA, 18 bp, Artificial Sequence
  Synthetic DNA
taatacgcctggctacag

SEQ ID NO: 14254 - DNA, 18 bp, Artificial Sequence
  Synthetic DNA
taatacgccttactactg

SEQ ID NO: 14255 - DNA, 18 bp, Artificial Sequence
  Synthetic DNA
taatacggctcgatagag

SEQ ID NO: 14256 - DNA, 18 bp, Artificial Sequence
  Synthetic DNA
taatacgtcccactaatg

SEQ ID NO: 14257 - DNA, 18 bp, Artificial Sequence
  Synthetic DNA
taatacgtctaggtatag

SEQ ID NO: 14258 - DNA, 18 bp, Artificial Sequence
  Synthetic DNA
taatactaccggctatag

SEQ ID NO: 14259 - DNA, 18 bp, Artificial Sequence
  Synthetic DNA
taatactactcactttta

SEQ ID NO: 14260 - DNA, 18 bp, Artificial Sequence
  Synthetic DNA
taatactagtcgctctag

SEQ ID NO: 14261 - DNA, 18 bp, Artificial Sequence
  Synthetic DNA
taatacttctcggtatag

SEQ ID NO: 14262 - DNA, 18 bp, Artificial Sequence
  Synthetic DNA
taatagaacacactattg

SEQ ID NO: 14263 - DNA, 18 bp, Artificial Sequence
  Synthetic DNA
taataggaatcgcaatag

SEQ ID NO: 14264 - DNA, 18 bp, Artificial Sequence
  Synthetic DNA
taataggacacagtattg

SEQ ID NO: 14265 - DNA, 18 bp, Artificial Sequence
  Synthetic DNA
taataggactcactcatg

SEQ ID NO: 14266 - DNA, 18 bp, Artificial Sequence
  Synthetic DNA
taatagtactcaatattg

SEQ ID NO: 14267 - DNA, 18 bp, Artificial Sequence
  Synthetic DNA
taatatgactcactcgtg

SEQ ID NO: 14268 - DNA, 18 bp, Artificial Sequence
  Synthetic DNA
taatatgtctcgctacag

SEQ ID NO: 14269 - DNA, 18 bp, Artificial Sequence
  Synthetic DNA
taatcagactcactatta

SEQ ID NO: 14270 - DNA, 18 bp, Artificial Sequence
  Synthetic DNA
taatccacctcactattg

SEQ ID NO: 14271 - DNA, 18 bp, Artificial Sequence
  Synthetic DNA
taatccgacccgctacag

SEQ ID NO: 14272 - DNA, 18 bp, Artificial Sequence
  Synthetic DNA
taatccgactcagtatta

SEQ ID NO: 14273 - DNA, 18 bp, Artificial Sequence
  Synthetic DNA
taatccgtctcgctaaag

SEQ ID NO: 14274 - DNA, 18 bp, Artificial Sequence
  Synthetic DNA
taatctgactcgctgtag

SEQ ID NO: 14275 - DNA, 18 bp, Artificial Sequence
  Synthetic DNA
taatgcaactcactagtg

SEQ ID NO: 14276 - DNA, 18 bp, Artificial Sequence
  Synthetic DNA
taatgcgaatcactaatg

SEQ ID NO: 14277 - DNA, 18 bp, Artificial Sequence
  Synthetic DNA
taatgcgactcgatatcg

SEQ ID NO: 14278 - DNA, 18 bp, Artificial Sequence
  Synthetic DNA
taatgcgactctctgttg

SEQ ID NO: 14279 - DNA, 18 bp, Artificial Sequence
  Synthetic DNA
taatgcgattcactcttg

SEQ ID NO: 14280 - DNA, 18 bp, Artificial Sequence
  Synthetic DNA
taatgcgcctcactatta

SEQ ID NO: 14281 - DNA, 18 bp, Artificial Sequence
  Synthetic DNA
taattaaactcacgatag

SEQ ID NO: 14282 - DNA, 18 bp, Artificial Sequence
  Synthetic DNA
taattagagtcactacag

SEQ ID NO: 14283 - DNA, 18 bp, Artificial Sequence
  Synthetic DNA
taattagagtcattatag

SEQ ID NO: 14284 - DNA, 18 bp, Artificial Sequence
  Synthetic DNA
taattccacttactacag

SEQ ID NO: 14285 - DNA, 18 bp, Artificial Sequence
  Synthetic DNA
taattcgaatcacaatcg

SEQ ID NO: 14286 - DNA, 18 bp, Artificial Sequence
  Synthetic DNA
taattcgaattacgatag

SEQ ID NO: 14287 - DNA, 18 bp, Artificial Sequence
  Synthetic DNA
taattcgacagactatcg

SEQ ID NO: 14288 - DNA, 18 bp, Artificial Sequence
  Synthetic DNA
taattcgacccagtaaag

SEQ ID NO: 14289 - DNA, 18 bp, Artificial Sequence
  Synthetic DNA
taattcgacgcactaagg

SEQ ID NO: 14290 - DNA, 18 bp, Artificial Sequence
  Synthetic DNA
taattcgactaactagcg

SEQ ID NO: 14291 - DNA, 18 bp, Artificial Sequence
  Synthetic DNA
taattcgactaacttgag

SEQ ID NO: 14292 - DNA, 18 bp, Artificial Sequence
  Synthetic DNA
taattcgactaattatcg

SEQ ID NO: 14293 - DNA, 18 bp, Artificial Sequence
  Synthetic DNA
taattcgactcaacatgg

SEQ ID NO: 14294 - DNA, 18 bp, Artificial Sequence
  Synthetic DNA
taattcgactcaccaacg

SEQ ID NO: 14295 - DNA, 18 bp, Artificial Sequence
  Synthetic DNA
taattcgactcacccaag

SEQ ID NO: 14296 - DNA, 18 bp, Artificial Sequence
  Synthetic DNA
taattcgactcagtcaag

SEQ ID NO: 14297 - DNA, 18 bp, Artificial Sequence
  Synthetic DNA
taattcgactccccacag

SEQ ID NO: 14298 - DNA, 18 bp, Artificial Sequence
  Synthetic DNA
taattcgactctctatca

SEQ ID NO: 14299 - DNA, 18 bp, Artificial Sequence
  Synthetic DNA
taattcgactgacagtag

SEQ ID NO: 14300 - DNA, 18 bp, Artificial Sequence
  Synthetic DNA
taattcgagttactatcg

SEQ ID NO: 14301 - DNA, 18 bp, Artificial Sequence
  Synthetic DNA
taattcgcaccactatag

SEQ ID NO: 14302 - DNA, 18 bp, Artificial Sequence
  Synthetic DNA
taattcgcatcaatatag

SEQ ID NO: 14303 - DNA, 18 bp, Artificial Sequence
  Synthetic DNA
taattcgccctactatag

SEQ ID NO: 14304 - DNA, 18 bp, Artificial Sequence
  Synthetic DNA
taattcgtctcactaccg

SEQ ID NO: 14305 - DNA, 18 bp, Artificial Sequence
  Synthetic DNA
taattcgtctccctgtag

SEQ ID NO: 14306 - DNA, 18 bp, Artificial Sequence
  Synthetic DNA
taattctactcactacgg

SEQ ID NO: 14307 - DNA, 18 bp, Artificial Sequence
  Synthetic DNA
taattctactcactagcg

SEQ ID NO: 14308 - DNA, 18 bp, Artificial Sequence
  Synthetic DNA
taattctactccccatag

SEQ ID NO: 14309 - DNA, 18 bp, Artificial Sequence
  Synthetic DNA
taattctagtcactatgg

SEQ ID NO: 14310 - DNA, 18 bp, Artificial Sequence
  Synthetic DNA
taattggactcactgtcg

SEQ ID NO: 14311 - DNA, 18 bp, Artificial Sequence
  Synthetic DNA
taatttaactcactgtag

SEQ ID NO: 14312 - DNA, 18 bp, Artificial Sequence
  Synthetic DNA
taatttcactcaccatag

SEQ ID NO: 14313 - DNA, 18 bp, Artificial Sequence
  Synthetic DNA
taatttgactcaccataa

SEQ ID NO: 14314 - DNA, 18 bp, Artificial Sequence
  Synthetic DNA
taatttgactcactagcg

SEQ ID NO: 14315 - DNA, 18 bp, Artificial Sequence
  Synthetic DNA
taatttgactcatgatag

SEQ ID NO: 14316 - DNA, 18 bp, Artificial Sequence
  Synthetic DNA
taatttgacttaatatag

SEQ ID NO: 14317 - DNA, 18 bp, Artificial Sequence
  Synthetic DNA
tactacgacacgctagag

SEQ ID NO: 14318 - DNA, 18 bp, Artificial Sequence
  Synthetic DNA
tactacgactcactcatg

SEQ ID NO: 14319 - DNA, 18 bp, Artificial Sequence
  Synthetic DNA
tactacgcctcacttttg

SEQ ID NO: 14320 - DNA, 18 bp, Artificial Sequence
  Synthetic DNA
tactaggactcggtatag

SEQ ID NO: 14321 - DNA, 18 bp, Artificial Sequence
  Synthetic DNA
tactccgactcacttttg

SEQ ID NO: 14322 - DNA, 18 bp, Artificial Sequence
  Synthetic DNA
tactcctactcactattg

SEQ ID NO: 14323 - DNA, 18 bp, Artificial Sequence
  Synthetic DNA
tacttccactcagtatag

SEQ ID NO: 14324 - DNA, 18 bp, Artificial Sequence
  Synthetic DNA
tacttcgactaactaaag

SEQ ID NO: 14325 - DNA, 18 bp, Artificial Sequence
  Synthetic DNA
tagaacggctcactattg

SEQ ID NO: 14326 - DNA, 18 bp, Artificial Sequence
  Synthetic DNA
tagctggactcactatag

SEQ ID NO: 14327 - DNA, 18 bp, Artificial Sequence
  Synthetic DNA
tagtacgattcactgttg

SEQ ID NO: 14328 - DNA, 18 bp, Artificial Sequence
  Synthetic DNA
tagtacgattcgctttag

SEQ ID NO: 14329 - DNA, 18 bp, Artificial Sequence
  Synthetic DNA
tagtccgactcaatattg

SEQ ID NO: 14330 - DNA, 18 bp, Artificial Sequence
  Synthetic DNA
tagttagattcactatag

SEQ ID NO: 14331 - DNA, 18 bp, Artificial Sequence
  Synthetic DNA
tagttcgactgagtatag

SEQ ID NO: 14332 - DNA, 18 bp, Artificial Sequence
  Synthetic DNA
tagttcgattcactctag

SEQ ID NO: 14333 - DNA, 18 bp, Artificial Sequence
  Synthetic DNA
tagttcgtctcactatcg

SEQ ID NO: 14334 - DNA, 18 bp, Artificial Sequence
  Synthetic DNA
tagtttgcctcactatag

SEQ ID NO: 14335 - DNA, 18 bp, Artificial Sequence
  Synthetic DNA
tatcacgactcacgattg

SEQ ID NO: 14336 - DNA, 18 bp, Artificial Sequence
  Synthetic DNA
tatgacgacccactattg

SEQ ID NO: 14337 - DNA, 18 bp, Artificial Sequence
  Synthetic DNA
tattacgactcacaatta

SEQ ID NO: 14338 - DNA, 18 bp, Artificial Sequence
  Synthetic DNA
tattacgacttgctatgg

SEQ ID NO: 14339 - DNA, 18 bp, Artificial Sequence
  Synthetic DNA
tattacgagtcacttttg

SEQ ID NO: 14340 - DNA, 18 bp, Artificial Sequence
  Synthetic DNA
tattacgcctagctatag

SEQ ID NO: 14341 - DNA, 18 bp, Artificial Sequence
  Synthetic DNA
tattactactcgctatcg

SEQ ID NO: 14342 - DNA, 18 bp, Artificial Sequence
  Synthetic DNA
tattccgaatcgctatag

SEQ ID NO: 14343 - DNA, 18 bp, Artificial Sequence
  Synthetic DNA
tatttcgactcacaataa

SEQ ID NO: 14344 - DNA, 18 bp, Artificial Sequence
  Synthetic DNA
tcaaacgacttactattg

SEQ ID NO: 14345 - DNA, 18 bp, Artificial Sequence
  Synthetic DNA
tcaatcgactcactaaag

SEQ ID NO: 14346 - DNA, 18 bp, Artificial Sequence
  Synthetic DNA
tcatacgactcaccaatg

SEQ ID NO: 14347 - DNA, 18 bp, Artificial Sequence
  Synthetic DNA
tcatacgactcactgctg

SEQ ID NO: 14348 - DNA, 18 bp, Artificial Sequence
  Synthetic DNA
tcatacgaggcgctatag

SEQ ID NO: 14349 - DNA, 18 bp, Artificial Sequence
  Synthetic DNA
tcatactactcactactg

SEQ ID NO: 14350 - DNA, 18 bp, Artificial Sequence
  Synthetic DNA
tcatccgactcacttttg

SEQ ID NO: 14351 - DNA, 18 bp, Artificial Sequence
  Synthetic DNA
tcattcgactaattatag

SEQ ID NO: 14352 - DNA, 18 bp, Artificial Sequence
  Synthetic DNA
tcattggtctcactatag

SEQ ID NO: 14353 - DNA, 18 bp, Artificial Sequence
  Synthetic DNA
tcgtacgactcactgttg

SEQ ID NO: 14354 - DNA, 18 bp, Artificial Sequence
  Synthetic DNA
tgaaacgactcaccattg

SEQ ID NO: 14355 - DNA, 18 bp, Artificial Sequence
  Synthetic DNA
tgaatcgactcactatgg

SEQ ID NO: 14356 - DNA, 18 bp, Artificial Sequence
  Synthetic DNA
tgatacgattcgctatcg

SEQ ID NO: 14357 - DNA, 18 bp, Artificial Sequence
  Synthetic DNA
tgatacgattcgctttag

SEQ ID NO: 14358 - DNA, 18 bp, Artificial Sequence
  Synthetic DNA
tgatactaatcgctatag

SEQ ID NO: 14359 - DNA, 18 bp, Artificial Sequence
  Synthetic DNA
tgatcagactcgctatag

SEQ ID NO: 14360 - DNA, 18 bp, Artificial Sequence
  Synthetic DNA
tgatgcgactcgcaatag

SEQ ID NO: 14361 - DNA, 18 bp, Artificial Sequence
  Synthetic DNA
tgctttgactcactatag

SEQ ID NO: 14362 - DNA, 18 bp, Artificial Sequence
  Synthetic DNA
tggttcgacgcactatag

SEQ ID NO: 14363 - DNA, 18 bp, Artificial Sequence
  Synthetic DNA
tgtttcgactcactttag

SEQ ID NO: 14364 - DNA, 18 bp, Artificial Sequence
  Synthetic DNA
ttacacgactcactcttg

SEQ ID NO: 14365 - DNA, 18 bp, Artificial Sequence
  Synthetic DNA
ttataaaactcgctatag

SEQ ID NO: 14366 - DNA, 18 bp, Artificial Sequence
  Synthetic DNA
ttataagactcactgttg

SEQ ID NO: 14367 - DNA, 18 bp, Artificial Sequence
  Synthetic DNA
ttatacgactcaatatta

SEQ ID NO: 14368 - DNA, 18 bp, Artificial Sequence
  Synthetic DNA
ttatacgactcgatatcg

SEQ ID NO: 14369 - DNA, 18 bp, Artificial Sequence
  Synthetic DNA
ttatacgactcgttatcg

SEQ ID NO: 14370 - DNA, 18 bp, Artificial Sequence
  Synthetic DNA
ttatacggctcgcaatag

SEQ ID NO: 14371 - DNA, 18 bp, Artificial Sequence
  Synthetic DNA
ttataggcctcgctatag

SEQ ID NO: 14372 - DNA, 18 bp, Artificial Sequence
  Synthetic DNA
ttattccactcactagag

SEQ ID NO: 14373 - DNA, 18 bp, Artificial Sequence
  Synthetic DNA
ttattcgactcactatca

SEQ ID NO: 14374 - DNA, 18 bp, Artificial Sequence
  Synthetic DNA
ttattcggctgactatag

SEQ ID NO: 14375 - DNA, 18 bp, Artificial Sequence
  Synthetic DNA
ttattggactcactatcg

SEQ ID NO: 14376 - DNA, 18 bp, Artificial Sequence
  Synthetic DNA
aaaaacgactctccatag

SEQ ID NO: 14377 - DNA, 18 bp, Artificial Sequence
  Synthetic DNA
aaaaacgattcactatgg

SEQ ID NO: 14378 - DNA, 18 bp, Artificial Sequence
  Synthetic DNA
aaaaactacccactatag

SEQ ID NO: 14379 - DNA, 18 bp, Artificial Sequence
  Synthetic DNA
aaataagactcactatct

SEQ ID NO: 14380 - DNA, 18 bp, Artificial Sequence
  Synthetic DNA
aaataagactccccatag

SEQ ID NO: 14381 - DNA, 18 bp, Artificial Sequence
  Synthetic DNA
aaatacaggtcactatag

SEQ ID NO: 14382 - DNA, 18 bp, Artificial Sequence
  Synthetic DNA
aaataccacacattatag

SEQ ID NO: 14383 - DNA, 18 bp, Artificial Sequence
  Synthetic DNA
aaataccactctccatag

SEQ ID NO: 14384 - DNA, 18 bp, Artificial Sequence
  Synthetic DNA
aaatacgacacaatgtag

SEQ ID NO: 14385 - DNA, 18 bp, Artificial Sequence
  Synthetic DNA
aaatacgactctcaataa

SEQ ID NO: 14386 - DNA, 18 bp, Artificial Sequence
  Synthetic DNA
aaatacgactgtctatgg

SEQ ID NO: 14387 - DNA, 18 bp, Artificial Sequence
  Synthetic DNA
aaatacgacttattttag

SEQ ID NO: 14388 - DNA, 18 bp, Artificial Sequence
  Synthetic DNA
aaatacgatccactatcg

SEQ ID NO: 14389 - DNA, 18 bp, Artificial Sequence
  Synthetic DNA
aaatacgatgcactttag

SEQ ID NO: 14390 - DNA, 18 bp, Artificial Sequence
  Synthetic DNA
aaatacgattcacgacag

SEQ ID NO: 14391 - DNA, 18 bp, Artificial Sequence
  Synthetic DNA
aaatacggcgcactttag

SEQ ID NO: 14392 - DNA, 18 bp, Artificial Sequence
  Synthetic DNA
aaatacggctgtctatag

SEQ ID NO: 14393 - DNA, 18 bp, Artificial Sequence
  Synthetic DNA
aaataggaatcactttag

SEQ ID NO: 14394 - DNA, 18 bp, Artificial Sequence
  Synthetic DNA
aaataggactcacaagag

SEQ ID NO: 14395 - DNA, 18 bp, Artificial Sequence
  Synthetic DNA
aaataggattcactttag

SEQ ID NO: 14396 - DNA, 18 bp, Artificial Sequence
  Synthetic DNA
aaataggcctcactatcg

SEQ ID NO: 14397 - DNA, 18 bp, Artificial Sequence
  Synthetic DNA
aaatatcacgcactatag

SEQ ID NO: 14398 - DNA, 18 bp, Artificial Sequence
  Synthetic DNA
aaatatgactcacgttag

SEQ ID NO: 14399 - DNA, 18 bp, Artificial Sequence
  Synthetic DNA
aaatatgacttactatgg

SEQ ID NO: 14400 - DNA, 18 bp, Artificial Sequence
  Synthetic DNA
aaatccgactatctatag

SEQ ID NO: 14401 - DNA, 18 bp, Artificial Sequence
  Synthetic DNA
aaatcctactcactctag

SEQ ID NO: 14402 - DNA, 18 bp, Artificial Sequence
  Synthetic DNA
aaatgctactcactctag

SEQ ID NO: 14403 - DNA, 18 bp, Artificial Sequence
  Synthetic DNA
aacaaggactcactatag

SEQ ID NO: 14404 - DNA, 18 bp, Artificial Sequence
  Synthetic DNA
aactacagctcactatag

SEQ ID NO: 14405 - DNA, 18 bp, Artificial Sequence
  Synthetic DNA
aactacgactgactacag

SEQ ID NO: 14406 - DNA, 18 bp, Artificial Sequence
  Synthetic DNA
aaggacgactaactatag

SEQ ID NO: 14407 - DNA, 18 bp, Artificial Sequence
  Synthetic DNA
aagtacgacacactatgg

SEQ ID NO: 14408 - DNA, 18 bp, Artificial Sequence
  Synthetic DNA
aagtacgagccactatag

SEQ ID NO: 14409 - DNA, 18 bp, Artificial Sequence
  Synthetic DNA
aagtatgattcactatag

SEQ ID NO: 14410 - DNA, 18 bp, Artificial Sequence
  Synthetic DNA
aatcgcgactcactatag

SEQ ID NO: 14411 - DNA, 18 bp, Artificial Sequence
  Synthetic DNA
aattacgactcactgcag

SEQ ID NO: 14412 - DNA, 18 bp, Artificial Sequence
  Synthetic DNA
aattacgactctctatat

SEQ ID NO: 14413 - DNA, 18 bp, Artificial Sequence
  Synthetic DNA
aattacgtctccctatag

SEQ ID NO: 14414 - DNA, 18 bp, Artificial Sequence
  Synthetic DNA
aattcagactcactatag

SEQ ID NO: 14415 - DNA, 18 bp, Artificial Sequence
  Synthetic DNA
acatacgactcactagcg

SEQ ID NO: 14416 - DNA, 18 bp, Artificial Sequence
  Synthetic DNA
acatacgactcactctcg

SEQ ID NO: 14417 - DNA, 18 bp, Artificial Sequence
  Synthetic DNA
acatacggcttactatag

SEQ ID NO: 14418 - DNA, 18 bp, Artificial Sequence
  Synthetic DNA
acataggactcacaatag

SEQ ID NO: 14419 - DNA, 18 bp, Artificial Sequence
  Synthetic DNA
acatatggctcactatag

SEQ ID NO: 14420 - DNA, 18 bp, Artificial Sequence
  Synthetic DNA
agatacgaatcactagag

SEQ ID NO: 14421 - DNA, 18 bp, Artificial Sequence
  Synthetic DNA
agatacgactcagtaaag

SEQ ID NO: 14422 - DNA, 18 bp, Artificial Sequence
  Synthetic DNA
aggtacgactaactatag

SEQ ID NO: 14423 - DNA, 18 bp, Artificial Sequence
  Synthetic DNA
agttacgactcactctag

SEQ ID NO: 14424 - DNA, 18 bp, Artificial Sequence
  Synthetic DNA
atatacgtctcactgtag

SEQ ID NO: 14425 - DNA, 18 bp, Artificial Sequence
  Synthetic DNA
atttacgactcactataa

SEQ ID NO: 14426 - DNA, 18 bp, Artificial Sequence
  Synthetic DNA
atttaggactcactatag

SEQ ID NO: 14427 - DNA, 18 bp, Artificial Sequence
  Synthetic DNA
caaaacgaccaactatag

SEQ ID NO: 14428 - DNA, 18 bp, Artificial Sequence
  Synthetic DNA
caaaacgacttactatgg

SEQ ID NO: 14429 - DNA, 18 bp, Artificial Sequence
  Synthetic DNA
caaaacgtctcagtatag

SEQ ID NO: 14430 - DNA, 18 bp, Artificial Sequence
  Synthetic DNA
caagacgaatcactatcg

SEQ ID NO: 14431 - DNA, 18 bp, Artificial Sequence
  Synthetic DNA
caagactactcactctag

SEQ ID NO: 14432 - DNA, 18 bp, Artificial Sequence
  Synthetic DNA
caataagacctactatag

SEQ ID NO: 14433 - DNA, 18 bp, Artificial Sequence
  Synthetic DNA
caataagtctaactatag

SEQ ID NO: 14434 - DNA, 18 bp, Artificial Sequence
  Synthetic DNA
caatacacctcactttag

SEQ ID NO: 14435 - DNA, 18 bp, Artificial Sequence
  Synthetic DNA
caataccaccccctatag

SEQ ID NO: 14436 - DNA, 18 bp, Artificial Sequence
  Synthetic DNA
caataccactcacttaag

SEQ ID NO: 14437 - DNA, 18 bp, Artificial Sequence
  Synthetic DNA
caataccactcactttcg

SEQ ID NO: 14438 - DNA, 18 bp, Artificial Sequence
  Synthetic DNA
caataccactcactttgg

SEQ ID NO: 14439 - DNA, 18 bp, Artificial Sequence
  Synthetic DNA
caatacgactcacatcag

SEQ ID NO: 14440 - DNA, 18 bp, Artificial Sequence
  Synthetic DNA
caatacgatccactatgg

SEQ ID NO: 14441 - DNA, 18 bp, Artificial Sequence
  Synthetic DNA
caatacgattcactgcag

SEQ ID NO: 14442 - DNA, 18 bp, Artificial Sequence
  Synthetic DNA
caatacgcctccctttag

SEQ ID NO: 14443 - DNA, 18 bp, Artificial Sequence
  Synthetic DNA
caatacgcctctctctag

SEQ ID NO: 14444 - DNA, 18 bp, Artificial Sequence
  Synthetic DNA
caatacggatcactaaag

SEQ ID NO: 14445 - DNA, 18 bp, Artificial Sequence
  Synthetic DNA
caatactacaaactatag

SEQ ID NO: 14446 - DNA, 18 bp, Artificial Sequence
  Synthetic DNA
caatacttctgactatag

SEQ ID NO: 14447 - DNA, 18 bp, Artificial Sequence
  Synthetic DNA
caatatgactccccatag

SEQ ID NO: 14448 - DNA, 18 bp, Artificial Sequence
  Synthetic DNA
caatatgtctaactatag

SEQ ID NO: 14449 - DNA, 18 bp, Artificial Sequence
  Synthetic DNA
caatattactcacgatag

SEQ ID NO: 14450 - DNA, 18 bp, Artificial Sequence
  Synthetic DNA
caatccgactcactgaag

SEQ ID NO: 14451 - DNA, 18 bp, Artificial Sequence
  Synthetic DNA
caatccgagtcactatcg

SEQ ID NO: 14452 - DNA, 18 bp, Artificial Sequence
  Synthetic DNA
caatgcgacacactttag

SEQ ID NO: 14453 - DNA, 18 bp, Artificial Sequence
  Synthetic DNA
caatgcgactcagtaaag

SEQ ID NO: 14454 - DNA, 18 bp, Artificial Sequence
  Synthetic DNA
cactacgactcactgtcg

SEQ ID NO: 14455 - DNA, 18 bp, Artificial Sequence
  Synthetic DNA
cagaacgactcactaaag

SEQ ID NO: 14456 - DNA, 18 bp, Artificial Sequence
  Synthetic DNA
cagtacaacttactatag

SEQ ID NO: 14457 - DNA, 18 bp, Artificial Sequence
  Synthetic DNA
cagtacgactcaatacag

SEQ ID NO: 14458 - DNA, 18 bp, Artificial Sequence
  Synthetic DNA
cattacaactcactttag

SEQ ID NO: 14459 - DNA, 18 bp, Artificial Sequence
  Synthetic DNA
ccataccactcattatag

SEQ ID NO: 14460 - DNA, 18 bp, Artificial Sequence
  Synthetic DNA
ccatacgacacaatatag

SEQ ID NO: 14461 - DNA, 18 bp, Artificial Sequence
  Synthetic DNA
ccatatgactctctatag

SEQ ID NO: 14462 - DNA, 18 bp, Artificial Sequence
  Synthetic DNA
cgatacacctcactatag

SEQ ID NO: 14463 - DNA, 18 bp, Artificial Sequence
  Synthetic DNA
ctagacgactcactatgg

SEQ ID NO: 14464 - DNA, 18 bp, Artificial Sequence
  Synthetic DNA
ctataccacccactatag

SEQ ID NO: 14465 - DNA, 18 bp, Artificial Sequence
  Synthetic DNA
ctatacgactcaatacag

SEQ ID NO: 14466 - DNA, 18 bp, Artificial Sequence
  Synthetic DNA
ctatacgactcattgtag

SEQ ID NO: 14467 - DNA, 18 bp, Artificial Sequence
  Synthetic DNA
ctataggactcactagag

SEQ ID NO: 14468 - DNA, 18 bp, Artificial Sequence
  Synthetic DNA
ctatccgacccactatag

SEQ ID NO: 14469 - DNA, 18 bp, Artificial Sequence
  Synthetic DNA
gaaaacgacacactctag

SEQ ID NO: 14470 - DNA, 18 bp, Artificial Sequence
  Synthetic DNA
gaacacgacacactatgg

SEQ ID NO: 14471 - DNA, 18 bp, Artificial Sequence
  Synthetic DNA
gaatacgaatctttatag

SEQ ID NO: 14472 - DNA, 18 bp, Artificial Sequence
  Synthetic DNA
gaatacgacactctaaag

SEQ ID NO: 14473 - DNA, 18 bp, Artificial Sequence
  Synthetic DNA
gaatacgactttctaaag

SEQ ID NO: 14474 - DNA, 18 bp, Artificial Sequence
  Synthetic DNA
gaatacgcctcaccttag

SEQ ID NO: 14475 - DNA, 18 bp, Artificial Sequence
  Synthetic DNA
gaatccgactctctatgg

SEQ ID NO: 14476 - DNA, 18 bp, Artificial Sequence
  Synthetic DNA
gaatgcgtctcaatatag

SEQ ID NO: 14477 - DNA, 18 bp, Artificial Sequence
  Synthetic DNA
gagaaccactcactatag

SEQ ID NO: 14478 - DNA, 18 bp, Artificial Sequence
  Synthetic DNA
gatgacgcctcactatag

SEQ ID NO: 14479 - DNA, 18 bp, Artificial Sequence
  Synthetic DNA
gattaagtctcactatag

SEQ ID NO: 14480 - DNA, 18 bp, Artificial Sequence
  Synthetic DNA
gcaaacgaatcactatag

SEQ ID NO: 14481 - DNA, 18 bp, Artificial Sequence
  Synthetic DNA
gcataggactcattatag

SEQ ID NO: 14482 - DNA, 18 bp, Artificial Sequence
  Synthetic DNA
gtacacgactcactgtag

SEQ ID NO: 14483 - DNA, 18 bp, Artificial Sequence
  Synthetic DNA
gtctacgactcactacag

SEQ ID NO: 14484 - DNA, 18 bp, Artificial Sequence
  Synthetic DNA
taaaaaaactccctatag

SEQ ID NO: 14485 - DNA, 18 bp, Artificial Sequence
  Synthetic DNA
taaaaacactcaatatag

SEQ ID NO: 14486 - DNA, 18 bp, Artificial Sequence
  Synthetic DNA
taaaaagaatcattatag

SEQ ID NO: 14487 - DNA, 18 bp, Artificial Sequence
  Synthetic DNA
taaaacaactgactatcg

SEQ ID NO: 14488 - DNA, 18 bp, Artificial Sequence
  Synthetic DNA
taaaaccgcacactatag

SEQ ID NO: 14489 - DNA, 18 bp, Artificial Sequence
  Synthetic DNA
taaaacgaatcagtagag

SEQ ID NO: 14490 - DNA, 18 bp, Artificial Sequence
  Synthetic DNA
taaaacgaccccctacag

SEQ ID NO: 14491 - DNA, 18 bp, Artificial Sequence
  Synthetic DNA
taaaacgactcataacag

SEQ ID NO: 14492 - DNA, 18 bp, Artificial Sequence
  Synthetic DNA
taaaacgatccactatcg

SEQ ID NO: 14493 - DNA, 18 bp, Artificial Sequence
  Synthetic DNA
taaaacgatccactatgg

SEQ ID NO: 14494 - DNA, 18 bp, Artificial Sequence
  Synthetic DNA
taaaacgcctaactttag

SEQ ID NO: 14495 - DNA, 18 bp, Artificial Sequence
  Synthetic DNA
taaaacgtctcactaccg

SEQ ID NO: 14496 - DNA, 18 bp, Artificial Sequence
  Synthetic DNA
taaaagaactcactttag

SEQ ID NO: 14497 - DNA, 18 bp, Artificial Sequence
  Synthetic DNA
taaaagcactcaatatag

SEQ ID NO: 14498 - DNA, 18 bp, Artificial Sequence
  Synthetic DNA
taaaatgccccactatag

SEQ ID NO: 14499 - DNA, 18 bp, Artificial Sequence
  Synthetic DNA
taaaccgactcattatcg

SEQ ID NO: 14500 - DNA, 18 bp, Artificial Sequence
  Synthetic DNA
taaaccgacttaccatag

SEQ ID NO: 14501 - DNA, 18 bp, Artificial Sequence
  Synthetic DNA
taaaccgacttactgtag

SEQ ID NO: 14502 - DNA, 18 bp, Artificial Sequence
  Synthetic DNA
taaaccggctcactctag

SEQ ID NO: 14503 - DNA, 18 bp, Artificial Sequence
  Synthetic DNA
taaacctactcacaatag

SEQ ID NO: 14504 - DNA, 18 bp, Artificial Sequence
  Synthetic DNA
taaagcgaatcactgtag

SEQ ID NO: 14505 - DNA, 18 bp, Artificial Sequence
  Synthetic DNA
taaagcgactcaatgtag

SEQ ID NO: 14506 - DNA, 18 bp, Artificial Sequence
  Synthetic DNA
taaagcgactcaatttag

SEQ ID NO: 14507 - DNA, 18 bp, Artificial Sequence
  Synthetic DNA
taaagcgactccccatag

SEQ ID NO: 14508 - DNA, 18 bp, Artificial Sequence
  Synthetic DNA
taaagcgtcccactatag

SEQ ID NO: 14509 - DNA, 18 bp, Artificial Sequence
  Synthetic DNA
taaagggactcactacag

SEQ ID NO: 14510 - DNA, 18 bp, Artificial Sequence
  Synthetic DNA
taacacaactcactctcg

SEQ ID NO: 14511 - DNA, 18 bp, Artificial Sequence
  Synthetic DNA
taacacaagtctctatag

SEQ ID NO: 14512 - DNA, 18 bp, Artificial Sequence
  Synthetic DNA
taacacaattcagtatag

SEQ ID NO: 14513 - DNA, 18 bp, Artificial Sequence
  Synthetic DNA
taacaccacacactttag

SEQ ID NO: 14514 - DNA, 18 bp, Artificial Sequence
  Synthetic DNA
taacacgaatctctatcg

SEQ ID NO: 14515 - DNA, 18 bp, Artificial Sequence
  Synthetic DNA
taacacgactatcaatag

SEQ ID NO: 14516 - DNA, 18 bp, Artificial Sequence
  Synthetic DNA
taacacgactcacaaacg

SEQ ID NO: 14517 - DNA, 18 bp, Artificial Sequence
  Synthetic DNA
taacacgactccatacag

SEQ ID NO: 14518 - DNA, 18 bp, Artificial Sequence
  Synthetic DNA
taacacgagtcacaaaag

SEQ ID NO: 14519 - DNA, 18 bp, Artificial Sequence
  Synthetic DNA
taacacgataaactatag

SEQ ID NO: 14520 - DNA, 18 bp, Artificial Sequence
  Synthetic DNA
taacacgatccactacag

SEQ ID NO: 14521 - DNA, 18 bp, Artificial Sequence
  Synthetic DNA
taacacgcctcaataaag

SEQ ID NO: 14522 - DNA, 18 bp, Artificial Sequence
  Synthetic DNA
taacacgccttactatgg

SEQ ID NO: 14523 - DNA, 18 bp, Artificial Sequence
  Synthetic DNA
taacacgtcgcacaatag

SEQ ID NO: 14524 - DNA, 18 bp, Artificial Sequence
  Synthetic DNA
taacacgtcgcactctag

SEQ ID NO: 14525 - DNA, 18 bp, Artificial Sequence
  Synthetic DNA
taacacgtctcaccatgg

SEQ ID NO: 14526 - DNA, 18 bp, Artificial Sequence
  Synthetic DNA
taacacgtctcactgtcg

SEQ ID NO: 14527 - DNA, 18 bp, Artificial Sequence
  Synthetic DNA
taacacgtctctcgatag

SEQ ID NO: 14528 - DNA, 18 bp, Artificial Sequence
  Synthetic DNA
taacacgtgtcaatatag

SEQ ID NO: 14529 - DNA, 18 bp, Artificial Sequence
  Synthetic DNA
taacaggactaaatatag

SEQ ID NO: 14530 - DNA, 18 bp, Artificial Sequence
  Synthetic DNA
taacatgactcaccagag

SEQ ID NO: 14531 - DNA, 18 bp, Artificial Sequence
  Synthetic DNA
taacatgacttactctag

SEQ ID NO: 14532 - DNA, 18 bp, Artificial Sequence
  Synthetic DNA
taacccgtctcactaaag

SEQ ID NO: 14533 - DNA, 18 bp, Artificial Sequence
  Synthetic DNA
taagaagactaactctag

SEQ ID NO: 14534 - DNA, 18 bp, Artificial Sequence
  Synthetic DNA
taagaagactcactaacg

SEQ ID NO: 14535 - DNA, 18 bp, Artificial Sequence
  Synthetic DNA
taagacaacacaccatag

SEQ ID NO: 14536 - DNA, 18 bp, Artificial Sequence
  Synthetic DNA
taagaccactctgtatag

SEQ ID NO: 14537 - DNA, 18 bp, Artificial Sequence
  Synthetic DNA
taagaccgctctctatag

SEQ ID NO: 14538 - DNA, 18 bp, Artificial Sequence
  Synthetic DNA
taagacgacccactgcag

SEQ ID NO: 14539 - DNA, 18 bp, Artificial Sequence
  Synthetic DNA
taagacgactcttaatag

SEQ ID NO: 14540 - DNA, 18 bp, Artificial Sequence
  Synthetic DNA
taagacgacttacaaaag

SEQ ID NO: 14541 - DNA, 18 bp, Artificial Sequence
  Synthetic DNA
taagacgattaactgtag

SEQ ID NO: 14542 - DNA, 18 bp, Artificial Sequence
  Synthetic DNA
taagacgattcacaatcg

SEQ ID NO: 14543 - DNA, 18 bp, Artificial Sequence
  Synthetic DNA
taagacgcttcaatatag

SEQ ID NO: 14544 - DNA, 18 bp, Artificial Sequence
  Synthetic DNA
taagacggctcaatatcg

SEQ ID NO: 14545 - DNA, 18 bp, Artificial Sequence
  Synthetic DNA
taagacgtatcactacag

SEQ ID NO: 14546 - DNA, 18 bp, Artificial Sequence
  Synthetic DNA
taagactactaactatcg

SEQ ID NO: 14547 - DNA, 18 bp, Artificial Sequence
  Synthetic DNA
taagaggcctcactaaag

SEQ ID NO: 14548 - DNA, 18 bp, Artificial Sequence
  Synthetic DNA
taagagttctcactatag

SEQ ID NO: 14549 - DNA, 18 bp, Artificial Sequence
  Synthetic DNA
taagatgtctaactatag

SEQ ID NO: 14550 - DNA, 18 bp, Artificial Sequence
  Synthetic DNA
taagatgtctcacaatag

SEQ ID NO: 14551 - DNA, 18 bp, Artificial Sequence
  Synthetic DNA
taagccgtctcactagag

SEQ ID NO: 14552 - DNA, 18 bp, Artificial Sequence
  Synthetic DNA
taagctgactcaccatag

SEQ ID NO: 14553 - DNA, 18 bp, Artificial Sequence
  Synthetic DNA
taataagacacacaatcg

SEQ ID NO: 14554 - DNA, 18 bp, Artificial Sequence
  Synthetic DNA
taataagacacactctcg

SEQ ID NO: 14555 - DNA, 18 bp, Artificial Sequence
  Synthetic DNA
taataagacccacgttag

SEQ ID NO: 14556 - DNA, 18 bp, Artificial Sequence
  Synthetic DNA
taataagaccctctacag

SEQ ID NO: 14557 - DNA, 18 bp, Artificial Sequence
  Synthetic DNA
taataagactcaaaagag

SEQ ID NO: 14558 - DNA, 18 bp, Artificial Sequence
  Synthetic DNA
taataagactcaacacag

SEQ ID NO: 14559 - DNA, 18 bp, Artificial Sequence
  Synthetic DNA
taataagactcaccttgg

SEQ ID NO: 14560 - DNA, 18 bp, Artificial Sequence
  Synthetic DNA
taataagactcattgcag

SEQ ID NO: 14561 - DNA, 18 bp, Artificial Sequence
  Synthetic DNA
taataagactcctgatag

SEQ ID NO: 14562 - DNA, 18 bp, Artificial Sequence
  Synthetic DNA
taataagactctgaatag

SEQ ID NO: 14563 - DNA, 18 bp, Artificial Sequence
  Synthetic DNA
taataagactgtctttag

SEQ ID NO: 14564 - DNA, 18 bp, Artificial Sequence
  Synthetic DNA
taataagagtccgtatag

SEQ ID NO: 14565 - DNA, 18 bp, Artificial Sequence
  Synthetic DNA
taataagagttactacag

SEQ ID NO: 14566 - DNA, 18 bp, Artificial Sequence
  Synthetic DNA
taataagattccctaaag

SEQ ID NO: 14567 - DNA, 18 bp, Artificial Sequence
  Synthetic DNA
taataagattgtctatag

SEQ ID NO: 14568 - DNA, 18 bp, Artificial Sequence
  Synthetic DNA
taataagtctcactaacg

SEQ ID NO: 14569 - DNA, 18 bp, Artificial Sequence
  Synthetic DNA
taatacaaatcacagtag

SEQ ID NO: 14570 - DNA, 18 bp, Artificial Sequence
  Synthetic DNA
taatacaaatctctagag

SEQ ID NO: 14571 - DNA, 18 bp, Artificial Sequence
  Synthetic DNA
taatacaactcactgacg

SEQ ID NO: 14572 - DNA, 18 bp, Artificial Sequence
  Synthetic DNA
taatacaactcattgcag

SEQ ID NO: 14573 - DNA, 18 bp, Artificial Sequence
  Synthetic DNA
taatacaacttacagtag

SEQ ID NO: 14574 - DNA, 18 bp, Artificial Sequence
  Synthetic DNA
taatacagctcacaacag

SEQ ID NO: 14575 - DNA, 18 bp, Artificial Sequence
  Synthetic DNA
taatacatctcactgtcg

SEQ ID NO: 14576 - DNA, 18 bp, Artificial Sequence
  Synthetic DNA
taatacatctccctaaag

SEQ ID NO: 14577 - DNA, 18 bp, Artificial Sequence
  Synthetic DNA
taataccaatgacgatag

SEQ ID NO: 14578 - DNA, 18 bp, Artificial Sequence
  Synthetic DNA
taataccaccaactatcg

SEQ ID NO: 14579 - DNA, 18 bp, Artificial Sequence
  Synthetic DNA
taataccacgctctgtag

SEQ ID NO: 14580 - DNA, 18 bp, Artificial Sequence
  Synthetic DNA
taataccactgagtttag

SEQ ID NO: 14581 - DNA, 18 bp, Artificial Sequence
  Synthetic DNA
taatacctatcattatag

SEQ ID NO: 14582 - DNA, 18 bp, Artificial Sequence
  Synthetic DNA
taatacctcccactttag

SEQ ID NO: 14583 - DNA, 18 bp, Artificial Sequence
  Synthetic DNA
taatacctctcacactag

SEQ ID NO: 14584 - DNA, 18 bp, Artificial Sequence
  Synthetic DNA
taatacctctgaccatag

SEQ ID NO: 14585 - DNA, 18 bp, Artificial Sequence
  Synthetic DNA
taatacgaacctctatgg

SEQ ID NO: 14586 - DNA, 18 bp, Artificial Sequence
  Synthetic DNA
taatacgaatcacaacgg

SEQ ID NO: 14587 - DNA, 18 bp, Artificial Sequence
  Synthetic DNA
taatacgacaaattacag

SEQ ID NO: 14588 - DNA, 18 bp, Artificial Sequence
  Synthetic DNA
taatacgacacacttaaa

SEQ ID NO: 14589 - DNA, 18 bp, Artificial Sequence
  Synthetic DNA
taatacgacaccatgtag

SEQ ID NO: 14590 - DNA, 18 bp, Artificial Sequence
  Synthetic DNA
taatacgaccaactttcg

SEQ ID NO: 14591 - DNA, 18 bp, Artificial Sequence
  Synthetic DNA
taatacgaccttctatgg

SEQ ID NO: 14592 - DNA, 18 bp, Artificial Sequence
  Synthetic DNA
taatacgacgcattgtgg

SEQ ID NO: 14593 - DNA, 18 bp, Artificial Sequence
  Synthetic DNA
taatacgactaattttgg

SEQ ID NO: 14594 - DNA, 18 bp, Artificial Sequence
  Synthetic DNA
taatacgactatctaacg

SEQ ID NO: 14595 - DNA, 18 bp, Artificial Sequence
  Synthetic DNA
taatacgactcaaattaa

SEQ ID NO: 14596 - DNA, 18 bp, Artificial Sequence
  Synthetic DNA
taatacgactcacagaac

SEQ ID NO: 14597 - DNA, 18 bp, Artificial Sequence
  Synthetic DNA
taatacgactcagattac

SEQ ID NO: 14598 - DNA, 18 bp, Artificial Sequence
  Synthetic DNA
taatacgactcatgaacg

SEQ ID NO: 14599 - DNA, 18 bp, Artificial Sequence
  Synthetic DNA
taatacgactctcctgag

SEQ ID NO: 14600 - DNA, 18 bp, Artificial Sequence
  Synthetic DNA
taatacgactctctttca

SEQ ID NO: 14601 - DNA, 18 bp, Artificial Sequence
  Synthetic DNA
taatacgactctgcagag

SEQ ID NO: 14602 - DNA, 18 bp, Artificial Sequence
  Synthetic DNA
taatacgactcttgttag

SEQ ID NO: 14603 - DNA, 18 bp, Artificial Sequence
  Synthetic DNA
taatacgacttacattac

SEQ ID NO: 14604 - DNA, 18 bp, Artificial Sequence
  Synthetic DNA
taatacgacttcttatcg

SEQ ID NO: 14605 - DNA, 18 bp, Artificial Sequence
  Synthetic DNA
taatacgagacaagatag

SEQ ID NO: 14606 - DNA, 18 bp, Artificial Sequence
  Synthetic DNA
taatacgagtgacaatcg

SEQ ID NO: 14607 - DNA, 18 bp, Artificial Sequence
  Synthetic DNA
taatacgagttactaaaa

SEQ ID NO: 14608 - DNA, 18 bp, Artificial Sequence
  Synthetic DNA
taatacgagttcctttag

SEQ ID NO: 14609 - DNA, 18 bp, Artificial Sequence
  Synthetic DNA
taatacgagtttctacag

SEQ ID NO: 14610 - DNA, 18 bp, Artificial Sequence
  Synthetic DNA
taatacgatacagtaaag

SEQ ID NO: 14611 - DNA, 18 bp, Artificial Sequence
  Synthetic DNA
taatacgatcctatatag

SEQ ID NO: 14612 - DNA, 18 bp, Artificial Sequence
  Synthetic DNA
taatacgattaactaacg

SEQ ID NO: 14613 - DNA, 18 bp, Artificial Sequence
  Synthetic DNA
taatacgattcaacatcg

SEQ ID NO: 14614 - DNA, 18 bp, Artificial Sequence
  Synthetic DNA
taatacgattcccgttag

SEQ ID NO: 14615 - DNA, 18 bp, Artificial Sequence
  Synthetic DNA
taatacgcatcaccttag

SEQ ID NO: 14616 - DNA, 18 bp, Artificial Sequence
  Synthetic DNA
taatacgcatctctagag

SEQ ID NO: 14617 - DNA, 18 bp, Artificial Sequence
  Synthetic DNA
taatacgcatgactttag

SEQ ID NO: 14618 - DNA, 18 bp, Artificial Sequence
  Synthetic DNA
taatacgccacaccatgg

SEQ ID NO: 14619 - DNA, 18 bp, Artificial Sequence
  Synthetic DNA
taatacgccactccatag

SEQ ID NO: 14620 - DNA, 18 bp, Artificial Sequence
  Synthetic DNA
taatacgcgtcactaagg

SEQ ID NO: 14621 - DNA, 18 bp, Artificial Sequence
  Synthetic DNA
taatacgcgtctcaatag

SEQ ID NO: 14622 - DNA, 18 bp, Artificial Sequence
  Synthetic DNA
taatacggatctctgtag

SEQ ID NO: 14623 - DNA, 18 bp, Artificial Sequence
  Synthetic DNA
taatacggcagattatag

SEQ ID NO: 14624 - DNA, 18 bp, Artificial Sequence
  Synthetic DNA
taatacggcccattatgg

SEQ ID NO: 14625 - DNA, 18 bp, Artificial Sequence
  Synthetic DNA
taatacgggtgactaaag

SEQ ID NO: 14626 - DNA, 18 bp, Artificial Sequence
  Synthetic DNA
taatacggttcagtataa

SEQ ID NO: 14627 - DNA, 18 bp, Artificial Sequence
  Synthetic DNA
taatacgtcaccatatag

SEQ ID NO: 14628 - DNA, 18 bp, Artificial Sequence
  Synthetic DNA
taatacgtcccaatctag

SEQ ID NO: 14629 - DNA, 18 bp, Artificial Sequence
  Synthetic DNA
taatacgtcccaccataa

SEQ ID NO: 14630 - DNA, 18 bp, Artificial Sequence
  Synthetic DNA
taatacgtccgactaaag

SEQ ID NO: 14631 - DNA, 18 bp, Artificial Sequence
  Synthetic DNA
taatacgtcgaactttag

SEQ ID NO: 14632 - DNA, 18 bp, Artificial Sequence
  Synthetic DNA
taatacgtcgtactttag

SEQ ID NO: 14633 - DNA, 18 bp, Artificial Sequence
  Synthetic DNA
taatacgtctcacaatga

SEQ ID NO: 14634 - DNA, 18 bp, Artificial Sequence
  Synthetic DNA
taatacgtctcactaact

SEQ ID NO: 14635 - DNA, 18 bp, Artificial Sequence
  Synthetic DNA
taatacgtctcagcctag

SEQ ID NO: 14636 - DNA, 18 bp, Artificial Sequence
  Synthetic DNA
taatacgtctgaatagag

SEQ ID NO: 14637 - DNA, 18 bp, Artificial Sequence
  Synthetic DNA
taatacgtctttctataa

SEQ ID NO: 14638 - DNA, 18 bp, Artificial Sequence
  Synthetic DNA
taatacgtgttagtatag

SEQ ID NO: 14639 - DNA, 18 bp, Artificial Sequence
  Synthetic DNA
taatactaatgcctatag

SEQ ID NO: 14640 - DNA, 18 bp, Artificial Sequence
  Synthetic DNA
taatactacacaatatgg

SEQ ID NO: 14641 - DNA, 18 bp, Artificial Sequence
  Synthetic DNA
taatactactacgtatag

SEQ ID NO: 14642 - DNA, 18 bp, Artificial Sequence
  Synthetic DNA
taatactactcaacacag

SEQ ID NO: 14643 - DNA, 18 bp, Artificial Sequence
  Synthetic DNA
taatactactcacattac

SEQ ID NO: 14644 - DNA, 18 bp, Artificial Sequence
  Synthetic DNA
taatactactcattctgg

SEQ ID NO: 14645 - DNA, 18 bp, Artificial Sequence
  Synthetic DNA
taatactactcattggag

SEQ ID NO: 14646 - DNA, 18 bp, Artificial Sequence
  Synthetic DNA
taatactactctcaatac

SEQ ID NO: 14647 - DNA, 18 bp, Artificial Sequence
  Synthetic DNA
taatactactgactgtcg

SEQ ID NO: 14648 - DNA, 18 bp, Artificial Sequence
  Synthetic DNA
taatactactttctagag

SEQ ID NO: 14649 - DNA, 18 bp, Artificial Sequence
  Synthetic DNA
taatactagtccctatgg

SEQ ID NO: 14650 - DNA, 18 bp, Artificial Sequence
  Synthetic DNA
taataggaatcacttaag

SEQ ID NO: 14651 - DNA, 18 bp, Artificial Sequence
  Synthetic DNA
taataggactcactgggg

SEQ ID NO: 14652 - DNA, 18 bp, Artificial Sequence
  Synthetic DNA
taataggactctaaatag

SEQ ID NO: 14653 - DNA, 18 bp, Artificial Sequence
  Synthetic DNA
taataggactgattatgg

SEQ ID NO: 14654 - DNA, 18 bp, Artificial Sequence
  Synthetic DNA
taataggactgtttatag

SEQ ID NO: 14655 - DNA, 18 bp, Artificial Sequence
  Synthetic DNA
taataggactttctacag

SEQ ID NO: 14656 - DNA, 18 bp, Artificial Sequence
  Synthetic DNA
taataggagtaaatatag

SEQ ID NO: 14657 - DNA, 18 bp, Artificial Sequence
  Synthetic DNA
taataggcgtcactagag

SEQ ID NO: 14658 - DNA, 18 bp, Artificial Sequence
  Synthetic DNA
taataggtcccactttag

SEQ ID NO: 14659 - DNA, 18 bp, Artificial Sequence
  Synthetic DNA
taatagtacacacaatag

SEQ ID NO: 14660 - DNA, 18 bp, Artificial Sequence
  Synthetic DNA
taatatcaatcaatatag

SEQ ID NO: 14661 - DNA, 18 bp, Artificial Sequence
  Synthetic DNA
taatatcactcacactag

SEQ ID NO: 14662 - DNA, 18 bp, Artificial Sequence
  Synthetic DNA
taatatcactcacagtag

SEQ ID NO: 14663 - DNA, 18 bp, Artificial Sequence
  Synthetic DNA
taatatccgtcactatag

SEQ ID NO: 14664 - DNA, 18 bp, Artificial Sequence
  Synthetic DNA
taatatgaatcaaaatag

SEQ ID NO: 14665 - DNA, 18 bp, Artificial Sequence
  Synthetic DNA
taatatgacccactctgg

SEQ ID NO: 14666 - DNA, 18 bp, Artificial Sequence
  Synthetic DNA
taatatgaccgactaaag

SEQ ID NO: 14667 - DNA, 18 bp, Artificial Sequence
  Synthetic DNA
taatatgactcacataag

SEQ ID NO: 14668 - DNA, 18 bp, Artificial Sequence
  Synthetic DNA
taatatgactctctatct

SEQ ID NO: 14669 - DNA, 18 bp, Artificial Sequence
  Synthetic DNA
taatatgagacagtatag

SEQ ID NO: 14670 - DNA, 18 bp, Artificial Sequence
  Synthetic DNA
taatatgagttaatatag

SEQ ID NO: 14671 - DNA, 18 bp, Artificial Sequence
  Synthetic DNA
taatatgatcgactatag

SEQ ID NO: 14672 - DNA, 18 bp, Artificial Sequence
  Synthetic DNA
taatatgattaacgatag

SEQ ID NO: 14673 - DNA, 18 bp, Artificial Sequence
  Synthetic DNA
taatatgcatcactagag

SEQ ID NO: 14674 - DNA, 18 bp, Artificial Sequence
  Synthetic DNA
taatatgccccaatatag

SEQ ID NO: 14675 - DNA, 18 bp, Artificial Sequence
  Synthetic DNA
taatatgcctcactctgg

SEQ ID NO: 14676 - DNA, 18 bp, Artificial Sequence
  Synthetic DNA
taatatgcctcagtacag

SEQ ID NO: 14677 - DNA, 18 bp, Artificial Sequence
  Synthetic DNA
taatatggctgaccatag

SEQ ID NO: 14678 - DNA, 18 bp, Artificial Sequence
  Synthetic DNA
taatatgtctcacgctag

SEQ ID NO: 14679 - DNA, 18 bp, Artificial Sequence
  Synthetic DNA
taatatgtctccctatgg

SEQ ID NO: 14680 - DNA, 18 bp, Artificial Sequence
  Synthetic DNA
taatatgtctctctctag

SEQ ID NO: 14681 - DNA, 18 bp, Artificial Sequence
  Synthetic DNA
taatatgtctctctgtag

SEQ ID NO: 14682 - DNA, 18 bp, Artificial Sequence
  Synthetic DNA
taatccaaatccctatag

SEQ ID NO: 14683 - DNA, 18 bp, Artificial Sequence
  Synthetic DNA
taatccaactcactccag

SEQ ID NO: 14684 - DNA, 18 bp, Artificial Sequence
  Synthetic DNA
taatccaattcactatgg

SEQ ID NO: 14685 - DNA, 18 bp, Artificial Sequence
  Synthetic DNA
taatcccacgcaatatag

SEQ ID NO: 14686 - DNA, 18 bp, Artificial Sequence
  Synthetic DNA
taatccgaaactctatag

SEQ ID NO: 14687 - DNA, 18 bp, Artificial Sequence
  Synthetic DNA
taatccgacatactatgg

SEQ ID NO: 14688 - DNA, 18 bp, Artificial Sequence
  Synthetic DNA
taatccgactaaatatcg

SEQ ID NO: 14689 - DNA, 18 bp, Artificial Sequence
  Synthetic DNA
taatccgactcactttcc

SEQ ID NO: 14690 - DNA, 18 bp, Artificial Sequence
  Synthetic DNA
taatccgactctctacgg

SEQ ID NO: 14691 - DNA, 18 bp, Artificial Sequence
  Synthetic DNA
taatccgactctctttcg

SEQ ID NO: 14692 - DNA, 18 bp, Artificial Sequence
  Synthetic DNA
taatccgactgaaaatag

SEQ ID NO: 14693 - DNA, 18 bp, Artificial Sequence
  Synthetic DNA
taatccgacttacgatcg

SEQ ID NO: 14694 - DNA, 18 bp, Artificial Sequence
  Synthetic DNA
taatccgatttacgatag

SEQ ID NO: 14695 - DNA, 18 bp, Artificial Sequence
  Synthetic DNA
taatccgtcacaccatag

SEQ ID NO: 14696 - DNA, 18 bp, Artificial Sequence
  Synthetic DNA
taatccgtcgcactaaag

SEQ ID NO: 14697 - DNA, 18 bp, Artificial Sequence
  Synthetic DNA
taatccgtctcagtatcg

SEQ ID NO: 14698 - DNA, 18 bp, Artificial Sequence
  Synthetic DNA
taatcctactcacgatgg

SEQ ID NO: 14699 - DNA, 18 bp, Artificial Sequence
  Synthetic DNA
taatcctactcactttgg

SEQ ID NO: 14700 - DNA, 18 bp, Artificial Sequence
  Synthetic DNA
taatccttctcaccatag

SEQ ID NO: 14701 - DNA, 18 bp, Artificial Sequence
  Synthetic DNA
taatcggactcacttcag

SEQ ID NO: 14702 - DNA, 18 bp, Artificial Sequence
  Synthetic DNA
taatcggactcattacag

SEQ ID NO: 14703 - DNA, 18 bp, Artificial Sequence
  Synthetic DNA
taatctaactcaatatag

SEQ ID NO: 14704 - DNA, 18 bp, Artificial Sequence
  Synthetic DNA
taatctgactcaatagag

SEQ ID NO: 14705 - DNA, 18 bp, Artificial Sequence
  Synthetic DNA
taatctgactcagtgtag

SEQ ID NO: 14706 - DNA, 18 bp, Artificial Sequence
  Synthetic DNA
taatctgcctcaatatag

SEQ ID NO: 14707 - DNA, 18 bp, Artificial Sequence
  Synthetic DNA
taatgagactcactccag

SEQ ID NO: 14708 - DNA, 18 bp, Artificial Sequence
  Synthetic DNA
taatgagcctcaccatag

SEQ ID NO: 14709 - DNA, 18 bp, Artificial Sequence
  Synthetic DNA
taatgcaaatcactgtag

SEQ ID NO: 14710 - DNA, 18 bp, Artificial Sequence
  Synthetic DNA
taatgcaactcactttgg

SEQ ID NO: 14711 - DNA, 18 bp, Artificial Sequence
  Synthetic DNA
taatgcaactcataatag

SEQ ID NO: 14712 - DNA, 18 bp, Artificial Sequence
  Synthetic DNA
taatgcaacttactatcg

SEQ ID NO: 14713 - DNA, 18 bp, Artificial Sequence
  Synthetic DNA
taatgcacctcacaatag

SEQ ID NO: 14714 - DNA, 18 bp, Artificial Sequence
  Synthetic DNA
taatgcaccttactatag

SEQ ID NO: 14715 - DNA, 18 bp, Artificial Sequence
  Synthetic DNA
taatgccactcacattag

SEQ ID NO: 14716 - DNA, 18 bp, Artificial Sequence
  Synthetic DNA
taatgccattaactatag

SEQ ID NO: 14717 - DNA, 18 bp, Artificial Sequence
  Synthetic DNA
taatgcctgtcactatag

SEQ ID NO: 14718 - DNA, 18 bp, Artificial Sequence
  Synthetic DNA
taatgcgactaaccatcg

SEQ ID NO: 14719 - DNA, 18 bp, Artificial Sequence
  Synthetic DNA
taatgcgactcaaaaaag

SEQ ID NO: 14720 - DNA, 18 bp, Artificial Sequence
  Synthetic DNA
taatgcgactcacattgg

SEQ ID NO: 14721 - DNA, 18 bp, Artificial Sequence
  Synthetic DNA
taatgcgactctctttgg

SEQ ID NO: 14722 - DNA, 18 bp, Artificial Sequence
  Synthetic DNA
taatgcgacttactctgg

SEQ ID NO: 14723 - DNA, 18 bp, Artificial Sequence
  Synthetic DNA
taatgcgagttactttag

SEQ ID NO: 14724 - DNA, 18 bp, Artificial Sequence
  Synthetic DNA
taatgcgtctcaccctag

SEQ ID NO: 14725 - DNA, 18 bp, Artificial Sequence
  Synthetic DNA
taatgcgtctcactgaag

SEQ ID NO: 14726 - DNA, 18 bp, Artificial Sequence
  Synthetic DNA
taatgcgtctcattacag

SEQ ID NO: 14727 - DNA, 18 bp, Artificial Sequence
  Synthetic DNA
taatgcgtgtcactatgg

SEQ ID NO: 14728 - DNA, 18 bp, Artificial Sequence
  Synthetic DNA
taatgcttcttactatag

SEQ ID NO: 14729 - DNA, 18 bp, Artificial Sequence
  Synthetic DNA
taatgggaagcactatag

SEQ ID NO: 14730 - DNA, 18 bp, Artificial Sequence
  Synthetic DNA
taatgtgacacaccatag

SEQ ID NO: 14731 - DNA, 18 bp, Artificial Sequence
  Synthetic DNA
taatgttactcaatatag

SEQ ID NO: 14732 - DNA, 18 bp, Artificial Sequence
  Synthetic DNA
tacaaccacgcactatag

SEQ ID NO: 14733 - DNA, 18 bp, Artificial Sequence
  Synthetic DNA
tacaacgactcaatatcg

SEQ ID NO: 14734 - DNA, 18 bp, Artificial Sequence
  Synthetic DNA
tacaactactgactatag

SEQ ID NO: 14735 - DNA, 18 bp, Artificial Sequence
  Synthetic DNA
taccacgacacattatag

SEQ ID NO: 14736 - DNA, 18 bp, Artificial Sequence
  Synthetic DNA
taccacgattccctatag

SEQ ID NO: 14737 - DNA, 18 bp, Artificial Sequence
  Synthetic DNA
taccacgtctcattatag

SEQ ID NO: 14738 - DNA, 18 bp, Artificial Sequence
  Synthetic DNA
tacgacgactctctatcg

SEQ ID NO: 14739 - DNA, 18 bp, Artificial Sequence
  Synthetic DNA
tactaccacacactctag

SEQ ID NO: 14740 - DNA, 18 bp, Artificial Sequence
  Synthetic DNA
tactaccactcactttcg

SEQ ID NO: 14741 - DNA, 18 bp, Artificial Sequence
  Synthetic DNA
tactacgaataactttag

SEQ ID NO: 14742 - DNA, 18 bp, Artificial Sequence
  Synthetic DNA
tactacgacagactttag

SEQ ID NO: 14743 - DNA, 18 bp, Artificial Sequence
  Synthetic DNA
tactacgactaaaaatag

SEQ ID NO: 14744 - DNA, 18 bp, Artificial Sequence
  Synthetic DNA
tactacggcagactatag

SEQ ID NO: 14745 - DNA, 18 bp, Artificial Sequence
  Synthetic DNA
tactacgtcgcactgtag

SEQ ID NO: 14746 - DNA, 18 bp, Artificial Sequence
  Synthetic DNA
tactacgtctcactggag

SEQ ID NO: 14747 - DNA, 18 bp, Artificial Sequence
  Synthetic DNA
tactactactcaatataa

SEQ ID NO: 14748 - DNA, 18 bp, Artificial Sequence
  Synthetic DNA
tactactactctgtatag

SEQ ID NO: 14749 - DNA, 18 bp, Artificial Sequence
  Synthetic DNA
tactactactgactacag

SEQ ID NO: 14750 - DNA, 18 bp, Artificial Sequence
  Synthetic DNA
tactccgacacactaaag

SEQ ID NO: 14751 - DNA, 18 bp, Artificial Sequence
  Synthetic DNA
tactccgactaattatag

SEQ ID NO: 14752 - DNA, 18 bp, Artificial Sequence
  Synthetic DNA
tactccgactcaatgtag

SEQ ID NO: 14753 - DNA, 18 bp, Artificial Sequence
  Synthetic DNA
tagaacgacccaatatag

SEQ ID NO: 14754 - DNA, 18 bp, Artificial Sequence
  Synthetic DNA
tagaacgactcactcaag

SEQ ID NO: 14755 - DNA, 18 bp, Artificial Sequence
  Synthetic DNA
tagaacgactcacttgag

SEQ ID NO: 14756 - DNA, 18 bp, Artificial Sequence
  Synthetic DNA
tagaactactcacgatag

SEQ ID NO: 14757 - DNA, 18 bp, Artificial Sequence
  Synthetic DNA
tagagcgactcacgatag

SEQ ID NO: 14758 - DNA, 18 bp, Artificial Sequence
  Synthetic DNA
tagcacgactcagaatag

SEQ ID NO: 14759 - DNA, 18 bp, Artificial Sequence
  Synthetic DNA
tagcacgagtgactatag

SEQ ID NO: 14760 - DNA, 18 bp, Artificial Sequence
  Synthetic DNA
tagcacgtctaactatag

SEQ ID NO: 14761 - DNA, 18 bp, Artificial Sequence
  Synthetic DNA
taggacggctcactacag

SEQ ID NO: 14762 - DNA, 18 bp, Artificial Sequence
  Synthetic DNA
tagtaagactcaccttag

SEQ ID NO: 14763 - DNA, 18 bp, Artificial Sequence
  Synthetic DNA
tagtacgacggactttag

SEQ ID NO: 14764 - DNA, 18 bp, Artificial Sequence
  Synthetic DNA
tagtacgactcactgacg

SEQ ID NO: 14765 - DNA, 18 bp, Artificial Sequence
  Synthetic DNA
tagtacgcgtcactatgg

SEQ ID NO: 14766 - DNA, 18 bp, Artificial Sequence
  Synthetic DNA
tagtacgtctcacaatcg

SEQ ID NO: 14767 - DNA, 18 bp, Artificial Sequence
  Synthetic DNA
tagtagcactcattatag

SEQ ID NO: 14768 - DNA, 18 bp, Artificial Sequence
  Synthetic DNA
tagtatggcttactatag

SEQ ID NO: 14769 - DNA, 18 bp, Artificial Sequence
  Synthetic DNA
tagtcatactcactatag

SEQ ID NO: 14770 - DNA, 18 bp, Artificial Sequence
  Synthetic DNA
tagtgcgacttacaatag

SEQ ID NO: 14771 - DNA, 18 bp, Artificial Sequence
  Synthetic DNA
tagtgggacttactatag

SEQ ID NO: 14772 - DNA, 18 bp, Artificial Sequence
  Synthetic DNA
tataacgactgacgatag

SEQ ID NO: 14773 - DNA, 18 bp, Artificial Sequence
  Synthetic DNA
tataacgcatcactatag

SEQ ID NO: 14774 - DNA, 18 bp, Artificial Sequence
  Synthetic DNA
tataaggactcaccatag

SEQ ID NO: 14775 - DNA, 18 bp, Artificial Sequence
  Synthetic DNA
tatactgactcactatag

SEQ ID NO: 14776 - DNA, 18 bp, Artificial Sequence
  Synthetic DNA
tatcaagactcaccatag

SEQ ID NO: 14777 - DNA, 18 bp, Artificial Sequence
  Synthetic DNA
tatcacgcctcactttag

SEQ ID NO: 14778 - DNA, 18 bp, Artificial Sequence
  Synthetic DNA
tatgacgcatcactatag

SEQ ID NO: 14779 - DNA, 18 bp, Artificial Sequence
  Synthetic DNA
tattaagaatcactctag

SEQ ID NO: 14780 - DNA, 18 bp, Artificial Sequence
  Synthetic DNA
tattaagactccctatcg

SEQ ID NO: 14781 - DNA, 18 bp, Artificial Sequence
  Synthetic DNA
tattaccactctgtatag

SEQ ID NO: 14782 - DNA, 18 bp, Artificial Sequence
  Synthetic DNA
tattacgaatcactaacg

SEQ ID NO: 14783 - DNA, 18 bp, Artificial Sequence
  Synthetic DNA
tattacgactcaatggag

SEQ ID NO: 14784 - DNA, 18 bp, Artificial Sequence
  Synthetic DNA
tattacgactcaccttcg

SEQ ID NO: 14785 - DNA, 18 bp, Artificial Sequence
  Synthetic DNA
tattacgactcacttaaa

SEQ ID NO: 14786 - DNA, 18 bp, Artificial Sequence
  Synthetic DNA
tattacgactctctaaaa

SEQ ID NO: 14787 - DNA, 18 bp, Artificial Sequence
  Synthetic DNA
tattacgactctctttac

SEQ ID NO: 14788 - DNA, 18 bp, Artificial Sequence
  Synthetic DNA
tattacgactgtatatag

SEQ ID NO: 14789 - DNA, 18 bp, Artificial Sequence
  Synthetic DNA
tattacgatccacgatag

SEQ ID NO: 14790 - DNA, 18 bp, Artificial Sequence
  Synthetic DNA
tattacgcataactatag

SEQ ID NO: 14791 - DNA, 18 bp, Artificial Sequence
  Synthetic DNA
tattacgccactctatag

SEQ ID NO: 14792 - DNA, 18 bp, Artificial Sequence
  Synthetic DNA
tattacgcttcactatcg

SEQ ID NO: 14793 - DNA, 18 bp, Artificial Sequence
  Synthetic DNA
tattacggctccctgtag

SEQ ID NO: 14794 - DNA, 18 bp, Artificial Sequence
  Synthetic DNA
tattaggagtgactatag

SEQ ID NO: 14795 - DNA, 18 bp, Artificial Sequence
  Synthetic DNA
tattagggctcattatag

SEQ ID NO: 14796 - DNA, 18 bp, Artificial Sequence
  Synthetic DNA
tattatgacccactgtag

SEQ ID NO: 14797 - DNA, 18 bp, Artificial Sequence
  Synthetic DNA
tattatgactcacgatgg

SEQ ID NO: 14798 - DNA, 18 bp, Artificial Sequence
  Synthetic DNA
tattatgactcactctcg

SEQ ID NO: 14799 - DNA, 18 bp, Artificial Sequence
  Synthetic DNA
tattatgactcagtatgg

SEQ ID NO: 14800 - DNA, 18 bp, Artificial Sequence
  Synthetic DNA
tattcctactcactatcg

SEQ ID NO: 14801 - DNA, 18 bp, Artificial Sequence
  Synthetic DNA
tattcggactcactttag

SEQ ID NO: 14802 - DNA, 18 bp, Artificial Sequence
  Synthetic DNA
tattcgtactcactatag

SEQ ID NO: 14803 - DNA, 18 bp, Artificial Sequence
  Synthetic DNA
tattctgacccactatag

SEQ ID NO: 14804 - DNA, 18 bp, Artificial Sequence
  Synthetic DNA
tattgagactcaatatag

SEQ ID NO: 14805 - DNA, 18 bp, Artificial Sequence
  Synthetic DNA
tattgagcctcactatag

SEQ ID NO: 14806 - DNA, 18 bp, Artificial Sequence
  Synthetic DNA
tattgcgactcaccctag

SEQ ID NO: 14807 - DNA, 18 bp, Artificial Sequence
  Synthetic DNA
tattgcttctcactatag

SEQ ID NO: 14808 - DNA, 18 bp, Artificial Sequence
  Synthetic DNA
tcaaacgactcacactag

SEQ ID NO: 14809 - DNA, 18 bp, Artificial Sequence
  Synthetic DNA
tcaaacgactcactaagg

SEQ ID NO: 14810 - DNA, 18 bp, Artificial Sequence
  Synthetic DNA
tcaaacgactcactacgg

SEQ ID NO: 14811 - DNA, 18 bp, Artificial Sequence
  Synthetic DNA
tcaaatgactcactaaag

SEQ ID NO: 14812 - DNA, 18 bp, Artificial Sequence
  Synthetic DNA
tcagaagactcagtatag

SEQ ID NO: 14813 - DNA, 18 bp, Artificial Sequence
  Synthetic DNA
tcagacgactctctatcg

SEQ ID NO: 14814 - DNA, 18 bp, Artificial Sequence
  Synthetic DNA
tcagacgtctcactttag

SEQ ID NO: 14815 - DNA, 18 bp, Artificial Sequence
  Synthetic DNA
tcataagactaagtatag

SEQ ID NO: 14816 - DNA, 18 bp, Artificial Sequence
  Synthetic DNA
tcataccactcattttag

SEQ ID NO: 14817 - DNA, 18 bp, Artificial Sequence
  Synthetic DNA
tcataccattcaccatag

SEQ ID NO: 14818 - DNA, 18 bp, Artificial Sequence
  Synthetic DNA
tcatacgattccctatcg

SEQ ID NO: 14819 - DNA, 18 bp, Artificial Sequence
  Synthetic DNA
tcatacgcctcattatgg

SEQ ID NO: 14820 - DNA, 18 bp, Artificial Sequence
  Synthetic DNA
tcatacggctcattttag

SEQ ID NO: 14821 - DNA, 18 bp, Artificial Sequence
  Synthetic DNA
tcatacgtctcaacatag

SEQ ID NO: 14822 - DNA, 18 bp, Artificial Sequence
  Synthetic DNA
tcatacgtctcatcatag

SEQ ID NO: 14823 - DNA, 18 bp, Artificial Sequence
  Synthetic DNA
tcatacgtctctctctag

SEQ ID NO: 14824 - DNA, 18 bp, Artificial Sequence
  Synthetic DNA
tcatactaccaactatag

SEQ ID NO: 14825 - DNA, 18 bp, Artificial Sequence
  Synthetic DNA
tcataggactcactaacg

SEQ ID NO: 14826 - DNA, 18 bp, Artificial Sequence
  Synthetic DNA
tcataggatacactatag

SEQ ID NO: 14827 - DNA, 18 bp, Artificial Sequence
  Synthetic DNA
tcatataagtcactatag

SEQ ID NO: 14828 - DNA, 18 bp, Artificial Sequence
  Synthetic DNA
tcatatcactcactttag

SEQ ID NO: 14829 - DNA, 18 bp, Artificial Sequence
  Synthetic DNA
tcatatcactcagtatag

SEQ ID NO: 14830 - DNA, 18 bp, Artificial Sequence
  Synthetic DNA
tcatatgactcatcatag

SEQ ID NO: 14831 - DNA, 18 bp, Artificial Sequence
  Synthetic DNA
tcatccgactcattacag

SEQ ID NO: 14832 - DNA, 18 bp, Artificial Sequence
  Synthetic DNA
tcatccgactctgtatag

SEQ ID NO: 14833 - DNA, 18 bp, Artificial Sequence
  Synthetic DNA
tcatgcgagtcattatag

SEQ ID NO: 14834 - DNA, 18 bp, Artificial Sequence
  Synthetic DNA
tcatgcgcctcagtatag

SEQ ID NO: 14835 - DNA, 18 bp, Artificial Sequence
  Synthetic DNA
tcctgcgactcactttag

SEQ ID NO: 14836 - DNA, 18 bp, Artificial Sequence
  Synthetic DNA
tctaaagactcactatag

SEQ ID NO: 14837 - DNA, 18 bp, Artificial Sequence
  Synthetic DNA
tcttaccactcactttag

SEQ ID NO: 14838 - DNA, 18 bp, Artificial Sequence
  Synthetic DNA
tcttaggactcactgtag

SEQ ID NO: 14839 - DNA, 18 bp, Artificial Sequence
  Synthetic DNA
tgaaacgaaacactatag

SEQ ID NO: 14840 - DNA, 18 bp, Artificial Sequence
  Synthetic DNA
tgaaacgattcaatatag

SEQ ID NO: 14841 - DNA, 18 bp, Artificial Sequence
  Synthetic DNA
tgaaactacttactatag

SEQ ID NO: 14842 - DNA, 18 bp, Artificial Sequence
  Synthetic DNA
tgaagcgactcactaaag

SEQ ID NO: 14843 - DNA, 18 bp, Artificial Sequence
  Synthetic DNA
tgacacaactcactatgg

SEQ ID NO: 14844 - DNA, 18 bp, Artificial Sequence
  Synthetic DNA
tgacacgactcaccttag

SEQ ID NO: 14845 - DNA, 18 bp, Artificial Sequence
  Synthetic DNA
tgataagactcactcaag

SEQ ID NO: 14846 - DNA, 18 bp, Artificial Sequence
  Synthetic DNA
tgataagagtaactatag

SEQ ID NO: 14847 - DNA, 18 bp, Artificial Sequence
  Synthetic DNA
tgatacaattcactatgg

SEQ ID NO: 14848 - DNA, 18 bp, Artificial Sequence
  Synthetic DNA
tgataccactctctctag

SEQ ID NO: 14849 - DNA, 18 bp, Artificial Sequence
  Synthetic DNA
tgataccatacactatag

SEQ ID NO: 14850 - DNA, 18 bp, Artificial Sequence
  Synthetic DNA
tgatacgaattactgtag

SEQ ID NO: 14851 - DNA, 18 bp, Artificial Sequence
  Synthetic DNA
tgatacgagtcacattag

SEQ ID NO: 14852 - DNA, 18 bp, Artificial Sequence
  Synthetic DNA
tgatacgatatactatag

SEQ ID NO: 14853 - DNA, 18 bp, Artificial Sequence
  Synthetic DNA
tgatacgattcccaatag

SEQ ID NO: 14854 - DNA, 18 bp, Artificial Sequence
  Synthetic DNA
tgatacgcctcaataaag

SEQ ID NO: 14855 - DNA, 18 bp, Artificial Sequence
  Synthetic DNA
tgatacgtttaactatag

SEQ ID NO: 14856 - DNA, 18 bp, Artificial Sequence
  Synthetic DNA
tgatagctctcactatag

SEQ ID NO: 14857 - DNA, 18 bp, Artificial Sequence
  Synthetic DNA
tgataggactcattgtag

SEQ ID NO: 14858 - DNA, 18 bp, Artificial Sequence
  Synthetic DNA
tgatatgacccattatag

SEQ ID NO: 14859 - DNA, 18 bp, Artificial Sequence
  Synthetic DNA
tgatatgactgtctatag

SEQ ID NO: 14860 - DNA, 18 bp, Artificial Sequence
  Synthetic DNA
tgatcccactcactaaag

SEQ ID NO: 14861 - DNA, 18 bp, Artificial Sequence
  Synthetic DNA
tgatgcgattcactttag

SEQ ID NO: 14862 - DNA, 18 bp, Artificial Sequence
  Synthetic DNA
tggtaggactcaccatag

SEQ ID NO: 14863 - DNA, 18 bp, Artificial Sequence
  Synthetic DNA
tggtaggactccctatag

SEQ ID NO: 14864 - DNA, 18 bp, Artificial Sequence
  Synthetic DNA
tgtaacgactcactacag

SEQ ID NO: 14865 - DNA, 18 bp, Artificial Sequence
  Synthetic DNA
tgtcacgactccctatag

SEQ ID NO: 14866 - DNA, 18 bp, Artificial Sequence
  Synthetic DNA
tgttaagactcactctag

SEQ ID NO: 14867 - DNA, 18 bp, Artificial Sequence
  Synthetic DNA
tgttacaacccactatag

SEQ ID NO: 14868 - DNA, 18 bp, Artificial Sequence
  Synthetic DNA
tgttacgacgcacaatag

SEQ ID NO: 14869 - DNA, 18 bp, Artificial Sequence
  Synthetic DNA
tgttacgacttactaaag

SEQ ID NO: 14870 - DNA, 18 bp, Artificial Sequence
  Synthetic DNA
ttaaaagactcaatatag

SEQ ID NO: 14871 - DNA, 18 bp, Artificial Sequence
  Synthetic DNA
ttaaacgactcaggatag

SEQ ID NO: 14872 - DNA, 18 bp, Artificial Sequence
  Synthetic DNA
ttaaacgatccactatag

SEQ ID NO: 14873 - DNA, 18 bp, Artificial Sequence
  Synthetic DNA
ttaaacgcctcaccatag

SEQ ID NO: 14874 - DNA, 18 bp, Artificial Sequence
  Synthetic DNA
ttaaacgcctgactatag

SEQ ID NO: 14875 - DNA, 18 bp, Artificial Sequence
  Synthetic DNA
ttacacgactaactatcg

SEQ ID NO: 14876 - DNA, 18 bp, Artificial Sequence
  Synthetic DNA
ttacaggcctcactatag

SEQ ID NO: 14877 - DNA, 18 bp, Artificial Sequence
  Synthetic DNA
ttagacgcctcactctag

SEQ ID NO: 14878 - DNA, 18 bp, Artificial Sequence
  Synthetic DNA
ttataaaactcactaaag

SEQ ID NO: 14879 - DNA, 18 bp, Artificial Sequence
  Synthetic DNA
ttataaaactcactacag

SEQ ID NO: 14880 - DNA, 18 bp, Artificial Sequence
  Synthetic DNA
ttataagactcactttaa

SEQ ID NO: 14881 - DNA, 18 bp, Artificial Sequence
  Synthetic DNA
ttataagactccctatgg

SEQ ID NO: 14882 - DNA, 18 bp, Artificial Sequence
  Synthetic DNA
ttataaggcacactatag

SEQ ID NO: 14883 - DNA, 18 bp, Artificial Sequence
  Synthetic DNA
ttatacaacgaactatag

SEQ ID NO: 14884 - DNA, 18 bp, Artificial Sequence
  Synthetic DNA
ttatacaactcactaccg

SEQ ID NO: 14885 - DNA, 18 bp, Artificial Sequence
  Synthetic DNA
ttatacaactcagtaaag

SEQ ID NO: 14886 - DNA, 18 bp, Artificial Sequence
  Synthetic DNA
ttatacaatgcactatag

SEQ ID NO: 14887 - DNA, 18 bp, Artificial Sequence
  Synthetic DNA
ttatacgaaccactacag

SEQ ID NO: 14888 - DNA, 18 bp, Artificial Sequence
  Synthetic DNA
ttatacgacgcactacgg

SEQ ID NO: 14889 - DNA, 18 bp, Artificial Sequence
  Synthetic DNA
ttatacgacgcactgcag

SEQ ID NO: 14890 - DNA, 18 bp, Artificial Sequence
  Synthetic DNA
ttatacgactcaatctgg

SEQ ID NO: 14891 - DNA, 18 bp, Artificial Sequence
  Synthetic DNA
ttatacgactcaatgcag

SEQ ID NO: 14892 - DNA, 18 bp, Artificial Sequence
  Synthetic DNA
ttatacgactcacattaa

SEQ ID NO: 14893 - DNA, 18 bp, Artificial Sequence
  Synthetic DNA
ttatacgactgcctctag

SEQ ID NO: 14894 - DNA, 18 bp, Artificial Sequence
  Synthetic DNA
ttatacgacttactcaag

SEQ ID NO: 14895 - DNA, 18 bp, Artificial Sequence
  Synthetic DNA
ttatacgagtcaccagag

SEQ ID NO: 14896 - DNA, 18 bp, Artificial Sequence
  Synthetic DNA
ttatacgattcaatatcg

SEQ ID NO: 14897 - DNA, 18 bp, Artificial Sequence
  Synthetic DNA
ttatacgcataactatag

SEQ ID NO: 14898 - DNA, 18 bp, Artificial Sequence
  Synthetic DNA
ttatacgcctaactgtag

SEQ ID NO: 14899 - DNA, 18 bp, Artificial Sequence
  Synthetic DNA
ttatacgcctcactctcg

SEQ ID NO: 14900 - DNA, 18 bp, Artificial Sequence
  Synthetic DNA
ttatacggcgcaatatag

SEQ ID NO: 14901 - DNA, 18 bp, Artificial Sequence
  Synthetic DNA
ttatacgtatcactacag

SEQ ID NO: 14902 - DNA, 18 bp, Artificial Sequence
  Synthetic DNA
ttatacgtcggactatag

SEQ ID NO: 14903 - DNA, 18 bp, Artificial Sequence
  Synthetic DNA
ttatagaactcactctag

SEQ ID NO: 14904 - DNA, 18 bp, Artificial Sequence
  Synthetic DNA
ttataggtctaactatag

SEQ ID NO: 14905 - DNA, 18 bp, Artificial Sequence
  Synthetic DNA
ttatatgactccctatgg

SEQ ID NO: 14906 - DNA, 18 bp, Artificial Sequence
  Synthetic DNA
ttatatggctcactatcg

SEQ ID NO: 14907 - DNA, 18 bp, Artificial Sequence
  Synthetic DNA
ttatcagactgactatag

SEQ ID NO: 14908 - DNA, 18 bp, Artificial Sequence
  Synthetic DNA
ttatcatactcactatag

SEQ ID NO: 14909 - DNA, 18 bp, Artificial Sequence
  Synthetic DNA
ttatccaactcactataa

SEQ ID NO: 14910 - DNA, 18 bp, Artificial Sequence
  Synthetic DNA
ttatccgaatcaatatag

SEQ ID NO: 14911 - DNA, 18 bp, Artificial Sequence
  Synthetic DNA
ttatgagactcaccatag

SEQ ID NO: 14912 - DNA, 18 bp, Artificial Sequence
  Synthetic DNA
ttatgcgactcactaacg

SEQ ID NO: 14913 - DNA, 18 bp, Artificial Sequence
  Synthetic DNA
ttatgcgactccctatcg

SEQ ID NO: 14914 - DNA, 18 bp, Artificial Sequence
  Synthetic DNA
ttatgcgactccctctag

SEQ ID NO: 14915 - DNA, 18 bp, Artificial Sequence
  Synthetic DNA
ttatgtgacccactatag

SEQ ID NO: 14916 - DNA, 18 bp, Artificial Sequence
  Synthetic DNA
ttctacgcctcactatcg

SEQ ID NO: 14917 - DNA, 18 bp, Artificial Sequence
  Synthetic DNA
ttgaacgactcactctag

SEQ ID NO: 14918 - DNA, 18 bp, Artificial Sequence
  Synthetic DNA
ttgtactgctcactatag

SEQ ID NO: 14919 - DNA, 18 bp, Artificial Sequence
  Synthetic DNA
ttgtaggactcactctag

SEQ ID NO: 14920 - DNA, 18 bp, Artificial Sequence
  Synthetic DNA
ttgtccgaatcactatag

SEQ ID NO: 14921 - DNA, 18 bp, Artificial Sequence
  Synthetic DNA
ttttacgaatcactatcg

SEQ ID NO: 14922 - DNA, 18 bp, Artificial Sequence
  Synthetic DNA
ttttacgactaactagag

SEQ ID NO: 14923 - DNA, 18 bp, Artificial Sequence
  Synthetic DNA
ttttacgactcactctac

SEQ ID NO: 14924 - DNA, 18 bp, Artificial Sequence
  Synthetic DNA
ttttacgtctcactataa

SEQ ID NO: 14925 - DNA, 18 bp, Artificial Sequence
  Synthetic DNA
ttttaggactctctatag

SEQ ID NO: 14926 - DNA, 18 bp, Artificial Sequence
  Synthetic DNA
ttttatgactcactatcg

SEQ ID NO: 14927 - DNA, 18 bp, Artificial Sequence
  Synthetic DNA
ttttccgactcaccatag

SEQ ID NO: 14928 - DNA, 18 bp, Artificial Sequence
  Synthetic DNA
tattacaactcacttttg

SEQ ID NO: 14929 - DNA, 18 bp, Artificial Sequence
  Synthetic DNA
taatgcgtctcactaatg

SEQ ID NO: 14930 - DNA, 18 bp, Artificial Sequence
  Synthetic DNA
taatacgacactccattg

SEQ ID NO: 14931 - DNA, 18 bp, Artificial Sequence
  Synthetic DNA
aaatccgtctcactaaag

SEQ ID NO: 14932 - DNA, 18 bp, Artificial Sequence
  Synthetic DNA
ttttacgactcactttgg

SEQ ID NO: 14933 - DNA, 18 bp, Artificial Sequence
  Synthetic DNA
ttatacaactcactactg

SEQ ID NO: 14934 - DNA, 18 bp, Artificial Sequence
  Synthetic DNA
aaaaatgactcactagag

SEQ ID NO: 14935 - DNA, 18 bp, Artificial Sequence
  Synthetic DNA
tagtgcgtctcactttag

SEQ ID NO: 14936 - DNA, 18 bp, Artificial Sequence
  Synthetic DNA
tatagcgactcactgtag

SEQ ID NO: 14937 - DNA, 18 bp, Artificial Sequence
  Synthetic DNA
taatacgtcccactcaag

SEQ ID NO: 14938 - DNA, 18 bp, Artificial Sequence
  Synthetic DNA
tgatgcgactcaccattg

SEQ ID NO: 14939 - DNA, 18 bp, Artificial Sequence
  Synthetic DNA
tttcacgcctcactatag

SEQ ID NO: 14940 - DNA, 18 bp, Artificial Sequence
  Synthetic DNA
ttttcagactcactatag

SEQ ID NO: 14941 - DNA, 18 bp, Artificial Sequence
  Synthetic DNA
taatgcgtctcacttaag

SEQ ID NO: 14942 - DNA, 18 bp, Artificial Sequence
  Synthetic DNA
ttatacgcatcactaaag

SEQ ID NO: 14943 - DNA, 18 bp, Artificial Sequence
  Synthetic DNA
ttatacgactcgccattg

SEQ ID NO: 14944 - DNA, 18 bp, Artificial Sequence
  Synthetic DNA
aaatacgactcgctccag

SEQ ID NO: 14945 - DNA, 18 bp, Artificial Sequence
  Synthetic DNA
taattagactcaataaag

SEQ ID NO: 14946 - DNA, 18 bp, Artificial Sequence
  Synthetic DNA
ttaaacgacgcactattg

SEQ ID NO: 14947 - DNA, 18 bp, Artificial Sequence
  Synthetic DNA
taaaataactcactaaag

SEQ ID NO: 14948 - DNA, 18 bp, Artificial Sequence
  Synthetic DNA
taatgcgactctctctcg

SEQ ID NO: 14949 - DNA, 18 bp, Artificial Sequence
  Synthetic DNA
ttataagcctcactttag

SEQ ID NO: 14950 - DNA, 18 bp, Artificial Sequence
  Synthetic DNA
ctatacgactcgctattg

SEQ ID NO: 14951 - DNA, 18 bp, Artificial Sequence
  Synthetic DNA
ttatgcgactcacttttg

SEQ ID NO: 14952 - DNA, 18 bp, Artificial Sequence
  Synthetic DNA
atatccgacacactatag

SEQ ID NO: 14953 - DNA, 18 bp, Artificial Sequence
  Synthetic DNA
ttttacaactcactaaag

SEQ ID NO: 14954 - DNA, 18 bp, Artificial Sequence
  Synthetic DNA
ttataggactcactgttg

SEQ ID NO: 14955 - DNA, 18 bp, Artificial Sequence
  Synthetic DNA
aaatagaactcactatcg

SEQ ID NO: 14956 - DNA, 18 bp, Artificial Sequence
  Synthetic DNA
caatccgtctcactatgg

SEQ ID NO: 14957 - DNA, 18 bp, Artificial Sequence
  Synthetic DNA
taaaccgactcactttcg

SEQ ID NO: 14958 - DNA, 18 bp, Artificial Sequence
  Synthetic DNA
tgttacgtatcactatag

SEQ ID NO: 14959 - DNA, 18 bp, Artificial Sequence
  Synthetic DNA
ctatatgcctcactatag

SEQ ID NO: 14960 - DNA, 18 bp, Artificial Sequence
  Synthetic DNA
ttaaaggactcactaaag

SEQ ID NO: 14961 - DNA, 18 bp, Artificial Sequence
  Synthetic DNA
ttatacaactcacttgag

SEQ ID NO: 14962 - DNA, 18 bp, Artificial Sequence
  Synthetic DNA
taattgaactcactattg

SEQ ID NO: 14963 - DNA, 18 bp, Artificial Sequence
  Synthetic DNA
ttaatcgactcgctatag

SEQ ID NO: 14964 - DNA, 18 bp, Artificial Sequence
  Synthetic DNA
taattagtctcaccatag

SEQ ID NO: 14965 - DNA, 18 bp, Artificial Sequence
  Synthetic DNA
tgatacgacgcactgttg

SEQ ID NO: 14966 - DNA, 18 bp, Artificial Sequence
  Synthetic DNA
gcaaacgactaactatag

SEQ ID NO: 14967 - DNA, 18 bp, Artificial Sequence
  Synthetic DNA
taataggtctctctgtag

SEQ ID NO: 14968 - DNA, 18 bp, Artificial Sequence
  Synthetic DNA
ttaaacgactaactaaag

SEQ ID NO: 14969 - DNA, 18 bp, Artificial Sequence
  Synthetic DNA
taatacaactcccttttg

SEQ ID NO: 14970 - DNA, 18 bp, Artificial Sequence
  Synthetic DNA
tagttagactcactttag

SEQ ID NO: 14971 - DNA, 18 bp, Artificial Sequence
  Synthetic DNA
ttattcgactcaggatag

SEQ ID NO: 14972 - DNA, 18 bp, Artificial Sequence
  Synthetic DNA
aaatacaactctgtatag

SEQ ID NO: 14973 - DNA, 18 bp, Artificial Sequence
  Synthetic DNA
taatagaactcacttaag

SEQ ID NO: 14974 - DNA, 18 bp, Artificial Sequence
  Synthetic DNA
taatgcgtcacactaaag

SEQ ID NO: 14975 - DNA, 18 bp, Artificial Sequence
  Synthetic DNA
ttaaacgactcacttcag

SEQ ID NO: 14976 - DNA, 18 bp, Artificial Sequence
  Synthetic DNA
ttaatcgactcactagag

SEQ ID NO: 14977 - DNA, 18 bp, Artificial Sequence
  Synthetic DNA
ttatgcgattcactaaag

SEQ ID NO: 14978 - DNA, 18 bp, Artificial Sequence
  Synthetic DNA
taaatcaactcgctatag

SEQ ID NO: 14979 - DNA, 18 bp, Artificial Sequence
  Synthetic DNA
atatacgactcaccattg

SEQ ID NO: 14980 - DNA, 18 bp, Artificial Sequence
  Synthetic DNA
taatgctactcacttttg

SEQ ID NO: 14981 - DNA, 18 bp, Artificial Sequence
  Synthetic DNA
taattcaactcacgctag

SEQ ID NO: 14982 - DNA, 18 bp, Artificial Sequence
  Synthetic DNA
taattcgtcgctctatag

SEQ ID NO: 14983 - DNA, 18 bp, Artificial Sequence
  Synthetic DNA
taattctgcgcactatag

SEQ ID NO: 14984 - DNA, 18 bp, Artificial Sequence
  Synthetic DNA
tatatcgactcactgtag

SEQ ID NO: 14985 - DNA, 18 bp, Artificial Sequence
  Synthetic DNA
tattgcgactcactagtg

SEQ ID NO: 14986 - DNA, 18 bp, Artificial Sequence
  Synthetic DNA
tgattcggctcacaatag

SEQ ID NO: 14987 - DNA, 18 bp, Artificial Sequence
  Synthetic DNA
aaatactagtcactttag

SEQ ID NO: 14988 - DNA, 18 bp, Artificial Sequence
  Synthetic DNA
taacaggactcaccacag

SEQ ID NO: 14989 - DNA, 18 bp, Artificial Sequence
  Synthetic DNA
taataccactctttatcg

SEQ ID NO: 14990 - DNA, 18 bp, Artificial Sequence
  Synthetic DNA
taatacgagcttctatag

SEQ ID NO: 14991 - DNA, 18 bp, Artificial Sequence
  Synthetic DNA
taataggactctgtttag

SEQ ID NO: 14992 - DNA, 18 bp, Artificial Sequence
  Synthetic DNA
tattaagacccactctag

SEQ ID NO: 14993 - DNA, 18 bp, Artificial Sequence
  Synthetic DNA
tcctacgactcacttcag

SEQ ID NO: 14994 - DNA, 18 bp, Artificial Sequence
  Synthetic DNA
ttaaaagactcactctag

SEQ ID NO: 14995 - DNA, 18 bp, Artificial Sequence
  Synthetic DNA
ttagactactcacaatag

SEQ ID NO: 14996 - DNA, 18 bp, Artificial Sequence
  Synthetic DNA
ttctacgactccctaaag

SEQ ID NO: 14997 - DNA, 18 bp, Artificial Sequence
  Synthetic DNA
taattggactcacttttg

SEQ ID NO: 14998 - DNA, 18 bp, Artificial Sequence
  Synthetic DNA
ttttaagactcgctatag

SEQ ID NO: 14999 - DNA, 18 bp, Artificial Sequence
  Synthetic DNA
atatgcgactcactttag

SEQ ID NO: 15000 - DNA, 18 bp, Artificial Sequence
  Synthetic DNA
taattcaactcactactg

SEQ ID NO: 15001 - DNA, 18 bp, Artificial Sequence
  Synthetic DNA
tattacaactctctacag

SEQ ID NO: 15002 - DNA, 18 bp, Artificial Sequence
  Synthetic DNA
ttattcgtctcactgtag

SEQ ID NO: 15003 - DNA, 18 bp, Artificial Sequence
  Synthetic DNA
taatacttctcgctattg

SEQ ID NO: 15004 - DNA, 18 bp, Artificial Sequence
  Synthetic DNA
taaagcgactcacttttg

SEQ ID NO: 15005 - DNA, 18 bp, Artificial Sequence
  Synthetic DNA
ttatacaactcgctacag

SEQ ID NO: 15006 - DNA, 18 bp, Artificial Sequence
  Synthetic DNA
tattacgagttactttag

SEQ ID NO: 15007 - DNA, 18 bp, Artificial Sequence
  Synthetic DNA
taatgcgtctcacttttg

SEQ ID NO: 15008 - DNA, 18 bp, Artificial Sequence
  Synthetic DNA
taatgtgactcgctatcg

SEQ ID NO: 15009 - DNA, 18 bp, Artificial Sequence
  Synthetic DNA
tattttgcctcactatag

SEQ ID NO: 15010 - DNA, 18 bp, Artificial Sequence
  Synthetic DNA
ttcatcgactcactatag

SEQ ID NO: 15011 - DNA, 18 bp, Artificial Sequence
  Synthetic DNA
ttataggactcacttttg

SEQ ID NO: 15012 - DNA, 18 bp, Artificial Sequence
  Synthetic DNA
ttattcgcctcactattg

SEQ ID NO: 15013 - DNA, 18 bp, Artificial Sequence
  Synthetic DNA
taaaaggactcactcttg

SEQ ID NO: 15014 - DNA, 18 bp, Artificial Sequence
  Synthetic DNA
ttatgcgactcactttcg

SEQ ID NO: 15015 - DNA, 18 bp, Artificial Sequence
  Synthetic DNA
taatacgacacgcaattg

SEQ ID NO: 15016 - DNA, 18 bp, Artificial Sequence
  Synthetic DNA
taattcgacacgccatag

SEQ ID NO: 15017 - DNA, 18 bp, Artificial Sequence
  Synthetic DNA
aaatacgtgtcactattg

SEQ ID NO: 15018 - DNA, 18 bp, Artificial Sequence
  Synthetic DNA
aaatccgactctctattg

SEQ ID NO: 15019 - DNA, 18 bp, Artificial Sequence
  Synthetic DNA
caatacgactcaataatg

SEQ ID NO: 15020 - DNA, 18 bp, Artificial Sequence
  Synthetic DNA
caatccaactcactattg

SEQ ID NO: 15021 - DNA, 18 bp, Artificial Sequence
  Synthetic DNA
gaattcgactcactgaag

SEQ ID NO: 15022 - DNA, 18 bp, Artificial Sequence
  Synthetic DNA
taaaactgctcgctatag

SEQ ID NO: 15023 - DNA, 18 bp, Artificial Sequence
  Synthetic DNA
taaagcgactcaatattg

SEQ ID NO: 15024 - DNA, 18 bp, Artificial Sequence
  Synthetic DNA
taacaccacccgctatag

SEQ ID NO: 15025 - DNA, 18 bp, Artificial Sequence
  Synthetic DNA
taacacgcctcaatattg

SEQ ID NO: 15026 - DNA, 18 bp, Artificial Sequence
  Synthetic DNA
taataaaactcgctttag

SEQ ID NO: 15027 - DNA, 18 bp, Artificial Sequence
  Synthetic DNA
taataccactcacatttg

SEQ ID NO: 15028 - DNA, 18 bp, Artificial Sequence
  Synthetic DNA
taatacgacttaccactg

SEQ ID NO: 15029 - DNA, 18 bp, Artificial Sequence
  Synthetic DNA
taatatgagtcaccattg

SEQ ID NO: 15030 - DNA, 18 bp, Artificial Sequence
  Synthetic DNA
taatattactcgccatag

SEQ ID NO: 15031 - DNA, 18 bp, Artificial Sequence
  Synthetic DNA
taatccgaatcactgttg

SEQ ID NO: 15032 - DNA, 18 bp, Artificial Sequence
  Synthetic DNA
taatccgaatcgttatag

SEQ ID NO: 15033 - DNA, 18 bp, Artificial Sequence
  Synthetic DNA
taattggactcactcaag

SEQ ID NO: 15034 - DNA, 18 bp, Artificial Sequence
  Synthetic DNA
taatttgactcagtttag

SEQ ID NO: 15035 - DNA, 18 bp, Artificial Sequence
  Synthetic DNA
tactacgactcacagttg

SEQ ID NO: 15036 - DNA, 18 bp, Artificial Sequence
  Synthetic DNA
tacttcgactctctatgg

SEQ ID NO: 15037 - DNA, 18 bp, Artificial Sequence
  Synthetic DNA
tagttcgagtcactatcg

SEQ ID NO: 15038 - DNA, 18 bp, Artificial Sequence
  Synthetic DNA
tataacgactcgccatag

SEQ ID NO: 15039 - DNA, 18 bp, Artificial Sequence
  Synthetic DNA
tattaccacttactattg

SEQ ID NO: 15040 - DNA, 18 bp, Artificial Sequence
  Synthetic DNA
tatttccacgcactatag

SEQ ID NO: 15041 - DNA, 18 bp, Artificial Sequence
  Synthetic DNA
tcataagactctctattg

SEQ ID NO: 15042 - DNA, 18 bp, Artificial Sequence
  Synthetic DNA
tcattcgactcagaatag

SEQ ID NO: 15043 - DNA, 18 bp, Artificial Sequence
  Synthetic DNA
tctcacgactcgctatag

SEQ ID NO: 15044 - DNA, 18 bp, Artificial Sequence
  Synthetic DNA
tgatacgactccctcttg

SEQ ID NO: 15045 - DNA, 18 bp, Artificial Sequence
  Synthetic DNA
ttatacgactcgctagcg

SEQ ID NO: 15046 - DNA, 18 bp, Artificial Sequence
  Synthetic DNA
ttattccactccctatag

SEQ ID NO: 15047 - DNA, 18 bp, Artificial Sequence
  Synthetic DNA
ttattcgactccccatag

SEQ ID NO: 15048 - DNA, 18 bp, Artificial Sequence
  Synthetic DNA
aaaaactactcacgatag

SEQ ID NO: 15049 - DNA, 18 bp, Artificial Sequence
  Synthetic DNA
aaagatgaatcactatag

SEQ ID NO: 15050 - DNA, 18 bp, Artificial Sequence
  Synthetic DNA
aaataagcctctctatag

SEQ ID NO: 15051 - DNA, 18 bp, Artificial Sequence
  Synthetic DNA
aataacgactcacgatag

SEQ ID NO: 15052 - DNA, 18 bp, Artificial Sequence
  Synthetic DNA
aattccgactcattatag

SEQ ID NO: 15053 - DNA, 18 bp, Artificial Sequence
  Synthetic DNA
agatacaacacactatag

SEQ ID NO: 15054 - DNA, 18 bp, Artificial Sequence
  Synthetic DNA
ccatacgacacaccatag

SEQ ID NO: 15055 - DNA, 18 bp, Artificial Sequence
  Synthetic DNA
ccatatggctcactatag

SEQ ID NO: 15056 - DNA, 18 bp, Artificial Sequence
  Synthetic DNA
cgataagactcactttag

SEQ ID NO: 15057 - DNA, 18 bp, Artificial Sequence
  Synthetic DNA
ctatacaactcactctag

SEQ ID NO: 15058 - DNA, 18 bp, Artificial Sequence
  Synthetic DNA
ctatacgactaattatag

SEQ ID NO: 15059 - DNA, 18 bp, Artificial Sequence
  Synthetic DNA
taaaacgaattacgatag

SEQ ID NO: 15060 - DNA, 18 bp, Artificial Sequence
  Synthetic DNA
taaaacgactcacctaag

SEQ ID NO: 15061 - DNA, 18 bp, Artificial Sequence
  Synthetic DNA
taaaacgactcagtctgg

SEQ ID NO: 15062 - DNA, 18 bp, Artificial Sequence
  Synthetic DNA
taaaacgactctccacag

SEQ ID NO: 15063 - DNA, 18 bp, Artificial Sequence
  Synthetic DNA
taaaacggctcccaatag

SEQ ID NO: 15064 - DNA, 18 bp, Artificial Sequence
  Synthetic DNA
taaagcgactcacttcag

SEQ ID NO: 15065 - DNA, 18 bp, Artificial Sequence
  Synthetic DNA
taaagcgcctcactaaag

SEQ ID NO: 15066 - DNA, 18 bp, Artificial Sequence
  Synthetic DNA
taaagcgtctcactaaag

SEQ ID NO: 15067 - DNA, 18 bp, Artificial Sequence
  Synthetic DNA
taacacatctcactatcg

SEQ ID NO: 15068 - DNA, 18 bp, Artificial Sequence
  Synthetic DNA
taacacgactctcaatcg

SEQ ID NO: 15069 - DNA, 18 bp, Artificial Sequence
  Synthetic DNA
taataacgctcactaaag

SEQ ID NO: 15070 - DNA, 18 bp, Artificial Sequence
  Synthetic DNA
taataaggttaactatag

SEQ ID NO: 15071 - DNA, 18 bp, Artificial Sequence
  Synthetic DNA
taatacccctcacttgag

SEQ ID NO: 15072 - DNA, 18 bp, Artificial Sequence
  Synthetic DNA
taatacgaattcgtatag

SEQ ID NO: 15073 - DNA, 18 bp, Artificial Sequence
  Synthetic DNA
taatacgacacatcagag

SEQ ID NO: 15074 - DNA, 18 bp, Artificial Sequence
  Synthetic DNA
taatacgacataatctag

SEQ ID NO: 15075 - DNA, 18 bp, Artificial Sequence
  Synthetic DNA
taatacgactcagaaacg

SEQ ID NO: 15076 - DNA, 18 bp, Artificial Sequence
  Synthetic DNA
taatacgactccgtctgg

SEQ ID NO: 15077 - DNA, 18 bp, Artificial Sequence
  Synthetic DNA
taatacgactgtcgatcg

SEQ ID NO: 15078 - DNA, 18 bp, Artificial Sequence
  Synthetic DNA
taatacgatccaataaag

SEQ ID NO: 15079 - DNA, 18 bp, Artificial Sequence
  Synthetic DNA
taatacggctgacgacag

SEQ ID NO: 15080 - DNA, 18 bp, Artificial Sequence
  Synthetic DNA
taatacgtctctctcgag

SEQ ID NO: 15081 - DNA, 18 bp, Artificial Sequence
  Synthetic DNA
taatactactaacttcag

SEQ ID NO: 15082 - DNA, 18 bp, Artificial Sequence
  Synthetic DNA
taataggactgaccatgg

SEQ ID NO: 15083 - DNA, 18 bp, Artificial Sequence
  Synthetic DNA
taatatgactctggatag

SEQ ID NO: 15084 - DNA, 18 bp, Artificial Sequence
  Synthetic DNA
taatccaactcattaaag

SEQ ID NO: 15085 - DNA, 18 bp, Artificial Sequence
  Synthetic DNA
taatcccacacactatcg

SEQ ID NO: 15086 - DNA, 18 bp, Artificial Sequence
  Synthetic DNA
taatgctactcactaacg

SEQ ID NO: 15087 - DNA, 18 bp, Artificial Sequence
  Synthetic DNA
tacaacgacttagtatag

SEQ ID NO: 15088 - DNA, 18 bp, Artificial Sequence
  Synthetic DNA
tactaggactcaatctag

SEQ ID NO: 15089 - DNA, 18 bp, Artificial Sequence
  Synthetic DNA
tatcacgactaactctag

SEQ ID NO: 15090 - DNA, 18 bp, Artificial Sequence
  Synthetic DNA
tattccgactcactaacg

SEQ ID NO: 15091 - DNA, 18 bp, Artificial Sequence
  Synthetic DNA
tattgcgactaactaaag

SEQ ID NO: 15092 - DNA, 18 bp, Artificial Sequence
  Synthetic DNA
tattgcgactcagtctag

SEQ ID NO: 15093 - DNA, 18 bp, Artificial Sequence
  Synthetic DNA
tcatacgacaccctatgg

SEQ ID NO: 15094 - DNA, 18 bp, Artificial Sequence
  Synthetic DNA
tcttacgacacactctag

SEQ ID NO: 15095 - DNA, 18 bp, Artificial Sequence
  Synthetic DNA
tgatacgtcacaatatag

SEQ ID NO: 15096 - DNA, 18 bp, Artificial Sequence
  Synthetic DNA
tgatacgtcacaccatag

SEQ ID NO: 15097 - DNA, 18 bp, Artificial Sequence
  Synthetic DNA
tgatgtaactcactatag

SEQ ID NO: 15098 - DNA, 18 bp, Artificial Sequence
  Synthetic DNA
tgctacgaatcagtatag

SEQ ID NO: 15099 - DNA, 18 bp, Artificial Sequence
  Synthetic DNA
ttaaacgactcactgcag

SEQ ID NO: 15100 - DNA, 18 bp, Artificial Sequence
  Synthetic DNA
ttaaacgactcagtatgg

SEQ ID NO: 15101 - DNA, 18 bp, Artificial Sequence
  Synthetic DNA
ttacacgagtcactttag

SEQ ID NO: 15102 - DNA, 18 bp, Artificial Sequence
  Synthetic DNA
ttataacactcagtatag

SEQ ID NO: 15103 - DNA, 18 bp, Artificial Sequence
  Synthetic DNA
ttataagactcactacgg

SEQ ID NO: 15104 - DNA, 18 bp, Artificial Sequence
  Synthetic DNA
ttatacagctcactctag

SEQ ID NO: 15105 - DNA, 18 bp, Artificial Sequence
  Synthetic DNA
ttatacgacttactctgg

SEQ ID NO: 15106 - DNA, 18 bp, Artificial Sequence
  Synthetic DNA
ttatatgactctctctag

SEQ ID NO: 15107 - DNA, 18 bp, Artificial Sequence
  Synthetic DNA
ttatgcgactccctttag

SEQ ID NO: 15108 - DNA, 18 bp, Artificial Sequence
  Synthetic DNA
ttatgcggatcactatag

SEQ ID NO: 15109 - DNA, 18 bp, Artificial Sequence
  Synthetic DNA
ttgtacgactgcctatag

SEQ ID NO: 15110 - DNA, 18 bp, Artificial Sequence
  Synthetic DNA
ttttacgactcactctcg

SEQ ID NO: 15111 - DNA, 18 bp, Artificial Sequence
  Synthetic DNA
ttattgaactcactatag

SEQ ID NO: 15112 - DNA, 18 bp, Artificial Sequence
  Synthetic DNA
ttttacgactcactactg

SEQ ID NO: 15113 - DNA, 18 bp, Artificial Sequence
  Synthetic DNA
ttttgcgtctcactatag

SEQ ID NO: 15114 - DNA, 18 bp, Artificial Sequence
  Synthetic DNA
caattagactcactattg

SEQ ID NO: 15115 - DNA, 18 bp, Artificial Sequence
  Synthetic DNA
tatttagactcactattg

SEQ ID NO: 15116 - DNA, 18 bp, Artificial Sequence
  Synthetic DNA
taaatcgactcacactag

SEQ ID NO: 15117 - DNA, 18 bp, Artificial Sequence
  Synthetic DNA
taatacgtctcgctaatg

SEQ ID NO: 15118 - DNA, 18 bp, Artificial Sequence
  Synthetic DNA
taaatggactcactttag

SEQ ID NO: 15119 - DNA, 18 bp, Artificial Sequence
  Synthetic DNA
taacacacctcactattg

SEQ ID NO: 15120 - DNA, 18 bp, Artificial Sequence
  Synthetic DNA
taattcgactctcttaag

SEQ ID NO: 15121 - DNA, 18 bp, Artificial Sequence
  Synthetic DNA
caataagactcacgatcg

SEQ ID NO: 15122 - DNA, 18 bp, Artificial Sequence
  Synthetic DNA
taatacaactcgcttaag

SEQ ID NO: 15123 - DNA, 18 bp, Artificial Sequence
  Synthetic DNA
tagtacgactctttttag

SEQ ID NO: 15124 - DNA, 18 bp, Artificial Sequence
  Synthetic DNA
gaattcgtctcactattg

SEQ ID NO: 15125 - DNA, 18 bp, Artificial Sequence
  Synthetic DNA
taatttgactcgctattg

SEQ ID NO: 15126 - DNA, 18 bp, Artificial Sequence
  Synthetic DNA
taatacgacacgctaatg

SEQ ID NO: 15127 - DNA, 18 bp, Artificial Sequence
  Synthetic DNA
taattcgactcggtaaag

SEQ ID NO: 15128 - DNA, 18 bp, Artificial Sequence
  Synthetic DNA
taaagcgactcgctaaag

SEQ ID NO: 15129 - DNA, 18 bp, Artificial Sequence
  Synthetic DNA
taatacgcatcacttttg

SEQ ID NO: 15130 - DNA, 18 bp, Artificial Sequence
  Synthetic DNA
taatgcgcctctctattg

SEQ ID NO: 15131 - DNA, 18 bp, Artificial Sequence
  Synthetic DNA
taattaaactcactatcg

SEQ ID NO: 15132 - DNA, 18 bp, Artificial Sequence
  Synthetic DNA
tagtacgacccacttttg

SEQ ID NO: 15133 - DNA, 18 bp, Artificial Sequence
  Synthetic DNA
tatttcgactcacgatgg

SEQ ID NO: 15134 - DNA, 18 bp, Artificial Sequence
  Synthetic DNA
ttattcaactcactgtag

SEQ ID NO: 15135 - DNA, 18 bp, Artificial Sequence
  Synthetic DNA
aaatacgcgtcactatgg

SEQ ID NO: 15136 - DNA, 18 bp, Artificial Sequence
  Synthetic DNA
aaatactactcaatatgg

SEQ ID NO: 15137 - DNA, 18 bp, Artificial Sequence
  Synthetic DNA
taaagcaagtcactatag

SEQ ID NO: 15138 - DNA, 18 bp, Artificial Sequence
  Synthetic DNA
taataagtatcactctag

SEQ ID NO: 15139 - DNA, 18 bp, Artificial Sequence
  Synthetic DNA
taatacgaagaacaatag

SEQ ID NO: 15140 - DNA, 18 bp, Artificial Sequence
  Synthetic DNA
taatacggtgcattatag

SEQ ID NO: 15141 - DNA, 18 bp, Artificial Sequence
  Synthetic DNA
taatagaactcacaaaag

SEQ ID NO: 15142 - DNA, 18 bp, Artificial Sequence
  Synthetic DNA
taatccgacatattatag

SEQ ID NO: 15143 - DNA, 18 bp, Artificial Sequence
  Synthetic DNA
taatcggaatcactatcg

SEQ ID NO: 15144 - DNA, 18 bp, Artificial Sequence
  Synthetic DNA
tagtacgactctctccag

SEQ ID NO: 15145 - DNA, 18 bp, Artificial Sequence
  Synthetic DNA
tattaccactcaccacag

SEQ ID NO: 15146 - DNA, 18 bp, Artificial Sequence
  Synthetic DNA
tattatgactaactagag

SEQ ID NO: 15147 - DNA, 18 bp, Artificial Sequence
  Synthetic DNA
ttacacaactcactttag

SEQ ID NO: 15148 - DNA, 18 bp, Artificial Sequence
  Synthetic DNA
tgatacgtctcgcaatag

SEQ ID NO: 15149 - DNA, 18 bp, Artificial Sequence
  Synthetic DNA
ttatacaactcacttaag

SEQ ID NO: 15150 - DNA, 18 bp, Artificial Sequence
  Synthetic DNA
ttatacgtctcactactg

SEQ ID NO: 15151 - DNA, 18 bp, Artificial Sequence
  Synthetic DNA
taattcgactcacaaatg

SEQ ID NO: 15152 - DNA, 18 bp, Artificial Sequence
  Synthetic DNA
aaataagactcgctattg

SEQ ID NO: 15153 - DNA, 18 bp, Artificial Sequence
  Synthetic DNA
taaatcgcctcactttag

SEQ ID NO: 15154 - DNA, 18 bp, Artificial Sequence
  Synthetic DNA
taatacgtctcggtacag

SEQ ID NO: 15155 - DNA, 18 bp, Artificial Sequence
  Synthetic DNA
ttattcgactcaccgtag

SEQ ID NO: 15156 - DNA, 18 bp, Artificial Sequence
  Synthetic DNA
aattaggactcagtatag

SEQ ID NO: 15157 - DNA, 18 bp, Artificial Sequence
  Synthetic DNA
taaaacaactccttatag

SEQ ID NO: 15158 - DNA, 18 bp, Artificial Sequence
  Synthetic DNA
taatgcgacatactgtag

SEQ ID NO: 15159 - DNA, 18 bp, Artificial Sequence
  Synthetic DNA
ttataaaactcactctag

SEQ ID NO: 15160 - DNA, 18 bp, Artificial Sequence
  Synthetic DNA
ttatactagtcattatag

SEQ ID NO: 15161 - DNA, 18 bp, Artificial Sequence
  Synthetic DNA
tattgcgtctcactttag

SEQ ID NO: 15162 - DNA, 18 bp, Artificial Sequence
  Synthetic DNA
ttattcgtctcactaaag

SEQ ID NO: 15163 - DNA, 18 bp, Artificial Sequence
  Synthetic DNA
taatacgtcacgcaatag

SEQ ID NO: 15164 - DNA, 18 bp, Artificial Sequence
  Synthetic DNA
taatataactcaatattg

SEQ ID NO: 15165 - DNA, 18 bp, Artificial Sequence
  Synthetic DNA
tttttcgactcactatcg

SEQ ID NO: 15166 - DNA, 18 bp, Artificial Sequence
  Synthetic DNA
aaatctgagtcactatag

SEQ ID NO: 15167 - DNA, 18 bp, Artificial Sequence
  Synthetic DNA
gtctccgactcactatag

SEQ ID NO: 15168 - DNA, 18 bp, Artificial Sequence
  Synthetic DNA
taatataactcactaagg

SEQ ID NO: 15169 - DNA, 18 bp, Artificial Sequence
  Synthetic DNA
taatgcaactcacagtag

SEQ ID NO: 15170 - DNA, 18 bp, Artificial Sequence
  Synthetic DNA
ttgtacgtctcactttag

SEQ ID NO: 15171 - DNA, 18 bp, Artificial Sequence
  Synthetic DNA
ttatacgactcacttctg

SEQ ID NO: 15172 - DNA, 18 bp, Artificial Sequence
  Synthetic DNA
taaaacgtctcactactg

SEQ ID NO: 15173 - DNA, 18 bp, Artificial Sequence
  Synthetic DNA
taataggactcacgaatg

SEQ ID NO: 15174 - DNA, 18 bp, Artificial Sequence
  Synthetic DNA
taatacgtcccactttcg

SEQ ID NO: 15175 - DNA, 18 bp, Artificial Sequence
  Synthetic DNA
tagtacgacattctatag

SEQ ID NO: 15176 - DNA, 18 bp, Artificial Sequence
  Synthetic DNA
tatttagactcactttag

SEQ ID NO: 15177 - DNA, 18 bp, Artificial Sequence
  Synthetic DNA
taatacgactcgcctgag

SEQ ID NO: 15178 - DNA, 18 bp, Artificial Sequence
  Synthetic DNA
taattcgtctctccatag

SEQ ID NO: 15179 - DNA, 18 bp, Artificial Sequence
  Synthetic DNA
taatacgtgtctctttag

SEQ ID NO: 15180 - DNA, 18 bp, Artificial Sequence
  Synthetic DNA
taaagcgactcaccattg

SEQ ID NO: 15181 - DNA, 18 bp, Artificial Sequence
  Synthetic DNA
tattatgactcacttttg

SEQ ID NO: 15182 - DNA, 18 bp, Artificial Sequence
  Synthetic DNA
tttaacgactcactatgg

SEQ ID NO: 15183 - DNA, 18 bp, Artificial Sequence
  Synthetic DNA
tataaggactcactttag

SEQ ID NO: 15184 - DNA, 18 bp, Artificial Sequence
  Synthetic DNA
ttttacgactctctctag

SEQ ID NO: 15185 - DNA, 18 bp, Artificial Sequence
  Synthetic DNA
taaatggactcgctatag

SEQ ID NO: 15186 - DNA, 18 bp, Artificial Sequence
  Synthetic DNA
taatacgtgtcgctattg

SEQ ID NO: 15187 - DNA, 18 bp, Artificial Sequence
  Synthetic DNA
aaatagaactcgctatag

SEQ ID NO: 15188 - DNA, 18 bp, Artificial Sequence
  Synthetic DNA
aaatatgactcacttttg

SEQ ID NO: 15189 - DNA, 18 bp, Artificial Sequence
  Synthetic DNA
taaaaggactcactaatg

SEQ ID NO: 15190 - DNA, 18 bp, Artificial Sequence
  Synthetic DNA
taattcccctcactgtag

SEQ ID NO: 15191 - DNA, 18 bp, Artificial Sequence
  Synthetic DNA
ttaaacgactcgttatag

SEQ ID NO: 15192 - DNA, 18 bp, Artificial Sequence
  Synthetic DNA
ttatacgactcgctgtcg

SEQ ID NO: 15193 - DNA, 18 bp, Artificial Sequence
  Synthetic DNA
aaatacaacttactttag

SEQ ID NO: 15194 - DNA, 18 bp, Artificial Sequence
  Synthetic DNA
aaatgcgactcacgaaag

SEQ ID NO: 15195 - DNA, 18 bp, Artificial Sequence
  Synthetic DNA
caataagactcaccttag

SEQ ID NO: 15196 - DNA, 18 bp, Artificial Sequence
  Synthetic DNA
caatatgtctcactagag

SEQ ID NO: 15197 - DNA, 18 bp, Artificial Sequence
  Synthetic DNA
gagtgcgactcactttag

SEQ ID NO: 15198 - DNA, 18 bp, Artificial Sequence
  Synthetic DNA
gattaccgctcactatag

SEQ ID NO: 15199 - DNA, 18 bp, Artificial Sequence
  Synthetic DNA
taaagcgactctctaaag

SEQ ID NO: 15200 - DNA, 18 bp, Artificial Sequence
  Synthetic DNA
taagacgagtcacaaaag

SEQ ID NO: 15201 - DNA, 18 bp, Artificial Sequence
  Synthetic DNA
taatacgatttcctacag

SEQ ID NO: 15202 - DNA, 18 bp, Artificial Sequence
  Synthetic DNA
taatactactcaccaacg

SEQ ID NO: 15203 - DNA, 18 bp, Artificial Sequence
  Synthetic DNA
tactacgaataactctag

SEQ ID NO: 15204 - DNA, 18 bp, Artificial Sequence
  Synthetic DNA
tattacgactttatatag

SEQ ID NO: 15205 - DNA, 18 bp, Artificial Sequence
  Synthetic DNA
tattccgactcactctgg

SEQ ID NO: 15206 - DNA, 18 bp, Artificial Sequence
  Synthetic DNA
tattgcgactctctatcg

SEQ ID NO: 15207 - DNA, 18 bp, Artificial Sequence
  Synthetic DNA
ttaaaccgctcactatag

SEQ ID NO: 15208 - DNA, 18 bp, Artificial Sequence
  Synthetic DNA
ttatccgacccactgtag

SEQ ID NO: 15209 - DNA, 18 bp, Artificial Sequence
  Synthetic DNA
ttttaggtctcactatag

SEQ ID NO: 15210 - DNA, 18 bp, Artificial Sequence
  Synthetic DNA
taattcgcctcgctattg

SEQ ID NO: 15211 - DNA, 18 bp, Artificial Sequence
  Synthetic DNA
aaattcgactcgctatcg

SEQ ID NO: 15212 - DNA, 18 bp, Artificial Sequence
  Synthetic DNA
caattccactcactattg

SEQ ID NO: 15213 - DNA, 18 bp, Artificial Sequence
  Synthetic DNA
caattcgactagctatag

SEQ ID NO: 15214 - DNA, 18 bp, Artificial Sequence
  Synthetic DNA
caattcgactcgctttag

SEQ ID NO: 15215 - DNA, 18 bp, Artificial Sequence
  Synthetic DNA
caattcgacttgctatag

SEQ ID NO: 15216 - DNA, 18 bp, Artificial Sequence
  Synthetic DNA
taaatcgattcgctatag

SEQ ID NO: 15217 - DNA, 18 bp, Artificial Sequence
  Synthetic DNA
taataagactcgctgttg

SEQ ID NO: 15218 - DNA, 18 bp, Artificial Sequence
  Synthetic DNA
taataaggctcgctattg

SEQ ID NO: 15219 - DNA, 18 bp, Artificial Sequence
  Synthetic DNA
taatacgacacggtattg

SEQ ID NO: 15220 - DNA, 18 bp, Artificial Sequence
  Synthetic DNA
taatatgagtcgctattg

SEQ ID NO: 15221 - DNA, 18 bp, Artificial Sequence
  Synthetic DNA
taatgcgactcgctatta

SEQ ID NO: 15222 - DNA, 18 bp, Artificial Sequence
  Synthetic DNA
taattagactcgatatag

SEQ ID NO: 15223 - DNA, 18 bp, Artificial Sequence
  Synthetic DNA
taattagactcggtatag

SEQ ID NO: 15224 - DNA, 18 bp, Artificial Sequence
  Synthetic DNA
taattcaactcactatta

SEQ ID NO: 15225 - DNA, 18 bp, Artificial Sequence
  Synthetic DNA
taattcaactcgctgtag

SEQ ID NO: 15226 - DNA, 18 bp, Artificial Sequence
  Synthetic DNA
taattcaacttgctatag

SEQ ID NO: 15227 - DNA, 18 bp, Artificial Sequence
  Synthetic DNA
taattcgacctactattg

SEQ ID NO: 15228 - DNA, 18 bp, Artificial Sequence
  Synthetic DNA
taattcgacgaactattg

SEQ ID NO: 15229 - DNA, 18 bp, Artificial Sequence
  Synthetic DNA
taattcgactcaatgttg

SEQ ID NO: 15230 - DNA, 18 bp, Artificial Sequence
  Synthetic DNA
taattcgactcagtatta

SEQ ID NO: 15231 - DNA, 18 bp, Artificial Sequence
  Synthetic DNA
taattcgactcgcaatcg

SEQ ID NO: 15232 - DNA, 18 bp, Artificial Sequence
  Synthetic DNA
taattcgacttacgattg

SEQ ID NO: 15233 - DNA, 18 bp, Artificial Sequence
  Synthetic DNA
taattcgagtcgctatgg

SEQ ID NO: 15234 - DNA, 18 bp, Artificial Sequence
  Synthetic DNA
taattcggctcactactg

SEQ ID NO: 15235 - DNA, 18 bp, Artificial Sequence
  Synthetic DNA
taatttgtctcgctatag

SEQ ID NO: 15236 - DNA, 18 bp, Artificial Sequence
  Synthetic DNA
tacttcggctcgctatag

SEQ ID NO: 15237 - DNA, 18 bp, Artificial Sequence
  Synthetic DNA
tagtgcgactcgctattg

SEQ ID NO: 15238 - DNA, 18 bp, Artificial Sequence
  Synthetic DNA
ttatacgaatcgctattg

SEQ ID NO: 15239 - DNA, 18 bp, Artificial Sequence
  Synthetic DNA
ttatacgacacgctattg

SEQ ID NO: 15240 - DNA, 18 bp, Artificial Sequence
  Synthetic DNA
ttatacgacccgctattg

SEQ ID NO: 15241 - DNA, 18 bp, Artificial Sequence
  Synthetic DNA
ttatacgattcgctattg

SEQ ID NO: 15242 - DNA, 18 bp, Artificial Sequence
  Synthetic DNA
ttatccgactcgctattg

SEQ ID NO: 15243 - DNA, 18 bp, Artificial Sequence
  Synthetic DNA
ttattcgactcgatatag

SEQ ID NO: 15244 - DNA, 18 bp, Artificial Sequence
  Synthetic DNA
ttattggactcgctatag

SEQ ID NO: 15245 - DNA, 18 bp, Artificial Sequence
  Synthetic DNA
aaatacgacccactagtg

SEQ ID NO: 15246 - DNA, 18 bp, Artificial Sequence
  Synthetic DNA
aaatacgactcattgttg

SEQ ID NO: 15247 - DNA, 18 bp, Artificial Sequence
  Synthetic DNA
aaatacgattcgcaatag

SEQ ID NO: 15248 - DNA, 18 bp, Artificial Sequence
  Synthetic DNA
aaatacggctcattattg

SEQ ID NO: 15249 - DNA, 18 bp, Artificial Sequence
  Synthetic DNA
aaataggactcattattg

SEQ ID NO: 15250 - DNA, 18 bp, Artificial Sequence
  Synthetic DNA
aaatgcgactcattattg

SEQ ID NO: 15251 - DNA, 18 bp, Artificial Sequence
  Synthetic DNA
aaatgcgactcgctatgg

SEQ ID NO: 15252 - DNA, 18 bp, Artificial Sequence
  Synthetic DNA
aaattcgacaaactatag

SEQ ID NO: 15253 - DNA, 18 bp, Artificial Sequence
  Synthetic DNA
aaattcgattcattatag

SEQ ID NO: 15254 - DNA, 18 bp, Artificial Sequence
  Synthetic DNA
aaatttgactcaccatag

SEQ ID NO: 15255 - DNA, 18 bp, Artificial Sequence
  Synthetic DNA
aactacgacttgctatag

SEQ ID NO: 15256 - DNA, 18 bp, Artificial Sequence
  Synthetic DNA
aagtgcgactcgctatag

SEQ ID NO: 15257 - DNA, 18 bp, Artificial Sequence
  Synthetic DNA
aagttcgactcattatag

SEQ ID NO: 15258 - DNA, 18 bp, Artificial Sequence
  Synthetic DNA
aattacgactcggtatag

SEQ ID NO: 15259 - DNA, 18 bp, Artificial Sequence
  Synthetic DNA
aatttcgactcactgtag

SEQ ID NO: 15260 - DNA, 18 bp, Artificial Sequence
  Synthetic DNA
acatacgactcacgattg

SEQ ID NO: 15261 - DNA, 18 bp, Artificial Sequence
  Synthetic DNA
agattcgattcactatag

SEQ ID NO: 15262 - DNA, 18 bp, Artificial Sequence
  Synthetic DNA
caaaacgactcggtatag

SEQ ID NO: 15263 - DNA, 18 bp, Artificial Sequence
  Synthetic DNA
caagaagactcgctatag

SEQ ID NO: 15264 - DNA, 18 bp, Artificial Sequence
  Synthetic DNA
caatacaactcgcaatag

SEQ ID NO: 15265 - DNA, 18 bp, Artificial Sequence
  Synthetic DNA
caataccactcactgttg

SEQ ID NO: 15266 - DNA, 18 bp, Artificial Sequence
  Synthetic DNA
caatacgactcagtgttg

SEQ ID NO: 15267 - DNA, 18 bp, Artificial Sequence
  Synthetic DNA
caatacggttcactattg

SEQ ID NO: 15268 - DNA, 18 bp, Artificial Sequence
  Synthetic DNA
caatacgtatcactattg

SEQ ID NO: 15269 - DNA, 18 bp, Artificial Sequence
  Synthetic DNA
caatacgtcttactattg

SEQ ID NO: 15270 - DNA, 18 bp, Artificial Sequence
  Synthetic DNA
caatccggctcactattg

SEQ ID NO: 15271 - DNA, 18 bp, Artificial Sequence
  Synthetic DNA
caattcgactatctatag

SEQ ID NO: 15272 - DNA, 18 bp, Artificial Sequence
  Synthetic DNA
caattcggctcactttag

SEQ ID NO: 15273 - DNA, 18 bp, Artificial Sequence
  Synthetic DNA
caatttgactcagtatag

SEQ ID NO: 15274 - DNA, 18 bp, Artificial Sequence
  Synthetic DNA
cacatcgactcactatag

SEQ ID NO: 15275 - DNA, 18 bp, Artificial Sequence
  Synthetic DNA
cactacgactcattattg

SEQ ID NO: 15276 - DNA, 18 bp, Artificial Sequence
  Synthetic DNA
cactacgtctcactattg

SEQ ID NO: 15277 - DNA, 18 bp, Artificial Sequence
  Synthetic DNA
cagtacgactcactaatg

SEQ ID NO: 15278 - DNA, 18 bp, Artificial Sequence
  Synthetic DNA
cgataggactcactattg

SEQ ID NO: 15279 - DNA, 18 bp, Artificial Sequence
  Synthetic DNA
ctatttgactcactatag

SEQ ID NO: 15280 - DNA, 18 bp, Artificial Sequence
  Synthetic DNA
gaaaacgactcactactg

SEQ ID NO: 15281 - DNA, 18 bp, Artificial Sequence
  Synthetic DNA
gaaatcgactcattatag

SEQ ID NO: 15282 - DNA, 18 bp, Artificial Sequence
  Synthetic DNA
gaataagactcgctaaag

SEQ ID NO: 15283 - DNA, 18 bp, Artificial Sequence
  Synthetic DNA
gaatacgtttcactattg

SEQ ID NO: 15284 - DNA, 18 bp, Artificial Sequence
  Synthetic DNA
gaattcgaatcactctag

SEQ ID NO: 15285 - DNA, 18 bp, Artificial Sequence
  Synthetic DNA
gaattcgacttactaaag

SEQ ID NO: 15286 - DNA, 18 bp, Artificial Sequence
  Synthetic DNA
gaattggactcacaatag

SEQ ID NO: 15287 - DNA, 18 bp, Artificial Sequence
  Synthetic DNA
taaaacgaatcgctaaag

SEQ ID NO: 15288 - DNA, 18 bp, Artificial Sequence
  Synthetic DNA
taaaacgactcaatatta

SEQ ID NO: 15289 - DNA, 18 bp, Artificial Sequence
  Synthetic DNA
taaaacgcctcactaatg

SEQ ID NO: 15290 - DNA, 18 bp, Artificial Sequence
  Synthetic DNA
taaaaggactcaccattg

SEQ ID NO: 15291 - DNA, 18 bp, Artificial Sequence
  Synthetic DNA
taaaatgagtcactattg

SEQ ID NO: 15292 - DNA, 18 bp, Artificial Sequence
  Synthetic DNA
taaaccaactcactattg

SEQ ID NO: 15293 - DNA, 18 bp, Artificial Sequence
  Synthetic DNA
taaaccgcctcgctatag

SEQ ID NO: 15294 - DNA, 18 bp, Artificial Sequence
  Synthetic DNA
taaatccactcaatatag

SEQ ID NO: 15295 - DNA, 18 bp, Artificial Sequence
  Synthetic DNA
taaatcgacacactataa

SEQ ID NO: 15296 - DNA, 18 bp, Artificial Sequence
  Synthetic DNA
taaatcgactgacaatag

SEQ ID NO: 15297 - DNA, 18 bp, Artificial Sequence
  Synthetic DNA
taaattgactcaccatag

SEQ ID NO: 15298 - DNA, 18 bp, Artificial Sequence
  Synthetic DNA
taaattgactgactatag

SEQ ID NO: 15299 - DNA, 18 bp, Artificial Sequence
  Synthetic DNA
taacacaactcacttttg

SEQ ID NO: 15300 - DNA, 18 bp, Artificial Sequence
  Synthetic DNA
taacacaactcagtattg

SEQ ID NO: 15301 - DNA, 18 bp, Artificial Sequence
  Synthetic DNA
taacacgactcagtaatg

SEQ ID NO: 15302 - DNA, 18 bp, Artificial Sequence
  Synthetic DNA
taacacgactcgatatcg

SEQ ID NO: 15303 - DNA, 18 bp, Artificial Sequence
  Synthetic DNA
taacacgactctctcttg

SEQ ID NO: 15304 - DNA, 18 bp, Artificial Sequence
  Synthetic DNA
taacacgactgcctattg

SEQ ID NO: 15305 - DNA, 18 bp, Artificial Sequence
  Synthetic DNA
taacacgactggcaatag

SEQ ID NO: 15306 - DNA, 18 bp, Artificial Sequence
  Synthetic DNA
taacatgactcactagtg

SEQ ID NO: 15307 - DNA, 18 bp, Artificial Sequence
  Synthetic DNA
taacgcgactcgctaaag

SEQ ID NO: 15308 - DNA, 18 bp, Artificial Sequence
  Synthetic DNA
taactccattcactatag

SEQ ID NO: 15309 - DNA, 18 bp, Artificial Sequence
  Synthetic DNA
taactcgccccactatag

SEQ ID NO: 15310 - DNA, 18 bp, Artificial Sequence
  Synthetic DNA
taagataactcactattg

SEQ ID NO: 15311 - DNA, 18 bp, Artificial Sequence
  Synthetic DNA
taagtcaacacactatag

SEQ ID NO: 15312 - DNA, 18 bp, Artificial Sequence
  Synthetic DNA
taagttgactcattatag

SEQ ID NO: 15313 - DNA, 18 bp, Artificial Sequence
  Synthetic DNA
taataacacacgctatag

SEQ ID NO: 15314 - DNA, 18 bp, Artificial Sequence
  Synthetic DNA
taatacaactgacaattg

SEQ ID NO: 15315 - DNA, 18 bp, Artificial Sequence
  Synthetic DNA
taatacaagtcgctttag

SEQ ID NO: 15316 - DNA, 18 bp, Artificial Sequence
  Synthetic DNA
taataccactcgcaatcg

SEQ ID NO: 15317 - DNA, 18 bp, Artificial Sequence
  Synthetic DNA
taatacgaatctctgttg

SEQ ID NO: 15318 - DNA, 18 bp, Artificial Sequence
  Synthetic DNA
taatacgacacaggattg

SEQ ID NO: 15319 - DNA, 18 bp, Artificial Sequence
  Synthetic DNA
taatacgacgcgccacag

SEQ ID NO: 15320 - DNA, 18 bp, Artificial Sequence
  Synthetic DNA
taatacgactcacccgtg

SEQ ID NO: 15321 - DNA, 18 bp, Artificial Sequence
  Synthetic DNA
taatacgactcacgtatg

SEQ ID NO: 15322 - DNA, 18 bp, Artificial Sequence
  Synthetic DNA
taatacgactccttcttg

SEQ ID NO: 15323 - DNA, 18 bp, Artificial Sequence
  Synthetic DNA
taatacgactcgcagaag

SEQ ID NO: 15324 - DNA, 18 bp, Artificial Sequence
  Synthetic DNA
taatacgactggccaaag

SEQ ID NO: 15325 - DNA, 18 bp, Artificial Sequence
  Synthetic DNA
taatacgagaaactattg

SEQ ID NO: 15326 - DNA, 18 bp, Artificial Sequence
  Synthetic DNA
taatacgagtcgttacag

SEQ ID NO: 15327 - DNA, 18 bp, Artificial Sequence
  Synthetic DNA
taatacgagtctctatta

SEQ ID NO: 15328 - DNA, 18 bp, Artificial Sequence
  Synthetic DNA
taatacgattaactactg

SEQ ID NO: 15329 - DNA, 18 bp, Artificial Sequence
  Synthetic DNA
taatacgattcattgttg

SEQ ID NO: 15330 - DNA, 18 bp, Artificial Sequence
  Synthetic DNA
taatacgcatcgcaatag

SEQ ID NO: 15331 - DNA, 18 bp, Artificial Sequence
  Synthetic DNA
taatacgtcgcaatattg

SEQ ID NO: 15332 - DNA, 18 bp, Artificial Sequence
  Synthetic DNA
taatacgtctcaccgttg

SEQ ID NO: 15333 - DNA, 18 bp, Artificial Sequence
  Synthetic DNA
taatactacccactgttg

SEQ ID NO: 15334 - DNA, 18 bp, Artificial Sequence
  Synthetic DNA
taatactactcgctaacg

SEQ ID NO: 15335 - DNA, 18 bp, Artificial Sequence
  Synthetic DNA
taatactactcgctcaag

SEQ ID NO: 15336 - DNA, 18 bp, Artificial Sequence
  Synthetic DNA
taatactactgcctattg

SEQ ID NO: 15337 - DNA, 18 bp, Artificial Sequence
  Synthetic DNA
taatactacttgctctag

SEQ ID NO: 15338 - DNA, 18 bp, Artificial Sequence
  Synthetic DNA
taatactcctcactcttg

SEQ ID NO: 15339 - DNA, 18 bp, Artificial Sequence
  Synthetic DNA
taatactcctcagtattg

SEQ ID NO: 15340 - DNA, 18 bp, Artificial Sequence
  Synthetic DNA
taatagaacttgctatag

SEQ ID NO: 15341 - DNA, 18 bp, Artificial Sequence
  Synthetic DNA
taatagagctcactattg

SEQ ID NO: 15342 - DNA, 18 bp, Artificial Sequence
  Synthetic DNA
taatagcaatcactattg

SEQ ID NO: 15343 - DNA, 18 bp, Artificial Sequence
  Synthetic DNA
taataggacacgctctag

SEQ ID NO: 15344 - DNA, 18 bp, Artificial Sequence
  Synthetic DNA
taataggactcacgtttg

SEQ ID NO: 15345 - DNA, 18 bp, Artificial Sequence
  Synthetic DNA
taataggacttactgttg

SEQ ID NO: 15346 - DNA, 18 bp, Artificial Sequence
  Synthetic DNA
taataggtatcactattg

SEQ ID NO: 15347 - DNA, 18 bp, Artificial Sequence
  Synthetic DNA
taataggtctcgatatag

SEQ ID NO: 15348 - DNA, 18 bp, Artificial Sequence
  Synthetic DNA
taataggtcttgctatag

SEQ ID NO: 15349 - DNA, 18 bp, Artificial Sequence
  Synthetic DNA
taatataactcactagtg

SEQ ID NO: 15350 - DNA, 18 bp, Artificial Sequence
  Synthetic DNA
taatatgaatcactatta

SEQ ID NO: 15351 - DNA, 18 bp, Artificial Sequence
  Synthetic DNA
taatatgaatcgcgatag

SEQ ID NO: 15352 - DNA, 18 bp, Artificial Sequence
  Synthetic DNA
taatatgactccatattg

SEQ ID NO: 15353 - DNA, 18 bp, Artificial Sequence
  Synthetic DNA
taatatgactcgctgtcg

SEQ ID NO: 15354 - DNA, 18 bp, Artificial Sequence
  Synthetic DNA
taatatgtctcaccattg

SEQ ID NO: 15355 - DNA, 18 bp, Artificial Sequence
  Synthetic DNA
taatattactgactattg

SEQ ID NO: 15356 - DNA, 18 bp, Artificial Sequence
  Synthetic DNA
taatccgaatcggtatag

SEQ ID NO: 15357 - DNA, 18 bp, Artificial Sequence
  Synthetic DNA
taatccgacccaatattg

SEQ ID NO: 15358 - DNA, 18 bp, Artificial Sequence
  Synthetic DNA
taatccgacccgctaaag

SEQ ID NO: 15359 - DNA, 18 bp, Artificial Sequence
  Synthetic DNA
taatccgactcgcttaag

SEQ ID NO: 15360 - DNA, 18 bp, Artificial Sequence
  Synthetic DNA
taatccgactctatattg

SEQ ID NO: 15361 - DNA, 18 bp, Artificial Sequence
  Synthetic DNA
taatccgactgacttttg

SEQ ID NO: 15362 - DNA, 18 bp, Artificial Sequence
  Synthetic DNA
taatccgattcgctagag

SEQ ID NO: 15363 - DNA, 18 bp, Artificial Sequence
  Synthetic DNA
taatcggactcacttttg

SEQ ID NO: 15364 - DNA, 18 bp, Artificial Sequence
  Synthetic DNA
taatgagagtcactattg

SEQ ID NO: 15365 - DNA, 18 bp, Artificial Sequence
  Synthetic DNA
taatgccaatcgctatag

SEQ ID NO: 15366 - DNA, 18 bp, Artificial Sequence
  Synthetic DNA
taatgcgattcaccattg

SEQ ID NO: 15367 - DNA, 18 bp, Artificial Sequence
  Synthetic DNA
taatgcgtgtcactattg

SEQ ID NO: 15368 - DNA, 18 bp, Artificial Sequence
  Synthetic DNA
taatgtgactcacttttg

SEQ ID NO: 15369 - DNA, 18 bp, Artificial Sequence
  Synthetic DNA
taatgtgactggctatag

SEQ ID NO: 15370 - DNA, 18 bp, Artificial Sequence
  Synthetic DNA
taattagacgcactttag

SEQ ID NO: 15371 - DNA, 18 bp, Artificial Sequence
  Synthetic DNA
taattagactcaatctag

SEQ ID NO: 15372 - DNA, 18 bp, Artificial Sequence
  Synthetic DNA
taattagactcactaacg

SEQ ID NO: 15373 - DNA, 18 bp, Artificial Sequence
  Synthetic DNA
taattagactcagaatag

SEQ ID NO: 15374 - DNA, 18 bp, Artificial Sequence
  Synthetic DNA
taattagattcagtatag

SEQ ID NO: 15375 - DNA, 18 bp, Artificial Sequence
  Synthetic DNA
taattagtcccactatag

SEQ ID NO: 15376 - DNA, 18 bp, Artificial Sequence
  Synthetic DNA
taattatactcactacag

SEQ ID NO: 15377 - DNA, 18 bp, Artificial Sequence
  Synthetic DNA
taattccagtcactaaag

SEQ ID NO: 15378 - DNA, 18 bp, Artificial Sequence
  Synthetic DNA
taattcgaatcaccatgg

SEQ ID NO: 15379 - DNA, 18 bp, Artificial Sequence
  Synthetic DNA
taattcgaatcacgttag

SEQ ID NO: 15380 - DNA, 18 bp, Artificial Sequence
  Synthetic DNA
taattcgaatccttatag

SEQ ID NO: 15381 - DNA, 18 bp, Artificial Sequence
  Synthetic DNA
taattcgacacactgtgg

SEQ ID NO: 15382 - DNA, 18 bp, Artificial Sequence
  Synthetic DNA
taattcgacgcagaatag

SEQ ID NO: 15383 - DNA, 18 bp, Artificial Sequence
  Synthetic DNA
taattcgactcagaacag

SEQ ID NO: 15384 - DNA, 18 bp, Artificial Sequence
  Synthetic DNA
taattcgactcaggaaag

SEQ ID NO: 15385 - DNA, 18 bp, Artificial Sequence
  Synthetic DNA
taattcgactctatagag

SEQ ID NO: 15386 - DNA, 18 bp, Artificial Sequence
  Synthetic DNA
taattcgagtcaaaatag

SEQ ID NO: 15387 - DNA, 18 bp, Artificial Sequence
  Synthetic DNA
taattcgattccctctag

SEQ ID NO: 15388 - DNA, 18 bp, Artificial Sequence
  Synthetic DNA
taattcgcctgaatatag

SEQ ID NO: 15389 - DNA, 18 bp, Artificial Sequence
  Synthetic DNA
taattcggctaaccatag

SEQ ID NO: 15390 - DNA, 18 bp, Artificial Sequence
  Synthetic DNA
taattcgtcttactagag

SEQ ID NO: 15391 - DNA, 18 bp, Artificial Sequence
  Synthetic DNA
taattctactcagtctag

SEQ ID NO: 15392 - DNA, 18 bp, Artificial Sequence
  Synthetic DNA
taattctactccctatgg

SEQ ID NO: 15393 - DNA, 18 bp, Artificial Sequence
  Synthetic DNA
taattgaactcactgtag

SEQ ID NO: 15394 - DNA, 18 bp, Artificial Sequence
  Synthetic DNA
taattggactcagtttag

SEQ ID NO: 15395 - DNA, 18 bp, Artificial Sequence
  Synthetic DNA
taattgtactcactttag

SEQ ID NO: 15396 - DNA, 18 bp, Artificial Sequence
  Synthetic DNA
taatttcactgactatag

SEQ ID NO: 15397 - DNA, 18 bp, Artificial Sequence
  Synthetic DNA
taatttgacgcactttag

SEQ ID NO: 15398 - DNA, 18 bp, Artificial Sequence
  Synthetic DNA
taatttgactcagcatag

SEQ ID NO: 15399 - DNA, 18 bp, Artificial Sequence
  Synthetic DNA
taatttgactctctgtag

SEQ ID NO: 15400 - DNA, 18 bp, Artificial Sequence
  Synthetic DNA
tactacgactatctattg

SEQ ID NO: 15401 - DNA, 18 bp, Artificial Sequence
  Synthetic DNA
tactacgactcacttgtg

SEQ ID NO: 15402 - DNA, 18 bp, Artificial Sequence
  Synthetic DNA
tactacgcctcaccattg

SEQ ID NO: 15403 - DNA, 18 bp, Artificial Sequence
  Synthetic DNA
tacttccacccactatag

SEQ ID NO: 15404 - DNA, 18 bp, Artificial Sequence
  Synthetic DNA
tacttcgactcacagtag

SEQ ID NO: 15405 - DNA, 18 bp, Artificial Sequence
  Synthetic DNA
tacttcgattccctatag

SEQ ID NO: 15406 - DNA, 18 bp, Artificial Sequence
  Synthetic DNA
tacttcgcctcactctag

SEQ ID NO: 15407 - DNA, 18 bp, Artificial Sequence
  Synthetic DNA
tagaacgacacgctatag

SEQ ID NO: 15408 - DNA, 18 bp, Artificial Sequence
  Synthetic DNA
tagctcgacgcactatag

SEQ ID NO: 15409 - DNA, 18 bp, Artificial Sequence
  Synthetic DNA
tagtacgacacgctctag

SEQ ID NO: 15410 - DNA, 18 bp, Artificial Sequence
  Synthetic DNA
tagtacgactcgttacag

SEQ ID NO: 15411 - DNA, 18 bp, Artificial Sequence
  Synthetic DNA
tagtacgattcactcttg

SEQ ID NO: 15412 - DNA, 18 bp, Artificial Sequence
  Synthetic DNA
tagttccactgactatag

SEQ ID NO: 15413 - DNA, 18 bp, Artificial Sequence
  Synthetic DNA
tagttcgactcactttaa

SEQ ID NO: 15414 - DNA, 18 bp, Artificial Sequence
  Synthetic DNA
tagttcgactcagtaaag

SEQ ID NO: 15415 - DNA, 18 bp, Artificial Sequence
  Synthetic DNA
tagttcgactctctacag

SEQ ID NO: 15416 - DNA, 18 bp, Artificial Sequence
  Synthetic DNA
tagttctactcactacag

SEQ ID NO: 15417 - DNA, 18 bp, Artificial Sequence
  Synthetic DNA
tagtttgactcactttag

SEQ ID NO: 15418 - DNA, 18 bp, Artificial Sequence
  Synthetic DNA
tatgacgactcgttatag

SEQ ID NO: 15419 - DNA, 18 bp, Artificial Sequence
  Synthetic DNA
tattaagactcgctacag

SEQ ID NO: 15420 - DNA, 18 bp, Artificial Sequence
  Synthetic DNA
tattaccacgcactattg

SEQ ID NO: 15421 - DNA, 18 bp, Artificial Sequence
  Synthetic DNA
tattacgagacactattg

SEQ ID NO: 15422 - DNA, 18 bp, Artificial Sequence
  Synthetic DNA
tattacgcctcactatta

SEQ ID NO: 15423 - DNA, 18 bp, Artificial Sequence
  Synthetic DNA
tattacgccttgctatag

SEQ ID NO: 15424 - DNA, 18 bp, Artificial Sequence
  Synthetic DNA
tattacgtctcgctatcg

SEQ ID NO: 15425 - DNA, 18 bp, Artificial Sequence
  Synthetic DNA
tattaggactccctattg

SEQ ID NO: 15426 - DNA, 18 bp, Artificial Sequence
  Synthetic DNA
tattgcgactcgctagag

SEQ ID NO: 15427 - DNA, 18 bp, Artificial Sequence
  Synthetic DNA
tatttcgactcactacgg

SEQ ID NO: 15428 - DNA, 18 bp, Artificial Sequence
  Synthetic DNA
tatttcgactcactatga

SEQ ID NO: 15429 - DNA, 18 bp, Artificial Sequence
  Synthetic DNA
tcaaacgaatcactattg

SEQ ID NO: 15430 - DNA, 18 bp, Artificial Sequence
  Synthetic DNA
tcaaacgactcactatta

SEQ ID NO: 15431 - DNA, 18 bp, Artificial Sequence
  Synthetic DNA
tcatacgacccgctacag

SEQ ID NO: 15432 - DNA, 18 bp, Artificial Sequence
  Synthetic DNA
tcatacgactctctgttg

SEQ ID NO: 15433 - DNA, 18 bp, Artificial Sequence
  Synthetic DNA
tcatactactcgccatag

SEQ ID NO: 15434 - DNA, 18 bp, Artificial Sequence
  Synthetic DNA
tcatatcactcactattg

SEQ ID NO: 15435 - DNA, 18 bp, Artificial Sequence
  Synthetic DNA
tcattcggcttactatag

SEQ ID NO: 15436 - DNA, 18 bp, Artificial Sequence
  Synthetic DNA
tcattggcctcactatag

SEQ ID NO: 15437 - DNA, 18 bp, Artificial Sequence
  Synthetic DNA
tcgtacgactagctatag

SEQ ID NO: 15438 - DNA, 18 bp, Artificial Sequence
  Synthetic DNA
tgaatcgtctcactatag

SEQ ID NO: 15439 - DNA, 18 bp, Artificial Sequence
  Synthetic DNA
tgacacgaatcgctatag

SEQ ID NO: 15440 - DNA, 18 bp, Artificial Sequence
  Synthetic DNA
tgatacaactctctattg

SEQ ID NO: 15441 - DNA, 18 bp, Artificial Sequence
  Synthetic DNA
tgataccgctcgctatag

SEQ ID NO: 15442 - DNA, 18 bp, Artificial Sequence
  Synthetic DNA
tgatacgacgcattattg

SEQ ID NO: 15443 - DNA, 18 bp, Artificial Sequence
  Synthetic DNA
tgatacgactcattactg

SEQ ID NO: 15444 - DNA, 18 bp, Artificial Sequence
  Synthetic DNA
tgatacgagtctctattg

SEQ ID NO: 15445 - DNA, 18 bp, Artificial Sequence
  Synthetic DNA
tgataggactcacaattg

SEQ ID NO: 15446 - DNA, 18 bp, Artificial Sequence
  Synthetic DNA
tgattagactcactatcg

SEQ ID NO: 15447 - DNA, 18 bp, Artificial Sequence
  Synthetic DNA
tgattcgactcaccataa

SEQ ID NO: 15448 - DNA, 18 bp, Artificial Sequence
  Synthetic DNA
tgattcggctcactatcg

SEQ ID NO: 15449 - DNA, 18 bp, Artificial Sequence
  Synthetic DNA
tgattggaatcactatag

SEQ ID NO: 15450 - DNA, 18 bp, Artificial Sequence
  Synthetic DNA
tggtacgactcaccattg

SEQ ID NO: 15451 - DNA, 18 bp, Artificial Sequence
  Synthetic DNA
tgttacaactcactattg

SEQ ID NO: 15452 - DNA, 18 bp, Artificial Sequence
  Synthetic DNA
ttacaagactcgctatag

SEQ ID NO: 15453 - DNA, 18 bp, Artificial Sequence
  Synthetic DNA
ttactcgactcacgatag

SEQ ID NO: 15454 - DNA, 18 bp, Artificial Sequence
  Synthetic DNA
ttactcgactcactatcg

SEQ ID NO: 15455 - DNA, 18 bp, Artificial Sequence
  Synthetic DNA
ttataagactcgctatcg

SEQ ID NO: 15456 - DNA, 18 bp, Artificial Sequence
  Synthetic DNA
ttataccactcgctttag

SEQ ID NO: 15457 - DNA, 18 bp, Artificial Sequence
  Synthetic DNA
ttatacgactcactgttc

SEQ ID NO: 15458 - DNA, 18 bp, Artificial Sequence
  Synthetic DNA
ttatacgactcgatacag

SEQ ID NO: 15459 - DNA, 18 bp, Artificial Sequence
  Synthetic DNA
ttatacgactgggtatag

SEQ ID NO: 15460 - DNA, 18 bp, Artificial Sequence
  Synthetic DNA
ttataggagtcactattg

SEQ ID NO: 15461 - DNA, 18 bp, Artificial Sequence
  Synthetic DNA
ttattcgaccctctatag

SEQ ID NO: 15462 - DNA, 18 bp, Artificial Sequence
  Synthetic DNA
ttattcgactcaccatcg

SEQ ID NO: 15463 - DNA, 18 bp, Artificial Sequence
  Synthetic DNA
ttctaccactcactattg

SEQ ID NO: 15464 - DNA, 18 bp, Artificial Sequence
  Synthetic DNA
ttctactactcgctatag

SEQ ID NO: 15465 - DNA, 18 bp, Artificial Sequence
  Synthetic DNA
aaaaacgacccactacag

SEQ ID NO: 15466 - DNA, 18 bp, Artificial Sequence
  Synthetic DNA
aaaaacgacttaatatag

SEQ ID NO: 15467 - DNA, 18 bp, Artificial Sequence
  Synthetic DNA
aaaaaggactcactaaag

SEQ ID NO: 15468 - DNA, 18 bp, Artificial Sequence
  Synthetic DNA
aaaacggactcactatag

SEQ ID NO: 15469 - DNA, 18 bp, Artificial Sequence
  Synthetic DNA
aaacacgactcacactag

SEQ ID NO: 15470 - DNA, 18 bp, Artificial Sequence
  Synthetic DNA
aaacacgacttactttag

SEQ ID NO: 15471 - DNA, 18 bp, Artificial Sequence
  Synthetic DNA
aaagacgactctctctag

SEQ ID NO: 15472 - DNA, 18 bp, Artificial Sequence
  Synthetic DNA
aaagacgagtcactctag

SEQ ID NO: 15473 - DNA, 18 bp, Artificial Sequence
  Synthetic DNA
aaagactactcactgtag

SEQ ID NO: 15474 - DNA, 18 bp, Artificial Sequence
  Synthetic DNA
aaagactactcattatag

SEQ ID NO: 15475 - DNA, 18 bp, Artificial Sequence
  Synthetic DNA
aaagccgactcactgtag

SEQ ID NO: 15476 - DNA, 18 bp, Artificial Sequence
  Synthetic DNA
aaaggcgactcattatag

SEQ ID NO: 15477 - DNA, 18 bp, Artificial Sequence
  Synthetic DNA
aaataagactcaccagag

SEQ ID NO: 15478 - DNA, 18 bp, Artificial Sequence
  Synthetic DNA
aaatacaactcacttcag

SEQ ID NO: 15479 - DNA, 18 bp, Artificial Sequence
  Synthetic DNA
aaataccacgcacaatag

SEQ ID NO: 15480 - DNA, 18 bp, Artificial Sequence
  Synthetic DNA
aaataccactctctacag

SEQ ID NO: 15481 - DNA, 18 bp, Artificial Sequence
  Synthetic DNA
aaataccactgactctag

SEQ ID NO: 15482 - DNA, 18 bp, Artificial Sequence
  Synthetic DNA
aaatacgaaccactacag

SEQ ID NO: 15483 - DNA, 18 bp, Artificial Sequence
  Synthetic DNA
aaatacgaatcaccgtag

SEQ ID NO: 15484 - DNA, 18 bp, Artificial Sequence
  Synthetic DNA
aaatacgaattagtatag

SEQ ID NO: 15485 - DNA, 18 bp, Artificial Sequence
  Synthetic DNA
aaatacgacactctctag

SEQ ID NO: 15486 - DNA, 18 bp, Artificial Sequence
  Synthetic DNA
aaatacgactacccatag

SEQ ID NO: 15487 - DNA, 18 bp, Artificial Sequence
  Synthetic DNA
aaatacgactcaacacag

SEQ ID NO: 15488 - DNA, 18 bp, Artificial Sequence
  Synthetic DNA
aaatacgactcagttaag

SEQ ID NO: 15489 - DNA, 18 bp, Artificial Sequence
  Synthetic DNA
aaatacgactcagttcag

SEQ ID NO: 15490 - DNA, 18 bp, Artificial Sequence
  Synthetic DNA
aaatacgactgaccacag

SEQ ID NO: 15491 - DNA, 18 bp, Artificial Sequence
  Synthetic DNA
aaatacgacttattagag

SEQ ID NO: 15492 - DNA, 18 bp, Artificial Sequence
  Synthetic DNA
aaatacgagtaactttag

SEQ ID NO: 15493 - DNA, 18 bp, Artificial Sequence
  Synthetic DNA
aaatacgagtcacaacag

SEQ ID NO: 15494 - DNA, 18 bp, Artificial Sequence
  Synthetic DNA
aaatacgcttcactagag

SEQ ID NO: 15495 - DNA, 18 bp, Artificial Sequence
  Synthetic DNA
aaatacggctcacttaag

SEQ ID NO: 15496 - DNA, 18 bp, Artificial Sequence
  Synthetic DNA
aaatacgtgtcaccatag

SEQ ID NO: 15497 - DNA, 18 bp, Artificial Sequence
  Synthetic DNA
aaatactactcaacatag

SEQ ID NO: 15498 - DNA, 18 bp, Artificial Sequence
  Synthetic DNA
aaatactactcagtacag

SEQ ID NO: 15499 - DNA, 18 bp, Artificial Sequence
  Synthetic DNA
aaataggaatcactagag

SEQ ID NO: 15500 - DNA, 18 bp, Artificial Sequence
  Synthetic DNA
aaataggactcaccttag

SEQ ID NO: 15501 - DNA, 18 bp, Artificial Sequence
  Synthetic DNA
aaataggactcatcatag

SEQ ID NO: 15502 - DNA, 18 bp, Artificial Sequence
  Synthetic DNA
aaataggtctgactatag

SEQ ID NO: 15503 - DNA, 18 bp, Artificial Sequence
  Synthetic DNA
aaatatgacacactgtag

SEQ ID NO: 15504 - DNA, 18 bp, Artificial Sequence
  Synthetic DNA
aaatatgactcacaataa

SEQ ID NO: 15505 - DNA, 18 bp, Artificial Sequence
  Synthetic DNA
aaatatgactctgtatag

SEQ ID NO: 15506 - DNA, 18 bp, Artificial Sequence
  Synthetic DNA
aaatatgactgactatgg

SEQ ID NO: 15507 - DNA, 18 bp, Artificial Sequence
  Synthetic DNA
aaatccaattcactatag

SEQ ID NO: 15508 - DNA, 18 bp, Artificial Sequence
  Synthetic DNA
aaatccgaatcattatag

SEQ ID NO: 15509 - DNA, 18 bp, Artificial Sequence
  Synthetic DNA
aaatccgacacaccatag

SEQ ID NO: 15510 - DNA, 18 bp, Artificial Sequence
  Synthetic DNA
aaatcggactaactatag

SEQ ID NO: 15511 - DNA, 18 bp, Artificial Sequence
  Synthetic DNA
aaatgcgaatcactaaag

SEQ ID NO: 15512 - DNA, 18 bp, Artificial Sequence
  Synthetic DNA
aaatgcgaattactatag

SEQ ID NO: 15513 - DNA, 18 bp, Artificial Sequence
  Synthetic DNA
aaatgcgactctctaaag

SEQ ID NO: 15514 - DNA, 18 bp, Artificial Sequence
  Synthetic DNA
aaatgcgtctaactatag

SEQ ID NO: 15515 - DNA, 18 bp, Artificial Sequence
  Synthetic DNA
aaatgcgtttcactatag

SEQ ID NO: 15516 - DNA, 18 bp, Artificial Sequence
  Synthetic DNA
aagaacgactcacaatag

SEQ ID NO: 15517 - DNA, 18 bp, Artificial Sequence
  Synthetic DNA
aagtacaattcactatag

SEQ ID NO: 15518 - DNA, 18 bp, Artificial Sequence
  Synthetic DNA
aagtacggctcactaaag

SEQ ID NO: 15519 - DNA, 18 bp, Artificial Sequence
  Synthetic DNA
aagtaggactcacgatag

SEQ ID NO: 15520 - DNA, 18 bp, Artificial Sequence
  Synthetic DNA
aagtgcgcctcactatag

SEQ ID NO: 15521 - DNA, 18 bp, Artificial Sequence
  Synthetic DNA
aatgacgactcactacag

SEQ ID NO: 15522 - DNA, 18 bp, Artificial Sequence
  Synthetic DNA
aattacgactcactccag

SEQ ID NO: 15523 - DNA, 18 bp, Artificial Sequence
  Synthetic DNA
aattacgactcactgtgg

SEQ ID NO: 15524 - DNA, 18 bp, Artificial Sequence
  Synthetic DNA
aattaggactcactttag

SEQ ID NO: 15525 - DNA, 18 bp, Artificial Sequence
  Synthetic DNA
acacacgactcactctag

SEQ ID NO: 15526 - DNA, 18 bp, Artificial Sequence
  Synthetic DNA
acatacgaccccctatag

SEQ ID NO: 15527 - DNA, 18 bp, Artificial Sequence
  Synthetic DNA
acatacgacgcaatatag

SEQ ID NO: 15528 - DNA, 18 bp, Artificial Sequence
  Synthetic DNA
acatacgagtaactatag

SEQ ID NO: 15529 - DNA, 18 bp, Artificial Sequence
  Synthetic DNA
agaaacgtctcactatag

SEQ ID NO: 15530 - DNA, 18 bp, Artificial Sequence
  Synthetic DNA
agttacgactgactatag

SEQ ID NO: 15531 - DNA, 18 bp, Artificial Sequence
  Synthetic DNA
atagaagactcactatag

SEQ ID NO: 15532 - DNA, 18 bp, Artificial Sequence
  Synthetic DNA
atagacgagtcactatag

SEQ ID NO: 15533 - DNA, 18 bp, Artificial Sequence
  Synthetic DNA
atatacgaatcactagag

SEQ ID NO: 15534 - DNA, 18 bp, Artificial Sequence
  Synthetic DNA
atataggactcactatgg

SEQ ID NO: 15535 - DNA, 18 bp, Artificial Sequence
  Synthetic DNA
caaaacaacacactatag

SEQ ID NO: 15536 - DNA, 18 bp, Artificial Sequence
  Synthetic DNA
caaaacgactaactacag

SEQ ID NO: 15537 - DNA, 18 bp, Artificial Sequence
  Synthetic DNA
caaaacgactcacaaaag

SEQ ID NO: 15538 - DNA, 18 bp, Artificial Sequence
  Synthetic DNA
caaaacgactcataatag

SEQ ID NO: 15539 - DNA, 18 bp, Artificial Sequence
  Synthetic DNA
caaacggactcactatag

SEQ ID NO: 15540 - DNA, 18 bp, Artificial Sequence
  Synthetic DNA
caacacaactcactctag

SEQ ID NO: 15541 - DNA, 18 bp, Artificial Sequence
  Synthetic DNA
caacacgactcccaatag

SEQ ID NO: 15542 - DNA, 18 bp, Artificial Sequence
  Synthetic DNA
caacacgactctctagag

SEQ ID NO: 15543 - DNA, 18 bp, Artificial Sequence
  Synthetic DNA
caacacgagtcactctag

SEQ ID NO: 15544 - DNA, 18 bp, Artificial Sequence
  Synthetic DNA
caataagacccactaaag

SEQ ID NO: 15545 - DNA, 18 bp, Artificial Sequence
  Synthetic DNA
caatacaaatcactatgg

SEQ ID NO: 15546 - DNA, 18 bp, Artificial Sequence
  Synthetic DNA
caatacaacccactttag

SEQ ID NO: 15547 - DNA, 18 bp, Artificial Sequence
  Synthetic DNA
caatacgacgcactaggg

SEQ ID NO: 15548 - DNA, 18 bp, Artificial Sequence
  Synthetic DNA
caatacgactcacaaacg

SEQ ID NO: 15549 - DNA, 18 bp, Artificial Sequence
  Synthetic DNA
caatacgccgcacaatag

SEQ ID NO: 15550 - DNA, 18 bp, Artificial Sequence
  Synthetic DNA
caatacgcctaactacag

SEQ ID NO: 15551 - DNA, 18 bp, Artificial Sequence
  Synthetic DNA
caatacgcttcactatcg

SEQ ID NO: 15552 - DNA, 18 bp, Artificial Sequence
  Synthetic DNA
caatacggatcacaatag

SEQ ID NO: 15553 - DNA, 18 bp, Artificial Sequence
  Synthetic DNA
caatacggcttaccatag

SEQ ID NO: 15554 - DNA, 18 bp, Artificial Sequence
  Synthetic DNA
caatactaatcactatgg

SEQ ID NO: 15555 - DNA, 18 bp, Artificial Sequence
  Synthetic DNA
caatactactcacttgag

SEQ ID NO: 15556 - DNA, 18 bp, Artificial Sequence
  Synthetic DNA
caataggaatcactaaag

SEQ ID NO: 15557 - DNA, 18 bp, Artificial Sequence
  Synthetic DNA
caataggactgcctatag

SEQ ID NO: 15558 - DNA, 18 bp, Artificial Sequence
  Synthetic DNA
caataggatccactatag

SEQ ID NO: 15559 - DNA, 18 bp, Artificial Sequence
  Synthetic DNA
caatatgactctatatag

SEQ ID NO: 15560 - DNA, 18 bp, Artificial Sequence
  Synthetic DNA
caatccgacacactttag

SEQ ID NO: 15561 - DNA, 18 bp, Artificial Sequence
  Synthetic DNA
caatccgactaactaaag

SEQ ID NO: 15562 - DNA, 18 bp, Artificial Sequence
  Synthetic DNA
caatccgactaactttag

SEQ ID NO: 15563 - DNA, 18 bp, Artificial Sequence
  Synthetic DNA
caatccgcctcacaatag

SEQ ID NO: 15564 - DNA, 18 bp, Artificial Sequence
  Synthetic DNA
caatcctactgactatag

SEQ ID NO: 15565 - DNA, 18 bp, Artificial Sequence
  Synthetic DNA
caatgcgactcacttaag

SEQ ID NO: 15566 - DNA, 18 bp, Artificial Sequence
  Synthetic DNA
caatgcgactctctatcg

SEQ ID NO: 15567 - DNA, 18 bp, Artificial Sequence
  Synthetic DNA
cactaccactaactatag

SEQ ID NO: 15568 - DNA, 18 bp, Artificial Sequence
  Synthetic DNA
cactacgattcactacag

SEQ ID NO: 15569 - DNA, 18 bp, Artificial Sequence
  Synthetic DNA
cagtacgacactctatag

SEQ ID NO: 15570 - DNA, 18 bp, Artificial Sequence
  Synthetic DNA
cagtacgacttaccatag

SEQ ID NO: 15571 - DNA, 18 bp, Artificial Sequence
  Synthetic DNA
cagtacgccccactatag

SEQ ID NO: 15572 - DNA, 18 bp, Artificial Sequence
  Synthetic DNA
cagtgagactcactatag

SEQ ID NO: 15573 - DNA, 18 bp, Artificial Sequence
  Synthetic DNA
cattgcgactcagtatag

SEQ ID NO: 15574 - DNA, 18 bp, Artificial Sequence
  Synthetic DNA
ccatgcgagtcactatag

SEQ ID NO: 15575 - DNA, 18 bp, Artificial Sequence
  Synthetic DNA
cgatacgactcacgaaag

SEQ ID NO: 15576 - DNA, 18 bp, Artificial Sequence
  Synthetic DNA
cgctacgactcactaaag

SEQ ID NO: 15577 - DNA, 18 bp, Artificial Sequence
  Synthetic DNA
ctagacgactcactttag

SEQ ID NO: 15578 - DNA, 18 bp, Artificial Sequence
  Synthetic DNA
ctagacgactccctatag

SEQ ID NO: 15579 - DNA, 18 bp, Artificial Sequence
  Synthetic DNA
ctatacgactcagtatcg

SEQ ID NO: 15580 - DNA, 18 bp, Artificial Sequence
  Synthetic DNA
ctatacgacttactatcg

SEQ ID NO: 15581 - DNA, 18 bp, Artificial Sequence
  Synthetic DNA
ctctacgactcactatcg

SEQ ID NO: 15582 - DNA, 18 bp, Artificial Sequence
  Synthetic DNA
gaaaacgacacactaaag

SEQ ID NO: 15583 - DNA, 18 bp, Artificial Sequence
  Synthetic DNA
gaaaacgatttactatag

SEQ ID NO: 15584 - DNA, 18 bp, Artificial Sequence
  Synthetic DNA
gaaaacgtttcactatag

SEQ ID NO: 15585 - DNA, 18 bp, Artificial Sequence
  Synthetic DNA
gaacacgtctcactgtag

SEQ ID NO: 15586 - DNA, 18 bp, Artificial Sequence
  Synthetic DNA
gaacgcgactcaccatag

SEQ ID NO: 15587 - DNA, 18 bp, Artificial Sequence
  Synthetic DNA
gaatacgacttcctacag

SEQ ID NO: 15588 - DNA, 18 bp, Artificial Sequence
  Synthetic DNA
gaatacgattcacttgag

SEQ ID NO: 15589 - DNA, 18 bp, Artificial Sequence
  Synthetic DNA
gaatacgattctctacag

SEQ ID NO: 15590 - DNA, 18 bp, Artificial Sequence
  Synthetic DNA
gaatactaccaactatag

SEQ ID NO: 15591 - DNA, 18 bp, Artificial Sequence
  Synthetic DNA
gaatccatctcactatag

SEQ ID NO: 15592 - DNA, 18 bp, Artificial Sequence
  Synthetic DNA
gaatgcgattcactatcg

SEQ ID NO: 15593 - DNA, 18 bp, Artificial Sequence
  Synthetic DNA
gagtacgcctcacaatag

SEQ ID NO: 15594 - DNA, 18 bp, Artificial Sequence
  Synthetic DNA
ggatactactcaatatag

SEQ ID NO: 15595 - DNA, 18 bp, Artificial Sequence
  Synthetic DNA
gtatacgactcacaatcg

SEQ ID NO: 15596 - DNA, 18 bp, Artificial Sequence
  Synthetic DNA
gtatactacacactatag

SEQ ID NO: 15597 - DNA, 18 bp, Artificial Sequence
  Synthetic DNA
gtatatgtctcactatag

SEQ ID NO: 15598 - DNA, 18 bp, Artificial Sequence
  Synthetic DNA
gtatccgtctcactatag

SEQ ID NO: 15599 - DNA, 18 bp, Artificial Sequence
  Synthetic DNA
taaaaagactcactttgg

SEQ ID NO: 15600 - DNA, 18 bp, Artificial Sequence
  Synthetic DNA
taaaaagactccctgtag

SEQ ID NO: 15601 - DNA, 18 bp, Artificial Sequence
  Synthetic DNA
taaaacaactcactcgag

SEQ ID NO: 15602 - DNA, 18 bp, Artificial Sequence
  Synthetic DNA
taaaacccctctctatag

SEQ ID NO: 15603 - DNA, 18 bp, Artificial Sequence
  Synthetic DNA
taaaacgaatcactaagg

SEQ ID NO: 15604 - DNA, 18 bp, Artificial Sequence
  Synthetic DNA
taaaacgaccctctacag

SEQ ID NO: 15605 - DNA, 18 bp, Artificial Sequence
  Synthetic DNA
taaaacgactcagtaacg

SEQ ID NO: 15606 - DNA, 18 bp, Artificial Sequence
  Synthetic DNA
taaaacgactccccatgg

SEQ ID NO: 15607 - DNA, 18 bp, Artificial Sequence
  Synthetic DNA
taaaacgacttaccatcg

SEQ ID NO: 15608 - DNA, 18 bp, Artificial Sequence
  Synthetic DNA
taaaacgagtcaatagag

SEQ ID NO: 15609 - DNA, 18 bp, Artificial Sequence
  Synthetic DNA
taaaacgagtctccatag

SEQ ID NO: 15610 - DNA, 18 bp, Artificial Sequence
  Synthetic DNA
taaaacgattaactagag

SEQ ID NO: 15611 - DNA, 18 bp, Artificial Sequence
  Synthetic DNA
taaaacgcctcaataaag

SEQ ID NO: 15612 - DNA, 18 bp, Artificial Sequence
  Synthetic DNA
taaaacgccttagtatag

SEQ ID NO: 15613 - DNA, 18 bp, Artificial Sequence
  Synthetic DNA
taaaacgtctcagtatcg

SEQ ID NO: 15614 - DNA, 18 bp, Artificial Sequence
  Synthetic DNA
taaaacgtgtcactatgg

SEQ ID NO: 15615 - DNA, 18 bp, Artificial Sequence
  Synthetic DNA
taaaactacacacgatag

SEQ ID NO: 15616 - DNA, 18 bp, Artificial Sequence
  Synthetic DNA
taaaaggacacactttag

SEQ ID NO: 15617 - DNA, 18 bp, Artificial Sequence
  Synthetic DNA
taaaaggaccgactatag

SEQ ID NO: 15618 - DNA, 18 bp, Artificial Sequence
  Synthetic DNA
taaaaggactcaatgtag

SEQ ID NO: 15619 - DNA, 18 bp, Artificial Sequence
  Synthetic DNA
taaaaggactctccatag

SEQ ID NO: 15620 - DNA, 18 bp, Artificial Sequence
  Synthetic DNA
taaaatgactccctatcg

SEQ ID NO: 15621 - DNA, 18 bp, Artificial Sequence
  Synthetic DNA
taaaattactcactgtag

SEQ ID NO: 15622 - DNA, 18 bp, Artificial Sequence
  Synthetic DNA
taaaccgactcacaatcg

SEQ ID NO: 15623 - DNA, 18 bp, Artificial Sequence
  Synthetic DNA
taaaccgactcacgatcg

SEQ ID NO: 15624 - DNA, 18 bp, Artificial Sequence
  Synthetic DNA
taaaccgattcattatag

SEQ ID NO: 15625 - DNA, 18 bp, Artificial Sequence
  Synthetic DNA
taaaccggctcactttag

SEQ ID NO: 15626 - DNA, 18 bp, Artificial Sequence
  Synthetic DNA
taaagaggctcactatag

SEQ ID NO: 15627 - DNA, 18 bp, Artificial Sequence
  Synthetic DNA
taaagcaactcactaaag

SEQ ID NO: 15628 - DNA, 18 bp, Artificial Sequence
  Synthetic DNA
taaagcgactaactaaag

SEQ ID NO: 15629 - DNA, 18 bp, Artificial Sequence
  Synthetic DNA
taaagcggctcaccatag

SEQ ID NO: 15630 - DNA, 18 bp, Artificial Sequence
  Synthetic DNA
taaagcgtctcactatgg

SEQ ID NO: 15631 - DNA, 18 bp, Artificial Sequence
  Synthetic DNA
taacaagacacattatag

SEQ ID NO: 15632 - DNA, 18 bp, Artificial Sequence
  Synthetic DNA
taacacgaatgattatag

SEQ ID NO: 15633 - DNA, 18 bp, Artificial Sequence
  Synthetic DNA
taacacgactaacaatgg

SEQ ID NO: 15634 - DNA, 18 bp, Artificial Sequence
  Synthetic DNA
taacacgtctctctatgg

SEQ ID NO: 15635 - DNA, 18 bp, Artificial Sequence
  Synthetic DNA
taacacgtgccactatag

SEQ ID NO: 15636 - DNA, 18 bp, Artificial Sequence
  Synthetic DNA
taacactactcatcatag

SEQ ID NO: 15637 - DNA, 18 bp, Artificial Sequence
  Synthetic DNA
taacactactcattagag

SEQ ID NO: 15638 - DNA, 18 bp, Artificial Sequence
  Synthetic DNA
taacactactgactttag

SEQ ID NO: 15639 - DNA, 18 bp, Artificial Sequence
  Synthetic DNA
taacaggactaactagag

SEQ ID NO: 15640 - DNA, 18 bp, Artificial Sequence
  Synthetic DNA
taacccgatccactatag

SEQ ID NO: 15641 - DNA, 18 bp, Artificial Sequence
  Synthetic DNA
taacccgattcagtatag

SEQ ID NO: 15642 - DNA, 18 bp, Artificial Sequence
  Synthetic DNA
taacgcgactcacaaaag

SEQ ID NO: 15643 - DNA, 18 bp, Artificial Sequence
  Synthetic DNA
taacgcgagtaactatag

SEQ ID NO: 15644 - DNA, 18 bp, Artificial Sequence
  Synthetic DNA
taacgcgcctaactatag

SEQ ID NO: 15645 - DNA, 18 bp, Artificial Sequence
  Synthetic DNA
taacgcgcctcattatag

SEQ ID NO: 15646 - DNA, 18 bp, Artificial Sequence
  Synthetic DNA
taagaagacatactatag

SEQ ID NO: 15647 - DNA, 18 bp, Artificial Sequence
  Synthetic DNA
taagacgaatcataatag

SEQ ID NO: 15648 - DNA, 18 bp, Artificial Sequence
  Synthetic DNA
taagacgacctacgatag

SEQ ID NO: 15649 - DNA, 18 bp, Artificial Sequence
  Synthetic DNA
taagactactcacagtag

SEQ ID NO: 15650 - DNA, 18 bp, Artificial Sequence
  Synthetic DNA
taagaggactcacattag

SEQ ID NO: 15651 - DNA, 18 bp, Artificial Sequence
  Synthetic DNA
taagatcactcactatcg

SEQ ID NO: 15652 - DNA, 18 bp, Artificial Sequence
  Synthetic DNA
taagatgacatactatag

SEQ ID NO: 15653 - DNA, 18 bp, Artificial Sequence
  Synthetic DNA
taagatgactctctttag

SEQ ID NO: 15654 - DNA, 18 bp, Artificial Sequence
  Synthetic DNA
taagatgtctcaatatag

SEQ ID NO: 15655 - DNA, 18 bp, Artificial Sequence
  Synthetic DNA
taagattagtcactatag

SEQ ID NO: 15656 - DNA, 18 bp, Artificial Sequence
  Synthetic DNA
taagcagtctcactatag

SEQ ID NO: 15657 - DNA, 18 bp, Artificial Sequence
  Synthetic DNA
taagccgacccactaaag

SEQ ID NO: 15658 - DNA, 18 bp, Artificial Sequence
  Synthetic DNA
taagccgactctctctag

SEQ ID NO: 15659 - DNA, 18 bp, Artificial Sequence
  Synthetic DNA
taaggcaactcactttag

SEQ ID NO: 15660 - DNA, 18 bp, Artificial Sequence
  Synthetic DNA
taataaaactcatgatag

SEQ ID NO: 15661 - DNA, 18 bp, Artificial Sequence
  Synthetic DNA
taataaaactctctagag

SEQ ID NO: 15662 - DNA, 18 bp, Artificial Sequence
  Synthetic DNA
taataaaatccactatag

SEQ ID NO: 15663 - DNA, 18 bp, Artificial Sequence
  Synthetic DNA
taataaagatcactatag

SEQ ID NO: 15664 - DNA, 18 bp, Artificial Sequence
  Synthetic DNA
taataacaatccctatag

SEQ ID NO: 15665 - DNA, 18 bp, Artificial Sequence
  Synthetic DNA
taataactctcaatatag

SEQ ID NO: 15666 - DNA, 18 bp, Artificial Sequence
  Synthetic DNA
taataagaatcaatatcg

SEQ ID NO: 15667 - DNA, 18 bp, Artificial Sequence
  Synthetic DNA
taataagaatcaccttag

SEQ ID NO: 15668 - DNA, 18 bp, Artificial Sequence
  Synthetic DNA
taataagaatgagtatag

SEQ ID NO: 15669 - DNA, 18 bp, Artificial Sequence
  Synthetic DNA
taataagacgcataatag

SEQ ID NO: 15670 - DNA, 18 bp, Artificial Sequence
  Synthetic DNA
taataagactaaatgtag

SEQ ID NO: 15671 - DNA, 18 bp, Artificial Sequence
  Synthetic DNA
taataagactaaccatgg

SEQ ID NO: 15672 - DNA, 18 bp, Artificial Sequence
  Synthetic DNA
taataagactcaatctgg

SEQ ID NO: 15673 - DNA, 18 bp, Artificial Sequence
  Synthetic DNA
taataagactcacttggg

SEQ ID NO: 15674 - DNA, 18 bp, Artificial Sequence
  Synthetic DNA
taataagactcataatcg

SEQ ID NO: 15675 - DNA, 18 bp, Artificial Sequence
  Synthetic DNA
taataagactccctttcg

SEQ ID NO: 15676 - DNA, 18 bp, Artificial Sequence
  Synthetic DNA
taataagactctctctgg

SEQ ID NO: 15677 - DNA, 18 bp, Artificial Sequence
  Synthetic DNA
taataagagtcattatcg

SEQ ID NO: 15678 - DNA, 18 bp, Artificial Sequence
  Synthetic DNA
taataagtatcactgtag

SEQ ID NO: 15679 - DNA, 18 bp, Artificial Sequence
  Synthetic DNA
taataagtccaactatag

SEQ ID NO: 15680 - DNA, 18 bp, Artificial Sequence
  Synthetic DNA
taataagtcttactagag

SEQ ID NO: 15681 - DNA, 18 bp, Artificial Sequence
  Synthetic DNA
taataatactcaaaatag

SEQ ID NO: 15682 - DNA, 18 bp, Artificial Sequence
  Synthetic DNA
taataatactcaccatcg

SEQ ID NO: 15683 - DNA, 18 bp, Artificial Sequence
  Synthetic DNA
taataatagttactatag

SEQ ID NO: 15684 - DNA, 18 bp, Artificial Sequence
  Synthetic DNA
taatacaaatcaatacag

SEQ ID NO: 15685 - DNA, 18 bp, Artificial Sequence
  Synthetic DNA
taatacaaatccatatag

SEQ ID NO: 15686 - DNA, 18 bp, Artificial Sequence
  Synthetic DNA
taatacaaatccttatag

SEQ ID NO: 15687 - DNA, 18 bp, Artificial Sequence
  Synthetic DNA
taatacaacccagtagag

SEQ ID NO: 15688 - DNA, 18 bp, Artificial Sequence
  Synthetic DNA
taatacaagtaactatcg

SEQ ID NO: 15689 - DNA, 18 bp, Artificial Sequence
  Synthetic DNA
taatacagccccctatag

SEQ ID NO: 15690 - DNA, 18 bp, Artificial Sequence
  Synthetic DNA
taatacagctcagtaaag

SEQ ID NO: 15691 - DNA, 18 bp, Artificial Sequence
  Synthetic DNA
taatacatctcaccacag

SEQ ID NO: 15692 - DNA, 18 bp, Artificial Sequence
  Synthetic DNA
taatacatctcaccgtag

SEQ ID NO: 15693 - DNA, 18 bp, Artificial Sequence
  Synthetic DNA
taatacatctcactggag

SEQ ID NO: 15694 - DNA, 18 bp, Artificial Sequence
  Synthetic DNA
taatacatctgcctatag

SEQ ID NO: 15695 - DNA, 18 bp, Artificial Sequence
  Synthetic DNA
taataccacgctctttag

SEQ ID NO: 15696 - DNA, 18 bp, Artificial Sequence
  Synthetic DNA
taataccactcagaaaag

SEQ ID NO: 15697 - DNA, 18 bp, Artificial Sequence
  Synthetic DNA
taataccacttacaagag

SEQ ID NO: 15698 - DNA, 18 bp, Artificial Sequence
  Synthetic DNA
taataccatccaatatag

SEQ ID NO: 15699 - DNA, 18 bp, Artificial Sequence
  Synthetic DNA
taataccattcaatatcg

SEQ ID NO: 15700 - DNA, 18 bp, Artificial Sequence
  Synthetic DNA
taataccatttactatcg

SEQ ID NO: 15701 - DNA, 18 bp, Artificial Sequence
  Synthetic DNA
taataccgatcattatag

SEQ ID NO: 15702 - DNA, 18 bp, Artificial Sequence
  Synthetic DNA
taatacgaaaccctctag

SEQ ID NO: 15703 - DNA, 18 bp, Artificial Sequence
  Synthetic DNA
taatacgaaatactatgg

SEQ ID NO: 15704 - DNA, 18 bp, Artificial Sequence
  Synthetic DNA
taatacgaactattatag

SEQ ID NO: 15705 - DNA, 18 bp, Artificial Sequence
  Synthetic DNA
taatacgaacttctatag

SEQ ID NO: 15706 - DNA, 18 bp, Artificial Sequence
  Synthetic DNA
taatacgacaaactggag

SEQ ID NO: 15707 - DNA, 18 bp, Artificial Sequence
  Synthetic DNA
taatacgacacagcatcg

SEQ ID NO: 15708 - DNA, 18 bp, Artificial Sequence
  Synthetic DNA
taatacgacaccctagcg

SEQ ID NO: 15709 - DNA, 18 bp, Artificial Sequence
  Synthetic DNA
taatacgacataatgtag

SEQ ID NO: 15710 - DNA, 18 bp, Artificial Sequence
  Synthetic DNA
taatacgaccctgtagag

SEQ ID NO: 15711 - DNA, 18 bp, Artificial Sequence
  Synthetic DNA
taatacgaccgataatag

SEQ ID NO: 15712 - DNA, 18 bp, Artificial Sequence
  Synthetic DNA
taatacgaccgccaatag

SEQ ID NO: 15713 - DNA, 18 bp, Artificial Sequence
  Synthetic DNA
taatacgacgctttatgg

SEQ ID NO: 15714 - DNA, 18 bp, Artificial Sequence
  Synthetic DNA
taatacgactcaattagg

SEQ ID NO: 15715 - DNA, 18 bp, Artificial Sequence
  Synthetic DNA
taatacgactcactggcc

SEQ ID NO: 15716 - DNA, 18 bp, Artificial Sequence
  Synthetic DNA
taatacgactcatcaagg

SEQ ID NO: 15717 - DNA, 18 bp, Artificial Sequence
  Synthetic DNA
taatacgactcccccaag

SEQ ID NO: 15718 - DNA, 18 bp, Artificial Sequence
  Synthetic DNA
taatacgactctcggcag

SEQ ID NO: 15719 - DNA, 18 bp, Artificial Sequence
  Synthetic DNA
taatacgactgacttacg

SEQ ID NO: 15720 - DNA, 18 bp, Artificial Sequence
  Synthetic DNA
taatacgacttactcagg

SEQ ID NO: 15721 - DNA, 18 bp, Artificial Sequence
  Synthetic DNA
taatacgacttagttaag

SEQ ID NO: 15722 - DNA, 18 bp, Artificial Sequence
  Synthetic DNA
taatacgacttataagag

SEQ ID NO: 15723 - DNA, 18 bp, Artificial Sequence
  Synthetic DNA
taatacgagacactggag

SEQ ID NO: 15724 - DNA, 18 bp, Artificial Sequence
  Synthetic DNA
taatacgagtaactaacg

SEQ ID NO: 15725 - DNA, 18 bp, Artificial Sequence
  Synthetic DNA
taatacgatagactatcg

SEQ ID NO: 15726 - DNA, 18 bp, Artificial Sequence
  Synthetic DNA
taatacgatagagtatag

SEQ ID NO: 15727 - DNA, 18 bp, Artificial Sequence
  Synthetic DNA
taatacgattcacacgag

SEQ ID NO: 15728 - DNA, 18 bp, Artificial Sequence
  Synthetic DNA
taatacgcatcaatgtag

SEQ ID NO: 15729 - DNA, 18 bp, Artificial Sequence
  Synthetic DNA
taatacgcattacaatag

SEQ ID NO: 15730 - DNA, 18 bp, Artificial Sequence
  Synthetic DNA
taatacgcctcaataacg

SEQ ID NO: 15731 - DNA, 18 bp, Artificial Sequence
  Synthetic DNA
taatacgcctcccagtag

SEQ ID NO: 15732 - DNA, 18 bp, Artificial Sequence
  Synthetic DNA
taatacgcgccactttag

SEQ ID NO: 15733 - DNA, 18 bp, Artificial Sequence
  Synthetic DNA
taatacgctgcactaaag

SEQ ID NO: 15734 - DNA, 18 bp, Artificial Sequence
  Synthetic DNA
taatacggaccactaaag

SEQ ID NO: 15735 - DNA, 18 bp, Artificial Sequence
  Synthetic DNA
taatacggatccctacag

SEQ ID NO: 15736 - DNA, 18 bp, Artificial Sequence
  Synthetic DNA
taatacggctaactccag

SEQ ID NO: 15737 - DNA, 18 bp, Artificial Sequence
  Synthetic DNA
taatacggctcaatttcg

SEQ ID NO: 15738 - DNA, 18 bp, Artificial Sequence
  Synthetic DNA
taatacggctcattcaag

SEQ ID NO: 15739 - DNA, 18 bp, Artificial Sequence
  Synthetic DNA
taatacggtttactatcg

SEQ ID NO: 15740 - DNA, 18 bp, Artificial Sequence
  Synthetic DNA
taatacgtatcagtttag

SEQ ID NO: 15741 - DNA, 18 bp, Artificial Sequence
  Synthetic DNA
taatacgtcacacaataa

SEQ ID NO: 15742 - DNA, 18 bp, Artificial Sequence
  Synthetic DNA
taatacgtcactctctag

SEQ ID NO: 15743 - DNA, 18 bp, Artificial Sequence
  Synthetic DNA
taatacgtcgcattaaag

SEQ ID NO: 15744 - DNA, 18 bp, Artificial Sequence
  Synthetic DNA
taatacgtcggactttag

SEQ ID NO: 15745 - DNA, 18 bp, Artificial Sequence
  Synthetic DNA
taatacgtctaagtatgg

SEQ ID NO: 15746 - DNA, 18 bp, Artificial Sequence
  Synthetic DNA
taatacgtctccggatag

SEQ ID NO: 15747 - DNA, 18 bp, Artificial Sequence
  Synthetic DNA
taatacgtctgacttcag

SEQ ID NO: 15748 - DNA, 18 bp, Artificial Sequence
  Synthetic DNA
taatacgtgccaccatag

SEQ ID NO: 15749 - DNA, 18 bp, Artificial Sequence
  Synthetic DNA
taatacgttctactatag

SEQ ID NO: 15750 - DNA, 18 bp, Artificial Sequence
  Synthetic DNA
taatacgtttccctgtag

SEQ ID NO: 15751 - DNA, 18 bp, Artificial Sequence
  Synthetic DNA
taatacgtttgactgtag

SEQ ID NO: 15752 - DNA, 18 bp, Artificial Sequence
  Synthetic DNA
taatactaatccctatcg

SEQ ID NO: 15753 - DNA, 18 bp, Artificial Sequence
  Synthetic DNA
taatactacacacgacag

SEQ ID NO: 15754 - DNA, 18 bp, Artificial Sequence
  Synthetic DNA
taatactactcaatcaag

SEQ ID NO: 15755 - DNA, 18 bp, Artificial Sequence
  Synthetic DNA
taatactactcacattgg

SEQ ID NO: 15756 - DNA, 18 bp, Artificial Sequence
  Synthetic DNA
taatactactccagatag

SEQ ID NO: 15757 - DNA, 18 bp, Artificial Sequence
  Synthetic DNA
taatactactgaccaaag

SEQ ID NO: 15758 - DNA, 18 bp, Artificial Sequence
  Synthetic DNA
taatactcgtcacaatag

SEQ ID NO: 15759 - DNA, 18 bp, Artificial Sequence
  Synthetic DNA
taatacttctaactagag

SEQ ID NO: 15760 - DNA, 18 bp, Artificial Sequence
  Synthetic DNA
taatacttctccctgtag

SEQ ID NO: 15761 - DNA, 18 bp, Artificial Sequence
  Synthetic DNA
taatagcaatcactatgg

SEQ ID NO: 15762 - DNA, 18 bp, Artificial Sequence
  Synthetic DNA
taataggactcaccggag

SEQ ID NO: 15763 - DNA, 18 bp, Artificial Sequence
  Synthetic DNA
taataggactcagaaaag

SEQ ID NO: 15764 - DNA, 18 bp, Artificial Sequence
  Synthetic DNA
taataggactcagaagag

SEQ ID NO: 15765 - DNA, 18 bp, Artificial Sequence
  Synthetic DNA
taataggatccagtatag

SEQ ID NO: 15766 - DNA, 18 bp, Artificial Sequence
  Synthetic DNA
taataggccacacgatag

SEQ ID NO: 15767 - DNA, 18 bp, Artificial Sequence
  Synthetic DNA
taatagtaattactatag

SEQ ID NO: 15768 - DNA, 18 bp, Artificial Sequence
  Synthetic DNA
taatataaatcactgtag

SEQ ID NO: 15769 - DNA, 18 bp, Artificial Sequence
  Synthetic DNA
taatataacagactatag

SEQ ID NO: 15770 - DNA, 18 bp, Artificial Sequence
  Synthetic DNA
taatataactctctgtag

SEQ ID NO: 15771 - DNA, 18 bp, Artificial Sequence
  Synthetic DNA
taatataatttactatag

SEQ ID NO: 15772 - DNA, 18 bp, Artificial Sequence
  Synthetic DNA
taatatgaattactgtag

SEQ ID NO: 15773 - DNA, 18 bp, Artificial Sequence
  Synthetic DNA
taatatgacacaggatag

SEQ ID NO: 15774 - DNA, 18 bp, Artificial Sequence
  Synthetic DNA
taatatgacataccatag

SEQ ID NO: 15775 - DNA, 18 bp, Artificial Sequence
  Synthetic DNA
taatatgactcaataccg

SEQ ID NO: 15776 - DNA, 18 bp, Artificial Sequence
  Synthetic DNA
taatatgactcactacct

SEQ ID NO: 15777 - DNA, 18 bp, Artificial Sequence
  Synthetic DNA
taatatgactctctgcag

SEQ ID NO: 15778 - DNA, 18 bp, Artificial Sequence
  Synthetic DNA
taatatgactctcttgag

SEQ ID NO: 15779 - DNA, 18 bp, Artificial Sequence
  Synthetic DNA
taatatgacttactaagg

SEQ ID NO: 15780 - DNA, 18 bp, Artificial Sequence
  Synthetic DNA
taatatgactttctgtag

SEQ ID NO: 15781 - DNA, 18 bp, Artificial Sequence
  Synthetic DNA
taatatgagtcccaatag

SEQ ID NO: 15782 - DNA, 18 bp, Artificial Sequence
  Synthetic DNA
taatatgtctcactttgg

SEQ ID NO: 15783 - DNA, 18 bp, Artificial Sequence
  Synthetic DNA
taatatgtctgactaaag

SEQ ID NO: 15784 - DNA, 18 bp, Artificial Sequence
  Synthetic DNA
taatattactaattatag

SEQ ID NO: 15785 - DNA, 18 bp, Artificial Sequence
  Synthetic DNA
taatattactccttatag

SEQ ID NO: 15786 - DNA, 18 bp, Artificial Sequence
  Synthetic DNA
taatcaggctcactatcg

SEQ ID NO: 15787 - DNA, 18 bp, Artificial Sequence
  Synthetic DNA
taatccaacacactctag

SEQ ID NO: 15788 - DNA, 18 bp, Artificial Sequence
  Synthetic DNA
taatccaacccaccatag

SEQ ID NO: 15789 - DNA, 18 bp, Artificial Sequence
  Synthetic DNA
taatccaactcacttgag

SEQ ID NO: 15790 - DNA, 18 bp, Artificial Sequence
  Synthetic DNA
taatccgactaacactag

SEQ ID NO: 15791 - DNA, 18 bp, Artificial Sequence
  Synthetic DNA
taatccgagtctcaatag

SEQ ID NO: 15792 - DNA, 18 bp, Artificial Sequence
  Synthetic DNA
taatccgattcactttcg

SEQ ID NO: 15793 - DNA, 18 bp, Artificial Sequence
  Synthetic DNA
taatccgattctctataa

SEQ ID NO: 15794 - DNA, 18 bp, Artificial Sequence
  Synthetic DNA
taatccgcttcattatag

SEQ ID NO: 15795 - DNA, 18 bp, Artificial Sequence
  Synthetic DNA
taatccggcccactatgg

SEQ ID NO: 15796 - DNA, 18 bp, Artificial Sequence
  Synthetic DNA
taatccgtcgaactatag

SEQ ID NO: 15797 - DNA, 18 bp, Artificial Sequence
  Synthetic DNA
taatccgtgtcactttag

SEQ ID NO: 15798 - DNA, 18 bp, Artificial Sequence
  Synthetic DNA
taatcggactcaccatcg

SEQ ID NO: 15799 - DNA, 18 bp, Artificial Sequence
  Synthetic DNA
taatcgtagtcactatag

SEQ ID NO: 15800 - DNA, 18 bp, Artificial Sequence
  Synthetic DNA
taatctgaatcactatgg

SEQ ID NO: 15801 - DNA, 18 bp, Artificial Sequence
  Synthetic DNA
taatctgacacaatatag

SEQ ID NO: 15802 - DNA, 18 bp, Artificial Sequence
  Synthetic DNA
taatctgactcactgcag

SEQ ID NO: 15803 - DNA, 18 bp, Artificial Sequence
  Synthetic DNA
taatctgactcattttag

SEQ ID NO: 15804 - DNA, 18 bp, Artificial Sequence
  Synthetic DNA
taatcttactctctatag

SEQ ID NO: 15805 - DNA, 18 bp, Artificial Sequence
  Synthetic DNA
taatgagactcactaagg

SEQ ID NO: 15806 - DNA, 18 bp, Artificial Sequence
  Synthetic DNA
taatgcaactcactctcg

SEQ ID NO: 15807 - DNA, 18 bp, Artificial Sequence
  Synthetic DNA
taatgccacgcattatag

SEQ ID NO: 15808 - DNA, 18 bp, Artificial Sequence
  Synthetic DNA
taatgccattcactttag

SEQ ID NO: 15809 - DNA, 18 bp, Artificial Sequence
  Synthetic DNA
taatgcgaaacactatgg

SEQ ID NO: 15810 - DNA, 18 bp, Artificial Sequence
  Synthetic DNA
taatgcgaatcagtctag

SEQ ID NO: 15811 - DNA, 18 bp, Artificial Sequence
  Synthetic DNA
taatgcgactcacactgg

SEQ ID NO: 15812 - DNA, 18 bp, Artificial Sequence
  Synthetic DNA
taatgcgactctcgataa

SEQ ID NO: 15813 - DNA, 18 bp, Artificial Sequence
  Synthetic DNA
taatgcgacttactagcg

SEQ ID NO: 15814 - DNA, 18 bp, Artificial Sequence
  Synthetic DNA
taatgcgatccacgatag

SEQ ID NO: 15815 - DNA, 18 bp, Artificial Sequence
  Synthetic DNA
taatgcgatttaccatag

SEQ ID NO: 15816 - DNA, 18 bp, Artificial Sequence
  Synthetic DNA
taatgcggctcacactag

SEQ ID NO: 15817 - DNA, 18 bp, Artificial Sequence
  Synthetic DNA
taatgcggctcactatca

SEQ ID NO: 15818 - DNA, 18 bp, Artificial Sequence
  Synthetic DNA
taatgcggctctcgatag

SEQ ID NO: 15819 - DNA, 18 bp, Artificial Sequence
  Synthetic DNA
taatgcgtcttaatatag

SEQ ID NO: 15820 - DNA, 18 bp, Artificial Sequence
  Synthetic DNA
taatgctactcacaatcg

SEQ ID NO: 15821 - DNA, 18 bp, Artificial Sequence
  Synthetic DNA
taatggtacacactatag

SEQ ID NO: 15822 - DNA, 18 bp, Artificial Sequence
  Synthetic DNA
taatgtgaatcactacag

SEQ ID NO: 15823 - DNA, 18 bp, Artificial Sequence
  Synthetic DNA
taatgtgcctctctatag

SEQ ID NO: 15824 - DNA, 18 bp, Artificial Sequence
  Synthetic DNA
taatgtgtctgactatag

SEQ ID NO: 15825 - DNA, 18 bp, Artificial Sequence
  Synthetic DNA
taatgttactcagtatag

SEQ ID NO: 15826 - DNA, 18 bp, Artificial Sequence
  Synthetic DNA
tacaacgactaattatag

SEQ ID NO: 15827 - DNA, 18 bp, Artificial Sequence
  Synthetic DNA
tacaacgactcatcatag

SEQ ID NO: 15828 - DNA, 18 bp, Artificial Sequence
  Synthetic DNA
tacaacgagtcactaaag

SEQ ID NO: 15829 - DNA, 18 bp, Artificial Sequence
  Synthetic DNA
tacaacgagtcattatag

SEQ ID NO: 15830 - DNA, 18 bp, Artificial Sequence
  Synthetic DNA
tacaacgattcactctag

SEQ ID NO: 15831 - DNA, 18 bp, Artificial Sequence
  Synthetic DNA
tacaatgactcactctag

SEQ ID NO: 15832 - DNA, 18 bp, Artificial Sequence
  Synthetic DNA
tacaatgactctctatag

SEQ ID NO: 15833 - DNA, 18 bp, Artificial Sequence
  Synthetic DNA
tacacagactcactatag

SEQ ID NO: 15834 - DNA, 18 bp, Artificial Sequence
  Synthetic DNA
taccacgagtcacgatag

SEQ ID NO: 15835 - DNA, 18 bp, Artificial Sequence
  Synthetic DNA
tacgacgagtcactatcg

SEQ ID NO: 15836 - DNA, 18 bp, Artificial Sequence
  Synthetic DNA
tactaagactcacttaag

SEQ ID NO: 15837 - DNA, 18 bp, Artificial Sequence
  Synthetic DNA
tactaaggctcactttag

SEQ ID NO: 15838 - DNA, 18 bp, Artificial Sequence
  Synthetic DNA
tactacaacatactatag

SEQ ID NO: 15839 - DNA, 18 bp, Artificial Sequence
  Synthetic DNA
tactaccactctcaatag

SEQ ID NO: 15840 - DNA, 18 bp, Artificial Sequence
  Synthetic DNA
tactacgaatcattacag

SEQ ID NO: 15841 - DNA, 18 bp, Artificial Sequence
  Synthetic DNA
tactacgacagaatatag

SEQ ID NO: 15842 - DNA, 18 bp, Artificial Sequence
  Synthetic DNA
tactacgactcacaccag

SEQ ID NO: 15843 - DNA, 18 bp, Artificial Sequence
  Synthetic DNA
tactacgagtacctatag

SEQ ID NO: 15844 - DNA, 18 bp, Artificial Sequence
  Synthetic DNA
tactacgcctctctatcg

SEQ ID NO: 15845 - DNA, 18 bp, Artificial Sequence
  Synthetic DNA
tactacggctctctctag

SEQ ID NO: 15846 - DNA, 18 bp, Artificial Sequence
  Synthetic DNA
tactatgactctctacag

SEQ ID NO: 15847 - DNA, 18 bp, Artificial Sequence
  Synthetic DNA
tactccgtctcactttag

SEQ ID NO: 15848 - DNA, 18 bp, Artificial Sequence
  Synthetic DNA
tactcttactcactatag

SEQ ID NO: 15849 - DNA, 18 bp, Artificial Sequence
  Synthetic DNA
tactgcgactcactgtcg

SEQ ID NO: 15850 - DNA, 18 bp, Artificial Sequence
  Synthetic DNA
tactgcgattcactttag

SEQ ID NO: 15851 - DNA, 18 bp, Artificial Sequence
  Synthetic DNA
tagaacgactcaatatgg

SEQ ID NO: 15852 - DNA, 18 bp, Artificial Sequence
  Synthetic DNA
tagaacgactcactgaag

SEQ ID NO: 15853 - DNA, 18 bp, Artificial Sequence
  Synthetic DNA
tagaacgacttaatatag

SEQ ID NO: 15854 - DNA, 18 bp, Artificial Sequence
  Synthetic DNA
tagaactactcaccatag

SEQ ID NO: 15855 - DNA, 18 bp, Artificial Sequence
  Synthetic DNA
tagaatgagtcactatag

SEQ ID NO: 15856 - DNA, 18 bp, Artificial Sequence
  Synthetic DNA
tagtaagattcactatgg

SEQ ID NO: 15857 - DNA, 18 bp, Artificial Sequence
  Synthetic DNA
tagtacaaattactatag

SEQ ID NO: 15858 - DNA, 18 bp, Artificial Sequence
  Synthetic DNA
tagtaccattcaccatag

SEQ ID NO: 15859 - DNA, 18 bp, Artificial Sequence
  Synthetic DNA
tagtacctctctctatag

SEQ ID NO: 15860 - DNA, 18 bp, Artificial Sequence
  Synthetic DNA
tagtacgactcaaagtag

SEQ ID NO: 15861 - DNA, 18 bp, Artificial Sequence
  Synthetic DNA
tagtacgactcagttaag

SEQ ID NO: 15862 - DNA, 18 bp, Artificial Sequence
  Synthetic DNA
tagtacgacttaatttag

SEQ ID NO: 15863 - DNA, 18 bp, Artificial Sequence
  Synthetic DNA
tagtacgattcaccgtag

SEQ ID NO: 15864 - DNA, 18 bp, Artificial Sequence
  Synthetic DNA
tagtacgccatactatag

SEQ ID NO: 15865 - DNA, 18 bp, Artificial Sequence
  Synthetic DNA
tagtacgtcccactttag

SEQ ID NO: 15866 - DNA, 18 bp, Artificial Sequence
  Synthetic DNA
tagtactaccgactatag

SEQ ID NO: 15867 - DNA, 18 bp, Artificial Sequence
  Synthetic DNA
tagtagatctcactatag

SEQ ID NO: 15868 - DNA, 18 bp, Artificial Sequence
  Synthetic DNA
tagtatgactcattatcg

SEQ ID NO: 15869 - DNA, 18 bp, Artificial Sequence
  Synthetic DNA
tagtatgagtcattatag

SEQ ID NO: 15870 - DNA, 18 bp, Artificial Sequence
  Synthetic DNA
tagtcctactcactaaag

SEQ ID NO: 15871 - DNA, 18 bp, Artificial Sequence
  Synthetic DNA
tagtgcaacacactatag

SEQ ID NO: 15872 - DNA, 18 bp, Artificial Sequence
  Synthetic DNA
tagtgcgactcaccagag

SEQ ID NO: 15873 - DNA, 18 bp, Artificial Sequence
  Synthetic DNA
tataacgaccccctatag

SEQ ID NO: 15874 - DNA, 18 bp, Artificial Sequence
  Synthetic DNA
tataacgactcaccacag

SEQ ID NO: 15875 - DNA, 18 bp, Artificial Sequence
  Synthetic DNA
tataacgactcactggag

SEQ ID NO: 15876 - DNA, 18 bp, Artificial Sequence
  Synthetic DNA
tatcacgacacagtatag

SEQ ID NO: 15877 - DNA, 18 bp, Artificial Sequence
  Synthetic DNA
tatcacgactctctatgg

SEQ ID NO: 15878 - DNA, 18 bp, Artificial Sequence
  Synthetic DNA
tatcacgactctgtatag

SEQ ID NO: 15879 - DNA, 18 bp, Artificial Sequence
  Synthetic DNA
tatcacgtcgcactatag

SEQ ID NO: 15880 - DNA, 18 bp, Artificial Sequence
  Synthetic DNA
tatcactactcactatcg

SEQ ID NO: 15881 - DNA, 18 bp, Artificial Sequence
  Synthetic DNA
tatcatgactaactatag

SEQ ID NO: 15882 - DNA, 18 bp, Artificial Sequence
  Synthetic DNA
tatgaggactcactgtag

SEQ ID NO: 15883 - DNA, 18 bp, Artificial Sequence
  Synthetic DNA
tattaccactcagtgtag

SEQ ID NO: 15884 - DNA, 18 bp, Artificial Sequence
  Synthetic DNA
tattacgaaccacgatag

SEQ ID NO: 15885 - DNA, 18 bp, Artificial Sequence
  Synthetic DNA
tattacgacacaccttag

SEQ ID NO: 15886 - DNA, 18 bp, Artificial Sequence
  Synthetic DNA
tattacgacacacgttag

SEQ ID NO: 15887 - DNA, 18 bp, Artificial Sequence
  Synthetic DNA
tattacgacgcaatctag

SEQ ID NO: 15888 - DNA, 18 bp, Artificial Sequence
  Synthetic DNA
tattacgacgcactaacg

SEQ ID NO: 15889 - DNA, 18 bp, Artificial Sequence
  Synthetic DNA
tattacgactaacttgag

SEQ ID NO: 15890 - DNA, 18 bp, Artificial Sequence
  Synthetic DNA
tattacgactcacaaccg

SEQ ID NO: 15891 - DNA, 18 bp, Artificial Sequence
  Synthetic DNA
tattacgactcacgttgg

SEQ ID NO: 15892 - DNA, 18 bp, Artificial Sequence
  Synthetic DNA
tattacgactcactcaaa

SEQ ID NO: 15893 - DNA, 18 bp, Artificial Sequence
  Synthetic DNA
tattacgactcacttccg

SEQ ID NO: 15894 - DNA, 18 bp, Artificial Sequence
  Synthetic DNA
tattacgactcctaatag

SEQ ID NO: 15895 - DNA, 18 bp, Artificial Sequence
  Synthetic DNA
tattacgattcactccag

SEQ ID NO: 15896 - DNA, 18 bp, Artificial Sequence
  Synthetic DNA
tattacgccgcaatatag

SEQ ID NO: 15897 - DNA, 18 bp, Artificial Sequence
  Synthetic DNA
tattacgcctccctacag

SEQ ID NO: 15898 - DNA, 18 bp, Artificial Sequence
  Synthetic DNA
tattacgcgtcactttag

SEQ ID NO: 15899 - DNA, 18 bp, Artificial Sequence
  Synthetic DNA
tattacggcccactctag

SEQ ID NO: 15900 - DNA, 18 bp, Artificial Sequence
  Synthetic DNA
tattacggctcaatatgg

SEQ ID NO: 15901 - DNA, 18 bp, Artificial Sequence
  Synthetic DNA
tattacggctcacgatgg

SEQ ID NO: 15902 - DNA, 18 bp, Artificial Sequence
  Synthetic DNA
tattacggctgactagag

SEQ ID NO: 15903 - DNA, 18 bp, Artificial Sequence
  Synthetic DNA
tattacggttccctatag

SEQ ID NO: 15904 - DNA, 18 bp, Artificial Sequence
  Synthetic DNA
tattacgtccccctatag

SEQ ID NO: 15905 - DNA, 18 bp, Artificial Sequence
  Synthetic DNA
tattacgtctcactaagg

SEQ ID NO: 15906 - DNA, 18 bp, Artificial Sequence
  Synthetic DNA
tattatcacacactatag

SEQ ID NO: 15907 - DNA, 18 bp, Artificial Sequence
  Synthetic DNA
tattatgacccactatgg

SEQ ID NO: 15908 - DNA, 18 bp, Artificial Sequence
  Synthetic DNA
tattcccagtcactatag

SEQ ID NO: 15909 - DNA, 18 bp, Artificial Sequence
  Synthetic DNA
tattccgaatcactagag

SEQ ID NO: 15910 - DNA, 18 bp, Artificial Sequence
  Synthetic DNA
tattcggactcaatatag

SEQ ID NO: 15911 - DNA, 18 bp, Artificial Sequence
  Synthetic DNA
tattgcgactcagaatag

SEQ ID NO: 15912 - DNA, 18 bp, Artificial Sequence
  Synthetic DNA
tattgcgacttattatag

SEQ ID NO: 15913 - DNA, 18 bp, Artificial Sequence
  Synthetic DNA
tcaaacgagtcacaatag

SEQ ID NO: 15914 - DNA, 18 bp, Artificial Sequence
  Synthetic DNA
tcaagcgactcactctag

SEQ ID NO: 15915 - DNA, 18 bp, Artificial Sequence
  Synthetic DNA
tcacacggctcactacag

SEQ ID NO: 15916 - DNA, 18 bp, Artificial Sequence
  Synthetic DNA
tcacatgattcactatag

SEQ ID NO: 15917 - DNA, 18 bp, Artificial Sequence
  Synthetic DNA
tcataagacttacgatag

SEQ ID NO: 15918 - DNA, 18 bp, Artificial Sequence
  Synthetic DNA
tcataagattcactatgg

SEQ ID NO: 15919 - DNA, 18 bp, Artificial Sequence
  Synthetic DNA
tcataagcctcactatcg

SEQ ID NO: 15920 - DNA, 18 bp, Artificial Sequence
  Synthetic DNA
tcataaggctcactctag

SEQ ID NO: 15921 - DNA, 18 bp, Artificial Sequence
  Synthetic DNA
tcatacaactccctatcg

SEQ ID NO: 15922 - DNA, 18 bp, Artificial Sequence
  Synthetic DNA
tcataccactcactgcag

SEQ ID NO: 15923 - DNA, 18 bp, Artificial Sequence
  Synthetic DNA
tcatacgaataactttag

SEQ ID NO: 15924 - DNA, 18 bp, Artificial Sequence
  Synthetic DNA
tcatacgacacactaacg

SEQ ID NO: 15925 - DNA, 18 bp, Artificial Sequence
  Synthetic DNA
tcatacgactcaacacag

SEQ ID NO: 15926 - DNA, 18 bp, Artificial Sequence
  Synthetic DNA
tcatacgactcacaagcg

SEQ ID NO: 15927 - DNA, 18 bp, Artificial Sequence
  Synthetic DNA
tcatacgactgattctag

SEQ ID NO: 15928 - DNA, 18 bp, Artificial Sequence
  Synthetic DNA
tcatacgacttcctaaag

SEQ ID NO: 15929 - DNA, 18 bp, Artificial Sequence
  Synthetic DNA
tcatacgacttcttatag

SEQ ID NO: 15930 - DNA, 18 bp, Artificial Sequence
  Synthetic DNA
tcatacggcccaatatag

SEQ ID NO: 15931 - DNA, 18 bp, Artificial Sequence
  Synthetic DNA
tcatacggctaaatatag

SEQ ID NO: 15932 - DNA, 18 bp, Artificial Sequence
  Synthetic DNA
tcatacggctccctaaag

SEQ ID NO: 15933 - DNA, 18 bp, Artificial Sequence
  Synthetic DNA
tcatactactcaataaag

SEQ ID NO: 15934 - DNA, 18 bp, Artificial Sequence
  Synthetic DNA
tcatactactctctagag

SEQ ID NO: 15935 - DNA, 18 bp, Artificial Sequence
  Synthetic DNA
tcatactattcactgtag

SEQ ID NO: 15936 - DNA, 18 bp, Artificial Sequence
  Synthetic DNA
tcataggactcacttaag

SEQ ID NO: 15937 - DNA, 18 bp, Artificial Sequence
  Synthetic DNA
tcataggactcattaaag

SEQ ID NO: 15938 - DNA, 18 bp, Artificial Sequence
  Synthetic DNA
tcatatggctcactatgg

SEQ ID NO: 15939 - DNA, 18 bp, Artificial Sequence
  Synthetic DNA
tcatctgactcactatcg

SEQ ID NO: 15940 - DNA, 18 bp, Artificial Sequence
  Synthetic DNA
tcatgcgactcaccgtag

SEQ ID NO: 15941 - DNA, 18 bp, Artificial Sequence
  Synthetic DNA
tcctaagcctcactatag

SEQ ID NO: 15942 - DNA, 18 bp, Artificial Sequence
  Synthetic DNA
tcctgcgagtcactatag

SEQ ID NO: 15943 - DNA, 18 bp, Artificial Sequence
  Synthetic DNA
tcgtacgtctctctatag

SEQ ID NO: 15944 - DNA, 18 bp, Artificial Sequence
  Synthetic DNA
tctaatgactcactatag

SEQ ID NO: 15945 - DNA, 18 bp, Artificial Sequence
  Synthetic DNA
tctcacgacgcactatag

SEQ ID NO: 15946 - DNA, 18 bp, Artificial Sequence
  Synthetic DNA
tgaaacgaatcactaaag

SEQ ID NO: 15947 - DNA, 18 bp, Artificial Sequence
  Synthetic DNA
tgaaacgactctctagag

SEQ ID NO: 15948 - DNA, 18 bp, Artificial Sequence
  Synthetic DNA
tgaaacgcctcaatatag

SEQ ID NO: 15949 - DNA, 18 bp, Artificial Sequence
  Synthetic DNA
tgaaacgcctccctatag

SEQ ID NO: 15950 - DNA, 18 bp, Artificial Sequence
  Synthetic DNA
tgaaaggtctcactatag

SEQ ID NO: 15951 - DNA, 18 bp, Artificial Sequence
  Synthetic DNA
tgaaccaactcactatag

SEQ ID NO: 15952 - DNA, 18 bp, Artificial Sequence
  Synthetic DNA
tgacaggtctcactatag

SEQ ID NO: 15953 - DNA, 18 bp, Artificial Sequence
  Synthetic DNA
tgataagacccattatag

SEQ ID NO: 15954 - DNA, 18 bp, Artificial Sequence
  Synthetic DNA
tgataagattcacgatag

SEQ ID NO: 15955 - DNA, 18 bp, Artificial Sequence
  Synthetic DNA
tgataccactcacaaaag

SEQ ID NO: 15956 - DNA, 18 bp, Artificial Sequence
  Synthetic DNA
tgatacgaaccactctag

SEQ ID NO: 15957 - DNA, 18 bp, Artificial Sequence
  Synthetic DNA
tgatacgaatcacactag

SEQ ID NO: 15958 - DNA, 18 bp, Artificial Sequence
  Synthetic DNA
tgatacgacagactaaag

SEQ ID NO: 15959 - DNA, 18 bp, Artificial Sequence
  Synthetic DNA
tgatacgactaactaacg

SEQ ID NO: 15960 - DNA, 18 bp, Artificial Sequence
  Synthetic DNA
tgatacgacttattctag

SEQ ID NO: 15961 - DNA, 18 bp, Artificial Sequence
  Synthetic DNA
tgatacgacttcctacag

SEQ ID NO: 15962 - DNA, 18 bp, Artificial Sequence
  Synthetic DNA
tgatacgacttcgtatag

SEQ ID NO: 15963 - DNA, 18 bp, Artificial Sequence
  Synthetic DNA
tgatacgagtccctttag

SEQ ID NO: 15964 - DNA, 18 bp, Artificial Sequence
  Synthetic DNA
tgatacgattcactaagg

SEQ ID NO: 15965 - DNA, 18 bp, Artificial Sequence
  Synthetic DNA
tgatacggctcattagag

SEQ ID NO: 15966 - DNA, 18 bp, Artificial Sequence
  Synthetic DNA
tgatactacccactctag

SEQ ID NO: 15967 - DNA, 18 bp, Artificial Sequence
  Synthetic DNA
tgatactagtccctatag

SEQ ID NO: 15968 - DNA, 18 bp, Artificial Sequence
  Synthetic DNA
tgatactcctcactttag

SEQ ID NO: 15969 - DNA, 18 bp, Artificial Sequence
  Synthetic DNA
tgatactgctgactatag

SEQ ID NO: 15970 - DNA, 18 bp, Artificial Sequence
  Synthetic DNA
tgataggactcccaatag

SEQ ID NO: 15971 - DNA, 18 bp, Artificial Sequence
  Synthetic DNA
tgatccgacttactatcg

SEQ ID NO: 15972 - DNA, 18 bp, Artificial Sequence
  Synthetic DNA
tgatgggactccctatag

SEQ ID NO: 15973 - DNA, 18 bp, Artificial Sequence
  Synthetic DNA
tgcaacgactgactatag

SEQ ID NO: 15974 - DNA, 18 bp, Artificial Sequence
  Synthetic DNA
tgctacgtctcattatag

SEQ ID NO: 15975 - DNA, 18 bp, Artificial Sequence
  Synthetic DNA
tgctgcgactcactatgg

SEQ ID NO: 15976 - DNA, 18 bp, Artificial Sequence
  Synthetic DNA
tggaacgactcaccatag

SEQ ID NO: 15977 - DNA, 18 bp, Artificial Sequence
  Synthetic DNA
tggtatgacgcactatag

SEQ ID NO: 15978 - DNA, 18 bp, Artificial Sequence
  Synthetic DNA
tgtaacgactcactctag

SEQ ID NO: 15979 - DNA, 18 bp, Artificial Sequence
  Synthetic DNA
tgttacgactccttatag

SEQ ID NO: 15980 - DNA, 18 bp, Artificial Sequence
  Synthetic DNA
tgttacgacttagtatag

SEQ ID NO: 15981 - DNA, 18 bp, Artificial Sequence
  Synthetic DNA
tgttacgtctcaatatag

SEQ ID NO: 15982 - DNA, 18 bp, Artificial Sequence
  Synthetic DNA
tgttactactcactgtag

SEQ ID NO: 15983 - DNA, 18 bp, Artificial Sequence
  Synthetic DNA
tgttactactgactatag

SEQ ID NO: 15984 - DNA, 18 bp, Artificial Sequence
  Synthetic DNA
ttaaacgactcaatgtag

SEQ ID NO: 15985 - DNA, 18 bp, Artificial Sequence
  Synthetic DNA
ttaaacgactctctctag

SEQ ID NO: 15986 - DNA, 18 bp, Artificial Sequence
  Synthetic DNA
ttaaacgcctcactatgg

SEQ ID NO: 15987 - DNA, 18 bp, Artificial Sequence
  Synthetic DNA
ttaagggactcactatag

SEQ ID NO: 15988 - DNA, 18 bp, Artificial Sequence
  Synthetic DNA
ttacacccctcactatag

SEQ ID NO: 15989 - DNA, 18 bp, Artificial Sequence
  Synthetic DNA
ttacacgacccacaatag

SEQ ID NO: 15990 - DNA, 18 bp, Artificial Sequence
  Synthetic DNA
ttacactactcactatcg

SEQ ID NO: 15991 - DNA, 18 bp, Artificial Sequence
  Synthetic DNA
ttacaggactcactatcg

SEQ ID NO: 15992 - DNA, 18 bp, Artificial Sequence
  Synthetic DNA
ttacatgtctcactatag

SEQ ID NO: 15993 - DNA, 18 bp, Artificial Sequence
  Synthetic DNA
ttagacggctccctatag

SEQ ID NO: 15994 - DNA, 18 bp, Artificial Sequence
  Synthetic DNA
ttagacgtctcattatag

SEQ ID NO: 15995 - DNA, 18 bp, Artificial Sequence
  Synthetic DNA
ttatacaactcaatatcg

SEQ ID NO: 15996 - DNA, 18 bp, Artificial Sequence
  Synthetic DNA
ttataccaatcagtatag

SEQ ID NO: 15997 - DNA, 18 bp, Artificial Sequence
  Synthetic DNA
ttataccacccaccatag

SEQ ID NO: 15998 - DNA, 18 bp, Artificial Sequence
  Synthetic DNA
ttatacgaatcactgcag

SEQ ID NO: 15999 - DNA, 18 bp, Artificial Sequence
  Synthetic DNA
ttatacgacccaccaaag

SEQ ID NO: 16000 - DNA, 18 bp, Artificial Sequence
  Synthetic DNA
ttatacgactccttagag

SEQ ID NO: 16001 - DNA, 18 bp, Artificial Sequence
  Synthetic DNA
ttatacgactctccctag

SEQ ID NO: 16002 - DNA, 18 bp, Artificial Sequence
  Synthetic DNA
ttatacgactgtctataa

SEQ ID NO: 16003 - DNA, 18 bp, Artificial Sequence
  Synthetic DNA
ttatacgacttaataaag

SEQ ID NO: 16004 - DNA, 18 bp, Artificial Sequence
  Synthetic DNA
ttatacgacttaatatcg

SEQ ID NO: 16005 - DNA, 18 bp, Artificial Sequence
  Synthetic DNA
ttatacgagtccttatag

SEQ ID NO: 16006 - DNA, 18 bp, Artificial Sequence
  Synthetic DNA
ttatacgattccctgtag

SEQ ID NO: 16007 - DNA, 18 bp, Artificial Sequence
  Synthetic DNA
ttatacgcctcacgagag

SEQ ID NO: 16008 - DNA, 18 bp, Artificial Sequence
  Synthetic DNA
ttatacgccttactgtag

SEQ ID NO: 16009 - DNA, 18 bp, Artificial Sequence
  Synthetic DNA
ttatacgcttcactgtag

SEQ ID NO: 16010 - DNA, 18 bp, Artificial Sequence
  Synthetic DNA
ttatacggctccctctag

SEQ ID NO: 16011 - DNA, 18 bp, Artificial Sequence
  Synthetic DNA
ttatacgtctcagtctag

SEQ ID NO: 16012 - DNA, 18 bp, Artificial Sequence
  Synthetic DNA
ttatacgtttcacgatag

SEQ ID NO: 16013 - DNA, 18 bp, Artificial Sequence
  Synthetic DNA
ttataggactcacgaaag

SEQ ID NO: 16014 - DNA, 18 bp, Artificial Sequence
  Synthetic DNA
ttataggactcattgtag

SEQ ID NO: 16015 - DNA, 18 bp, Artificial Sequence
  Synthetic DNA
ttatatgactcaatagag

SEQ ID NO: 16016 - DNA, 18 bp, Artificial Sequence
  Synthetic DNA
ttatatgacttacgatag

SEQ ID NO: 16017 - DNA, 18 bp, Artificial Sequence
  Synthetic DNA
ttatattacgcactatag

SEQ ID NO: 16018 - DNA, 18 bp, Artificial Sequence
  Synthetic DNA
ttatccaactcactatcg

SEQ ID NO: 16019 - DNA, 18 bp, Artificial Sequence
  Synthetic DNA
ttatccgactaaccatag

SEQ ID NO: 16020 - DNA, 18 bp, Artificial Sequence
  Synthetic DNA
ttatccgactcactttcg

SEQ ID NO: 16021 - DNA, 18 bp, Artificial Sequence
  Synthetic DNA
ttatccgacttactttag

SEQ ID NO: 16022 - DNA, 18 bp, Artificial Sequence
  Synthetic DNA
ttatccggctcaatatag

SEQ ID NO: 16023 - DNA, 18 bp, Artificial Sequence
  Synthetic DNA
ttatgcgactaacaatag

SEQ ID NO: 16024 - DNA, 18 bp, Artificial Sequence
  Synthetic DNA
ttatgcgactcacaatcg

SEQ ID NO: 16025 - DNA, 18 bp, Artificial Sequence
  Synthetic DNA
ttatgcgagtcagtatag

SEQ ID NO: 16026 - DNA, 18 bp, Artificial Sequence
  Synthetic DNA
ttatgcgcctcactttag

SEQ ID NO: 16027 - DNA, 18 bp, Artificial Sequence
  Synthetic DNA
ttccacgacccactatag

SEQ ID NO: 16028 - DNA, 18 bp, Artificial Sequence
  Synthetic DNA
ttcgacgactctctatag

SEQ ID NO: 16029 - DNA, 18 bp, Artificial Sequence
  Synthetic DNA
ttctacgacacagtatag

SEQ ID NO: 16030 - DNA, 18 bp, Artificial Sequence
  Synthetic DNA
ttctacgactgtctatag

SEQ ID NO: 16031 - DNA, 18 bp, Artificial Sequence
  Synthetic DNA
ttctgcgtctcactatag

SEQ ID NO: 16032 - DNA, 18 bp, Artificial Sequence
  Synthetic DNA
ttgtacgactccttatag

SEQ ID NO: 16033 - DNA, 18 bp, Artificial Sequence
  Synthetic DNA
ttgtacgactctatatag

SEQ ID NO: 16034 - DNA, 18 bp, Artificial Sequence
  Synthetic DNA
ttgtactactcactacag

SEQ ID NO: 16035 - DNA, 18 bp, Artificial Sequence
  Synthetic DNA
ttgtactactgactatag

SEQ ID NO: 16036 - DNA, 18 bp, Artificial Sequence
  Synthetic DNA
ttttacgactcaagatag

SEQ ID NO: 16037 - DNA, 18 bp, Artificial Sequence
  Synthetic DNA
ttttgcgactcactacag

SEQ ID NO: 16038 - DNA, 18 bp, Artificial Sequence
  Synthetic DNA
taattcaactcacttttg

SEQ ID NO: 16039 - DNA, 18 bp, Artificial Sequence
  Synthetic DNA
ttttaagactcactaaag

SEQ ID NO: 16040 - DNA, 18 bp, Artificial Sequence
  Synthetic DNA
aaatgcgactcactaatg

SEQ ID NO: 16041 - DNA, 18 bp, Artificial Sequence
  Synthetic DNA
taatacgcctaacaaaag

SEQ ID NO: 16042 - DNA, 18 bp, Artificial Sequence
  Synthetic DNA
taatatttctcacaatag

SEQ ID NO: 16043 - DNA, 18 bp, Artificial Sequence
  Synthetic DNA
tagtacgactcacattcg

SEQ ID NO: 16044 - DNA, 18 bp, Artificial Sequence
  Synthetic DNA
taattcgcctcattttag

SEQ ID NO: 16045 - DNA, 18 bp, Artificial Sequence
  Synthetic DNA
ttatacgactatctattg

SEQ ID NO: 16046 - DNA, 18 bp, Artificial Sequence
  Synthetic DNA
tattgcgcctcactttag

SEQ ID NO: 16047 - DNA, 18 bp, Artificial Sequence
  Synthetic DNA
tgattagactcactattg

SEQ ID NO: 16048 - DNA, 18 bp, Artificial Sequence
  Synthetic DNA
aaataggactcgctaaag

SEQ ID NO: 16049 - DNA, 18 bp, Artificial Sequence
  Synthetic DNA
ctaatcgactcactatag

SEQ ID NO: 16050 - DNA, 18 bp, Artificial Sequence
  Synthetic DNA
aattacgactcagaatag

SEQ ID NO: 16051 - DNA, 18 bp, Artificial Sequence
  Synthetic DNA
agatagaactcactatag

SEQ ID NO: 16052 - DNA, 18 bp, Artificial Sequence
  Synthetic DNA
tattgcgactcacttaag

SEQ ID NO: 16053 - DNA, 18 bp, Artificial Sequence
  Synthetic DNA
ttattggactcactttag

SEQ ID NO: 16054 - DNA, 18 bp, Artificial Sequence
  Synthetic DNA
taatacaactcactcatg

SEQ ID NO: 16055 - DNA, 18 bp, Artificial Sequence
  Synthetic DNA
tattacgactccgtttag

SEQ ID NO: 16056 - DNA, 18 bp, Artificial Sequence
  Synthetic DNA
ttatacaactcagtctag

SEQ ID NO: 16057 - DNA, 18 bp, Artificial Sequence
  Synthetic DNA
ttatacgtctcactcaag

SEQ ID NO: 16058 - DNA, 18 bp, Artificial Sequence
  Synthetic DNA
ttatagaactcactattg

SEQ ID NO: 16059 - DNA, 18 bp, Artificial Sequence
  Synthetic DNA
ttattagacgcactatag

SEQ ID NO: 16060 - DNA, 18 bp, Artificial Sequence
  Synthetic DNA
aaataggactcactcaag

SEQ ID NO: 16061 - DNA, 18 bp, Artificial Sequence
  Synthetic DNA
ctttacgactcactaaag

SEQ ID NO: 16062 - DNA, 18 bp, Artificial Sequence
  Synthetic DNA
ttaaacgactcacactag

SEQ ID NO: 16063 - DNA, 18 bp, Artificial Sequence
  Synthetic DNA
ttatacgactcacataag

SEQ ID NO: 16064 - DNA, 18 bp, Artificial Sequence
  Synthetic DNA
taattcgactagctacag

SEQ ID NO: 16065 - DNA, 18 bp, Artificial Sequence
  Synthetic DNA
atatacgactcgctatgg

SEQ ID NO: 16066 - DNA, 18 bp, Artificial Sequence
  Synthetic DNA
taaaacggctcgctttag

SEQ ID NO: 16067 - DNA, 18 bp, Artificial Sequence
  Synthetic DNA
taaatcgagtcactaaag

SEQ ID NO: 16068 - DNA, 18 bp, Artificial Sequence
  Synthetic DNA
taatacaacacgctacag

SEQ ID NO: 16069 - DNA, 18 bp, Artificial Sequence
  Synthetic DNA
taatacgacactctagtg

SEQ ID NO: 16070 - DNA, 18 bp, Artificial Sequence
  Synthetic DNA
tcaatcgcctcactatag

SEQ ID NO: 16071 - DNA, 18 bp, Artificial Sequence
  Synthetic DNA
tgatacgacttagtattg

SEQ ID NO: 16072 - DNA, 18 bp, Artificial Sequence
  Synthetic DNA
ttattcgactcacttgag

SEQ ID NO: 16073 - DNA, 18 bp, Artificial Sequence
  Synthetic DNA
ttattcgactcagaatag

SEQ ID NO: 16074 - DNA, 18 bp, Artificial Sequence
  Synthetic DNA
aaatgcgccttactatag

SEQ ID NO: 16075 - DNA, 18 bp, Artificial Sequence
  Synthetic DNA
agataccaatcactatag

SEQ ID NO: 16076 - DNA, 18 bp, Artificial Sequence
  Synthetic DNA
taaaacgactcagttaag

SEQ ID NO: 16077 - DNA, 18 bp, Artificial Sequence
  Synthetic DNA
taacacgtctcactctcg

SEQ ID NO: 16078 - DNA, 18 bp, Artificial Sequence
  Synthetic DNA
taatacgtctcacaccag

SEQ ID NO: 16079 - DNA, 18 bp, Artificial Sequence
  Synthetic DNA
tagtacggctcaatatgg

SEQ ID NO: 16080 - DNA, 18 bp, Artificial Sequence
  Synthetic DNA
tcaaacgactcattaaag

SEQ ID NO: 16081 - DNA, 18 bp, Artificial Sequence
  Synthetic DNA
tcctacgaatcactttag

SEQ ID NO: 16082 - DNA, 18 bp, Artificial Sequence
  Synthetic DNA
tgatacttctcaatatag

SEQ ID NO: 16083 - DNA, 18 bp, Artificial Sequence
  Synthetic DNA
tgttacgactcactcaag

SEQ ID NO: 16084 - DNA, 18 bp, Artificial Sequence
  Synthetic DNA
ttaaccgactcactttag

SEQ ID NO: 16085 - DNA, 18 bp, Artificial Sequence
  Synthetic DNA
ttatactcctcactacag

SEQ ID NO: 16086 - DNA, 18 bp, Artificial Sequence
  Synthetic DNA
ttatccgattcactaaag

SEQ ID NO: 16087 - DNA, 18 bp, Artificial Sequence
  Synthetic DNA
ttatgcgactccctacag

SEQ ID NO: 16088 - DNA, 18 bp, Artificial Sequence
  Synthetic DNA
caatacgactcagttttg

SEQ ID NO: 16089 - DNA, 18 bp, Artificial Sequence
  Synthetic DNA
ttattcggctcactaaag

SEQ ID NO: 16090 - DNA, 18 bp, Artificial Sequence
  Synthetic DNA
ttttacggctcactattg

SEQ ID NO: 16091 - DNA, 18 bp, Artificial Sequence
  Synthetic DNA
gaattcgactcactccag

SEQ ID NO: 16092 - DNA, 18 bp, Artificial Sequence
  Synthetic DNA
taatgagactcactcttg

SEQ ID NO: 16093 - DNA, 18 bp, Artificial Sequence
  Synthetic DNA
ctatacaactcactaaag

SEQ ID NO: 16094 - DNA, 18 bp, Artificial Sequence
  Synthetic DNA
taatcagactcacttcag

SEQ ID NO: 16095 - DNA, 18 bp, Artificial Sequence
  Synthetic DNA
tattacgactctcttcag

SEQ ID NO: 16096 - DNA, 18 bp, Artificial Sequence
  Synthetic DNA
taattcgactcagattag

SEQ ID NO: 16097 - DNA, 18 bp, Artificial Sequence
  Synthetic DNA
ttatgtgtctcactatag

SEQ ID NO: 16098 - DNA, 18 bp, Artificial Sequence
  Synthetic DNA
aattaagactcactttag

SEQ ID NO: 16099 - DNA, 18 bp, Artificial Sequence
  Synthetic DNA
taattcgagtcgctattg

SEQ ID NO: 16100 - DNA, 18 bp, Artificial Sequence
  Synthetic DNA
aaatacgactcgctactg

SEQ ID NO: 16101 - DNA, 18 bp, Artificial Sequence
  Synthetic DNA
caatacgacgcgctattg

SEQ ID NO: 16102 - DNA, 18 bp, Artificial Sequence
  Synthetic DNA
taatacgaaccgctattg

SEQ ID NO: 16103 - DNA, 18 bp, Artificial Sequence
  Synthetic DNA
taatacgactcgctgctg

SEQ ID NO: 16104 - DNA, 18 bp, Artificial Sequence
  Synthetic DNA
taattcgtctcacgattg

SEQ ID NO: 16105 - DNA, 18 bp, Artificial Sequence
  Synthetic DNA
aaatgcgactcaatattg

SEQ ID NO: 16106 - DNA, 18 bp, Artificial Sequence
  Synthetic DNA
caaaacgactcactaatg

SEQ ID NO: 16107 - DNA, 18 bp, Artificial Sequence
  Synthetic DNA
cagtccgactcgctatag

SEQ ID NO: 16108 - DNA, 18 bp, Artificial Sequence
  Synthetic DNA
gacttcgactcactttag

SEQ ID NO: 16109 - DNA, 18 bp, Artificial Sequence
  Synthetic DNA
ggatacgactcacaattg

SEQ ID NO: 16110 - DNA, 18 bp, Artificial Sequence
  Synthetic DNA
ggatacgactcgctatcg

SEQ ID NO: 16111 - DNA, 18 bp, Artificial Sequence
  Synthetic DNA
taaatcgactcagtttag

SEQ ID NO: 16112 - DNA, 18 bp, Artificial Sequence
  Synthetic DNA
taacacaactcgttatag

SEQ ID NO: 16113 - DNA, 18 bp, Artificial Sequence
  Synthetic DNA
taactcgacacaccatag

SEQ ID NO: 16114 - DNA, 18 bp, Artificial Sequence
  Synthetic DNA
taatacaacacgctctag

SEQ ID NO: 16115 - DNA, 18 bp, Artificial Sequence
  Synthetic DNA
taatacgaccctctcttg

SEQ ID NO: 16116 - DNA, 18 bp, Artificial Sequence
  Synthetic DNA
taatacgtatcgatatag

SEQ ID NO: 16117 - DNA, 18 bp, Artificial Sequence
  Synthetic DNA
taatacgtatcgctatcg

SEQ ID NO: 16118 - DNA, 18 bp, Artificial Sequence
  Synthetic DNA
taatactatttactattg

SEQ ID NO: 16119 - DNA, 18 bp, Artificial Sequence
  Synthetic DNA
taatagcactcactaatg

SEQ ID NO: 16120 - DNA, 18 bp, Artificial Sequence
  Synthetic DNA
taataggacacacttttg

SEQ ID NO: 16121 - DNA, 18 bp, Artificial Sequence
  Synthetic DNA
taatatgactcgatttag

SEQ ID NO: 16122 - DNA, 18 bp, Artificial Sequence
  Synthetic DNA
taatatgactcgctacgg

SEQ ID NO: 16123 - DNA, 18 bp, Artificial Sequence
  Synthetic DNA
taattagactcacgaaag

SEQ ID NO: 16124 - DNA, 18 bp, Artificial Sequence
  Synthetic DNA
taattcgaaacactctag

SEQ ID NO: 16125 - DNA, 18 bp, Artificial Sequence
  Synthetic DNA
taattcgactcattttcg

SEQ ID NO: 16126 - DNA, 18 bp, Artificial Sequence
  Synthetic DNA
taattcgactcccttaag

SEQ ID NO: 16127 - DNA, 18 bp, Artificial Sequence
  Synthetic DNA
taattcggctcaacatag

SEQ ID NO: 16128 - DNA, 18 bp, Artificial Sequence
  Synthetic DNA
tactacgacttacaattg

SEQ ID NO: 16129 - DNA, 18 bp, Artificial Sequence
  Synthetic DNA
tactccgactcacaattg

SEQ ID NO: 16130 - DNA, 18 bp, Artificial Sequence
  Synthetic DNA
tagtacgtctcactcttg

SEQ ID NO: 16131 - DNA, 18 bp, Artificial Sequence
  Synthetic DNA
tattacgtctcgcgatag

SEQ ID NO: 16132 - DNA, 18 bp, Artificial Sequence
  Synthetic DNA
tcatgcgactggctatag

SEQ ID NO: 16133 - DNA, 18 bp, Artificial Sequence
  Synthetic DNA
ttatacgactcacagttg

SEQ ID NO: 16134 - DNA, 18 bp, Artificial Sequence
  Synthetic DNA
aaatatgacaccctatag

SEQ ID NO: 16135 - DNA, 18 bp, Artificial Sequence
  Synthetic DNA
aaatccgaatcactgtag

SEQ ID NO: 16136 - DNA, 18 bp, Artificial Sequence
  Synthetic DNA
aagtccgacgcactatag

SEQ ID NO: 16137 - DNA, 18 bp, Artificial Sequence
  Synthetic DNA
acatacaactcaccatag

SEQ ID NO: 16138 - DNA, 18 bp, Artificial Sequence
  Synthetic DNA
caataagactcactccag

SEQ ID NO: 16139 - DNA, 18 bp, Artificial Sequence
  Synthetic DNA
caataagactcacttaag

SEQ ID NO: 16140 - DNA, 18 bp, Artificial Sequence
  Synthetic DNA
caatacggttcactttag

SEQ ID NO: 16141 - DNA, 18 bp, Artificial Sequence
  Synthetic DNA
caatacgtttcactgtag

SEQ ID NO: 16142 - DNA, 18 bp, Artificial Sequence
  Synthetic DNA
cactacgactctcaatag

SEQ ID NO: 16143 - DNA, 18 bp, Artificial Sequence
  Synthetic DNA
cattacaactgactatag

SEQ ID NO: 16144 - DNA, 18 bp, Artificial Sequence
  Synthetic DNA
cattacggcttactatag

SEQ ID NO: 16145 - DNA, 18 bp, Artificial Sequence
  Synthetic DNA
ctatccgactccctatag

SEQ ID NO: 16146 - DNA, 18 bp, Artificial Sequence
  Synthetic DNA
gaatacgactcaaattag

SEQ ID NO: 16147 - DNA, 18 bp, Artificial Sequence
  Synthetic DNA
gaatacgtatcactttag

SEQ ID NO: 16148 - DNA, 18 bp, Artificial Sequence
  Synthetic DNA
gtatgcgactcactgtag

SEQ ID NO: 16149 - DNA, 18 bp, Artificial Sequence
  Synthetic DNA
taaaacgatttactttag

SEQ ID NO: 16150 - DNA, 18 bp, Artificial Sequence
  Synthetic DNA
taacaagtctcattatag

SEQ ID NO: 16151 - DNA, 18 bp, Artificial Sequence
  Synthetic DNA
taacaccacgcactttag

SEQ ID NO: 16152 - DNA, 18 bp, Artificial Sequence
  Synthetic DNA
taacacgactctttacag

SEQ ID NO: 16153 - DNA, 18 bp, Artificial Sequence
  Synthetic DNA
taacgcgacttattatag

SEQ ID NO: 16154 - DNA, 18 bp, Artificial Sequence
  Synthetic DNA
taagacaactaacaatag

SEQ ID NO: 16155 - DNA, 18 bp, Artificial Sequence
  Synthetic DNA
taataagactcagttgag

SEQ ID NO: 16156 - DNA, 18 bp, Artificial Sequence
  Synthetic DNA
taataagactgactgaag

SEQ ID NO: 16157 - DNA, 18 bp, Artificial Sequence
  Synthetic DNA
taataagagttacaatag

SEQ ID NO: 16158 - DNA, 18 bp, Artificial Sequence
  Synthetic DNA
taatacaattcagtatcg

SEQ ID NO: 16159 - DNA, 18 bp, Artificial Sequence
  Synthetic DNA
taatacacaacactatag

SEQ ID NO: 16160 - DNA, 18 bp, Artificial Sequence
  Synthetic DNA
taatacacttcactttag

SEQ ID NO: 16161 - DNA, 18 bp, Artificial Sequence
  Synthetic DNA
taataccactcaaagtag

SEQ ID NO: 16162 - DNA, 18 bp, Artificial Sequence
  Synthetic DNA
taataccattatctatag

SEQ ID NO: 16163 - DNA, 18 bp, Artificial Sequence
  Synthetic DNA
taatacgacacccaagag

SEQ ID NO: 16164 - DNA, 18 bp, Artificial Sequence
  Synthetic DNA
taatacgacagacaacag

SEQ ID NO: 16165 - DNA, 18 bp, Artificial Sequence
  Synthetic DNA
taatacgtcacattatgg

SEQ ID NO: 16166 - DNA, 18 bp, Artificial Sequence
  Synthetic DNA
taatacgtctgaccacag

SEQ ID NO: 16167 - DNA, 18 bp, Artificial Sequence
  Synthetic DNA
taatactactcacaaacg

SEQ ID NO: 16168 - DNA, 18 bp, Artificial Sequence
  Synthetic DNA
taatatgactcattaacg

SEQ ID NO: 16169 - DNA, 18 bp, Artificial Sequence
  Synthetic DNA
taatatgactcccattag

SEQ ID NO: 16170 - DNA, 18 bp, Artificial Sequence
  Synthetic DNA
taatatgactgaatatcg

SEQ ID NO: 16171 - DNA, 18 bp, Artificial Sequence
  Synthetic DNA
taatccaagtcaccatag

SEQ ID NO: 16172 - DNA, 18 bp, Artificial Sequence
  Synthetic DNA
taatcccactcccaatag

SEQ ID NO: 16173 - DNA, 18 bp, Artificial Sequence
  Synthetic DNA
taatccgaatcaccttag

SEQ ID NO: 16174 - DNA, 18 bp, Artificial Sequence
  Synthetic DNA
taatccgactcatagtag

SEQ ID NO: 16175 - DNA, 18 bp, Artificial Sequence
  Synthetic DNA
taatccgactctacatag

SEQ ID NO: 16176 - DNA, 18 bp, Artificial Sequence
  Synthetic DNA
taatccgacttactttgg

SEQ ID NO: 16177 - DNA, 18 bp, Artificial Sequence
  Synthetic DNA
taatccgattcacattag

SEQ ID NO: 16178 - DNA, 18 bp, Artificial Sequence
  Synthetic DNA
taatctaactcactacag

SEQ ID NO: 16179 - DNA, 18 bp, Artificial Sequence
  Synthetic DNA
taatctgattcacaatag

SEQ ID NO: 16180 - DNA, 18 bp, Artificial Sequence
  Synthetic DNA
taatgcgtctcactttcg

SEQ ID NO: 16181 - DNA, 18 bp, Artificial Sequence
  Synthetic DNA
tacaacgcctcactctag

SEQ ID NO: 16182 - DNA, 18 bp, Artificial Sequence
  Synthetic DNA
tactactacccactttag

SEQ ID NO: 16183 - DNA, 18 bp, Artificial Sequence
  Synthetic DNA
tactaggtttcactatag

SEQ ID NO: 16184 - DNA, 18 bp, Artificial Sequence
  Synthetic DNA
tactgcgactcataatag

SEQ ID NO: 16185 - DNA, 18 bp, Artificial Sequence
  Synthetic DNA
tagtacgacatactatcg

SEQ ID NO: 16186 - DNA, 18 bp, Artificial Sequence
  Synthetic DNA
tagtacggctcaatacag

SEQ ID NO: 16187 - DNA, 18 bp, Artificial Sequence
  Synthetic DNA
tagtactattcattatag

SEQ ID NO: 16188 - DNA, 18 bp, Artificial Sequence
  Synthetic DNA
tagtaggacttactaaag

SEQ ID NO: 16189 - DNA, 18 bp, Artificial Sequence
  Synthetic DNA
tatcacgacacactctag

SEQ ID NO: 16190 - DNA, 18 bp, Artificial Sequence
  Synthetic DNA
tattacgattcacaatcg

SEQ ID NO: 16191 - DNA, 18 bp, Artificial Sequence
  Synthetic DNA
tattactactcaccatcg

SEQ ID NO: 16192 - DNA, 18 bp, Artificial Sequence
  Synthetic DNA
tattactgcccactatag

SEQ ID NO: 16193 - DNA, 18 bp, Artificial Sequence
  Synthetic DNA
tattaggactctctaaag

SEQ ID NO: 16194 - DNA, 18 bp, Artificial Sequence
  Synthetic DNA
tattccgactcacaaaag

SEQ ID NO: 16195 - DNA, 18 bp, Artificial Sequence
  Synthetic DNA
tcataagacaccctatag

SEQ ID NO: 16196 - DNA, 18 bp, Artificial Sequence
  Synthetic DNA
tcatacctctcaatatag

SEQ ID NO: 16197 - DNA, 18 bp, Artificial Sequence
  Synthetic DNA
tcatacgaatgtctatag

SEQ ID NO: 16198 - DNA, 18 bp, Artificial Sequence
  Synthetic DNA
tcatacgactaaatacag

SEQ ID NO: 16199 - DNA, 18 bp, Artificial Sequence
  Synthetic DNA
tcatgcgtctctctatag

SEQ ID NO: 16200 - DNA, 18 bp, Artificial Sequence
  Synthetic DNA
tcctatgactcactttag

SEQ ID NO: 16201 - DNA, 18 bp, Artificial Sequence
  Synthetic DNA
tgatacaacaccctatag

SEQ ID NO: 16202 - DNA, 18 bp, Artificial Sequence
  Synthetic DNA
tgatacgactcacttagg

SEQ ID NO: 16203 - DNA, 18 bp, Artificial Sequence
  Synthetic DNA
tgatacgtatcactctag

SEQ ID NO: 16204 - DNA, 18 bp, Artificial Sequence
  Synthetic DNA
tgatccgacttactgtag

SEQ ID NO: 16205 - DNA, 18 bp, Artificial Sequence
  Synthetic DNA
tgctacgactctctgtag

SEQ ID NO: 16206 - DNA, 18 bp, Artificial Sequence
  Synthetic DNA
tggtccgactcattatag

SEQ ID NO: 16207 - DNA, 18 bp, Artificial Sequence
  Synthetic DNA
ttaaccgagtcactatag

SEQ ID NO: 16208 - DNA, 18 bp, Artificial Sequence
  Synthetic DNA
ttacacgattcaccatag

SEQ ID NO: 16209 - DNA, 18 bp, Artificial Sequence
  Synthetic DNA
ttataataatcactatag

SEQ ID NO: 16210 - DNA, 18 bp, Artificial Sequence
  Synthetic DNA
ttataatactcacaatag

SEQ ID NO: 16211 - DNA, 18 bp, Artificial Sequence
  Synthetic DNA
ttataccactaactagag

SEQ ID NO: 16212 - DNA, 18 bp, Artificial Sequence
  Synthetic DNA
ttataggactcagtttag

SEQ ID NO: 16213 - DNA, 18 bp, Artificial Sequence
  Synthetic DNA
ttatgctactcactacag

SEQ ID NO: 16214 - DNA, 18 bp, Artificial Sequence
  Synthetic DNA
ttatgctactcactgtag

SEQ ID NO: 16215 - DNA, 18 bp, Artificial Sequence
  Synthetic DNA
ttgtacgacgccctatag

SEQ ID NO: 16216 - DNA, 18 bp, Artificial Sequence
  Synthetic DNA
ttttacgactccgtatag

SEQ ID NO: 16217 - DNA, 18 bp, Artificial Sequence
  Synthetic DNA
taaaacaactcactactg

SEQ ID NO: 16218 - DNA, 18 bp, Artificial Sequence
  Synthetic DNA
ttaatcgactcaccatag

SEQ ID NO: 16219 - DNA, 18 bp, Artificial Sequence
  Synthetic DNA
ttaatcgactcactatcg

SEQ ID NO: 16220 - DNA, 18 bp, Artificial Sequence
  Synthetic DNA
taattcgactcactgatg

SEQ ID NO: 16221 - DNA, 18 bp, Artificial Sequence
  Synthetic DNA
tttttcaactcactatag

SEQ ID NO: 16222 - DNA, 18 bp, Artificial Sequence
  Synthetic DNA
tattacaactcagtttag

SEQ ID NO: 16223 - DNA, 18 bp, Artificial Sequence
  Synthetic DNA
ttatgggactcactaaag

SEQ ID NO: 16224 - DNA, 18 bp, Artificial Sequence
  Synthetic DNA
caataggactcactaatg

SEQ ID NO: 16225 - DNA, 18 bp, Artificial Sequence
  Synthetic DNA
tatttcgtctcgctatag

SEQ ID NO: 16226 - DNA, 18 bp, Artificial Sequence
  Synthetic DNA
tattgcgtctcactattg

SEQ ID NO: 16227 - DNA, 18 bp, Artificial Sequence
  Synthetic DNA
tattacgtctcgctattg

SEQ ID NO: 16228 - DNA, 18 bp, Artificial Sequence
  Synthetic DNA
aaatgcgactcgctatcg

SEQ ID NO: 16229 - DNA, 18 bp, Artificial Sequence
  Synthetic DNA
taacacgtctcactactg

SEQ ID NO: 16230 - DNA, 18 bp, Artificial Sequence
  Synthetic DNA
taatacgattcgcttaag

SEQ ID NO: 16231 - DNA, 18 bp, Artificial Sequence
  Synthetic DNA
taatatggctgactattg

SEQ ID NO: 16232 - DNA, 18 bp, Artificial Sequence
  Synthetic DNA
tactacgtctcgctaaag

SEQ ID NO: 16233 - DNA, 18 bp, Artificial Sequence
  Synthetic DNA
tgatactactcacttttg

SEQ ID NO: 16234 - DNA, 18 bp, Artificial Sequence
  Synthetic DNA
ttctacgtctcactattg

SEQ ID NO: 16235 - DNA, 18 bp, Artificial Sequence
  Synthetic DNA
aaaaacgtctcaccatag

SEQ ID NO: 16236 - DNA, 18 bp, Artificial Sequence
  Synthetic DNA
caatacgactaagtaaag

SEQ ID NO: 16237 - DNA, 18 bp, Artificial Sequence
  Synthetic DNA
cataacgacgcactatag

SEQ ID NO: 16238 - DNA, 18 bp, Artificial Sequence
  Synthetic DNA
gaataggactcactttgg

SEQ ID NO: 16239 - DNA, 18 bp, Artificial Sequence
  Synthetic DNA
taaaacgcctcagtaaag

SEQ ID NO: 16240 - DNA, 18 bp, Artificial Sequence
  Synthetic DNA
taacacggcccaccatag

SEQ ID NO: 16241 - DNA, 18 bp, Artificial Sequence
  Synthetic DNA
taatacgtcccacaaaag

SEQ ID NO: 16242 - DNA, 18 bp, Artificial Sequence
  Synthetic DNA
taatacgtgacactatcg

SEQ ID NO: 16243 - DNA, 18 bp, Artificial Sequence
  Synthetic DNA
taataggtttcactttag

SEQ ID NO: 16244 - DNA, 18 bp, Artificial Sequence
  Synthetic DNA
tatcacgtctcactaaag

SEQ ID NO: 16245 - DNA, 18 bp, Artificial Sequence
  Synthetic DNA
tattaaaactcattatag

SEQ ID NO: 16246 - DNA, 18 bp, Artificial Sequence
  Synthetic DNA
tattacgactccatagag

SEQ ID NO: 16247 - DNA, 18 bp, Artificial Sequence
  Synthetic DNA
tcaaacaactcactgtag

SEQ ID NO: 16248 - DNA, 18 bp, Artificial Sequence
  Synthetic DNA
tcgtacgaaacactatag

SEQ ID NO: 16249 - DNA, 18 bp, Artificial Sequence
  Synthetic DNA
ttaagcaactcactatag

SEQ ID NO: 16250 - DNA, 18 bp, Artificial Sequence
  Synthetic DNA
ttatgcgaatcactaaag

SEQ ID NO: 16251 - DNA, 18 bp, Artificial Sequence
  Synthetic DNA
ttatgtgactcactaaag

SEQ ID NO: 16252 - DNA, 18 bp, Artificial Sequence
  Synthetic DNA
tattgcgactcactgcag

SEQ ID NO: 16253 - DNA, 18 bp, Artificial Sequence
  Synthetic DNA
caatacaactcactcttg

SEQ ID NO: 16254 - DNA, 18 bp, Artificial Sequence
  Synthetic DNA
agatacgtctcactaaag

SEQ ID NO: 16255 - DNA, 18 bp, Artificial Sequence
  Synthetic DNA
taatagtgcacactatag

SEQ ID NO: 16256 - DNA, 18 bp, Artificial Sequence
  Synthetic DNA
tattgggactcactaaag

SEQ ID NO: 16257 - DNA, 18 bp, Artificial Sequence
  Synthetic DNA
taaaacgactcgcttaag

SEQ ID NO: 16258 - DNA, 18 bp, Artificial Sequence
  Synthetic DNA
taatacgattcataattg

SEQ ID NO: 16259 - DNA, 18 bp, Artificial Sequence
  Synthetic DNA
tttttcgactcactttag

SEQ ID NO: 16260 - DNA, 18 bp, Artificial Sequence
  Synthetic DNA
caatgcgacgcaccatag

SEQ ID NO: 16261 - DNA, 18 bp, Artificial Sequence
  Synthetic DNA
ttaatggactcactatag

SEQ ID NO: 16262 - DNA, 18 bp, Artificial Sequence
  Synthetic DNA
ttattcgactctctttag

SEQ ID NO: 16263 - DNA, 18 bp, Artificial Sequence
  Synthetic DNA
taatacgactcgcaactg

SEQ ID NO: 16264 - DNA, 18 bp, Artificial Sequence
  Synthetic DNA
tcaatcgtctcactatag

SEQ ID NO: 16265 - DNA, 18 bp, Artificial Sequence
  Synthetic DNA
ttttacgactcgctttag

SEQ ID NO: 16266 - DNA, 18 bp, Artificial Sequence
  Synthetic DNA
atatacgcctcactaaag

SEQ ID NO: 16267 - DNA, 18 bp, Artificial Sequence
  Synthetic DNA
ttaaacgactcactgaag

SEQ ID NO: 16268 - DNA, 18 bp, Artificial Sequence
  Synthetic DNA
tatttcgactcgctattg

SEQ ID NO: 16269 - DNA, 18 bp, Artificial Sequence
  Synthetic DNA
aaatacgactcgatattg

SEQ ID NO: 16270 - DNA, 18 bp, Artificial Sequence
  Synthetic DNA
caaaacgactcgctattg

SEQ ID NO: 16271 - DNA, 18 bp, Artificial Sequence
  Synthetic DNA
caattagactcgctatag

SEQ ID NO: 16272 - DNA, 18 bp, Artificial Sequence
  Synthetic DNA
caattcgactcaatattg

SEQ ID NO: 16273 - DNA, 18 bp, Artificial Sequence
  Synthetic DNA
taaatctactcgctatag

SEQ ID NO: 16274 - DNA, 18 bp, Artificial Sequence
  Synthetic DNA
taatacgcctcgcttttg

SEQ ID NO: 16275 - DNA, 18 bp, Artificial Sequence
  Synthetic DNA
taattcaactcgctaaag

SEQ ID NO: 16276 - DNA, 18 bp, Artificial Sequence
  Synthetic DNA
taattccactcactcttg

SEQ ID NO: 16277 - DNA, 18 bp, Artificial Sequence
  Synthetic DNA
taattcgaagcactattg

SEQ ID NO: 16278 - DNA, 18 bp, Artificial Sequence
  Synthetic DNA
taattcgaatcgatatag

SEQ ID NO: 16279 - DNA, 18 bp, Artificial Sequence
  Synthetic DNA
taattcgactcgatttag

SEQ ID NO: 16280 - DNA, 18 bp, Artificial Sequence
  Synthetic DNA
taattcgactcgcactag

SEQ ID NO: 16281 - DNA, 18 bp, Artificial Sequence
  Synthetic DNA
taattcgagtcgctctag

SEQ ID NO: 16282 - DNA, 18 bp, Artificial Sequence
  Synthetic DNA
taattgggctcactattg

SEQ ID NO: 16283 - DNA, 18 bp, Artificial Sequence
  Synthetic DNA
tagtacgactagctattg

SEQ ID NO: 16284 - DNA, 18 bp, Artificial Sequence
  Synthetic DNA
tagtacgactcgcttttg

SEQ ID NO: 16285 - DNA, 18 bp, Artificial Sequence
  Synthetic DNA
tagttcgactctctattg

SEQ ID NO: 16286 - DNA, 18 bp, Artificial Sequence
  Synthetic DNA
tataacgactcgctattg

SEQ ID NO: 16287 - DNA, 18 bp, Artificial Sequence
  Synthetic DNA
tattacaactcgctattg

SEQ ID NO: 16288 - DNA, 18 bp, Artificial Sequence
  Synthetic DNA
tcattcgactgactattg

SEQ ID NO: 16289 - DNA, 18 bp, Artificial Sequence
  Synthetic DNA
tcttacgactcgctattg

SEQ ID NO: 16290 - DNA, 18 bp, Artificial Sequence
  Synthetic DNA
tgatacgacacgctattg

SEQ ID NO: 16291 - DNA, 18 bp, Artificial Sequence
  Synthetic DNA
ttatacgactcgcaattg

SEQ ID NO: 16292 - DNA, 18 bp, Artificial Sequence
  Synthetic DNA
ttatacgactcgctaatg

SEQ ID NO: 16293 - DNA, 18 bp, Artificial Sequence
  Synthetic DNA
aaaatcgacgcactatag

SEQ ID NO: 16294 - DNA, 18 bp, Artificial Sequence
  Synthetic DNA
aaactcgagtcactatag

SEQ ID NO: 16295 - DNA, 18 bp, Artificial Sequence
  Synthetic DNA
aaatatgactcaccattg

SEQ ID NO: 16296 - DNA, 18 bp, Artificial Sequence
  Synthetic DNA
aaatccgactcgctatcg

SEQ ID NO: 16297 - DNA, 18 bp, Artificial Sequence
  Synthetic DNA
aaatccgagtcactattg

SEQ ID NO: 16298 - DNA, 18 bp, Artificial Sequence
  Synthetic DNA
aaatgcgattcgctatag

SEQ ID NO: 16299 - DNA, 18 bp, Artificial Sequence
  Synthetic DNA
aaattcgactcaccgtag

SEQ ID NO: 16300 - DNA, 18 bp, Artificial Sequence
  Synthetic DNA
aaattcgactcactgcag

SEQ ID NO: 16301 - DNA, 18 bp, Artificial Sequence
  Synthetic DNA
aactacgacttactattg

SEQ ID NO: 16302 - DNA, 18 bp, Artificial Sequence
  Synthetic DNA
acatacgactcgttatag

SEQ ID NO: 16303 - DNA, 18 bp, Artificial Sequence
  Synthetic DNA
atatacgactcgctataa

SEQ ID NO: 16304 - DNA, 18 bp, Artificial Sequence
  Synthetic DNA
caaaacgacacactattg

SEQ ID NO: 16305 - DNA, 18 bp, Artificial Sequence
  Synthetic DNA
caagactactcgctatag

SEQ ID NO: 16306 - DNA, 18 bp, Artificial Sequence
  Synthetic DNA
caatacgatacactattg

SEQ ID NO: 16307 - DNA, 18 bp, Artificial Sequence
  Synthetic DNA
caattcgactctctgtag

SEQ ID NO: 16308 - DNA, 18 bp, Artificial Sequence
  Synthetic DNA
caattcgagtcactatgg

SEQ ID NO: 16309 - DNA, 18 bp, Artificial Sequence
  Synthetic DNA
caattcgagttactatag

SEQ ID NO: 16310 - DNA, 18 bp, Artificial Sequence
  Synthetic DNA
cgttacgactcactattg

SEQ ID NO: 16311 - DNA, 18 bp, Artificial Sequence
  Synthetic DNA
ctataagactcactattg

SEQ ID NO: 16312 - DNA, 18 bp, Artificial Sequence
  Synthetic DNA
gaataagacttgctatag

SEQ ID NO: 16313 - DNA, 18 bp, Artificial Sequence
  Synthetic DNA
gaatacaactcagtattg

SEQ ID NO: 16314 - DNA, 18 bp, Artificial Sequence
  Synthetic DNA
gaatacgacacaccattg

SEQ ID NO: 16315 - DNA, 18 bp, Artificial Sequence
  Synthetic DNA
gaattcgactcacagtag

SEQ ID NO: 16316 - DNA, 18 bp, Artificial Sequence
  Synthetic DNA
gaattcgattcacaatag

SEQ ID NO: 16317 - DNA, 18 bp, Artificial Sequence
  Synthetic DNA
gagttcgactcacaatag

SEQ ID NO: 16318 - DNA, 18 bp, Artificial Sequence
  Synthetic DNA
gtatacgactcacttttg

SEQ ID NO: 16319 - DNA, 18 bp, Artificial Sequence
  Synthetic DNA
taaaacgactcactggtg

SEQ ID NO: 16320 - DNA, 18 bp, Artificial Sequence
  Synthetic DNA
taaaacgactcgctgaag

SEQ ID NO: 16321 - DNA, 18 bp, Artificial Sequence
  Synthetic DNA
taaaacgactgactactg

SEQ ID NO: 16322 - DNA, 18 bp, Artificial Sequence
  Synthetic DNA
taaaacgcctcgctacag

SEQ ID NO: 16323 - DNA, 18 bp, Artificial Sequence
  Synthetic DNA
taaaaggtctcactattg

SEQ ID NO: 16324 - DNA, 18 bp, Artificial Sequence
  Synthetic DNA
taaaatgactcgctacag

SEQ ID NO: 16325 - DNA, 18 bp, Artificial Sequence
  Synthetic DNA
taaagcgactcgctgtag

SEQ ID NO: 16326 - DNA, 18 bp, Artificial Sequence
  Synthetic DNA
taaatcgacgcattatag

SEQ ID NO: 16327 - DNA, 18 bp, Artificial Sequence
  Synthetic DNA
taaatcgactcacttcag

SEQ ID NO: 16328 - DNA, 18 bp, Artificial Sequence
  Synthetic DNA
taaatcgattcactacag

SEQ ID NO: 16329 - DNA, 18 bp, Artificial Sequence
  Synthetic DNA
taaatggactcactaaag

SEQ ID NO: 16330 - DNA, 18 bp, Artificial Sequence
  Synthetic DNA
taaatggactcactacag

SEQ ID NO: 16331 - DNA, 18 bp, Artificial Sequence
  Synthetic DNA
taaatttactcactatag

SEQ ID NO: 16332 - DNA, 18 bp, Artificial Sequence
  Synthetic DNA
taacacgacacagtattg

SEQ ID NO: 16333 - DNA, 18 bp, Artificial Sequence
  Synthetic DNA
taacacgactcgatttag

SEQ ID NO: 16334 - DNA, 18 bp, Artificial Sequence
  Synthetic DNA
taacacgatgcgctatag

SEQ ID NO: 16335 - DNA, 18 bp, Artificial Sequence
  Synthetic DNA
taacactactcactgttg

SEQ ID NO: 16336 - DNA, 18 bp, Artificial Sequence
  Synthetic DNA
taacaggattcgctatag

SEQ ID NO: 16337 - DNA, 18 bp, Artificial Sequence
  Synthetic DNA
taactagactcactttag

SEQ ID NO: 16338 - DNA, 18 bp, Artificial Sequence
  Synthetic DNA
taactcgacttactacag

SEQ ID NO: 16339 - DNA, 18 bp, Artificial Sequence
  Synthetic DNA
taactcgagtcaatatag

SEQ ID NO: 16340 - DNA, 18 bp, Artificial Sequence
  Synthetic DNA
taagaagactaactattg

SEQ ID NO: 16341 - DNA, 18 bp, Artificial Sequence
  Synthetic DNA
taagacgaatctctattg

SEQ ID NO: 16342 - DNA, 18 bp, Artificial Sequence
  Synthetic DNA
taagacgtctcacttttg

SEQ ID NO: 16343 - DNA, 18 bp, Artificial Sequence
  Synthetic DNA
taagtaaactcactatag

SEQ ID NO: 16344 - DNA, 18 bp, Artificial Sequence
  Synthetic DNA
taagttgactcactaaag

SEQ ID NO: 16345 - DNA, 18 bp, Artificial Sequence
  Synthetic DNA
taataaaaatcgctatag

SEQ ID NO: 16346 - DNA, 18 bp, Artificial Sequence
  Synthetic DNA
taataacactcactactg

SEQ ID NO: 16347 - DNA, 18 bp, Artificial Sequence
  Synthetic DNA
taataagtctcgcaatag

SEQ ID NO: 16348 - DNA, 18 bp, Artificial Sequence
  Synthetic DNA
taatacaaatcgctatgg

SEQ ID NO: 16349 - DNA, 18 bp, Artificial Sequence
  Synthetic DNA
taatacacctcaccattg

SEQ ID NO: 16350 - DNA, 18 bp, Artificial Sequence
  Synthetic DNA
taatacacgtcactattg

SEQ ID NO: 16351 - DNA, 18 bp, Artificial Sequence
  Synthetic DNA
taataccactcacaatta

SEQ ID NO: 16352 - DNA, 18 bp, Artificial Sequence
  Synthetic DNA
taatacgaatcacgtttg

SEQ ID NO: 16353 - DNA, 18 bp, Artificial Sequence
  Synthetic DNA
taatacgaattaatattg

SEQ ID NO: 16354 - DNA, 18 bp, Artificial Sequence
  Synthetic DNA
taatacgaattactgttg

SEQ ID NO: 16355 - DNA, 18 bp, Artificial Sequence
  Synthetic DNA
taatacgacacgcaaaag

SEQ ID NO: 16356 - DNA, 18 bp, Artificial Sequence
  Synthetic DNA
taatacgacacgcttgag

SEQ ID NO: 16357 - DNA, 18 bp, Artificial Sequence
  Synthetic DNA
taatacgactcacctgtg

SEQ ID NO: 16358 - DNA, 18 bp, Artificial Sequence
  Synthetic DNA
taatacgactcactgatc

SEQ ID NO: 16359 - DNA, 18 bp, Artificial Sequence
  Synthetic DNA
taatacgactccccaatg

SEQ ID NO: 16360 - DNA, 18 bp, Artificial Sequence
  Synthetic DNA
taatacgacttattgttg

SEQ ID NO: 16361 - DNA, 18 bp, Artificial Sequence
  Synthetic DNA
taatacgacttgttatcg

SEQ ID NO: 16362 - DNA, 18 bp, Artificial Sequence
  Synthetic DNA
taatacgagtcgataaag

SEQ ID NO: 16363 - DNA, 18 bp, Artificial Sequence
  Synthetic DNA
taatacgagtcgcattag

SEQ ID NO: 16364 - DNA, 18 bp, Artificial Sequence
  Synthetic DNA
taatacgagttgatatag

SEQ ID NO: 16365 - DNA, 18 bp, Artificial Sequence
  Synthetic DNA
taatacgagttgctttag

SEQ ID NO: 16366 - DNA, 18 bp, Artificial Sequence
  Synthetic DNA
taatacgattcaccactg

SEQ ID NO: 16367 - DNA, 18 bp, Artificial Sequence
  Synthetic DNA
taatacgccccacttttg

SEQ ID NO: 16368 - DNA, 18 bp, Artificial Sequence
  Synthetic DNA
taatacgcctctgtattg

SEQ ID NO: 16369 - DNA, 18 bp, Artificial Sequence
  Synthetic DNA
taatacggctctccattg

SEQ ID NO: 16370 - DNA, 18 bp, Artificial Sequence
  Synthetic DNA
taatacgtctcgctaacg

SEQ ID NO: 16371 - DNA, 18 bp, Artificial Sequence
  Synthetic DNA
taatactactaactactg

SEQ ID NO: 16372 - DNA, 18 bp, Artificial Sequence
  Synthetic DNA
taatactactcgcaaaag

SEQ ID NO: 16373 - DNA, 18 bp, Artificial Sequence
  Synthetic DNA
taataggtctccctattg

SEQ ID NO: 16374 - DNA, 18 bp, Artificial Sequence
  Synthetic DNA
taatagtactcgatatag

SEQ ID NO: 16375 - DNA, 18 bp, Artificial Sequence
  Synthetic DNA
taatataaatcgctatag

SEQ ID NO: 16376 - DNA, 18 bp, Artificial Sequence
  Synthetic DNA
taatatcactcaccattg

SEQ ID NO: 16377 - DNA, 18 bp, Artificial Sequence
  Synthetic DNA
taatatgactcgcgctag

SEQ ID NO: 16378 - DNA, 18 bp, Artificial Sequence
  Synthetic DNA
taatatgactcgtcatag

SEQ ID NO: 16379 - DNA, 18 bp, Artificial Sequence
  Synthetic DNA
taatatgactgactactg

SEQ ID NO: 16380 - DNA, 18 bp, Artificial Sequence
  Synthetic DNA
taatatgagacactattg

SEQ ID NO: 16381 - DNA, 18 bp, Artificial Sequence
  Synthetic DNA
taatatgattaactattg

SEQ ID NO: 16382 - DNA, 18 bp, Artificial Sequence
  Synthetic DNA
taatcccactcactactg

SEQ ID NO: 16383 - DNA, 18 bp, Artificial Sequence
  Synthetic DNA
taatccgactacctattg

SEQ ID NO: 16384 - DNA, 18 bp, Artificial Sequence
  Synthetic DNA
taatcgtactcactattg

SEQ ID NO: 16385 - DNA, 18 bp, Artificial Sequence
  Synthetic DNA
taatctcactcgctatag

SEQ ID NO: 16386 - DNA, 18 bp, Artificial Sequence
  Synthetic DNA
taatgagactcacttttg

SEQ ID NO: 16387 - DNA, 18 bp, Artificial Sequence
  Synthetic DNA
taatgcaactcgttatag

SEQ ID NO: 16388 - DNA, 18 bp, Artificial Sequence
  Synthetic DNA
taatgcgacacaatattg

SEQ ID NO: 16389 - DNA, 18 bp, Artificial Sequence
  Synthetic DNA
taatgcgactcacaactg

SEQ ID NO: 16390 - DNA, 18 bp, Artificial Sequence
  Synthetic DNA
taatgcgactcagtaatg

SEQ ID NO: 16391 - DNA, 18 bp, Artificial Sequence
  Synthetic DNA
taatgcgactgtctattg

SEQ ID NO: 16392 - DNA, 18 bp, Artificial Sequence
  Synthetic DNA
taatgctactcacgattg

SEQ ID NO: 16393 - DNA, 18 bp, Artificial Sequence
  Synthetic DNA
taatgtgactctctattg

SEQ ID NO: 16394 - DNA, 18 bp, Artificial Sequence
  Synthetic DNA
taattagaatcactataa

SEQ ID NO: 16395 - DNA, 18 bp, Artificial Sequence
  Synthetic DNA
taattagactcactttaa

SEQ ID NO: 16396 - DNA, 18 bp, Artificial Sequence
  Synthetic DNA
taattagactcactttcg

SEQ ID NO: 16397 - DNA, 18 bp, Artificial Sequence
  Synthetic DNA
taattagactcattagag

SEQ ID NO: 16398 - DNA, 18 bp, Artificial Sequence
  Synthetic DNA
taattagacttagtatag

SEQ ID NO: 16399 - DNA, 18 bp, Artificial Sequence
  Synthetic DNA
taattcaacccactttag

SEQ ID NO: 16400 - DNA, 18 bp, Artificial Sequence
  Synthetic DNA
taattcaactcccgatag

SEQ ID NO: 16401 - DNA, 18 bp, Artificial Sequence
  Synthetic DNA
taattcaactccctagag

SEQ ID NO: 16402 - DNA, 18 bp, Artificial Sequence
  Synthetic DNA
taattcaactgcctatag

SEQ ID NO: 16403 - DNA, 18 bp, Artificial Sequence
  Synthetic DNA
taattccactcacactag

SEQ ID NO: 16404 - DNA, 18 bp, Artificial Sequence
  Synthetic DNA
taattccactcaccctag

SEQ ID NO: 16405 - DNA, 18 bp, Artificial Sequence
  Synthetic DNA
taattccactctgtatag

SEQ ID NO: 16406 - DNA, 18 bp, Artificial Sequence
  Synthetic DNA
taattcgactcaccagcg

SEQ ID NO: 16407 - DNA, 18 bp, Artificial Sequence
  Synthetic DNA
taattcgactcacctaag

SEQ ID NO: 16408 - DNA, 18 bp, Artificial Sequence
  Synthetic DNA
taattcgactgcatatag

SEQ ID NO: 16409 - DNA, 18 bp, Artificial Sequence
  Synthetic DNA
taattcgatgcacgatag

SEQ ID NO: 16410 - DNA, 18 bp, Artificial Sequence
  Synthetic DNA
taattcgattcaatacag

SEQ ID NO: 16411 - DNA, 18 bp, Artificial Sequence
  Synthetic DNA
taattcgattcacaacag

SEQ ID NO: 16412 - DNA, 18 bp, Artificial Sequence
  Synthetic DNA
taattcgccccactaaag

SEQ ID NO: 16413 - DNA, 18 bp, Artificial Sequence
  Synthetic DNA
taattcgcctcactaagg

SEQ ID NO: 16414 - DNA, 18 bp, Artificial Sequence
  Synthetic DNA
taattcgcttcactaaag

SEQ ID NO: 16415 - DNA, 18 bp, Artificial Sequence
  Synthetic DNA
taattcggctctgtatag

SEQ ID NO: 16416 - DNA, 18 bp, Artificial Sequence
  Synthetic DNA
taattcgtctgactgtag

SEQ ID NO: 16417 - DNA, 18 bp, Artificial Sequence
  Synthetic DNA
taattcgtcttacgatag

SEQ ID NO: 16418 - DNA, 18 bp, Artificial Sequence
  Synthetic DNA
taattctactaattatag

SEQ ID NO: 16419 - DNA, 18 bp, Artificial Sequence
  Synthetic DNA
taattctactcacttgag

SEQ ID NO: 16420 - DNA, 18 bp, Artificial Sequence
  Synthetic DNA
taattctactgcctatag

SEQ ID NO: 16421 - DNA, 18 bp, Artificial Sequence
  Synthetic DNA
taattctattcaccatag

SEQ ID NO: 16422 - DNA, 18 bp, Artificial Sequence
  Synthetic DNA
taattctcctcactgtag

SEQ ID NO: 16423 - DNA, 18 bp, Artificial Sequence
  Synthetic DNA
taattctgctcactaaag

SEQ ID NO: 16424 - DNA, 18 bp, Artificial Sequence
  Synthetic DNA
taattgcacacactatag

SEQ ID NO: 16425 - DNA, 18 bp, Artificial Sequence
  Synthetic DNA
taattgcactcactttag

SEQ ID NO: 16426 - DNA, 18 bp, Artificial Sequence
  Synthetic DNA
taattggactcacaatcg

SEQ ID NO: 16427 - DNA, 18 bp, Artificial Sequence
  Synthetic DNA
taatttgaatcactagag

SEQ ID NO: 16428 - DNA, 18 bp, Artificial Sequence
  Synthetic DNA
taatttgactcaatttag

SEQ ID NO: 16429 - DNA, 18 bp, Artificial Sequence
  Synthetic DNA
taatttgcctcactatgg

SEQ ID NO: 16430 - DNA, 18 bp, Artificial Sequence
  Synthetic DNA
tactaacactcgctatag

SEQ ID NO: 16431 - DNA, 18 bp, Artificial Sequence
  Synthetic DNA
tactaggactcactactg

SEQ ID NO: 16432 - DNA, 18 bp, Artificial Sequence
  Synthetic DNA
tactccgactaactattg

SEQ ID NO: 16433 - DNA, 18 bp, Artificial Sequence
  Synthetic DNA
tacttcgacacagtatag

SEQ ID NO: 16434 - DNA, 18 bp, Artificial Sequence
  Synthetic DNA
tacttcgacctactatag

SEQ ID NO: 16435 - DNA, 18 bp, Artificial Sequence
  Synthetic DNA
tacttcgactgactaaag

SEQ ID NO: 16436 - DNA, 18 bp, Artificial Sequence
  Synthetic DNA
tacttcgacttactaaag

SEQ ID NO: 16437 - DNA, 18 bp, Artificial Sequence
  Synthetic DNA
tagaccgactcactattg

SEQ ID NO: 16438 - DNA, 18 bp, Artificial Sequence
  Synthetic DNA
tagtacgactcgccagag

SEQ ID NO: 16439 - DNA, 18 bp, Artificial Sequence
  Synthetic DNA
tagtacgagtcggtatag

SEQ ID NO: 16440 - DNA, 18 bp, Artificial Sequence
  Synthetic DNA
tagtacgtctaactattg

SEQ ID NO: 16441 - DNA, 18 bp, Artificial Sequence
  Synthetic DNA
tagtaggactctctattg

SEQ ID NO: 16442 - DNA, 18 bp, Artificial Sequence
  Synthetic DNA
tagttcgaatcacaatag

SEQ ID NO: 16443 - DNA, 18 bp, Artificial Sequence
  Synthetic DNA
tagttcgtctcactaaag

SEQ ID NO: 16444 - DNA, 18 bp, Artificial Sequence
  Synthetic DNA
tagtttgactcactctag

SEQ ID NO: 16445 - DNA, 18 bp, Artificial Sequence
  Synthetic DNA
tataacgactcgcgatag

SEQ ID NO: 16446 - DNA, 18 bp, Artificial Sequence
  Synthetic DNA
tatcacgacttactattg

SEQ ID NO: 16447 - DNA, 18 bp, Artificial Sequence
  Synthetic DNA
tattaagactcgctatgg

SEQ ID NO: 16448 - DNA, 18 bp, Artificial Sequence
  Synthetic DNA
tattaagactcgctctag

SEQ ID NO: 16449 - DNA, 18 bp, Artificial Sequence
  Synthetic DNA
tattacgaatccctattg

SEQ ID NO: 16450 - DNA, 18 bp, Artificial Sequence
  Synthetic DNA
tattacgactcacccttg

SEQ ID NO: 16451 - DNA, 18 bp, Artificial Sequence
  Synthetic DNA
tattacgactcactactt

SEQ ID NO: 16452 - DNA, 18 bp, Artificial Sequence
  Synthetic DNA
tattacgactcactcctg

SEQ ID NO: 16453 - DNA, 18 bp, Artificial Sequence
  Synthetic DNA
tattacgactcgatacag

SEQ ID NO: 16454 - DNA, 18 bp, Artificial Sequence
  Synthetic DNA
tattacggcccactattg

SEQ ID NO: 16455 - DNA, 18 bp, Artificial Sequence
  Synthetic DNA
tattccgactcaccattg

SEQ ID NO: 16456 - DNA, 18 bp, Artificial Sequence
  Synthetic DNA
tattccgactcgctttag

SEQ ID NO: 16457 - DNA, 18 bp, Artificial Sequence
  Synthetic DNA
tattgcgactaactattg

SEQ ID NO: 16458 - DNA, 18 bp, Artificial Sequence
  Synthetic DNA
tatttccactcattatag

SEQ ID NO: 16459 - DNA, 18 bp, Artificial Sequence
  Synthetic DNA
tatttccactgactatag

SEQ ID NO: 16460 - DNA, 18 bp, Artificial Sequence
  Synthetic DNA
tatttcgacacactctag

SEQ ID NO: 16461 - DNA, 18 bp, Artificial Sequence
  Synthetic DNA
tatttcgactcacaatcg

SEQ ID NO: 16462 - DNA, 18 bp, Artificial Sequence
  Synthetic DNA
tatttcgactcaccttag

SEQ ID NO: 16463 - DNA, 18 bp, Artificial Sequence
  Synthetic DNA
tatttcgactcactagcg

SEQ ID NO: 16464 - DNA, 18 bp, Artificial Sequence
  Synthetic DNA
tatttcgactcacttgag

SEQ ID NO: 16465 - DNA, 18 bp, Artificial Sequence
  Synthetic DNA
tatttggactcacgatag

SEQ ID NO: 16466 - DNA, 18 bp, Artificial Sequence
  Synthetic DNA
tatttggactcactaaag

SEQ ID NO: 16467 - DNA, 18 bp, Artificial Sequence
  Synthetic DNA
tatttggactcagtatag

SEQ ID NO: 16468 - DNA, 18 bp, Artificial Sequence
  Synthetic DNA
tcaatggactcactatag

SEQ ID NO: 16469 - DNA, 18 bp, Artificial Sequence
  Synthetic DNA
tcacacgattcactattg

SEQ ID NO: 16470 - DNA, 18 bp, Artificial Sequence
  Synthetic DNA
tcactcgagtcactatag

SEQ ID NO: 16471 - DNA, 18 bp, Artificial Sequence
  Synthetic DNA
tcatacgacccaatattg

SEQ ID NO: 16472 - DNA, 18 bp, Artificial Sequence
  Synthetic DNA
tcatacgactctctcttg

SEQ ID NO: 16473 - DNA, 18 bp, Artificial Sequence
  Synthetic DNA
tcattcgagtcactatgg

SEQ ID NO: 16474 - DNA, 18 bp, Artificial Sequence
  Synthetic DNA
tcattcgcgtcactatag

SEQ ID NO: 16475 - DNA, 18 bp, Artificial Sequence
  Synthetic DNA
tcatttgacccactatag

SEQ ID NO: 16476 - DNA, 18 bp, Artificial Sequence
  Synthetic DNA
tgactcggctcactatag

SEQ ID NO: 16477 - DNA, 18 bp, Artificial Sequence
  Synthetic DNA
tgataagacgcactattg

SEQ ID NO: 16478 - DNA, 18 bp, Artificial Sequence
  Synthetic DNA
tgataagactcactgttg

SEQ ID NO: 16479 - DNA, 18 bp, Artificial Sequence
  Synthetic DNA
tgatacacctcactattg

SEQ ID NO: 16480 - DNA, 18 bp, Artificial Sequence
  Synthetic DNA
tgatacgtcccactattg

SEQ ID NO: 16481 - DNA, 18 bp, Artificial Sequence
  Synthetic DNA
tgataggactcgctttag

SEQ ID NO: 16482 - DNA, 18 bp, Artificial Sequence
  Synthetic DNA
tgatccgactcagtattg

SEQ ID NO: 16483 - DNA, 18 bp, Artificial Sequence
  Synthetic DNA
tgattcgactcaccgtag

SEQ ID NO: 16484 - DNA, 18 bp, Artificial Sequence
  Synthetic DNA
tgattcgactcactctgg

SEQ ID NO: 16485 - DNA, 18 bp, Artificial Sequence
  Synthetic DNA
tgattcgactctctatcg

SEQ ID NO: 16486 - DNA, 18 bp, Artificial Sequence
  Synthetic DNA
tgattcgtctcagtatag

SEQ ID NO: 16487 - DNA, 18 bp, Artificial Sequence
  Synthetic DNA
tgcaacgactcactattg

SEQ ID NO: 16488 - DNA, 18 bp, Artificial Sequence
  Synthetic DNA
tgttacgactcactactg

SEQ ID NO: 16489 - DNA, 18 bp, Artificial Sequence
  Synthetic DNA
ttataccagtcactattg

SEQ ID NO: 16490 - DNA, 18 bp, Artificial Sequence
  Synthetic DNA
ttatacgacacgctctag

SEQ ID NO: 16491 - DNA, 18 bp, Artificial Sequence
  Synthetic DNA
ttatacgactcacaatta

SEQ ID NO: 16492 - DNA, 18 bp, Artificial Sequence
  Synthetic DNA
ttatacgcctcactaatg

SEQ ID NO: 16493 - DNA, 18 bp, Artificial Sequence
  Synthetic DNA
ttattagactcaccatag

SEQ ID NO: 16494 - DNA, 18 bp, Artificial Sequence
  Synthetic DNA
ttattaggctcactatag

SEQ ID NO: 16495 - DNA, 18 bp, Artificial Sequence
  Synthetic DNA
ttattcgactcactccag

SEQ ID NO: 16496 - DNA, 18 bp, Artificial Sequence
  Synthetic DNA
ttattcgactcccgatag

SEQ ID NO: 16497 - DNA, 18 bp, Artificial Sequence
  Synthetic DNA
ttctacgacgcgctatag

SEQ ID NO: 16498 - DNA, 18 bp, Artificial Sequence
  Synthetic DNA
ttctacgactcgctgtag

SEQ ID NO: 16499 - DNA, 18 bp, Artificial Sequence
  Synthetic DNA
ttcttcgactcaccatag

SEQ ID NO: 16500 - DNA, 18 bp, Artificial Sequence
  Synthetic DNA
ttgtacaactcgctatag

SEQ ID NO: 16501 - DNA, 18 bp, Artificial Sequence
  Synthetic DNA
ttgtacgactcgctacag

SEQ ID NO: 16502 - DNA, 18 bp, Artificial Sequence
  Synthetic DNA
ttgtacgactggctatag

SEQ ID NO: 16503 - DNA, 18 bp, Artificial Sequence
  Synthetic DNA
ttttacgactcgccatag

SEQ ID NO: 16504 - DNA, 18 bp, Artificial Sequence
  Synthetic DNA
aaaaacgacccattatag

SEQ ID NO: 16505 - DNA, 18 bp, Artificial Sequence
  Synthetic DNA
aaacaggactcacaatag

SEQ ID NO: 16506 - DNA, 18 bp, Artificial Sequence
  Synthetic DNA
aaagacgactgattatag

SEQ ID NO: 16507 - DNA, 18 bp, Artificial Sequence
  Synthetic DNA
aaagacgtcacactatag

SEQ ID NO: 16508 - DNA, 18 bp, Artificial Sequence
  Synthetic DNA
aaataagacacactgtag

SEQ ID NO: 16509 - DNA, 18 bp, Artificial Sequence
  Synthetic DNA
aaataagactcaccacag

SEQ ID NO: 16510 - DNA, 18 bp, Artificial Sequence
  Synthetic DNA
aaataagattaactatag

SEQ ID NO: 16511 - DNA, 18 bp, Artificial Sequence
  Synthetic DNA
aaatacatgtcactatag

SEQ ID NO: 16512 - DNA, 18 bp, Artificial Sequence
  Synthetic DNA
aaataccactcaatatgg

SEQ ID NO: 16513 - DNA, 18 bp, Artificial Sequence
  Synthetic DNA
aaataccattcacgatag

SEQ ID NO: 16514 - DNA, 18 bp, Artificial Sequence
  Synthetic DNA
aaatacgacacattataa

SEQ ID NO: 16515 - DNA, 18 bp, Artificial Sequence
  Synthetic DNA
aaatacgacaccatatag

SEQ ID NO: 16516 - DNA, 18 bp, Artificial Sequence
  Synthetic DNA
aaatacgactcaaactag

SEQ ID NO: 16517 - DNA, 18 bp, Artificial Sequence
  Synthetic DNA
aaatacgactcaacagag

SEQ ID NO: 16518 - DNA, 18 bp, Artificial Sequence
  Synthetic DNA
aaatacgacttagtgtag

SEQ ID NO: 16519 - DNA, 18 bp, Artificial Sequence
  Synthetic DNA
aaatacgagtcattctag

SEQ ID NO: 16520 - DNA, 18 bp, Artificial Sequence
  Synthetic DNA
aaatacgagtctcaatag

SEQ ID NO: 16521 - DNA, 18 bp, Artificial Sequence
  Synthetic DNA
aaatacgattctctacag

SEQ ID NO: 16522 - DNA, 18 bp, Artificial Sequence
  Synthetic DNA
aaatacgcaacactatag

SEQ ID NO: 16523 - DNA, 18 bp, Artificial Sequence
  Synthetic DNA
aaatacgccacattatag

SEQ ID NO: 16524 - DNA, 18 bp, Artificial Sequence
  Synthetic DNA
aaatacgtctaactctag

SEQ ID NO: 16525 - DNA, 18 bp, Artificial Sequence
  Synthetic DNA
aaatacgtctcaatctag

SEQ ID NO: 16526 - DNA, 18 bp, Artificial Sequence
  Synthetic DNA
aaatactacatactatag

SEQ ID NO: 16527 - DNA, 18 bp, Artificial Sequence
  Synthetic DNA
aaatactccttactatag

SEQ ID NO: 16528 - DNA, 18 bp, Artificial Sequence
  Synthetic DNA
aaatagcacttactatag

SEQ ID NO: 16529 - DNA, 18 bp, Artificial Sequence
  Synthetic DNA
aaataggacatactatag

SEQ ID NO: 16530 - DNA, 18 bp, Artificial Sequence
  Synthetic DNA
aaataggacttactatcg

SEQ ID NO: 16531 - DNA, 18 bp, Artificial Sequence
  Synthetic DNA
aaataggcctcactacag

SEQ ID NO: 16532 - DNA, 18 bp, Artificial Sequence
  Synthetic DNA
aaatccaactcactctag

SEQ ID NO: 16533 - DNA, 18 bp, Artificial Sequence
  Synthetic DNA
aaatccgacagactatag

SEQ ID NO: 16534 - DNA, 18 bp, Artificial Sequence
  Synthetic DNA
aaatcctactcactagag

SEQ ID NO: 16535 - DNA, 18 bp, Artificial Sequence
  Synthetic DNA
aaatgagactcacgatag

SEQ ID NO: 16536 - DNA, 18 bp, Artificial Sequence
  Synthetic DNA
aaatgcgactcacttcag

SEQ ID NO: 16537 - DNA, 18 bp, Artificial Sequence
  Synthetic DNA
aaatgcgagtcacaatag

SEQ ID NO: 16538 - DNA, 18 bp, Artificial Sequence
  Synthetic DNA
aactaccactcattatag

SEQ ID NO: 16539 - DNA, 18 bp, Artificial Sequence
  Synthetic DNA
aactacgactgactgtag

SEQ ID NO: 16540 - DNA, 18 bp, Artificial Sequence
  Synthetic DNA
aactacgtctcattatag

SEQ ID NO: 16541 - DNA, 18 bp, Artificial Sequence
  Synthetic DNA
aactctgactcactatag

SEQ ID NO: 16542 - DNA, 18 bp, Artificial Sequence
  Synthetic DNA
aagtacgactcacttcag

SEQ ID NO: 16543 - DNA, 18 bp, Artificial Sequence
  Synthetic DNA
aagtatgactccctatag

SEQ ID NO: 16544 - DNA, 18 bp, Artificial Sequence
  Synthetic DNA
aattacgactcacgaaag

SEQ ID NO: 16545 - DNA, 18 bp, Artificial Sequence
  Synthetic DNA
aattgggactcactatag

SEQ ID NO: 16546 - DNA, 18 bp, Artificial Sequence
  Synthetic DNA
acttaccactcactatag

SEQ ID NO: 16547 - DNA, 18 bp, Artificial Sequence
  Synthetic DNA
agacacgactcactatgg

SEQ ID NO: 16548 - DNA, 18 bp, Artificial Sequence
  Synthetic DNA
agagacgactctctatag

SEQ ID NO: 16549 - DNA, 18 bp, Artificial Sequence
  Synthetic DNA
agataagactaactatag

SEQ ID NO: 16550 - DNA, 18 bp, Artificial Sequence
  Synthetic DNA
agatacgactctctagag

SEQ ID NO: 16551 - DNA, 18 bp, Artificial Sequence
  Synthetic DNA
agatacgagtctctatag

SEQ ID NO: 16552 - DNA, 18 bp, Artificial Sequence
  Synthetic DNA
agatatgactcagtatag

SEQ ID NO: 16553 - DNA, 18 bp, Artificial Sequence
  Synthetic DNA
atacacgactcactacag

SEQ ID NO: 16554 - DNA, 18 bp, Artificial Sequence
  Synthetic DNA
atagacgtctcactatag

SEQ ID NO: 16555 - DNA, 18 bp, Artificial Sequence
  Synthetic DNA
atatacgacgcactctag

SEQ ID NO: 16556 - DNA, 18 bp, Artificial Sequence
  Synthetic DNA
atatacgactaactagag

SEQ ID NO: 16557 - DNA, 18 bp, Artificial Sequence
  Synthetic DNA
atatacgactcagaatag

SEQ ID NO: 16558 - DNA, 18 bp, Artificial Sequence
  Synthetic DNA
atatacgactgcctatag

SEQ ID NO: 16559 - DNA, 18 bp, Artificial Sequence
  Synthetic DNA
atatagaactcactatag

SEQ ID NO: 16560 - DNA, 18 bp, Artificial Sequence
  Synthetic DNA
atataggacgcactatag

SEQ ID NO: 16561 - DNA, 18 bp, Artificial Sequence
  Synthetic DNA
caaaacgaatcactaaag

SEQ ID NO: 16562 - DNA, 18 bp, Artificial Sequence
  Synthetic DNA
caaaacgtcttactatag

SEQ ID NO: 16563 - DNA, 18 bp, Artificial Sequence
  Synthetic DNA
caacacgactcacactag

SEQ ID NO: 16564 - DNA, 18 bp, Artificial Sequence
  Synthetic DNA
caacgcgtctcactatag

SEQ ID NO: 16565 - DNA, 18 bp, Artificial Sequence
  Synthetic DNA
caagacgcctcactaaag

SEQ ID NO: 16566 - DNA, 18 bp, Artificial Sequence
  Synthetic DNA
caagatgactctctatag

SEQ ID NO: 16567 - DNA, 18 bp, Artificial Sequence
  Synthetic DNA
caataacactcactacag

SEQ ID NO: 16568 - DNA, 18 bp, Artificial Sequence
  Synthetic DNA
caataagaatccctatag

SEQ ID NO: 16569 - DNA, 18 bp, Artificial Sequence
  Synthetic DNA
caataagacccactttag

SEQ ID NO: 16570 - DNA, 18 bp, Artificial Sequence
  Synthetic DNA
caataaggctcactaaag

SEQ ID NO: 16571 - DNA, 18 bp, Artificial Sequence
  Synthetic DNA
caataagtctcactgtag

SEQ ID NO: 16572 - DNA, 18 bp, Artificial Sequence
  Synthetic DNA
caatacaacacacaatag

SEQ ID NO: 16573 - DNA, 18 bp, Artificial Sequence
  Synthetic DNA
caatacaacttacgatag

SEQ ID NO: 16574 - DNA, 18 bp, Artificial Sequence
  Synthetic DNA
caataccaatcactatcg

SEQ ID NO: 16575 - DNA, 18 bp, Artificial Sequence
  Synthetic DNA
caatacgaatcactagcg

SEQ ID NO: 16576 - DNA, 18 bp, Artificial Sequence
  Synthetic DNA
caatacgactaacaaaag

SEQ ID NO: 16577 - DNA, 18 bp, Artificial Sequence
  Synthetic DNA
caatacgactaagaatag

SEQ ID NO: 16578 - DNA, 18 bp, Artificial Sequence
  Synthetic DNA
caatacgactctacatag

SEQ ID NO: 16579 - DNA, 18 bp, Artificial Sequence
  Synthetic DNA
caatacgactgaatacag

SEQ ID NO: 16580 - DNA, 18 bp, Artificial Sequence
  Synthetic DNA
caatacggctcacaaaag

SEQ ID NO: 16581 - DNA, 18 bp, Artificial Sequence
  Synthetic DNA
caatacggttcactagag

SEQ ID NO: 16582 - DNA, 18 bp, Artificial Sequence
  Synthetic DNA
caatacgtctcacagtag

SEQ ID NO: 16583 - DNA, 18 bp, Artificial Sequence
  Synthetic DNA
caatacgtcttaatatag

SEQ ID NO: 16584 - DNA, 18 bp, Artificial Sequence
  Synthetic DNA
caatactacttaatatag

SEQ ID NO: 16585 - DNA, 18 bp, Artificial Sequence
  Synthetic DNA
caatactcttcactatag

SEQ ID NO: 16586 - DNA, 18 bp, Artificial Sequence
  Synthetic DNA
caatataactcactaaag

SEQ ID NO: 16587 - DNA, 18 bp, Artificial Sequence
  Synthetic DNA
caatatgactcaaaatag

SEQ ID NO: 16588 - DNA, 18 bp, Artificial Sequence
  Synthetic DNA
caatatgactgactatcg

SEQ ID NO: 16589 - DNA, 18 bp, Artificial Sequence
  Synthetic DNA
caatatgcctcactttag

SEQ ID NO: 16590 - DNA, 18 bp, Artificial Sequence
  Synthetic DNA
caatatgtctcactctag

SEQ ID NO: 16591 - DNA, 18 bp, Artificial Sequence
  Synthetic DNA
caatatgtcttactatag

SEQ ID NO: 16592 - DNA, 18 bp, Artificial Sequence
  Synthetic DNA
caatccgattcactctag

SEQ ID NO: 16593 - DNA, 18 bp, Artificial Sequence
  Synthetic DNA
caatcctactcactaaag

SEQ ID NO: 16594 - DNA, 18 bp, Artificial Sequence
  Synthetic DNA
cactacatctcactatag

SEQ ID NO: 16595 - DNA, 18 bp, Artificial Sequence
  Synthetic DNA
cactacccctcactatag

SEQ ID NO: 16596 - DNA, 18 bp, Artificial Sequence
  Synthetic DNA
cactacgactaactaaag

SEQ ID NO: 16597 - DNA, 18 bp, Artificial Sequence
  Synthetic DNA
cactacgtttcactatag

SEQ ID NO: 16598 - DNA, 18 bp, Artificial Sequence
  Synthetic DNA
cagtacgattctctatag

SEQ ID NO: 16599 - DNA, 18 bp, Artificial Sequence
  Synthetic DNA
cagtatgactcaccatag

SEQ ID NO: 16600 - DNA, 18 bp, Artificial Sequence
  Synthetic DNA
cataacgcctcactatag

SEQ ID NO: 16601 - DNA, 18 bp, Artificial Sequence
  Synthetic DNA
catcacgacacactatag

SEQ ID NO: 16602 - DNA, 18 bp, Artificial Sequence
  Synthetic DNA
cattacaacccactatag

SEQ ID NO: 16603 - DNA, 18 bp, Artificial Sequence
  Synthetic DNA
cattacgactcattaaag

SEQ ID NO: 16604 - DNA, 18 bp, Artificial Sequence
  Synthetic DNA
cgttacgactaactatag

SEQ ID NO: 16605 - DNA, 18 bp, Artificial Sequence
  Synthetic DNA
ctataagactcaatatag

SEQ ID NO: 16606 - DNA, 18 bp, Artificial Sequence
  Synthetic DNA
ctataccactgactatag

SEQ ID NO: 16607 - DNA, 18 bp, Artificial Sequence
  Synthetic DNA
ctatacgagtctctatag

SEQ ID NO: 16608 - DNA, 18 bp, Artificial Sequence
  Synthetic DNA
ctatatgactcactatgg

SEQ ID NO: 16609 - DNA, 18 bp, Artificial Sequence
  Synthetic DNA
ctatgcaactcactatag

SEQ ID NO: 16610 - DNA, 18 bp, Artificial Sequence
  Synthetic DNA
gaaaacgattcattatag

SEQ ID NO: 16611 - DNA, 18 bp, Artificial Sequence
  Synthetic DNA
gaatacgacacaccttag

SEQ ID NO: 16612 - DNA, 18 bp, Artificial Sequence
  Synthetic DNA
gaatacgactcacattgg

SEQ ID NO: 16613 - DNA, 18 bp, Artificial Sequence
  Synthetic DNA
gaatactactcagaatag

SEQ ID NO: 16614 - DNA, 18 bp, Artificial Sequence
  Synthetic DNA
gaatccgactctatatag

SEQ ID NO: 16615 - DNA, 18 bp, Artificial Sequence
  Synthetic DNA
gacaacgactcactgtag

SEQ ID NO: 16616 - DNA, 18 bp, Artificial Sequence
  Synthetic DNA
gactacgacccactttag

SEQ ID NO: 16617 - DNA, 18 bp, Artificial Sequence
  Synthetic DNA
gactacgactcactaagg

SEQ ID NO: 16618 - DNA, 18 bp, Artificial Sequence
  Synthetic DNA
gactatgactcactacag

SEQ ID NO: 16619 - DNA, 18 bp, Artificial Sequence
  Synthetic DNA
gagtacgacacactctag

SEQ ID NO: 16620 - DNA, 18 bp, Artificial Sequence
  Synthetic DNA
gattacgactcattgtag

SEQ ID NO: 16621 - DNA, 18 bp, Artificial Sequence
  Synthetic DNA
ggatacgtcccactatag

SEQ ID NO: 16622 - DNA, 18 bp, Artificial Sequence
  Synthetic DNA
ggatcggactcactatag

SEQ ID NO: 16623 - DNA, 18 bp, Artificial Sequence
  Synthetic DNA
ggctacgactcactctag

SEQ ID NO: 16624 - DNA, 18 bp, Artificial Sequence
  Synthetic DNA
ggttacgaatcactatag

SEQ ID NO: 16625 - DNA, 18 bp, Artificial Sequence
  Synthetic DNA
gtatacaactcactaaag

SEQ ID NO: 16626 - DNA, 18 bp, Artificial Sequence
  Synthetic DNA
gtatacgactctctgtag

SEQ ID NO: 16627 - DNA, 18 bp, Artificial Sequence
  Synthetic DNA
taaaaagaccgactatag

SEQ ID NO: 16628 - DNA, 18 bp, Artificial Sequence
  Synthetic DNA
taaaaagactcacttgag

SEQ ID NO: 16629 - DNA, 18 bp, Artificial Sequence
  Synthetic DNA
taaaaagactctctttag

SEQ ID NO: 16630 - DNA, 18 bp, Artificial Sequence
  Synthetic DNA
taaaaagattcactctag

SEQ ID NO: 16631 - DNA, 18 bp, Artificial Sequence
  Synthetic DNA
taaaaccactcacgacag

SEQ ID NO: 16632 - DNA, 18 bp, Artificial Sequence
  Synthetic DNA
taaaaccactcagaatag

SEQ ID NO: 16633 - DNA, 18 bp, Artificial Sequence
  Synthetic DNA
taaaacgaatacctatag

SEQ ID NO: 16634 - DNA, 18 bp, Artificial Sequence
  Synthetic DNA
taaaacgacacagtttag

SEQ ID NO: 16635 - DNA, 18 bp, Artificial Sequence
  Synthetic DNA
taaaacgacatactataa

SEQ ID NO: 16636 - DNA, 18 bp, Artificial Sequence
  Synthetic DNA
taaaacgacccacaacag

SEQ ID NO: 16637 - DNA, 18 bp, Artificial Sequence
  Synthetic DNA
taaaacgactaacgaaag

SEQ ID NO: 16638 - DNA, 18 bp, Artificial Sequence
  Synthetic DNA
taaaacgactcacaggag

SEQ ID NO: 16639 - DNA, 18 bp, Artificial Sequence
  Synthetic DNA
taaaacgactcaccgtgg

SEQ ID NO: 16640 - DNA, 18 bp, Artificial Sequence
  Synthetic DNA
taaaacgactcactccgg

SEQ ID NO: 16641 - DNA, 18 bp, Artificial Sequence
  Synthetic DNA
taaaacgactcatcatcg

SEQ ID NO: 16642 - DNA, 18 bp, Artificial Sequence
  Synthetic DNA
taaaacgagtcactgaag

SEQ ID NO: 16643 - DNA, 18 bp, Artificial Sequence
  Synthetic DNA
taaaacgagtcattacag

SEQ ID NO: 16644 - DNA, 18 bp, Artificial Sequence
  Synthetic DNA
taaaacgattgactttag

SEQ ID NO: 16645 - DNA, 18 bp, Artificial Sequence
  Synthetic DNA
taaaacggcacacaatag

SEQ ID NO: 16646 - DNA, 18 bp, Artificial Sequence
  Synthetic DNA
taaaacgtatcactatgg

SEQ ID NO: 16647 - DNA, 18 bp, Artificial Sequence
  Synthetic DNA
taaaactactgactatcg

SEQ ID NO: 16648 - DNA, 18 bp, Artificial Sequence
  Synthetic DNA
taaaactagtcactatgg

SEQ ID NO: 16649 - DNA, 18 bp, Artificial Sequence
  Synthetic DNA
taaaactcctcaccatag

SEQ ID NO: 16650 - DNA, 18 bp, Artificial Sequence
  Synthetic DNA
taaaactgctcaccatag

SEQ ID NO: 16651 - DNA, 18 bp, Artificial Sequence
  Synthetic DNA
taaaacttctcactagag

SEQ ID NO: 16652 - DNA, 18 bp, Artificial Sequence
  Synthetic DNA
taaaaggactcacaatcg

SEQ ID NO: 16653 - DNA, 18 bp, Artificial Sequence
  Synthetic DNA
taaaaggactcacttaag

SEQ ID NO: 16654 - DNA, 18 bp, Artificial Sequence
  Synthetic DNA
taaaaggactcataatag

SEQ ID NO: 16655 - DNA, 18 bp, Artificial Sequence
  Synthetic DNA
taaaataactcactacag

SEQ ID NO: 16656 - DNA, 18 bp, Artificial Sequence
  Synthetic DNA
taaaattactccctatag

SEQ ID NO: 16657 - DNA, 18 bp, Artificial Sequence
  Synthetic DNA
taaaattagtcactatag

SEQ ID NO: 16658 - DNA, 18 bp, Artificial Sequence
  Synthetic DNA
taaaccgacacactttag

SEQ ID NO: 16659 - DNA, 18 bp, Artificial Sequence
  Synthetic DNA
taaagccactcattatag

SEQ ID NO: 16660 - DNA, 18 bp, Artificial Sequence
  Synthetic DNA
taaagcgactcacgagag

SEQ ID NO: 16661 - DNA, 18 bp, Artificial Sequence
  Synthetic DNA
taaagcgactgactttag

SEQ ID NO: 16662 - DNA, 18 bp, Artificial Sequence
  Synthetic DNA
taaagcggctcactttag

SEQ ID NO: 16663 - DNA, 18 bp, Artificial Sequence
  Synthetic DNA
taaagcgtctcaccatag

SEQ ID NO: 16664 - DNA, 18 bp, Artificial Sequence
  Synthetic DNA
taaagcttctcactatag

SEQ ID NO: 16665 - DNA, 18 bp, Artificial Sequence
  Synthetic DNA
taaagggactcattatag

SEQ ID NO: 16666 - DNA, 18 bp, Artificial Sequence
  Synthetic DNA
taacaaaactcactacag

SEQ ID NO: 16667 - DNA, 18 bp, Artificial Sequence
  Synthetic DNA
taacaatactcactaaag

SEQ ID NO: 16668 - DNA, 18 bp, Artificial Sequence
  Synthetic DNA
taacacaacccactatgg

SEQ ID NO: 16669 - DNA, 18 bp, Artificial Sequence
  Synthetic DNA
taacacaagacactatag

SEQ ID NO: 16670 - DNA, 18 bp, Artificial Sequence
  Synthetic DNA
taacacgaataactttag

SEQ ID NO: 16671 - DNA, 18 bp, Artificial Sequence
  Synthetic DNA
taacacgaccaactctag

SEQ ID NO: 16672 - DNA, 18 bp, Artificial Sequence
  Synthetic DNA
taacacgactaagtagag

SEQ ID NO: 16673 - DNA, 18 bp, Artificial Sequence
  Synthetic DNA
taacacgactctcactag

SEQ ID NO: 16674 - DNA, 18 bp, Artificial Sequence
  Synthetic DNA
taacacgacttagaatag

SEQ ID NO: 16675 - DNA, 18 bp, Artificial Sequence
  Synthetic DNA
taacacgattctatatag

SEQ ID NO: 16676 - DNA, 18 bp, Artificial Sequence
  Synthetic DNA
taacacgcgccactatag

SEQ ID NO: 16677 - DNA, 18 bp, Artificial Sequence
  Synthetic DNA
taacacgcgtcactttag

SEQ ID NO: 16678 - DNA, 18 bp, Artificial Sequence
  Synthetic DNA
taacacgtctaactatcg

SEQ ID NO: 16679 - DNA, 18 bp, Artificial Sequence
  Synthetic DNA
taacactactcattgtag

SEQ ID NO: 16680 - DNA, 18 bp, Artificial Sequence
  Synthetic DNA
taacaggaatctctatag

SEQ ID NO: 16681 - DNA, 18 bp, Artificial Sequence
  Synthetic DNA
taaccagactcaatatag

SEQ ID NO: 16682 - DNA, 18 bp, Artificial Sequence
  Synthetic DNA
taacccgacttactaaag

SEQ ID NO: 16683 - DNA, 18 bp, Artificial Sequence
  Synthetic DNA
taacgcgacctactatag

SEQ ID NO: 16684 - DNA, 18 bp, Artificial Sequence
  Synthetic DNA
taacgcgactccctacag

SEQ ID NO: 16685 - DNA, 18 bp, Artificial Sequence
  Synthetic DNA
taacgctaatcactatag

SEQ ID NO: 16686 - DNA, 18 bp, Artificial Sequence
  Synthetic DNA
taagaagaatcactttag

SEQ ID NO: 16687 - DNA, 18 bp, Artificial Sequence
  Synthetic DNA
taagaagacacattatag

SEQ ID NO: 16688 - DNA, 18 bp, Artificial Sequence
  Synthetic DNA
taagaccattcaccatag

SEQ ID NO: 16689 - DNA, 18 bp, Artificial Sequence
  Synthetic DNA
taagacgactccttctag

SEQ ID NO: 16690 - DNA, 18 bp, Artificial Sequence
  Synthetic DNA
taagacgattaaccatag

SEQ ID NO: 16691 - DNA, 18 bp, Artificial Sequence
  Synthetic DNA
taagacgtgtctctatag

SEQ ID NO: 16692 - DNA, 18 bp, Artificial Sequence
  Synthetic DNA
taagacttctcaccatag

SEQ ID NO: 16693 - DNA, 18 bp, Artificial Sequence
  Synthetic DNA
taagatgactctatatag

SEQ ID NO: 16694 - DNA, 18 bp, Artificial Sequence
  Synthetic DNA
taaggccactaactatag

SEQ ID NO: 16695 - DNA, 18 bp, Artificial Sequence
  Synthetic DNA
taaggcgagtcactatgg

SEQ ID NO: 16696 - DNA, 18 bp, Artificial Sequence
  Synthetic DNA
taataaaacacactatcg

SEQ ID NO: 16697 - DNA, 18 bp, Artificial Sequence
  Synthetic DNA
taataaaactcactctcg

SEQ ID NO: 16698 - DNA, 18 bp, Artificial Sequence
  Synthetic DNA
taataacacttactatcg

SEQ ID NO: 16699 - DNA, 18 bp, Artificial Sequence
  Synthetic DNA
taataacagtcaatatag

SEQ ID NO: 16700 - DNA, 18 bp, Artificial Sequence
  Synthetic DNA
taataagaatcaatagag

SEQ ID NO: 16701 - DNA, 18 bp, Artificial Sequence
  Synthetic DNA
taataagaatcagtatgg

SEQ ID NO: 16702 - DNA, 18 bp, Artificial Sequence
  Synthetic DNA
taataagacacacaacag

SEQ ID NO: 16703 - DNA, 18 bp, Artificial Sequence
  Synthetic DNA
taataagacgctttatag

SEQ ID NO: 16704 - DNA, 18 bp, Artificial Sequence
  Synthetic DNA
taataagactcactcagg

SEQ ID NO: 16705 - DNA, 18 bp, Artificial Sequence
  Synthetic DNA
taataagacttaacatag

SEQ ID NO: 16706 - DNA, 18 bp, Artificial Sequence
  Synthetic DNA
taataagagtaattatag

SEQ ID NO: 16707 - DNA, 18 bp, Artificial Sequence
  Synthetic DNA
taataagcctcacattag

SEQ ID NO: 16708 - DNA, 18 bp, Artificial Sequence
  Synthetic DNA
taataagcctcattatgg

SEQ ID NO: 16709 - DNA, 18 bp, Artificial Sequence
  Synthetic DNA
taataagcctgactatgg

SEQ ID NO: 16710 - DNA, 18 bp, Artificial Sequence
  Synthetic DNA
taataagcgtcactgtag

SEQ ID NO: 16711 - DNA, 18 bp, Artificial Sequence
  Synthetic DNA
taataaggcatactatag

SEQ ID NO: 16712 - DNA, 18 bp, Artificial Sequence
  Synthetic DNA
taataagtcccaatatag

SEQ ID NO: 16713 - DNA, 18 bp, Artificial Sequence
  Synthetic DNA
taataagtctccctttag

SEQ ID NO: 16714 - DNA, 18 bp, Artificial Sequence
  Synthetic DNA
taataagttacactatag

SEQ ID NO: 16715 - DNA, 18 bp, Artificial Sequence
  Synthetic DNA
taataagtttcactagag

SEQ ID NO: 16716 - DNA, 18 bp, Artificial Sequence
  Synthetic DNA
taatacaacacaatatgg

SEQ ID NO: 16717 - DNA, 18 bp, Artificial Sequence
  Synthetic DNA
taatacaactaattgtag

SEQ ID NO: 16718 - DNA, 18 bp, Artificial Sequence
  Synthetic DNA
taatacaactcagagtag

SEQ ID NO: 16719 - DNA, 18 bp, Artificial Sequence
  Synthetic DNA
taatacaacttaatgtag

SEQ ID NO: 16720 - DNA, 18 bp, Artificial Sequence
  Synthetic DNA
taatacaacttactctcg

SEQ ID NO: 16721 - DNA, 18 bp, Artificial Sequence
  Synthetic DNA
taatacaactttccatag

SEQ ID NO: 16722 - DNA, 18 bp, Artificial Sequence
  Synthetic DNA
taatacaatcctctatag

SEQ ID NO: 16723 - DNA, 18 bp, Artificial Sequence
  Synthetic DNA
taatacaattatctatag

SEQ ID NO: 16724 - DNA, 18 bp, Artificial Sequence
  Synthetic DNA
taatacaattctctagag

SEQ ID NO: 16725 - DNA, 18 bp, Artificial Sequence
  Synthetic DNA
taatacagctcaagatag

SEQ ID NO: 16726 - DNA, 18 bp, Artificial Sequence
  Synthetic DNA
taataccaataacaatag

SEQ ID NO: 16727 - DNA, 18 bp, Artificial Sequence
  Synthetic DNA
taataccaatccctagag

SEQ ID NO: 16728 - DNA, 18 bp, Artificial Sequence
  Synthetic DNA
taataccaattacgatag

SEQ ID NO: 16729 - DNA, 18 bp, Artificial Sequence
  Synthetic DNA
taataccaattactctag

SEQ ID NO: 16730 - DNA, 18 bp, Artificial Sequence
  Synthetic DNA
taataccacacccgatag

SEQ ID NO: 16731 - DNA, 18 bp, Artificial Sequence
  Synthetic DNA
taataccaccccctacag

SEQ ID NO: 16732 - DNA, 18 bp, Artificial Sequence
  Synthetic DNA
taataccactcacttacg

SEQ ID NO: 16733 - DNA, 18 bp, Artificial Sequence
  Synthetic DNA
taataccactctctggag

SEQ ID NO: 16734 - DNA, 18 bp, Artificial Sequence
  Synthetic DNA
taataccactctctgtcg

SEQ ID NO: 16735 - DNA, 18 bp, Artificial Sequence
  Synthetic DNA
taataccacttagtatcg

SEQ ID NO: 16736 - DNA, 18 bp, Artificial Sequence
  Synthetic DNA
taataccagccactaaag

SEQ ID NO: 16737 - DNA, 18 bp, Artificial Sequence
  Synthetic DNA
taataccagtcacaagag

SEQ ID NO: 16738 - DNA, 18 bp, Artificial Sequence
  Synthetic DNA
taatacctcccacgatag

SEQ ID NO: 16739 - DNA, 18 bp, Artificial Sequence
  Synthetic DNA
taatacgaaacagtaaag

SEQ ID NO: 16740 - DNA, 18 bp, Artificial Sequence
  Synthetic DNA
taatacgaactacgatag

SEQ ID NO: 16741 - DNA, 18 bp, Artificial Sequence
  Synthetic DNA
taatacgaagcataatag

SEQ ID NO: 16742 - DNA, 18 bp, Artificial Sequence
  Synthetic DNA
taatacgaatacttatag

SEQ ID NO: 16743 - DNA, 18 bp, Artificial Sequence
  Synthetic DNA
taatacgaatcagcacag

SEQ ID NO: 16744 - DNA, 18 bp, Artificial Sequence
  Synthetic DNA
taatacgaatccccatgg

SEQ ID NO: 16745 - DNA, 18 bp, Artificial Sequence
  Synthetic DNA
taatacgacaaacaacag

SEQ ID NO: 16746 - DNA, 18 bp, Artificial Sequence
  Synthetic DNA
taatacgacaaagtgtag

SEQ ID NO: 16747 - DNA, 18 bp, Artificial Sequence
  Synthetic DNA
taatacgacaatctgtag

SEQ ID NO: 16748 - DNA, 18 bp, Artificial Sequence
  Synthetic DNA
taatacgacacagaaaag

SEQ ID NO: 16749 - DNA, 18 bp, Artificial Sequence
  Synthetic DNA
taatacgacactgtttag

SEQ ID NO: 16750 - DNA, 18 bp, Artificial Sequence
  Synthetic DNA
taatacgacagactaagg

SEQ ID NO: 16751 - DNA, 18 bp, Artificial Sequence
  Synthetic DNA
taatacgacagtccatag

SEQ ID NO: 16752 - DNA, 18 bp, Artificial Sequence
  Synthetic DNA
taatacgaccaataatag

SEQ ID NO: 16753 - DNA, 18 bp, Artificial Sequence
  Synthetic DNA
taatacgacccaccttgg

SEQ ID NO: 16754 - DNA, 18 bp, Artificial Sequence
  Synthetic DNA
taatacgaccctatacag

SEQ ID NO: 16755 - DNA, 18 bp, Artificial Sequence
  Synthetic DNA
taatacgacgaacttaag

SEQ ID NO: 16756 - DNA, 18 bp, Artificial Sequence
  Synthetic DNA
taatacgacgccgtgtag

SEQ ID NO: 16757 - DNA, 18 bp, Artificial Sequence
  Synthetic DNA
taatacgactaacactgg

SEQ ID NO: 16758 - DNA, 18 bp, Artificial Sequence
  Synthetic DNA
taatacgactacccaaag

SEQ ID NO: 16759 - DNA, 18 bp, Artificial Sequence
  Synthetic DNA
taatacgactatccttag

SEQ ID NO: 16760 - DNA, 18 bp, Artificial Sequence
  Synthetic DNA
taatacgactctatccag

SEQ ID NO: 16761 - DNA, 18 bp, Artificial Sequence
  Synthetic DNA
taatacgactctccaccg

SEQ ID NO: 16762 - DNA, 18 bp, Artificial Sequence
  Synthetic DNA
taatacgactgaatgtaa

SEQ ID NO: 16763 - DNA, 18 bp, Artificial Sequence
  Synthetic DNA
taatacgacttatcaaag

SEQ ID NO: 16764 - DNA, 18 bp, Artificial Sequence
  Synthetic DNA
taatacgagaaattatag

SEQ ID NO: 16765 - DNA, 18 bp, Artificial Sequence
  Synthetic DNA
taatacgagcctctaaag

SEQ ID NO: 16766 - DNA, 18 bp, Artificial Sequence
  Synthetic DNA
taatacgaggcattacag

SEQ ID NO: 16767 - DNA, 18 bp, Artificial Sequence
  Synthetic DNA
taatacgagtcaggatcg

SEQ ID NO: 16768 - DNA, 18 bp, Artificial Sequence
  Synthetic DNA
taatacgatacacttcag

SEQ ID NO: 16769 - DNA, 18 bp, Artificial Sequence
  Synthetic DNA
taatacgatgacctatag

SEQ ID NO: 16770 - DNA, 18 bp, Artificial Sequence
  Synthetic DNA
taatacgattcaatagcg

SEQ ID NO: 16771 - DNA, 18 bp, Artificial Sequence
  Synthetic DNA
taatacgcatcacaacag

SEQ ID NO: 16772 - DNA, 18 bp, Artificial Sequence
  Synthetic DNA
taatacgccacataatag

SEQ ID NO: 16773 - DNA, 18 bp, Artificial Sequence
  Synthetic DNA
taatacgccactctatgg

SEQ ID NO: 16774 - DNA, 18 bp, Artificial Sequence
  Synthetic DNA
taatacgcccaaatatag

SEQ ID NO: 16775 - DNA, 18 bp, Artificial Sequence
  Synthetic DNA
taatacgcctacctaaag

SEQ ID NO: 16776 - DNA, 18 bp, Artificial Sequence
  Synthetic DNA
taatacgcctgacttcag

SEQ ID NO: 16777 - DNA, 18 bp, Artificial Sequence
  Synthetic DNA
taatacgccttatcatag

SEQ ID NO: 16778 - DNA, 18 bp, Artificial Sequence
  Synthetic DNA
taatacggctaagtacag

SEQ ID NO: 16779 - DNA, 18 bp, Artificial Sequence
  Synthetic DNA
taatacggttaactaaag

SEQ ID NO: 16780 - DNA, 18 bp, Artificial Sequence
  Synthetic DNA
taatacggttctctgtag

SEQ ID NO: 16781 - DNA, 18 bp, Artificial Sequence
  Synthetic DNA
taatacggtttattatag

SEQ ID NO: 16782 - DNA, 18 bp, Artificial Sequence
  Synthetic DNA
taatacgtcccaaaatag

SEQ ID NO: 16783 - DNA, 18 bp, Artificial Sequence
  Synthetic DNA
taatacgtcccaacatag

SEQ ID NO: 16784 - DNA, 18 bp, Artificial Sequence
  Synthetic DNA
taatacgtcccagtatcg

SEQ ID NO: 16785 - DNA, 18 bp, Artificial Sequence
  Synthetic DNA
taatacgtcgctatatag

SEQ ID NO: 16786 - DNA, 18 bp, Artificial Sequence
  Synthetic DNA
taatacgtctcaaaatcg

SEQ ID NO: 16787 - DNA, 18 bp, Artificial Sequence
  Synthetic DNA
taatacgtctcacccaag

SEQ ID NO: 16788 - DNA, 18 bp, Artificial Sequence
  Synthetic DNA
taatacgtctccatatcg

SEQ ID NO: 16789 - DNA, 18 bp, Artificial Sequence
  Synthetic DNA
taatacgtctccctttcg

SEQ ID NO: 16790 - DNA, 18 bp, Artificial Sequence
  Synthetic DNA
taatacgtctccttgtag

SEQ ID NO: 16791 - DNA, 18 bp, Artificial Sequence
  Synthetic DNA
taatacgtctgaatgtag

SEQ ID NO: 16792 - DNA, 18 bp, Artificial Sequence
  Synthetic DNA
taatacgtctgaccagag

SEQ ID NO: 16793 - DNA, 18 bp, Artificial Sequence
  Synthetic DNA
taatacgtcttaatctag

SEQ ID NO: 16794 - DNA, 18 bp, Artificial Sequence
  Synthetic DNA
taatacgtgccattatag

SEQ ID NO: 16795 - DNA, 18 bp, Artificial Sequence
  Synthetic DNA
taatacgtgtaactaaag

SEQ ID NO: 16796 - DNA, 18 bp, Artificial Sequence
  Synthetic DNA
taatacgtttctgtatag

SEQ ID NO: 16797 - DNA, 18 bp, Artificial Sequence
  Synthetic DNA
taatacgtttgaccatag

SEQ ID NO: 16798 - DNA, 18 bp, Artificial Sequence
  Synthetic DNA
taatactaaacaccatag

SEQ ID NO: 16799 - DNA, 18 bp, Artificial Sequence
  Synthetic DNA
taatactacacactagcg

SEQ ID NO: 16800 - DNA, 18 bp, Artificial Sequence
  Synthetic DNA
taatactactcaataacg

SEQ ID NO: 16801 - DNA, 18 bp, Artificial Sequence
  Synthetic DNA
taatactactcaccctgg

SEQ ID NO: 16802 - DNA, 18 bp, Artificial Sequence
  Synthetic DNA
taatactactcccactag

SEQ ID NO: 16803 - DNA, 18 bp, Artificial Sequence
  Synthetic DNA
taatactactgacattag

SEQ ID NO: 16804 - DNA, 18 bp, Artificial Sequence
  Synthetic DNA
taatactacttaatatcg

SEQ ID NO: 16805 - DNA, 18 bp, Artificial Sequence
  Synthetic DNA
taatactacttactaacg

SEQ ID NO: 16806 - DNA, 18 bp, Artificial Sequence
  Synthetic DNA
taatactacttactcaag

SEQ ID NO: 16807 - DNA, 18 bp, Artificial Sequence
  Synthetic DNA
taatactattccctatgg

SEQ ID NO: 16808 - DNA, 18 bp, Artificial Sequence
  Synthetic DNA
taatactcctccttatag

SEQ ID NO: 16809 - DNA, 18 bp, Artificial Sequence
  Synthetic DNA
taatactcttcactgtag

SEQ ID NO: 16810 - DNA, 18 bp, Artificial Sequence
  Synthetic DNA
taatactgctcaccaaag

SEQ ID NO: 16811 - DNA, 18 bp, Artificial Sequence
  Synthetic DNA
taatactggccactatag

SEQ ID NO: 16812 - DNA, 18 bp, Artificial Sequence
  Synthetic DNA
taatacttgtcactatgg

SEQ ID NO: 16813 - DNA, 18 bp, Artificial Sequence
  Synthetic DNA
taatagaactcagtaaag

SEQ ID NO: 16814 - DNA, 18 bp, Artificial Sequence
  Synthetic DNA
taatagaattcacaatag

SEQ ID NO: 16815 - DNA, 18 bp, Artificial Sequence
  Synthetic DNA
taatagaattcactaaag

SEQ ID NO: 16816 - DNA, 18 bp, Artificial Sequence
  Synthetic DNA
taatagcactaaccatag

SEQ ID NO: 16817 - DNA, 18 bp, Artificial Sequence
  Synthetic DNA
taatagcactaactttag

SEQ ID NO: 16818 - DNA, 18 bp, Artificial Sequence
  Synthetic DNA
taatagcactccttatag

SEQ ID NO: 16819 - DNA, 18 bp, Artificial Sequence
  Synthetic DNA
taataggaagcactttag

SEQ ID NO: 16820 - DNA, 18 bp, Artificial Sequence
  Synthetic DNA
taataggacactccatag

SEQ ID NO: 16821 - DNA, 18 bp, Artificial Sequence
  Synthetic DNA
taataggaccgactttag

SEQ ID NO: 16822 - DNA, 18 bp, Artificial Sequence
  Synthetic DNA
taataggactaattagag

SEQ ID NO: 16823 - DNA, 18 bp, Artificial Sequence
  Synthetic DNA
taataggactcaatgcag

SEQ ID NO: 16824 - DNA, 18 bp, Artificial Sequence
  Synthetic DNA
taataggactctttatgg

SEQ ID NO: 16825 - DNA, 18 bp, Artificial Sequence
  Synthetic DNA
taataggtctcaatacag

SEQ ID NO: 16826 - DNA, 18 bp, Artificial Sequence
  Synthetic DNA
taataggtgtcattatag

SEQ ID NO: 16827 - DNA, 18 bp, Artificial Sequence
  Synthetic DNA
taataggtttcagtatag

SEQ ID NO: 16828 - DNA, 18 bp, Artificial Sequence
  Synthetic DNA
taatagtactaactatgg

SEQ ID NO: 16829 - DNA, 18 bp, Artificial Sequence
  Synthetic DNA
taatataactcagtctag

SEQ ID NO: 16830 - DNA, 18 bp, Artificial Sequence
  Synthetic DNA
taatataactctgtatag

SEQ ID NO: 16831 - DNA, 18 bp, Artificial Sequence
  Synthetic DNA
taatataactgactctag

SEQ ID NO: 16832 - DNA, 18 bp, Artificial Sequence
  Synthetic DNA
taatatcactgactatgg

SEQ ID NO: 16833 - DNA, 18 bp, Artificial Sequence
  Synthetic DNA
taatatccctgactatag

SEQ ID NO: 16834 - DNA, 18 bp, Artificial Sequence
  Synthetic DNA
taatatctctcactacag

SEQ ID NO: 16835 - DNA, 18 bp, Artificial Sequence
  Synthetic DNA
taatatgactcaccagcg

SEQ ID NO: 16836 - DNA, 18 bp, Artificial Sequence
  Synthetic DNA
taatatgactcactcccg

SEQ ID NO: 16837 - DNA, 18 bp, Artificial Sequence
  Synthetic DNA
taatatgactccatctag

SEQ ID NO: 16838 - DNA, 18 bp, Artificial Sequence
  Synthetic DNA
taatatgactctttatgg

SEQ ID NO: 16839 - DNA, 18 bp, Artificial Sequence
  Synthetic DNA
taatatgagtcaataaag

SEQ ID NO: 16840 - DNA, 18 bp, Artificial Sequence
  Synthetic DNA
taatatgattcaatatcg

SEQ ID NO: 16841 - DNA, 18 bp, Artificial Sequence
  Synthetic DNA
taatatgattcagtttag

SEQ ID NO: 16842 - DNA, 18 bp, Artificial Sequence
  Synthetic DNA
taatatgattccctttag

SEQ ID NO: 16843 - DNA, 18 bp, Artificial Sequence
  Synthetic DNA
taatatgcctccttatag

SEQ ID NO: 16844 - DNA, 18 bp, Artificial Sequence
  Synthetic DNA
taatatgcctctcaatag

SEQ ID NO: 16845 - DNA, 18 bp, Artificial Sequence
  Synthetic DNA
taatattactaactttag

SEQ ID NO: 16846 - DNA, 18 bp, Artificial Sequence
  Synthetic DNA
taatcaaactcactttag

SEQ ID NO: 16847 - DNA, 18 bp, Artificial Sequence
  Synthetic DNA
taatcagacgcactacag

SEQ ID NO: 16848 - DNA, 18 bp, Artificial Sequence
  Synthetic DNA
taatccaactcaccagag

SEQ ID NO: 16849 - DNA, 18 bp, Artificial Sequence
  Synthetic DNA
taatccaactccatatag

SEQ ID NO: 16850 - DNA, 18 bp, Artificial Sequence
  Synthetic DNA
taatccgacactctatgg

SEQ ID NO: 16851 - DNA, 18 bp, Artificial Sequence
  Synthetic DNA
taatccgacagactttag

SEQ ID NO: 16852 - DNA, 18 bp, Artificial Sequence
  Synthetic DNA
taatccgacataccatag

SEQ ID NO: 16853 - DNA, 18 bp, Artificial Sequence
  Synthetic DNA
taatccgacgcataatag

SEQ ID NO: 16854 - DNA, 18 bp, Artificial Sequence
  Synthetic DNA
taatccgactctgcatag

SEQ ID NO: 16855 - DNA, 18 bp, Artificial Sequence
  Synthetic DNA
taatccgcatcactttag

SEQ ID NO: 16856 - DNA, 18 bp, Artificial Sequence
  Synthetic DNA
taatccgcctcaaaatag

SEQ ID NO: 16857 - DNA, 18 bp, Artificial Sequence
  Synthetic DNA
taatccgcctcacaatcg

SEQ ID NO: 16858 - DNA, 18 bp, Artificial Sequence
  Synthetic DNA
taatccgtctcaatctag

SEQ ID NO: 16859 - DNA, 18 bp, Artificial Sequence
  Synthetic DNA
taatcctactctgtatag

SEQ ID NO: 16860 - DNA, 18 bp, Artificial Sequence
  Synthetic DNA
taatctgactaacaatag

SEQ ID NO: 16861 - DNA, 18 bp, Artificial Sequence
  Synthetic DNA
taatctgactcactaacg

SEQ ID NO: 16862 - DNA, 18 bp, Artificial Sequence
  Synthetic DNA
taatcttactcactacag

SEQ ID NO: 16863 - DNA, 18 bp, Artificial Sequence
  Synthetic DNA
taatgagacacaccatag

SEQ ID NO: 16864 - DNA, 18 bp, Artificial Sequence
  Synthetic DNA
taatgagcctcattatag

SEQ ID NO: 16865 - DNA, 18 bp, Artificial Sequence
  Synthetic DNA
taatgcaactcacactag

SEQ ID NO: 16866 - DNA, 18 bp, Artificial Sequence
  Synthetic DNA
taatgccattcagtatag

SEQ ID NO: 16867 - DNA, 18 bp, Artificial Sequence
  Synthetic DNA
taatgcgactctcactag

SEQ ID NO: 16868 - DNA, 18 bp, Artificial Sequence
  Synthetic DNA
taatgcgacttaatacag

SEQ ID NO: 16869 - DNA, 18 bp, Artificial Sequence
  Synthetic DNA
taatgcgagtccctctag

SEQ ID NO: 16870 - DNA, 18 bp, Artificial Sequence
  Synthetic DNA
taatgcgcctcactaacg

SEQ ID NO: 16871 - DNA, 18 bp, Artificial Sequence
  Synthetic DNA
taatgcgcctccctatgg

SEQ ID NO: 16872 - DNA, 18 bp, Artificial Sequence
  Synthetic DNA
taatgcggcgcactatgg

SEQ ID NO: 16873 - DNA, 18 bp, Artificial Sequence
  Synthetic DNA
taatgcgtcacattatag

SEQ ID NO: 16874 - DNA, 18 bp, Artificial Sequence
  Synthetic DNA
taatgcgtctaactaaag

SEQ ID NO: 16875 - DNA, 18 bp, Artificial Sequence
  Synthetic DNA
taatgcgtctcactcaag

SEQ ID NO: 16876 - DNA, 18 bp, Artificial Sequence
  Synthetic DNA
taatgctacacattatag

SEQ ID NO: 16877 - DNA, 18 bp, Artificial Sequence
  Synthetic DNA
taatgggacgcaccatag

SEQ ID NO: 16878 - DNA, 18 bp, Artificial Sequence
  Synthetic DNA
taatgggactcacactag

SEQ ID NO: 16879 - DNA, 18 bp, Artificial Sequence
  Synthetic DNA
taatgggactcattgtag

SEQ ID NO: 16880 - DNA, 18 bp, Artificial Sequence
  Synthetic DNA
taatgtgacatactatag

SEQ ID NO: 16881 - DNA, 18 bp, Artificial Sequence
  Synthetic DNA
taatgtgactctctagag

SEQ ID NO: 16882 - DNA, 18 bp, Artificial Sequence
  Synthetic DNA
taatgtgattcacaatag

SEQ ID NO: 16883 - DNA, 18 bp, Artificial Sequence
  Synthetic DNA
taatgttactaactatag

SEQ ID NO: 16884 - DNA, 18 bp, Artificial Sequence
  Synthetic DNA
tacaacgactctctgtag

SEQ ID NO: 16885 - DNA, 18 bp, Artificial Sequence
  Synthetic DNA
tacaacgagtcacaatag

SEQ ID NO: 16886 - DNA, 18 bp, Artificial Sequence
  Synthetic DNA
tacagcgactcacaatag

SEQ ID NO: 16887 - DNA, 18 bp, Artificial Sequence
  Synthetic DNA
tacagcgactcactacag

SEQ ID NO: 16888 - DNA, 18 bp, Artificial Sequence
  Synthetic DNA
taccacgactctttatag

SEQ ID NO: 16889 - DNA, 18 bp, Artificial Sequence
  Synthetic DNA
taccacggctcacaatag

SEQ ID NO: 16890 - DNA, 18 bp, Artificial Sequence
  Synthetic DNA
tactaagacacaatatag

SEQ ID NO: 16891 - DNA, 18 bp, Artificial Sequence
  Synthetic DNA
tactaagactcactctcg

SEQ ID NO: 16892 - DNA, 18 bp, Artificial Sequence
  Synthetic DNA
tactacaacacaccatag

SEQ ID NO: 16893 - DNA, 18 bp, Artificial Sequence
  Synthetic DNA
tactacaactcaacatag

SEQ ID NO: 16894 - DNA, 18 bp, Artificial Sequence
  Synthetic DNA
tactacaagacactatag

SEQ ID NO: 16895 - DNA, 18 bp, Artificial Sequence
  Synthetic DNA
tactacaattcagtatag

SEQ ID NO: 16896 - DNA, 18 bp, Artificial Sequence
  Synthetic DNA
tactaccacccactacag

SEQ ID NO: 16897 - DNA, 18 bp, Artificial Sequence
  Synthetic DNA
tactaccactacctatag

SEQ ID NO: 16898 - DNA, 18 bp, Artificial Sequence
  Synthetic DNA
tactaccactcacaacag

SEQ ID NO: 16899 - DNA, 18 bp, Artificial Sequence
  Synthetic DNA
tactacctctcaatatag

SEQ ID NO: 16900 - DNA, 18 bp, Artificial Sequence
  Synthetic DNA
tactacgaatcattctag

SEQ ID NO: 16901 - DNA, 18 bp, Artificial Sequence
  Synthetic DNA
tactacgacgcacattag

SEQ ID NO: 16902 - DNA, 18 bp, Artificial Sequence
  Synthetic DNA
tactacgagacactttag

SEQ ID NO: 16903 - DNA, 18 bp, Artificial Sequence
  Synthetic DNA
tactacgatccactctag

SEQ ID NO: 16904 - DNA, 18 bp, Artificial Sequence
  Synthetic DNA
tactacggctcaatctag

SEQ ID NO: 16905 - DNA, 18 bp, Artificial Sequence
  Synthetic DNA
tactacgtatcaccatag

SEQ ID NO: 16906 - DNA, 18 bp, Artificial Sequence
  Synthetic DNA
tactacgtctcaacatag

SEQ ID NO: 16907 - DNA, 18 bp, Artificial Sequence
  Synthetic DNA
tactacgtctcacattag

SEQ ID NO: 16908 - DNA, 18 bp, Artificial Sequence
  Synthetic DNA
tactacgtctcactagcg

SEQ ID NO: 16909 - DNA, 18 bp, Artificial Sequence
  Synthetic DNA
tactactacacaccatag

SEQ ID NO: 16910 - DNA, 18 bp, Artificial Sequence
  Synthetic DNA
tactacttctcacgatag

SEQ ID NO: 16911 - DNA, 18 bp, Artificial Sequence
  Synthetic DNA
tactaggactcacagtag

SEQ ID NO: 16912 - DNA, 18 bp, Artificial Sequence
  Synthetic DNA
tactaggactcacttcag

SEQ ID NO: 16913 - DNA, 18 bp, Artificial Sequence
  Synthetic DNA
tactatgactaagtatag

SEQ ID NO: 16914 - DNA, 18 bp, Artificial Sequence
  Synthetic DNA
tactatggctcagtatag

SEQ ID NO: 16915 - DNA, 18 bp, Artificial Sequence
  Synthetic DNA
tactccaactccctatag

SEQ ID NO: 16916 - DNA, 18 bp, Artificial Sequence
  Synthetic DNA
tactcggactcactaaag

SEQ ID NO: 16917 - DNA, 18 bp, Artificial Sequence
  Synthetic DNA
tactgccacacactatag

SEQ ID NO: 16918 - DNA, 18 bp, Artificial Sequence
  Synthetic DNA
tactgcgactaaatatag

SEQ ID NO: 16919 - DNA, 18 bp, Artificial Sequence
  Synthetic DNA
tagaactacacactatag

SEQ ID NO: 16920 - DNA, 18 bp, Artificial Sequence
  Synthetic DNA
tagcgcgactcaatatag

SEQ ID NO: 16921 - DNA, 18 bp, Artificial Sequence
  Synthetic DNA
taggacgccacactatag

SEQ ID NO: 16922 - DNA, 18 bp, Artificial Sequence
  Synthetic DNA
taggaggactaactatag

SEQ ID NO: 16923 - DNA, 18 bp, Artificial Sequence
  Synthetic DNA
tagtaagaccctctatag

SEQ ID NO: 16924 - DNA, 18 bp, Artificial Sequence
  Synthetic DNA
tagtaagagtcactttag

SEQ ID NO: 16925 - DNA, 18 bp, Artificial Sequence
  Synthetic DNA
tagtaagcctctctatag

SEQ ID NO: 16926 - DNA, 18 bp, Artificial Sequence
  Synthetic DNA
tagtacgaatcacattag

SEQ ID NO: 16927 - DNA, 18 bp, Artificial Sequence
  Synthetic DNA
tagtacgaatttctatag

SEQ ID NO: 16928 - DNA, 18 bp, Artificial Sequence
  Synthetic DNA
tagtacgactaacttcag

SEQ ID NO: 16929 - DNA, 18 bp, Artificial Sequence
  Synthetic DNA
tagtacgactaattctag

SEQ ID NO: 16930 - DNA, 18 bp, Artificial Sequence
  Synthetic DNA
tagtacgactcacccgag

SEQ ID NO: 16931 - DNA, 18 bp, Artificial Sequence
  Synthetic DNA
tagtacgactgaatacag

SEQ ID NO: 16932 - DNA, 18 bp, Artificial Sequence
  Synthetic DNA
tagtacgagccactacag

SEQ ID NO: 16933 - DNA, 18 bp, Artificial Sequence
  Synthetic DNA
tagtacgatgcattatag

SEQ ID NO: 16934 - DNA, 18 bp, Artificial Sequence
  Synthetic DNA
tagtacgcctcagtatgg

SEQ ID NO: 16935 - DNA, 18 bp, Artificial Sequence
  Synthetic DNA
tagtacgtatcactgtag

SEQ ID NO: 16936 - DNA, 18 bp, Artificial Sequence
  Synthetic DNA
tagtacgtctaactaaag

SEQ ID NO: 16937 - DNA, 18 bp, Artificial Sequence
  Synthetic DNA
tagtagacctcactatag

SEQ ID NO: 16938 - DNA, 18 bp, Artificial Sequence
  Synthetic DNA
tagtccgactcattttag

SEQ ID NO: 16939 - DNA, 18 bp, Artificial Sequence
  Synthetic DNA
tagtgcgacccactaaag

SEQ ID NO: 16940 - DNA, 18 bp, Artificial Sequence
  Synthetic DNA
tagtgcgtctaactatag

SEQ ID NO: 16941 - DNA, 18 bp, Artificial Sequence
  Synthetic DNA
tataacaactccctatag

SEQ ID NO: 16942 - DNA, 18 bp, Artificial Sequence
  Synthetic DNA
tataacgactcaccatcg

SEQ ID NO: 16943 - DNA, 18 bp, Artificial Sequence
  Synthetic DNA
tataatgactgactatag

SEQ ID NO: 16944 - DNA, 18 bp, Artificial Sequence
  Synthetic DNA
tataccgcctcactatag

SEQ ID NO: 16945 - DNA, 18 bp, Artificial Sequence
  Synthetic DNA
tatcaagacgcactatag

SEQ ID NO: 16946 - DNA, 18 bp, Artificial Sequence
  Synthetic DNA
tatcacgacacactatgg

SEQ ID NO: 16947 - DNA, 18 bp, Artificial Sequence
  Synthetic DNA
tatcacgactaactatcg

SEQ ID NO: 16948 - DNA, 18 bp, Artificial Sequence
  Synthetic DNA
tatcacgattcagtatag

SEQ ID NO: 16949 - DNA, 18 bp, Artificial Sequence
  Synthetic DNA
tatcactactcattatag

SEQ ID NO: 16950 - DNA, 18 bp, Artificial Sequence
  Synthetic DNA
tatcgcaactcactatag

SEQ ID NO: 16951 - DNA, 18 bp, Artificial Sequence
  Synthetic DNA
tatgacaactcactatcg

SEQ ID NO: 16952 - DNA, 18 bp, Artificial Sequence
  Synthetic DNA
tatgacgactcaccacag

SEQ ID NO: 16953 - DNA, 18 bp, Artificial Sequence
  Synthetic DNA
tatggagactcactatag

SEQ ID NO: 16954 - DNA, 18 bp, Artificial Sequence
  Synthetic DNA
tattaacactccctatag

SEQ ID NO: 16955 - DNA, 18 bp, Artificial Sequence
  Synthetic DNA
tattaacgctcactatag

SEQ ID NO: 16956 - DNA, 18 bp, Artificial Sequence
  Synthetic DNA
tattaagactcagaatag

SEQ ID NO: 16957 - DNA, 18 bp, Artificial Sequence
  Synthetic DNA
tattaagcctgactatag

SEQ ID NO: 16958 - DNA, 18 bp, Artificial Sequence
  Synthetic DNA
tattacaactcaatatgg

SEQ ID NO: 16959 - DNA, 18 bp, Artificial Sequence
  Synthetic DNA
tattacacctcactacag

SEQ ID NO: 16960 - DNA, 18 bp, Artificial Sequence
  Synthetic DNA
tattaccaatcactatcg

SEQ ID NO: 16961 - DNA, 18 bp, Artificial Sequence
  Synthetic DNA
tattaccactaactgtag

SEQ ID NO: 16962 - DNA, 18 bp, Artificial Sequence
  Synthetic DNA
tattaccacttagtatag

SEQ ID NO: 16963 - DNA, 18 bp, Artificial Sequence
  Synthetic DNA
tattacgaacaactatag

SEQ ID NO: 16964 - DNA, 18 bp, Artificial Sequence
  Synthetic DNA
tattacgaagcactgtag

SEQ ID NO: 16965 - DNA, 18 bp, Artificial Sequence
  Synthetic DNA
tattacgaatcaccatcg

SEQ ID NO: 16966 - DNA, 18 bp, Artificial Sequence
  Synthetic DNA
tattacgaatccgtatag

SEQ ID NO: 16967 - DNA, 18 bp, Artificial Sequence
  Synthetic DNA
tattacgacagactctag

SEQ ID NO: 16968 - DNA, 18 bp, Artificial Sequence
  Synthetic DNA
tattacgacatactatgg

SEQ ID NO: 16969 - DNA, 18 bp, Artificial Sequence
  Synthetic DNA
tattacgacgcactgaag

SEQ ID NO: 16970 - DNA, 18 bp, Artificial Sequence
  Synthetic DNA
tattacgactatctatcg

SEQ ID NO: 16971 - DNA, 18 bp, Artificial Sequence
  Synthetic DNA
tattacgactccctgtcg

SEQ ID NO: 16972 - DNA, 18 bp, Artificial Sequence
  Synthetic DNA
tattacgactctcagtag

SEQ ID NO: 16973 - DNA, 18 bp, Artificial Sequence
  Synthetic DNA
tattacgactgacactag

SEQ ID NO: 16974 - DNA, 18 bp, Artificial Sequence
  Synthetic DNA
tattacgagttactagag

SEQ ID NO: 16975 - DNA, 18 bp, Artificial Sequence
  Synthetic DNA
tattacgcccctctatag

SEQ ID NO: 16976 - DNA, 18 bp, Artificial Sequence
  Synthetic DNA
tattacgccttactagag

SEQ ID NO: 16977 - DNA, 18 bp, Artificial Sequence
  Synthetic DNA
tattacggctcaatgtag

SEQ ID NO: 16978 - DNA, 18 bp, Artificial Sequence
  Synthetic DNA
tattacgtctcactctcg

SEQ ID NO: 16979 - DNA, 18 bp, Artificial Sequence
  Synthetic DNA
tattacgtctcattacag

SEQ ID NO: 16980 - DNA, 18 bp, Artificial Sequence
  Synthetic DNA
tattactactcaccacag

SEQ ID NO: 16981 - DNA, 18 bp, Artificial Sequence
  Synthetic DNA
tattactactcactttcg

SEQ ID NO: 16982 - DNA, 18 bp, Artificial Sequence
  Synthetic DNA
tattactagtcagtatag

SEQ ID NO: 16983 - DNA, 18 bp, Artificial Sequence
  Synthetic DNA
tattaggaccccctatag

SEQ ID NO: 16984 - DNA, 18 bp, Artificial Sequence
  Synthetic DNA
tattaggactcacggtag

SEQ ID NO: 16985 - DNA, 18 bp, Artificial Sequence
  Synthetic DNA
tattaggactcattatcg

SEQ ID NO: 16986 - DNA, 18 bp, Artificial Sequence
  Synthetic DNA
tattaggcctcactctag

SEQ ID NO: 16987 - DNA, 18 bp, Artificial Sequence
  Synthetic DNA
tattatgacgctctatag

SEQ ID NO: 16988 - DNA, 18 bp, Artificial Sequence
  Synthetic DNA
tattatgactcaatgtag

SEQ ID NO: 16989 - DNA, 18 bp, Artificial Sequence
  Synthetic DNA
tattatgactcactgtcg

SEQ ID NO: 16990 - DNA, 18 bp, Artificial Sequence
  Synthetic DNA
tattatggcccactatag

SEQ ID NO: 16991 - DNA, 18 bp, Artificial Sequence
  Synthetic DNA
tattatggctcactgtag

SEQ ID NO: 16992 - DNA, 18 bp, Artificial Sequence
  Synthetic DNA
tattccccctcactatag

SEQ ID NO: 16993 - DNA, 18 bp, Artificial Sequence
  Synthetic DNA
tattccgactcaccctag

SEQ ID NO: 16994 - DNA, 18 bp, Artificial Sequence
  Synthetic DNA
tattcggaatcactatag

SEQ ID NO: 16995 - DNA, 18 bp, Artificial Sequence
  Synthetic DNA
tattgagacccactatag

SEQ ID NO: 16996 - DNA, 18 bp, Artificial Sequence
  Synthetic DNA
tattgagactcactacag

SEQ ID NO: 16997 - DNA, 18 bp, Artificial Sequence
  Synthetic DNA
tattgctactcactctag

SEQ ID NO: 16998 - DNA, 18 bp, Artificial Sequence
  Synthetic DNA
tcaaaccactcactacag

SEQ ID NO: 16999 - DNA, 18 bp, Artificial Sequence
  Synthetic DNA
tcaaacgcatcactatag

SEQ ID NO: 17000 - DNA, 18 bp, Artificial Sequence
  Synthetic DNA
tcaaaggactcactatcg

SEQ ID NO: 17001 - DNA, 18 bp, Artificial Sequence
  Synthetic DNA
tcaaccgactcactacag

SEQ ID NO: 17002 - DNA, 18 bp, Artificial Sequence
  Synthetic DNA
tcacacgacactctatag

SEQ ID NO: 17003 - DNA, 18 bp, Artificial Sequence
  Synthetic DNA
tcacacgactcactttgg

SEQ ID NO: 17004 - DNA, 18 bp, Artificial Sequence
  Synthetic DNA
tcagaccacttactatag

SEQ ID NO: 17005 - DNA, 18 bp, Artificial Sequence
  Synthetic DNA
tcagccgactcactatgg

SEQ ID NO: 17006 - DNA, 18 bp, Artificial Sequence
  Synthetic DNA
tcataatactcacaatag

SEQ ID NO: 17007 - DNA, 18 bp, Artificial Sequence
  Synthetic DNA
tcataatactctctatag

SEQ ID NO: 17008 - DNA, 18 bp, Artificial Sequence
  Synthetic DNA
tcatacaagtcaatatag

SEQ ID NO: 17009 - DNA, 18 bp, Artificial Sequence
  Synthetic DNA
tcataccacacactaaag

SEQ ID NO: 17010 - DNA, 18 bp, Artificial Sequence
  Synthetic DNA
tcataccactcacaaaag

SEQ ID NO: 17011 - DNA, 18 bp, Artificial Sequence
  Synthetic DNA
tcatacctctcactgtag

SEQ ID NO: 17012 - DNA, 18 bp, Artificial Sequence
  Synthetic DNA
tcatacgactatctaaag

SEQ ID NO: 17013 - DNA, 18 bp, Artificial Sequence
  Synthetic DNA
tcatacgagtcattgtag

SEQ ID NO: 17014 - DNA, 18 bp, Artificial Sequence
  Synthetic DNA
tcatacggcccactatcg

SEQ ID NO: 17015 - DNA, 18 bp, Artificial Sequence
  Synthetic DNA
tcatacggctctctatgg

SEQ ID NO: 17016 - DNA, 18 bp, Artificial Sequence
  Synthetic DNA
tcatacgtatcacaatag

SEQ ID NO: 17017 - DNA, 18 bp, Artificial Sequence
  Synthetic DNA
tcatacgtctcactttcg

SEQ ID NO: 17018 - DNA, 18 bp, Artificial Sequence
  Synthetic DNA
tcatactacccactttag

SEQ ID NO: 17019 - DNA, 18 bp, Artificial Sequence
  Synthetic DNA
tcatactattcaatatag

SEQ ID NO: 17020 - DNA, 18 bp, Artificial Sequence
  Synthetic DNA
tcataggactgtctatag

SEQ ID NO: 17021 - DNA, 18 bp, Artificial Sequence
  Synthetic DNA
tcatatgtatcactatag

SEQ ID NO: 17022 - DNA, 18 bp, Artificial Sequence
  Synthetic DNA
tcatccgacatactatag

SEQ ID NO: 17023 - DNA, 18 bp, Artificial Sequence
  Synthetic DNA
tcatccgaccctctatag

SEQ ID NO: 17024 - DNA, 18 bp, Artificial Sequence
  Synthetic DNA
tcatgcgacttactaaag

SEQ ID NO: 17025 - DNA, 18 bp, Artificial Sequence
  Synthetic DNA
tcatgctaatcactatag

SEQ ID NO: 17026 - DNA, 18 bp, Artificial Sequence
  Synthetic DNA
tcgtacgacagactatag

SEQ ID NO: 17027 - DNA, 18 bp, Artificial Sequence
  Synthetic DNA
tcgtatgactcaccatag

SEQ ID NO: 17028 - DNA, 18 bp, Artificial Sequence
  Synthetic DNA
tcttaagactcactagag

SEQ ID NO: 17029 - DNA, 18 bp, Artificial Sequence
  Synthetic DNA
tcttacgaatcactgtag

SEQ ID NO: 17030 - DNA, 18 bp, Artificial Sequence
  Synthetic DNA
tcttccgcctcactatag

SEQ ID NO: 17031 - DNA, 18 bp, Artificial Sequence
  Synthetic DNA
tcttgcgacacactatag

SEQ ID NO: 17032 - DNA, 18 bp, Artificial Sequence
  Synthetic DNA
tgaaacgaatccctatag

SEQ ID NO: 17033 - DNA, 18 bp, Artificial Sequence
  Synthetic DNA
tgaaacgactcactgaag

SEQ ID NO: 17034 - DNA, 18 bp, Artificial Sequence
  Synthetic DNA
tgaaacggcttactatag

SEQ ID NO: 17035 - DNA, 18 bp, Artificial Sequence
  Synthetic DNA
tgaaatgactccctatag

SEQ ID NO: 17036 - DNA, 18 bp, Artificial Sequence
  Synthetic DNA
tgacacaactgactatag

SEQ ID NO: 17037 - DNA, 18 bp, Artificial Sequence
  Synthetic DNA
tgacgcgactcactttag

SEQ ID NO: 17038 - DNA, 18 bp, Artificial Sequence
  Synthetic DNA
tgataaaactcaccatag

SEQ ID NO: 17039 - DNA, 18 bp, Artificial Sequence
  Synthetic DNA
tgataagactcactctcg

SEQ ID NO: 17040 - DNA, 18 bp, Artificial Sequence
  Synthetic DNA
tgatacaaatcactagag

SEQ ID NO: 17041 - DNA, 18 bp, Artificial Sequence
  Synthetic DNA
tgatacaaattactatag

SEQ ID NO: 17042 - DNA, 18 bp, Artificial Sequence
  Synthetic DNA
tgatacaacacacgatag

SEQ ID NO: 17043 - DNA, 18 bp, Artificial Sequence
  Synthetic DNA
tgatacaactctctaaag

SEQ ID NO: 17044 - DNA, 18 bp, Artificial Sequence
  Synthetic DNA
tgataccacactctatag

SEQ ID NO: 17045 - DNA, 18 bp, Artificial Sequence
  Synthetic DNA
tgataccactctccatag

SEQ ID NO: 17046 - DNA, 18 bp, Artificial Sequence
  Synthetic DNA
tgatacgacactttatag

SEQ ID NO: 17047 - DNA, 18 bp, Artificial Sequence
  Synthetic DNA
tgatacgactaattgtag

SEQ ID NO: 17048 - DNA, 18 bp, Artificial Sequence
  Synthetic DNA
tgatacgactcactacct

SEQ ID NO: 17049 - DNA, 18 bp, Artificial Sequence
  Synthetic DNA
tgatacgactcatgctag

SEQ ID NO: 17050 - DNA, 18 bp, Artificial Sequence
  Synthetic DNA
tgatacgactgtctttag

SEQ ID NO: 17051 - DNA, 18 bp, Artificial Sequence
  Synthetic DNA
tgatacggctgaccatag

SEQ ID NO: 17052 - DNA, 18 bp, Artificial Sequence
  Synthetic DNA
tgatacgtctcactagcg

SEQ ID NO: 17053 - DNA, 18 bp, Artificial Sequence
  Synthetic DNA
tgatacgtcttactctag

SEQ ID NO: 17054 - DNA, 18 bp, Artificial Sequence
  Synthetic DNA
tgatactacgcactgtag

SEQ ID NO: 17055 - DNA, 18 bp, Artificial Sequence
  Synthetic DNA
tgatactactcaatacag

SEQ ID NO: 17056 - DNA, 18 bp, Artificial Sequence
  Synthetic DNA
tgatactactcacttaag

SEQ ID NO: 17057 - DNA, 18 bp, Artificial Sequence
  Synthetic DNA
tgatactactcataatag

SEQ ID NO: 17058 - DNA, 18 bp, Artificial Sequence
  Synthetic DNA
tgataggacacacaatag

SEQ ID NO: 17059 - DNA, 18 bp, Artificial Sequence
  Synthetic DNA
tgatagggctcaccatag

SEQ ID NO: 17060 - DNA, 18 bp, Artificial Sequence
  Synthetic DNA
tgatatcactcactatcg

SEQ ID NO: 17061 - DNA, 18 bp, Artificial Sequence
  Synthetic DNA
tgatatgacagactatag

SEQ ID NO: 17062 - DNA, 18 bp, Artificial Sequence
  Synthetic DNA
tgatatgactcaatatgg

SEQ ID NO: 17063 - DNA, 18 bp, Artificial Sequence
  Synthetic DNA
tgatatgagtcactatgg

SEQ ID NO: 17064 - DNA, 18 bp, Artificial Sequence
  Synthetic DNA
tgatatgattcaatatag

SEQ ID NO: 17065 - DNA, 18 bp, Artificial Sequence
  Synthetic DNA
tgatccgacacactacag

SEQ ID NO: 17066 - DNA, 18 bp, Artificial Sequence
  Synthetic DNA
tgatccgacttactttag

SEQ ID NO: 17067 - DNA, 18 bp, Artificial Sequence
  Synthetic DNA
tgatcctactaactatag

SEQ ID NO: 17068 - DNA, 18 bp, Artificial Sequence
  Synthetic DNA
tgatgcgaatcactatgg

SEQ ID NO: 17069 - DNA, 18 bp, Artificial Sequence
  Synthetic DNA
tgatgggactcactaaag

SEQ ID NO: 17070 - DNA, 18 bp, Artificial Sequence
  Synthetic DNA
tgcaacgactcactttag

SEQ ID NO: 17071 - DNA, 18 bp, Artificial Sequence
  Synthetic DNA
tgctgcgactcattatag

SEQ ID NO: 17072 - DNA, 18 bp, Artificial Sequence
  Synthetic DNA
tgctgctactcactatag

SEQ ID NO: 17073 - DNA, 18 bp, Artificial Sequence
  Synthetic DNA
tggtaagacacactatag

SEQ ID NO: 17074 - DNA, 18 bp, Artificial Sequence
  Synthetic DNA
tggtacgtctcactgtag

SEQ ID NO: 17075 - DNA, 18 bp, Artificial Sequence
  Synthetic DNA
tgttaagactcaccatag

SEQ ID NO: 17076 - DNA, 18 bp, Artificial Sequence
  Synthetic DNA
tgttaatactcactatag

SEQ ID NO: 17077 - DNA, 18 bp, Artificial Sequence
  Synthetic DNA
tgttacgacccagtatag

SEQ ID NO: 17078 - DNA, 18 bp, Artificial Sequence
  Synthetic DNA
tgttacgactgactatcg

SEQ ID NO: 17079 - DNA, 18 bp, Artificial Sequence
  Synthetic DNA
tgttatgcctcactatag

SEQ ID NO: 17080 - DNA, 18 bp, Artificial Sequence
  Synthetic DNA
ttaaaagactcactagag

SEQ ID NO: 17081 - DNA, 18 bp, Artificial Sequence
  Synthetic DNA
ttaaacgactaactatcg

SEQ ID NO: 17082 - DNA, 18 bp, Artificial Sequence
  Synthetic DNA
ttaaacgactcaatatcg

SEQ ID NO: 17083 - DNA, 18 bp, Artificial Sequence
  Synthetic DNA
ttaaacgactcactctcg

SEQ ID NO: 17084 - DNA, 18 bp, Artificial Sequence
  Synthetic DNA
ttaaacgagtcactagag

SEQ ID NO: 17085 - DNA, 18 bp, Artificial Sequence
  Synthetic DNA
ttaaacgcctcaatatag

SEQ ID NO: 17086 - DNA, 18 bp, Artificial Sequence
  Synthetic DNA
ttacacgagtcactgtag

SEQ ID NO: 17087 - DNA, 18 bp, Artificial Sequence
  Synthetic DNA
ttacccaactcactatag

SEQ ID NO: 17088 - DNA, 18 bp, Artificial Sequence
  Synthetic DNA
ttagactactcagtatag

SEQ ID NO: 17089 - DNA, 18 bp, Artificial Sequence
  Synthetic DNA
ttagaggactcattatag

SEQ ID NO: 17090 - DNA, 18 bp, Artificial Sequence
  Synthetic DNA
ttaggcgactcaccatag

SEQ ID NO: 17091 - DNA, 18 bp, Artificial Sequence
  Synthetic DNA
ttataagaatcactagag

SEQ ID NO: 17092 - DNA, 18 bp, Artificial Sequence
  Synthetic DNA
ttataagactcacaatgg

SEQ ID NO: 17093 - DNA, 18 bp, Artificial Sequence
  Synthetic DNA
ttataagactcatcatag

SEQ ID NO: 17094 - DNA, 18 bp, Artificial Sequence
  Synthetic DNA
ttataagactctctctag

SEQ ID NO: 17095 - DNA, 18 bp, Artificial Sequence
  Synthetic DNA
ttataagtctcactatcg

SEQ ID NO: 17096 - DNA, 18 bp, Artificial Sequence
  Synthetic DNA
ttatacaactcaccatcg

SEQ ID NO: 17097 - DNA, 18 bp, Artificial Sequence
  Synthetic DNA
ttatacaactcactgcag

SEQ ID NO: 17098 - DNA, 18 bp, Artificial Sequence
  Synthetic DNA
ttatacaagtcactataa

SEQ ID NO: 17099 - DNA, 18 bp, Artificial Sequence
  Synthetic DNA
ttataccacgcactatcg

SEQ ID NO: 17100 - DNA, 18 bp, Artificial Sequence
  Synthetic DNA
ttataccactctctgtag

SEQ ID NO: 17101 - DNA, 18 bp, Artificial Sequence
  Synthetic DNA
ttatacgacatactacag

SEQ ID NO: 17102 - DNA, 18 bp, Artificial Sequence
  Synthetic DNA
ttatacgacccactacgg

SEQ ID NO: 17103 - DNA, 18 bp, Artificial Sequence
  Synthetic DNA
ttatacgactcaccttgg

SEQ ID NO: 17104 - DNA, 18 bp, Artificial Sequence
  Synthetic DNA
ttatacgattcattgtag

SEQ ID NO: 17105 - DNA, 18 bp, Artificial Sequence
  Synthetic DNA
ttatacgcctcacgctag

SEQ ID NO: 17106 - DNA, 18 bp, Artificial Sequence
  Synthetic DNA
ttatacggctcaatgtag

SEQ ID NO: 17107 - DNA, 18 bp, Artificial Sequence
  Synthetic DNA
ttatacggcttacaatag

SEQ ID NO: 17108 - DNA, 18 bp, Artificial Sequence
  Synthetic DNA
ttatacgtctcacaataa

SEQ ID NO: 17109 - DNA, 18 bp, Artificial Sequence
  Synthetic DNA
ttatagaactcactatgg

SEQ ID NO: 17110 - DNA, 18 bp, Artificial Sequence
  Synthetic DNA
ttatagtactccctatag

SEQ ID NO: 17111 - DNA, 18 bp, Artificial Sequence
  Synthetic DNA
ttatatgacttcctatag

SEQ ID NO: 17112 - DNA, 18 bp, Artificial Sequence
  Synthetic DNA
ttatatgattcactttag

SEQ ID NO: 17113 - DNA, 18 bp, Artificial Sequence
  Synthetic DNA
ttatccaagtcactatag

SEQ ID NO: 17114 - DNA, 18 bp, Artificial Sequence
  Synthetic DNA
ttatccgactcattacag

SEQ ID NO: 17115 - DNA, 18 bp, Artificial Sequence
  Synthetic DNA
ttatccgacttactgtag

SEQ ID NO: 17116 - DNA, 18 bp, Artificial Sequence
  Synthetic DNA
ttatcctattcactatag

SEQ ID NO: 17117 - DNA, 18 bp, Artificial Sequence
  Synthetic DNA
ttatcggacttactatag

SEQ ID NO: 17118 - DNA, 18 bp, Artificial Sequence
  Synthetic DNA
ttatctaactcactatag

SEQ ID NO: 17119 - DNA, 18 bp, Artificial Sequence
  Synthetic DNA
ttatgcgaagcactatag

SEQ ID NO: 17120 - DNA, 18 bp, Artificial Sequence
  Synthetic DNA
ttatgcgacgtactatag

SEQ ID NO: 17121 - DNA, 18 bp, Artificial Sequence
  Synthetic DNA
ttatgcgactcaatgtag

SEQ ID NO: 17122 - DNA, 18 bp, Artificial Sequence
  Synthetic DNA
ttatgtgactcactttag

SEQ ID NO: 17123 - DNA, 18 bp, Artificial Sequence
  Synthetic DNA
ttctacgacggactatag

SEQ ID NO: 17124 - DNA, 18 bp, Artificial Sequence
  Synthetic DNA
ttctactacttactatag

SEQ ID NO: 17125 - DNA, 18 bp, Artificial Sequence
  Synthetic DNA
ttggacgacgcactatag

SEQ ID NO: 17126 - DNA, 18 bp, Artificial Sequence
  Synthetic DNA
ttgtacgactctctatcg

SEQ ID NO: 17127 - DNA, 18 bp, Artificial Sequence
  Synthetic DNA
ttgtacgcctcaccatag

SEQ ID NO: 17128 - DNA, 18 bp, Artificial Sequence
  Synthetic DNA
ttgtacgtctgactatag

SEQ ID NO: 17129 - DNA, 18 bp, Artificial Sequence
  Synthetic DNA
ttttacgagtcattatag

SEQ ID NO: 17130 - DNA, 18 bp, Artificial Sequence
  Synthetic DNA
taaaacgtgtcactaaag

SEQ ID NO: 17131 - DNA, 18 bp, Artificial Sequence
  Synthetic DNA
tataaagactcactaaag

SEQ ID NO: 17132 - DNA, 18 bp, Artificial Sequence
  Synthetic DNA
ttaaacgtctcactattg

SEQ ID NO: 17133 - DNA, 18 bp, Artificial Sequence
  Synthetic DNA
taaaatgactcacttttg

SEQ ID NO: 17134 - DNA, 18 bp, Artificial Sequence
  Synthetic DNA
taattggactcacattag

SEQ ID NO: 17135 - DNA, 18 bp, Artificial Sequence
  Synthetic DNA
tattttgactcactagag

SEQ ID NO: 17136 - DNA, 18 bp, Artificial Sequence
  Synthetic DNA
agttaggactcactatag

SEQ ID NO: 17137 - DNA, 18 bp, Artificial Sequence
  Synthetic DNA
tattataactcactacag

SEQ ID NO: 17138 - DNA, 18 bp, Artificial Sequence
  Synthetic DNA
taaatcgactcgctttag

SEQ ID NO: 17139 - DNA, 18 bp, Artificial Sequence
  Synthetic DNA
ttattagactcactgtag

SEQ ID NO: 17140 - DNA, 18 bp, Artificial Sequence
  Synthetic DNA
taattaaactcgctatag

SEQ ID NO: 17141 - DNA, 18 bp, Artificial Sequence
  Synthetic DNA
taattcgactcaatactg

SEQ ID NO: 17142 - DNA, 18 bp, Artificial Sequence
  Synthetic DNA
aaattcgactcactctcg

SEQ ID NO: 17143 - DNA, 18 bp, Artificial Sequence
  Synthetic DNA
tatttcgactctatatag

SEQ ID NO: 17144 - DNA, 18 bp, Artificial Sequence
  Synthetic DNA
tatttggactcactatgg

SEQ ID NO: 17145 - DNA, 18 bp, Artificial Sequence
  Synthetic DNA
tcattcgactctctatgg

SEQ ID NO: 17146 - DNA, 18 bp, Artificial Sequence
  Synthetic DNA
tgatttgtctcactatag

SEQ ID NO: 17147 - DNA, 18 bp, Artificial Sequence
  Synthetic DNA
ttaaacaactcgctatag

SEQ ID NO: 17148 - DNA, 18 bp, Artificial Sequence
  Synthetic DNA
ttataaggctcactattg

SEQ ID NO: 17149 - DNA, 18 bp, Artificial Sequence
  Synthetic DNA
ttatacggctcaataaag

SEQ ID NO: 17150 - DNA, 18 bp, Artificial Sequence
  Synthetic DNA
ttatatgacgcactacag

SEQ ID NO: 17151 - DNA, 18 bp, Artificial Sequence
  Synthetic DNA
ttgttcgactcacaatag

SEQ ID NO: 17152 - DNA, 18 bp, Artificial Sequence
  Synthetic DNA
taataagactcccactag

SEQ ID NO: 17153 - DNA, 18 bp, Artificial Sequence
  Synthetic DNA
taattggactcacaaaag

SEQ ID NO: 17154 - DNA, 18 bp, Artificial Sequence
  Synthetic DNA
ttaaacaactcactaaag

SEQ ID NO: 17155 - DNA, 18 bp, Artificial Sequence
  Synthetic DNA
ttattcgactcaccattg

SEQ ID NO: 17156 - DNA, 18 bp, Artificial Sequence
  Synthetic DNA
aaattcgcctcactaaag

SEQ ID NO: 17157 - DNA, 18 bp, Artificial Sequence
  Synthetic DNA
acataggactcgctatag

SEQ ID NO: 17158 - DNA, 18 bp, Artificial Sequence
  Synthetic DNA
caattcgactcattaaag

SEQ ID NO: 17159 - DNA, 18 bp, Artificial Sequence
  Synthetic DNA
cattacgactcactcttg

SEQ ID NO: 17160 - DNA, 18 bp, Artificial Sequence
  Synthetic DNA
taactctactcacaatag

SEQ ID NO: 17161 - DNA, 18 bp, Artificial Sequence
  Synthetic DNA
taatgcgactaacaattg

SEQ ID NO: 17162 - DNA, 18 bp, Artificial Sequence
  Synthetic DNA
tacttcatctcactatag

SEQ ID NO: 17163 - DNA, 18 bp, Artificial Sequence
  Synthetic DNA
tagtgcgacccactattg

SEQ ID NO: 17164 - DNA, 18 bp, Artificial Sequence
  Synthetic DNA
tcataccactcacaattg

SEQ ID NO: 17165 - DNA, 18 bp, Artificial Sequence
  Synthetic DNA
tgattcgtctcactatcg

SEQ ID NO: 17166 - DNA, 18 bp, Artificial Sequence
  Synthetic DNA
aaatacgactatctatcg

SEQ ID NO: 17167 - DNA, 18 bp, Artificial Sequence
  Synthetic DNA
aaatagaactcactatgg

SEQ ID NO: 17168 - DNA, 18 bp, Artificial Sequence
  Synthetic DNA
gataacgtctcactatag

SEQ ID NO: 17169 - DNA, 18 bp, Artificial Sequence
  Synthetic DNA
taaacggactcactaaag

SEQ ID NO: 17170 - DNA, 18 bp, Artificial Sequence
  Synthetic DNA
taataacagtcactaaag

SEQ ID NO: 17171 - DNA, 18 bp, Artificial Sequence
  Synthetic DNA
taatacgccacactttcg

SEQ ID NO: 17172 - DNA, 18 bp, Artificial Sequence
  Synthetic DNA
taatacttctgactatcg

SEQ ID NO: 17173 - DNA, 18 bp, Artificial Sequence
  Synthetic DNA
taataggtctctctaaag

SEQ ID NO: 17174 - DNA, 18 bp, Artificial Sequence
  Synthetic DNA
tataacgagtcacaatag

SEQ ID NO: 17175 - DNA, 18 bp, Artificial Sequence
  Synthetic DNA
tcttacgactcattttag

SEQ ID NO: 17176 - DNA, 18 bp, Artificial Sequence
  Synthetic DNA
tgatacgactctctgtcg

SEQ ID NO: 17177 - DNA, 18 bp, Artificial Sequence
  Synthetic DNA
ttaaacgactcacttgag

SEQ ID NO: 17178 - DNA, 18 bp, Artificial Sequence
  Synthetic DNA
ttaaccgactcactctag

SEQ ID NO: 17179 - DNA, 18 bp, Artificial Sequence
  Synthetic DNA
tattacgcctcactaatg

SEQ ID NO: 17180 - DNA, 18 bp, Artificial Sequence
  Synthetic DNA
taatacgatactctttag

SEQ ID NO: 17181 - DNA, 18 bp, Artificial Sequence
  Synthetic DNA
ttatccgtctcactgtag

SEQ ID NO: 17182 - DNA, 18 bp, Artificial Sequence
  Synthetic DNA
ttttacgactcacaacag

SEQ ID NO: 17183 - DNA, 18 bp, Artificial Sequence
  Synthetic DNA
aatttcgcctcactatag

SEQ ID NO: 17184 - DNA, 18 bp, Artificial Sequence
  Synthetic DNA
ttattcgactcactttcg

SEQ ID NO: 17185 - DNA, 18 bp, Artificial Sequence
  Synthetic DNA
aaataaggctcactatcg

SEQ ID NO: 17186 - DNA, 18 bp, Artificial Sequence
  Synthetic DNA
aataacgactcactttag

SEQ ID NO: 17187 - DNA, 18 bp, Artificial Sequence
  Synthetic DNA
acttacgactcactaaag

SEQ ID NO: 17188 - DNA, 18 bp, Artificial Sequence
  Synthetic DNA
tattacgtctcacactag

SEQ ID NO: 17189 - DNA, 18 bp, Artificial Sequence
  Synthetic DNA
tgaaacgtctcactgtag

SEQ ID NO: 17190 - DNA, 18 bp, Artificial Sequence
  Synthetic DNA
ttaaacgactcactaatg

SEQ ID NO: 17191 - DNA, 18 bp, Artificial Sequence
  Synthetic DNA
taattcgactcgctgtcg

SEQ ID NO: 17192 - DNA, 18 bp, Artificial Sequence
  Synthetic DNA
tagttcgactcactgttg

SEQ ID NO: 17193 - DNA, 18 bp, Artificial Sequence
  Synthetic DNA
tcattagactcactattg

SEQ ID NO: 17194 - DNA, 18 bp, Artificial Sequence
  Synthetic DNA
aaacaggactcactattg

SEQ ID NO: 17195 - DNA, 18 bp, Artificial Sequence
  Synthetic DNA
aaatacgatgcgctatag

SEQ ID NO: 17196 - DNA, 18 bp, Artificial Sequence
  Synthetic DNA
acatacgactcacaattg

SEQ ID NO: 17197 - DNA, 18 bp, Artificial Sequence
  Synthetic DNA
acatacgactcgctatcg

SEQ ID NO: 17198 - DNA, 18 bp, Artificial Sequence
  Synthetic DNA
cgattcgactcacgatag

SEQ ID NO: 17199 - DNA, 18 bp, Artificial Sequence
  Synthetic DNA
taactcgactctctagag

SEQ ID NO: 17200 - DNA, 18 bp, Artificial Sequence
  Synthetic DNA
taataagacgcaccattg

SEQ ID NO: 17201 - DNA, 18 bp, Artificial Sequence
  Synthetic DNA
taatacaaatggctatag

SEQ ID NO: 17202 - DNA, 18 bp, Artificial Sequence
  Synthetic DNA
taatacgaaacgctagag

SEQ ID NO: 17203 - DNA, 18 bp, Artificial Sequence
  Synthetic DNA
taatacgaatcaccactg

SEQ ID NO: 17204 - DNA, 18 bp, Artificial Sequence
  Synthetic DNA
taatacgactctctaata

SEQ ID NO: 17205 - DNA, 18 bp, Artificial Sequence
  Synthetic DNA
taatacgcctaattattg

SEQ ID NO: 17206 - DNA, 18 bp, Artificial Sequence
  Synthetic DNA
taatacgccttactcttg

SEQ ID NO: 17207 - DNA, 18 bp, Artificial Sequence
  Synthetic DNA
taattcgaaccactacag

SEQ ID NO: 17208 - DNA, 18 bp, Artificial Sequence
  Synthetic DNA
taattcgacataatatag

SEQ ID NO: 17209 - DNA, 18 bp, Artificial Sequence
  Synthetic DNA
taattcgacttacactag

SEQ ID NO: 17210 - DNA, 18 bp, Artificial Sequence
  Synthetic DNA
taattcgatttactctag

SEQ ID NO: 17211 - DNA, 18 bp, Artificial Sequence
  Synthetic DNA
taattcgtctctttatag

SEQ ID NO: 17212 - DNA, 18 bp, Artificial Sequence
  Synthetic DNA
taatttgacacactatgg

SEQ ID NO: 17213 - DNA, 18 bp, Artificial Sequence
  Synthetic DNA
taggaagactcactattg

SEQ ID NO: 17214 - DNA, 18 bp, Artificial Sequence
  Synthetic DNA
tataacgactcactcttg

SEQ ID NO: 17215 - DNA, 18 bp, Artificial Sequence
  Synthetic DNA
tatttcggctcactacag

SEQ ID NO: 17216 - DNA, 18 bp, Artificial Sequence
  Synthetic DNA
tcatccgactcagtattg

SEQ ID NO: 17217 - DNA, 18 bp, Artificial Sequence
  Synthetic DNA
tcattcgattcactgtag

SEQ ID NO: 17218 - DNA, 18 bp, Artificial Sequence
  Synthetic DNA
tcattctgctcactatag

SEQ ID NO: 17219 - DNA, 18 bp, Artificial Sequence
  Synthetic DNA
tgattcgtctcactacag

SEQ ID NO: 17220 - DNA, 18 bp, Artificial Sequence
  Synthetic DNA
ttagtcaactcactatag

SEQ ID NO: 17221 - DNA, 18 bp, Artificial Sequence
  Synthetic DNA
ttatacgactcagtagtg

SEQ ID NO: 17222 - DNA, 18 bp, Artificial Sequence
  Synthetic DNA
ttattcgactgacgatag

SEQ ID NO: 17223 - DNA, 18 bp, Artificial Sequence
  Synthetic DNA
ttattcggctcactttag

SEQ ID NO: 17224 - DNA, 18 bp, Artificial Sequence
  Synthetic DNA
ttctccgactcactattg

SEQ ID NO: 17225 - DNA, 18 bp, Artificial Sequence
  Synthetic DNA
aaatacaactgacaatag

SEQ ID NO: 17226 - DNA, 18 bp, Artificial Sequence
  Synthetic DNA
aaataccactaacaatag

SEQ ID NO: 17227 - DNA, 18 bp, Artificial Sequence
  Synthetic DNA
aaatacgacatactctag

SEQ ID NO: 17228 - DNA, 18 bp, Artificial Sequence
  Synthetic DNA
aaatatgactgactctag

SEQ ID NO: 17229 - DNA, 18 bp, Artificial Sequence
  Synthetic DNA
aaatatggctcactaaag

SEQ ID NO: 17230 - DNA, 18 bp, Artificial Sequence
  Synthetic DNA
aagtacgactcccaatag

SEQ ID NO: 17231 - DNA, 18 bp, Artificial Sequence
  Synthetic DNA
atatacgcctcacaatag

SEQ ID NO: 17232 - DNA, 18 bp, Artificial Sequence
  Synthetic DNA
caatacgactctgtagag

SEQ ID NO: 17233 - DNA, 18 bp, Artificial Sequence
  Synthetic DNA
cgatatgattcactatag

SEQ ID NO: 17234 - DNA, 18 bp, Artificial Sequence
  Synthetic DNA
gtaaacgtctcactatag

SEQ ID NO: 17235 - DNA, 18 bp, Artificial Sequence
  Synthetic DNA
taaaacaactcattgtag

SEQ ID NO: 17236 - DNA, 18 bp, Artificial Sequence
  Synthetic DNA
taaaaccactaactttag

SEQ ID NO: 17237 - DNA, 18 bp, Artificial Sequence
  Synthetic DNA
taaaacgactcagtcaag

SEQ ID NO: 17238 - DNA, 18 bp, Artificial Sequence
  Synthetic DNA
taaaacgatacactatcg

SEQ ID NO: 17239 - DNA, 18 bp, Artificial Sequence
  Synthetic DNA
taaaactagccactatag

SEQ ID NO: 17240 - DNA, 18 bp, Artificial Sequence
  Synthetic DNA
taaaattacacactatag

SEQ ID NO: 17241 - DNA, 18 bp, Artificial Sequence
  Synthetic DNA
taacacgacatactgtag

SEQ ID NO: 17242 - DNA, 18 bp, Artificial Sequence
  Synthetic DNA
taacacgacgctctttag

SEQ ID NO: 17243 - DNA, 18 bp, Artificial Sequence
  Synthetic DNA
taacacgagtcaataaag

SEQ ID NO: 17244 - DNA, 18 bp, Artificial Sequence
  Synthetic DNA
taacacgagtcactttcg

SEQ ID NO: 17245 - DNA, 18 bp, Artificial Sequence
  Synthetic DNA
taacacggatcacaatag

SEQ ID NO: 17246 - DNA, 18 bp, Artificial Sequence
  Synthetic DNA
taacatgatttactatag

SEQ ID NO: 17247 - DNA, 18 bp, Artificial Sequence
  Synthetic DNA
taagacatctcagtatag

SEQ ID NO: 17248 - DNA, 18 bp, Artificial Sequence
  Synthetic DNA
taataaggttcaccatag

SEQ ID NO: 17249 - DNA, 18 bp, Artificial Sequence
  Synthetic DNA
taatacaaagaactatag

SEQ ID NO: 17250 - DNA, 18 bp, Artificial Sequence
  Synthetic DNA
taatacaactcccaatcg

SEQ ID NO: 17251 - DNA, 18 bp, Artificial Sequence
  Synthetic DNA
taataccataccctatag

SEQ ID NO: 17252 - DNA, 18 bp, Artificial Sequence
  Synthetic DNA
taatacgaagaactaaag

SEQ ID NO: 17253 - DNA, 18 bp, Artificial Sequence
  Synthetic DNA
taatacgacctacaaaag

SEQ ID NO: 17254 - DNA, 18 bp, Artificial Sequence
  Synthetic DNA
taatacggctgtccatag

SEQ ID NO: 17255 - DNA, 18 bp, Artificial Sequence
  Synthetic DNA
taatacgtcccattttag

SEQ ID NO: 17256 - DNA, 18 bp, Artificial Sequence
  Synthetic DNA
taatacgtcgcacgagag

SEQ ID NO: 17257 - DNA, 18 bp, Artificial Sequence
  Synthetic DNA
taatacgtctaattctag

SEQ ID NO: 17258 - DNA, 18 bp, Artificial Sequence
  Synthetic DNA
taatactactcaacatgg

SEQ ID NO: 17259 - DNA, 18 bp, Artificial Sequence
  Synthetic DNA
taatatgactcaataacg

SEQ ID NO: 17260 - DNA, 18 bp, Artificial Sequence
  Synthetic DNA
taatatgactctatgtag

SEQ ID NO: 17261 - DNA, 18 bp, Artificial Sequence
  Synthetic DNA
taatatgactctccttag

SEQ ID NO: 17262 - DNA, 18 bp, Artificial Sequence
  Synthetic DNA
taatccaacacactaaag

SEQ ID NO: 17263 - DNA, 18 bp, Artificial Sequence
  Synthetic DNA
taatccgtctgactttag

SEQ ID NO: 17264 - DNA, 18 bp, Artificial Sequence
  Synthetic DNA
taatgagactatctatag

SEQ ID NO: 17265 - DNA, 18 bp, Artificial Sequence
  Synthetic DNA
taatgagactcattacag

SEQ ID NO: 17266 - DNA, 18 bp, Artificial Sequence
  Synthetic DNA
taatgcgaatgacaatag

SEQ ID NO: 17267 - DNA, 18 bp, Artificial Sequence
  Synthetic DNA
tactacgtctcaatctag

SEQ ID NO: 17268 - DNA, 18 bp, Artificial Sequence
  Synthetic DNA
tagaacgacacaatatag

SEQ ID NO: 17269 - DNA, 18 bp, Artificial Sequence
  Synthetic DNA
tagaacgactcagtatgg

SEQ ID NO: 17270 - DNA, 18 bp, Artificial Sequence
  Synthetic DNA
tagtacaacaaactatag

SEQ ID NO: 17271 - DNA, 18 bp, Artificial Sequence
  Synthetic DNA
tagtccgactcacaatgg

SEQ ID NO: 17272 - DNA, 18 bp, Artificial Sequence
  Synthetic DNA
tattacaactcagtctag

SEQ ID NO: 17273 - DNA, 18 bp, Artificial Sequence
  Synthetic DNA
tcatacgactctccacag

SEQ ID NO: 17274 - DNA, 18 bp, Artificial Sequence
  Synthetic DNA
tcatacgacttcctacag

SEQ ID NO: 17275 - DNA, 18 bp, Artificial Sequence
  Synthetic DNA
tcgtacgattcactatcg

SEQ ID NO: 17276 - DNA, 18 bp, Artificial Sequence
  Synthetic DNA
tcgtacgcctcagtatag

SEQ ID NO: 17277 - DNA, 18 bp, Artificial Sequence
  Synthetic DNA
tgaagcgtctcactatag

SEQ ID NO: 17278 - DNA, 18 bp, Artificial Sequence
  Synthetic DNA
tgatacgactaattatgg

SEQ ID NO: 17279 - DNA, 18 bp, Artificial Sequence
  Synthetic DNA
tgatacgactgtcaatag

SEQ ID NO: 17280 - DNA, 18 bp, Artificial Sequence
  Synthetic DNA
tgatacgtctcactgaag

SEQ ID NO: 17281 - DNA, 18 bp, Artificial Sequence
  Synthetic DNA
ttagactactaactatag

SEQ ID NO: 17282 - DNA, 18 bp, Artificial Sequence
  Synthetic DNA
ttataggattcactatgg

SEQ ID NO: 17283 - DNA, 18 bp, Artificial Sequence
  Synthetic DNA
ttctacggcacactatag

SEQ ID NO: 17284 - DNA, 18 bp, Artificial Sequence
  Synthetic DNA
ttgtacgacactctatag

SEQ ID NO: 17285 - DNA, 18 bp, Artificial Sequence
  Synthetic DNA
ttttacgactcactgtcg

SEQ ID NO: 17286 - DNA, 18 bp, Artificial Sequence
  Synthetic DNA
ttatacgtctcactaatg

SEQ ID NO: 17287 - DNA, 18 bp, Artificial Sequence
  Synthetic DNA
taaatcgtctcactttag

SEQ ID NO: 17288 - DNA, 18 bp, Artificial Sequence
  Synthetic DNA
ttatacgactctctactg

SEQ ID NO: 17289 - DNA, 18 bp, Artificial Sequence
  Synthetic DNA
ttatacggctaactattg

SEQ ID NO: 17290 - DNA, 18 bp, Artificial Sequence
  Synthetic DNA
ttatactactgactattg

SEQ ID NO: 17291 - DNA, 18 bp, Artificial Sequence
  Synthetic DNA
taatacttttcaatatag

SEQ ID NO: 17292 - DNA, 18 bp, Artificial Sequence
  Synthetic DNA
ttattcgtctcactattg

SEQ ID NO: 17293 - DNA, 18 bp, Artificial Sequence
  Synthetic DNA
taatccgacttgctattg

SEQ ID NO: 17294 - DNA, 18 bp, Artificial Sequence
  Synthetic DNA
gattacgactcactaatg

SEQ ID NO: 17295 - DNA, 18 bp, Artificial Sequence
  Synthetic DNA
taatccaactcgccatag

SEQ ID NO: 17296 - DNA, 18 bp, Artificial Sequence
  Synthetic DNA
tactacaactccctattg

SEQ ID NO: 17297 - DNA, 18 bp, Artificial Sequence
  Synthetic DNA
ttttacgactcactgttg

SEQ ID NO: 17298 - DNA, 18 bp, Artificial Sequence
  Synthetic DNA
aaatacgaaacactatcg

SEQ ID NO: 17299 - DNA, 18 bp, Artificial Sequence
  Synthetic DNA
aaatacgactgcctttag

SEQ ID NO: 17300 - DNA, 18 bp, Artificial Sequence
  Synthetic DNA
aaatacgagacaatatag

SEQ ID NO: 17301 - DNA, 18 bp, Artificial Sequence
  Synthetic DNA
aaatacgagtgtctatag

SEQ ID NO: 17302 - DNA, 18 bp, Artificial Sequence
  Synthetic DNA
aaatactaatccctatag

SEQ ID NO: 17303 - DNA, 18 bp, Artificial Sequence
  Synthetic DNA
aattacgtctcactacag

SEQ ID NO: 17304 - DNA, 18 bp, Artificial Sequence
  Synthetic DNA
acaaacgattcactatag

SEQ ID NO: 17305 - DNA, 18 bp, Artificial Sequence
  Synthetic DNA
atatacgactcagtaaag

SEQ ID NO: 17306 - DNA, 18 bp, Artificial Sequence
  Synthetic DNA
caatacaactcaccttag

SEQ ID NO: 17307 - DNA, 18 bp, Artificial Sequence
  Synthetic DNA
ctatacgcatcactatag

SEQ ID NO: 17308 - DNA, 18 bp, Artificial Sequence
  Synthetic DNA
gaataatactcactttag

SEQ ID NO: 17309 - DNA, 18 bp, Artificial Sequence
  Synthetic DNA
gaatacaagtcactttag

SEQ ID NO: 17310 - DNA, 18 bp, Artificial Sequence
  Synthetic DNA
taaaacgacttacgttag

SEQ ID NO: 17311 - DNA, 18 bp, Artificial Sequence
  Synthetic DNA
taaaacttttcactatag

SEQ ID NO: 17312 - DNA, 18 bp, Artificial Sequence
  Synthetic DNA
taaaccaactcactaaag

SEQ ID NO: 17313 - DNA, 18 bp, Artificial Sequence
  Synthetic DNA
taataagactcacttccg

SEQ ID NO: 17314 - DNA, 18 bp, Artificial Sequence
  Synthetic DNA
taatacaaattcctatag

SEQ ID NO: 17315 - DNA, 18 bp, Artificial Sequence
  Synthetic DNA
taatacagctcacaaaag

SEQ ID NO: 17316 - DNA, 18 bp, Artificial Sequence
  Synthetic DNA
taatacggcttcttatag

SEQ ID NO: 17317 - DNA, 18 bp, Artificial Sequence
  Synthetic DNA
taatagaactcactttcg

SEQ ID NO: 17318 - DNA, 18 bp, Artificial Sequence
  Synthetic DNA
tactactactcaaaatag

SEQ ID NO: 17319 - DNA, 18 bp, Artificial Sequence
  Synthetic DNA
tataacgactgtctatag

SEQ ID NO: 17320 - DNA, 18 bp, Artificial Sequence
  Synthetic DNA
tattacgaccctatatag

SEQ ID NO: 17321 - DNA, 18 bp, Artificial Sequence
  Synthetic DNA
tattacgaccctttatag

SEQ ID NO: 17322 - DNA, 18 bp, Artificial Sequence
  Synthetic DNA
ttatgcgactcagtaaag

SEQ ID NO: 17323 - DNA, 18 bp, Artificial Sequence
  Synthetic DNA
taattcaactctttatag

SEQ ID NO: 17324 - DNA, 18 bp, Artificial Sequence
  Synthetic DNA
taatacgactcgcatttg

SEQ ID NO: 17325 - DNA, 18 bp, Artificial Sequence
  Synthetic DNA
ttaagcgactcactattg

SEQ ID NO: 17326 - DNA, 18 bp, Artificial Sequence
  Synthetic DNA
tattccgaaccactatag

SEQ ID NO: 17327 - DNA, 18 bp, Artificial Sequence
  Synthetic DNA
tttcacgactcactatcg

SEQ ID NO: 17328 - DNA, 18 bp, Artificial Sequence
  Synthetic DNA
taattaaactcactattg

SEQ ID NO: 17329 - DNA, 18 bp, Artificial Sequence
  Synthetic DNA
caatgcgacacactattg

SEQ ID NO: 17330 - DNA, 18 bp, Artificial Sequence
  Synthetic DNA
ttttaagactcactattg

SEQ ID NO: 17331 - DNA, 18 bp, Artificial Sequence
  Synthetic DNA
taatacgtctcacttacg

SEQ ID NO: 17332 - DNA, 18 bp, Artificial Sequence
  Synthetic DNA
taattcgtctctctattg

SEQ ID NO: 17333 - DNA, 18 bp, Artificial Sequence
  Synthetic DNA
ttttacgtctcactattg

SEQ ID NO: 17334 - DNA, 18 bp, Artificial Sequence
  Synthetic DNA
ttttacgactctctattg

SEQ ID NO: 17335 - DNA, 18 bp, Artificial Sequence
  Synthetic DNA
taatacgaatttctttag

SEQ ID NO: 17336 - DNA, 18 bp, Artificial Sequence
  Synthetic DNA
taattcgtctcacttcag

SEQ ID NO: 17337 - DNA, 18 bp, Artificial Sequence
  Synthetic DNA
tattacgtctcactaatg

SEQ ID NO: 17338 - DNA, 18 bp, Artificial Sequence
  Synthetic DNA
tattacgtctcactactg

SEQ ID NO: 17339 - DNA, 18 bp, Artificial Sequence
  Synthetic DNA
tttttcgtctcactatag

SEQ ID NO: 17340 - DNA, 18 bp, Artificial Sequence
  Synthetic DNA
taaatcgactcactactg

SEQ ID NO: 17341 - DNA, 18 bp, Artificial Sequence
  Synthetic DNA
tatttggactcactattg

SEQ ID NO: 17342 - DNA, 18 bp, Artificial Sequence
  Synthetic DNA
aattgcgactcgctatag

SEQ ID NO: 17343 - DNA, 18 bp, Artificial Sequence
  Synthetic DNA
caattctactcactttag

SEQ ID NO: 17344 - DNA, 18 bp, Artificial Sequence
  Synthetic DNA
taaaacgacttgccatag

SEQ ID NO: 17345 - DNA, 18 bp, Artificial Sequence
  Synthetic DNA
taataagactcgcattag

SEQ ID NO: 17346 - DNA, 18 bp, Artificial Sequence
  Synthetic DNA
taattcgactttttatag

SEQ ID NO: 17347 - DNA, 18 bp, Artificial Sequence
  Synthetic DNA
tatctcgactcactttag

SEQ ID NO: 17348 - DNA, 18 bp, Artificial Sequence
  Synthetic DNA
tattaggactcactaatg

SEQ ID NO: 17349 - DNA, 18 bp, Artificial Sequence
  Synthetic DNA
ttacacgactcactgttg

SEQ ID NO: 17350 - DNA, 18 bp, Artificial Sequence
  Synthetic DNA
taaacctactctctatag

SEQ ID NO: 17351 - DNA, 18 bp, Artificial Sequence
  Synthetic DNA
taatacgaaacattaaag

SEQ ID NO: 17352 - DNA, 18 bp, Artificial Sequence
  Synthetic DNA
taatacgactatataaag

SEQ ID NO: 17353 - DNA, 18 bp, Artificial Sequence
  Synthetic DNA
taatactaattattatag

SEQ ID NO: 17354 - DNA, 18 bp, Artificial Sequence
  Synthetic DNA
taataggaatcactcaag

SEQ ID NO: 17355 - DNA, 18 bp, Artificial Sequence
  Synthetic DNA
taatccgaataaccatag

SEQ ID NO: 17356 - DNA, 18 bp, Artificial Sequence
  Synthetic DNA
taatgcaacgcactatcg

SEQ ID NO: 17357 - DNA, 18 bp, Artificial Sequence
  Synthetic DNA
tattaggactcactaagg

SEQ ID NO: 17358 - DNA, 18 bp, Artificial Sequence
  Synthetic DNA
tattgcgagtcacaatag

SEQ ID NO: 17359 - DNA, 18 bp, Artificial Sequence
  Synthetic DNA
tgatattactcactaaag

SEQ ID NO: 17360 - DNA, 18 bp, Artificial Sequence
  Synthetic DNA
ttaaactgctcactatag

SEQ ID NO: 17361 - DNA, 18 bp, Artificial Sequence
  Synthetic DNA
ttacacgactcacaatcg

SEQ ID NO: 17362 - DNA, 18 bp, Artificial Sequence
  Synthetic DNA
ttacgcgactcactaaag

SEQ ID NO: 17363 - DNA, 18 bp, Artificial Sequence
  Synthetic DNA
ttatacgacttcctatgg

SEQ ID NO: 17364 - DNA, 18 bp, Artificial Sequence
  Synthetic DNA
taattcgacgcgctattg

SEQ ID NO: 17365 - DNA, 18 bp, Artificial Sequence
  Synthetic DNA
aaattcgactcgttatag

SEQ ID NO: 17366 - DNA, 18 bp, Artificial Sequence
  Synthetic DNA
caattcgactcggtatag

SEQ ID NO: 17367 - DNA, 18 bp, Artificial Sequence
  Synthetic DNA
taaatcgactcgctacag

SEQ ID NO: 17368 - DNA, 18 bp, Artificial Sequence
  Synthetic DNA
taactcgactagctatag

SEQ ID NO: 17369 - DNA, 18 bp, Artificial Sequence
  Synthetic DNA
taataagactcgctcttg

SEQ ID NO: 17370 - DNA, 18 bp, Artificial Sequence
  Synthetic DNA
taatacagctcgctattg

SEQ ID NO: 17371 - DNA, 18 bp, Artificial Sequence
  Synthetic DNA
taataccacccgctattg

SEQ ID NO: 17372 - DNA, 18 bp, Artificial Sequence
  Synthetic DNA
taatacgactagcaattg

SEQ ID NO: 17373 - DNA, 18 bp, Artificial Sequence
  Synthetic DNA
taatacgcctcgctaatg

SEQ ID NO: 17374 - DNA, 18 bp, Artificial Sequence
  Synthetic DNA
taatgcgactcgctgttg

SEQ ID NO: 17375 - DNA, 18 bp, Artificial Sequence
  Synthetic DNA
taattcaactcactaatg

SEQ ID NO: 17376 - DNA, 18 bp, Artificial Sequence
  Synthetic DNA
taattcgactaaccattg

SEQ ID NO: 17377 - DNA, 18 bp, Artificial Sequence
  Synthetic DNA
taattcgactctcgattg

SEQ ID NO: 17378 - DNA, 18 bp, Artificial Sequence
  Synthetic DNA
taattcgagtcaatattg

SEQ ID NO: 17379 - DNA, 18 bp, Artificial Sequence
  Synthetic DNA
taattcggctcagtattg

SEQ ID NO: 17380 - DNA, 18 bp, Artificial Sequence
  Synthetic DNA
taattctactcgccatag

SEQ ID NO: 17381 - DNA, 18 bp, Artificial Sequence
  Synthetic DNA
taattggactcgctctag

SEQ ID NO: 17382 - DNA, 18 bp, Artificial Sequence
  Synthetic DNA
tacttcgactagctatag

SEQ ID NO: 17383 - DNA, 18 bp, Artificial Sequence
  Synthetic DNA
tacttcgactcattattg

SEQ ID NO: 17384 - DNA, 18 bp, Artificial Sequence
  Synthetic DNA
aaatacgactcattatta

SEQ ID NO: 17385 - DNA, 18 bp, Artificial Sequence
  Synthetic DNA
aaatacgactcgatagag

SEQ ID NO: 17386 - DNA, 18 bp, Artificial Sequence
  Synthetic DNA
aaatacgactcgcttaag

SEQ ID NO: 17387 - DNA, 18 bp, Artificial Sequence
  Synthetic DNA
aaatacggatcgctatag

SEQ ID NO: 17388 - DNA, 18 bp, Artificial Sequence
  Synthetic DNA
aaatatgactcactatta

SEQ ID NO: 17389 - DNA, 18 bp, Artificial Sequence
  Synthetic DNA
aaattcgaccccctatag

SEQ ID NO: 17390 - DNA, 18 bp, Artificial Sequence
  Synthetic DNA
aagatcgactcactatag

SEQ ID NO: 17391 - DNA, 18 bp, Artificial Sequence
  Synthetic DNA
aattaccactcactattg

SEQ ID NO: 17392 - DNA, 18 bp, Artificial Sequence
  Synthetic DNA
caagacgacacactattg

SEQ ID NO: 17393 - DNA, 18 bp, Artificial Sequence
  Synthetic DNA
caagtcaactcactatag

SEQ ID NO: 17394 - DNA, 18 bp, Artificial Sequence
  Synthetic DNA
caataaaactcactattg

SEQ ID NO: 17395 - DNA, 18 bp, Artificial Sequence
  Synthetic DNA
caatacgacccactgttg

SEQ ID NO: 17396 - DNA, 18 bp, Artificial Sequence
  Synthetic DNA
caatacgactcaattttg

SEQ ID NO: 17397 - DNA, 18 bp, Artificial Sequence
  Synthetic DNA
caatacgactcggtctag

SEQ ID NO: 17398 - DNA, 18 bp, Artificial Sequence
  Synthetic DNA
caatacgactgcctattg

SEQ ID NO: 17399 - DNA, 18 bp, Artificial Sequence
  Synthetic DNA
caatctgactcgctatag

SEQ ID NO: 17400 - DNA, 18 bp, Artificial Sequence
  Synthetic DNA
caattcgactcactaagg

SEQ ID NO: 17401 - DNA, 18 bp, Artificial Sequence
  Synthetic DNA
caattcgattcactttag

SEQ ID NO: 17402 - DNA, 18 bp, Artificial Sequence
  Synthetic DNA
caattcgattcattatag

SEQ ID NO: 17403 - DNA, 18 bp, Artificial Sequence
  Synthetic DNA
caattctacttactatag

SEQ ID NO: 17404 - DNA, 18 bp, Artificial Sequence
  Synthetic DNA
ccatactactcgctatag

SEQ ID NO: 17405 - DNA, 18 bp, Artificial Sequence
  Synthetic DNA
ccattcgactcactacag

SEQ ID NO: 17406 - DNA, 18 bp, Artificial Sequence
  Synthetic DNA
gaaaacgactctctattg

SEQ ID NO: 17407 - DNA, 18 bp, Artificial Sequence
  Synthetic DNA
gaattagactaactatag

SEQ ID NO: 17408 - DNA, 18 bp, Artificial Sequence
  Synthetic DNA
gagttcgactcagtatag

SEQ ID NO: 17409 - DNA, 18 bp, Artificial Sequence
  Synthetic DNA
gattacgactccctattg

SEQ ID NO: 17410 - DNA, 18 bp, Artificial Sequence
  Synthetic DNA
gatttcgacacactatag

SEQ ID NO: 17411 - DNA, 18 bp, Artificial Sequence
  Synthetic DNA
gtatacgacacactattg

SEQ ID NO: 17412 - DNA, 18 bp, Artificial Sequence
  Synthetic DNA
taaaacgactcacgtttg

SEQ ID NO: 17413 - DNA, 18 bp, Artificial Sequence
  Synthetic DNA
taaaacgactcattgttg

SEQ ID NO: 17414 - DNA, 18 bp, Artificial Sequence
  Synthetic DNA
taaaacgactcgacatag

SEQ ID NO: 17415 - DNA, 18 bp, Artificial Sequence
  Synthetic DNA
taaaacgactcgatatcg

SEQ ID NO: 17416 - DNA, 18 bp, Artificial Sequence
  Synthetic DNA
taaaacgatacgctatag

SEQ ID NO: 17417 - DNA, 18 bp, Artificial Sequence
  Synthetic DNA
taaaacggctcactcttg

SEQ ID NO: 17418 - DNA, 18 bp, Artificial Sequence
  Synthetic DNA
taaaacggttcactattg

SEQ ID NO: 17419 - DNA, 18 bp, Artificial Sequence
  Synthetic DNA
taaaactactcactcttg

SEQ ID NO: 17420 - DNA, 18 bp, Artificial Sequence
  Synthetic DNA
taaaactactcgctatgg

SEQ ID NO: 17421 - DNA, 18 bp, Artificial Sequence
  Synthetic DNA
taaagcgactcgatatag

SEQ ID NO: 17422 - DNA, 18 bp, Artificial Sequence
  Synthetic DNA
taaatcgacccactatcg

SEQ ID NO: 17423 - DNA, 18 bp, Artificial Sequence
  Synthetic DNA
taaatcgactcagtaaag

SEQ ID NO: 17424 - DNA, 18 bp, Artificial Sequence
  Synthetic DNA
taaatcgtctcactatcg

SEQ ID NO: 17425 - DNA, 18 bp, Artificial Sequence
  Synthetic DNA
taacaagactcaatattg

SEQ ID NO: 17426 - DNA, 18 bp, Artificial Sequence
  Synthetic DNA
taacaccactcactgttg

SEQ ID NO: 17427 - DNA, 18 bp, Artificial Sequence
  Synthetic DNA
taacacgaattactattg

SEQ ID NO: 17428 - DNA, 18 bp, Artificial Sequence
  Synthetic DNA
taacacgacttactcttg

SEQ ID NO: 17429 - DNA, 18 bp, Artificial Sequence
  Synthetic DNA
taacacgcatcactattg

SEQ ID NO: 17430 - DNA, 18 bp, Artificial Sequence
  Synthetic DNA
taacatgactcactgttg

SEQ ID NO: 17431 - DNA, 18 bp, Artificial Sequence
  Synthetic DNA
taacccgactaactattg

SEQ ID NO: 17432 - DNA, 18 bp, Artificial Sequence
  Synthetic DNA
taactcgaatcactatcg

SEQ ID NO: 17433 - DNA, 18 bp, Artificial Sequence
  Synthetic DNA
taactcgactcattctag

SEQ ID NO: 17434 - DNA, 18 bp, Artificial Sequence
  Synthetic DNA
taactcgactctctctag

SEQ ID NO: 17435 - DNA, 18 bp, Artificial Sequence
  Synthetic DNA
taactcgagtcacaatag

SEQ ID NO: 17436 - DNA, 18 bp, Artificial Sequence
  Synthetic DNA
taactcggctcactttag

SEQ ID NO: 17437 - DNA, 18 bp, Artificial Sequence
  Synthetic DNA
taagaagactccctattg

SEQ ID NO: 17438 - DNA, 18 bp, Artificial Sequence
  Synthetic DNA
taagacaactcacttttg

SEQ ID NO: 17439 - DNA, 18 bp, Artificial Sequence
  Synthetic DNA
taagacgaatcgcgatag

SEQ ID NO: 17440 - DNA, 18 bp, Artificial Sequence
  Synthetic DNA
taagacgacatactattg

SEQ ID NO: 17441 - DNA, 18 bp, Artificial Sequence
  Synthetic DNA
taagacgattcacttttg

SEQ ID NO: 17442 - DNA, 18 bp, Artificial Sequence
  Synthetic DNA
taagccggctcgctatag

SEQ ID NO: 17443 - DNA, 18 bp, Artificial Sequence
  Synthetic DNA
taagtctacccactatag

SEQ ID NO: 17444 - DNA, 18 bp, Artificial Sequence
  Synthetic DNA
taataagactcagtagtg

SEQ ID NO: 17445 - DNA, 18 bp, Artificial Sequence
  Synthetic DNA
taataagactggctttag

SEQ ID NO: 17446 - DNA, 18 bp, Artificial Sequence
  Synthetic DNA
taataagagtcacttttg

SEQ ID NO: 17447 - DNA, 18 bp, Artificial Sequence
  Synthetic DNA
taataagtcacgctatag

SEQ ID NO: 17448 - DNA, 18 bp, Artificial Sequence
  Synthetic DNA
taataatactcaccattg

SEQ ID NO: 17449 - DNA, 18 bp, Artificial Sequence
  Synthetic DNA
taatacaactcagtgttg

SEQ ID NO: 17450 - DNA, 18 bp, Artificial Sequence
  Synthetic DNA
taatacaactccctcttg

SEQ ID NO: 17451 - DNA, 18 bp, Artificial Sequence
  Synthetic DNA
taatacaacttactgttg

SEQ ID NO: 17452 - DNA, 18 bp, Artificial Sequence
  Synthetic DNA
taatacacctcggtatag

SEQ ID NO: 17453 - DNA, 18 bp, Artificial Sequence
  Synthetic DNA
taatacagctcactactg

SEQ ID NO: 17454 - DNA, 18 bp, Artificial Sequence
  Synthetic DNA
taataccactcacctttg

SEQ ID NO: 17455 - DNA, 18 bp, Artificial Sequence
  Synthetic DNA
taataccagtaactattg

SEQ ID NO: 17456 - DNA, 18 bp, Artificial Sequence
  Synthetic DNA
taatacgaagcagtattg

SEQ ID NO: 17457 - DNA, 18 bp, Artificial Sequence
  Synthetic DNA
taatacgacgcggaatag

SEQ ID NO: 17458 - DNA, 18 bp, Artificial Sequence
  Synthetic DNA
taatacgactcaatcgtg

SEQ ID NO: 17459 - DNA, 18 bp, Artificial Sequence
  Synthetic DNA
taatacgactcagcatta

SEQ ID NO: 17460 - DNA, 18 bp, Artificial Sequence
  Synthetic DNA
taatacgactcgtttaag

SEQ ID NO: 17461 - DNA, 18 bp, Artificial Sequence
  Synthetic DNA
taatacgactctttgttg

SEQ ID NO: 17462 - DNA, 18 bp, Artificial Sequence
  Synthetic DNA
taatacgacttacaagtg

SEQ ID NO: 17463 - DNA, 18 bp, Artificial Sequence
  Synthetic DNA
taatacgagttgctctag

SEQ ID NO: 17464 - DNA, 18 bp, Artificial Sequence
  Synthetic DNA
taatacgatacgatatag

SEQ ID NO: 17465 - DNA, 18 bp, Artificial Sequence
  Synthetic DNA
taatacgattagctgtag

SEQ ID NO: 17466 - DNA, 18 bp, Artificial Sequence
  Synthetic DNA
taatacggatcacaattg

SEQ ID NO: 17467 - DNA, 18 bp, Artificial Sequence
  Synthetic DNA
taatacggctcggtacag

SEQ ID NO: 17468 - DNA, 18 bp, Artificial Sequence
  Synthetic DNA
taatacggctgactactg

SEQ ID NO: 17469 - DNA, 18 bp, Artificial Sequence
  Synthetic DNA
taatacgtctggctaaag

SEQ ID NO: 17470 - DNA, 18 bp, Artificial Sequence
  Synthetic DNA
taatacgtttcgctgtag

SEQ ID NO: 17471 - DNA, 18 bp, Artificial Sequence
  Synthetic DNA
taatactactgaatattg

SEQ ID NO: 17472 - DNA, 18 bp, Artificial Sequence
  Synthetic DNA
taatactacttactcttg

SEQ ID NO: 17473 - DNA, 18 bp, Artificial Sequence
  Synthetic DNA
taatactcatcgctatag

SEQ ID NO: 17474 - DNA, 18 bp, Artificial Sequence
  Synthetic DNA
taatagaactcgctagag

SEQ ID NO: 17475 - DNA, 18 bp, Artificial Sequence
  Synthetic DNA
taataggactcacttctg

SEQ ID NO: 17476 - DNA, 18 bp, Artificial Sequence
  Synthetic DNA
taataggactcataattg

SEQ ID NO: 17477 - DNA, 18 bp, Artificial Sequence
  Synthetic DNA
taataggactcgctaccg

SEQ ID NO: 17478 - DNA, 18 bp, Artificial Sequence
  Synthetic DNA
taataggactctctcttg

SEQ ID NO: 17479 - DNA, 18 bp, Artificial Sequence
  Synthetic DNA
taataggcctctctattg

SEQ ID NO: 17480 - DNA, 18 bp, Artificial Sequence
  Synthetic DNA
taatagggatcactattg

SEQ ID NO: 17481 - DNA, 18 bp, Artificial Sequence
  Synthetic DNA
taatatatctcgctatag

SEQ ID NO: 17482 - DNA, 18 bp, Artificial Sequence
  Synthetic DNA
taatatcactctctattg

SEQ ID NO: 17483 - DNA, 18 bp, Artificial Sequence
  Synthetic DNA
taatatgaatccctattg

SEQ ID NO: 17484 - DNA, 18 bp, Artificial Sequence
  Synthetic DNA
taatatgactcgctctcg

SEQ ID NO: 17485 - DNA, 18 bp, Artificial Sequence
  Synthetic DNA
taatatgattcgccatag

SEQ ID NO: 17486 - DNA, 18 bp, Artificial Sequence
  Synthetic DNA
taatatgattcgctctag

SEQ ID NO: 17487 - DNA, 18 bp, Artificial Sequence
  Synthetic DNA
taatcagacacactattg

SEQ ID NO: 17488 - DNA, 18 bp, Artificial Sequence
  Synthetic DNA
taatcagactcgctaaag

SEQ ID NO: 17489 - DNA, 18 bp, Artificial Sequence
  Synthetic DNA
taatccgactcgctggag

SEQ ID NO: 17490 - DNA, 18 bp, Artificial Sequence
  Synthetic DNA
taatgcgacgaactattg

SEQ ID NO: 17491 - DNA, 18 bp, Artificial Sequence
  Synthetic DNA
taatgcgactcaaaattg

SEQ ID NO: 17492 - DNA, 18 bp, Artificial Sequence
  Synthetic DNA
taatgcgcctcactagtg

SEQ ID NO: 17493 - DNA, 18 bp, Artificial Sequence
  Synthetic DNA
taatgcggctgactattg

SEQ ID NO: 17494 - DNA, 18 bp, Artificial Sequence
  Synthetic DNA
taatgtgactcactaatg

SEQ ID NO: 17495 - DNA, 18 bp, Artificial Sequence
  Synthetic DNA
taattagactctccatag

SEQ ID NO: 17496 - DNA, 18 bp, Artificial Sequence
  Synthetic DNA
taattcaactcactaacg

SEQ ID NO: 17497 - DNA, 18 bp, Artificial Sequence
  Synthetic DNA
taattcaattcactatgg

SEQ ID NO: 17498 - DNA, 18 bp, Artificial Sequence
  Synthetic DNA
taattccactcactggag

SEQ ID NO: 17499 - DNA, 18 bp, Artificial Sequence
  Synthetic DNA
taattccactgactttag

SEQ ID NO: 17500 - DNA, 18 bp, Artificial Sequence
  Synthetic DNA
taattcccctcactaaag

SEQ ID NO: 17501 - DNA, 18 bp, Artificial Sequence
  Synthetic DNA
taattccgctcaatatag

SEQ ID NO: 17502 - DNA, 18 bp, Artificial Sequence
  Synthetic DNA
taattcctcccactatag

SEQ ID NO: 17503 - DNA, 18 bp, Artificial Sequence
  Synthetic DNA
taattcgaatcccaatag

SEQ ID NO: 17504 - DNA, 18 bp, Artificial Sequence
  Synthetic DNA
taattcgactcaacttag

SEQ ID NO: 17505 - DNA, 18 bp, Artificial Sequence
  Synthetic DNA
taattcgactcacttacg

SEQ ID NO: 17506 - DNA, 18 bp, Artificial Sequence
  Synthetic DNA
taattcgactccataaag

SEQ ID NO: 17507 - DNA, 18 bp, Artificial Sequence
  Synthetic DNA
taattcgactctcaatcg

SEQ ID NO: 17508 - DNA, 18 bp, Artificial Sequence
  Synthetic DNA
taattcgactctccatcg

SEQ ID NO: 17509 - DNA, 18 bp, Artificial Sequence
  Synthetic DNA
taattcgactgaatttag

SEQ ID NO: 17510 - DNA, 18 bp, Artificial Sequence
  Synthetic DNA
taattcgacttaccacag

SEQ ID NO: 17511 - DNA, 18 bp, Artificial Sequence
  Synthetic DNA
taattcgacttacttcag

SEQ ID NO: 17512 - DNA, 18 bp, Artificial Sequence
  Synthetic DNA
taattcgagtcattacag

SEQ ID NO: 17513 - DNA, 18 bp, Artificial Sequence
  Synthetic DNA
taattcgcctcattacag

SEQ ID NO: 17514 - DNA, 18 bp, Artificial Sequence
  Synthetic DNA
taattcgcgacactatag

SEQ ID NO: 17515 - DNA, 18 bp, Artificial Sequence
  Synthetic DNA
taattcgctgcactatag

SEQ ID NO: 17516 - DNA, 18 bp, Artificial Sequence
  Synthetic DNA
taattcggctcaccaaag

SEQ ID NO: 17517 - DNA, 18 bp, Artificial Sequence
  Synthetic DNA
taattcgtatcactatcg

SEQ ID NO: 17518 - DNA, 18 bp, Artificial Sequence
  Synthetic DNA
taattcgtcccagtatag

SEQ ID NO: 17519 - DNA, 18 bp, Artificial Sequence
  Synthetic DNA
taattcgtcgcacgatag

SEQ ID NO: 17520 - DNA, 18 bp, Artificial Sequence
  Synthetic DNA
taattcgtctcacagtag

SEQ ID NO: 17521 - DNA, 18 bp, Artificial Sequence
  Synthetic DNA
taattctaatccctatag

SEQ ID NO: 17522 - DNA, 18 bp, Artificial Sequence
  Synthetic DNA
taattctactcacaatcg

SEQ ID NO: 17523 - DNA, 18 bp, Artificial Sequence
  Synthetic DNA
taattctactcactctcg

SEQ ID NO: 17524 - DNA, 18 bp, Artificial Sequence
  Synthetic DNA
taattctggtcactatag

SEQ ID NO: 17525 - DNA, 18 bp, Artificial Sequence
  Synthetic DNA
taattggacacactatcg

SEQ ID NO: 17526 - DNA, 18 bp, Artificial Sequence
  Synthetic DNA
taattggacacactatgg

SEQ ID NO: 17527 - DNA, 18 bp, Artificial Sequence
  Synthetic DNA
taattggacactctatag

SEQ ID NO: 17528 - DNA, 18 bp, Artificial Sequence
  Synthetic DNA
taattggacttactaaag

SEQ ID NO: 17529 - DNA, 18 bp, Artificial Sequence
  Synthetic DNA
taattggattcattatag

SEQ ID NO: 17530 - DNA, 18 bp, Artificial Sequence
  Synthetic DNA
taattgggctcactatgg

SEQ ID NO: 17531 - DNA, 18 bp, Artificial Sequence
  Synthetic DNA
taatttacctcactatag

SEQ ID NO: 17532 - DNA, 18 bp, Artificial Sequence
  Synthetic DNA
taatttgacttactgtag

SEQ ID NO: 17533 - DNA, 18 bp, Artificial Sequence
  Synthetic DNA
taatttgtctcaccatag

SEQ ID NO: 17534 - DNA, 18 bp, Artificial Sequence
  Synthetic DNA
tacatcgactcacgatag

SEQ ID NO: 17535 - DNA, 18 bp, Artificial Sequence
  Synthetic DNA
tacatcgagtcactatag

SEQ ID NO: 17536 - DNA, 18 bp, Artificial Sequence
  Synthetic DNA
tactacaactcactactg

SEQ ID NO: 17537 - DNA, 18 bp, Artificial Sequence
  Synthetic DNA
tactaccactcactaatg

SEQ ID NO: 17538 - DNA, 18 bp, Artificial Sequence
  Synthetic DNA
tactacgaatctctattg

SEQ ID NO: 17539 - DNA, 18 bp, Artificial Sequence
  Synthetic DNA
tactacgacacactaatg

SEQ ID NO: 17540 - DNA, 18 bp, Artificial Sequence
  Synthetic DNA
tactacgaccagctatag

SEQ ID NO: 17541 - DNA, 18 bp, Artificial Sequence
  Synthetic DNA
tactacgagtcaatattg

SEQ ID NO: 17542 - DNA, 18 bp, Artificial Sequence
  Synthetic DNA
tactagaactcactattg

SEQ ID NO: 17543 - DNA, 18 bp, Artificial Sequence
  Synthetic DNA
tactatggctcactattg

SEQ ID NO: 17544 - DNA, 18 bp, Artificial Sequence
  Synthetic DNA
tacttcgactcagtaaag

SEQ ID NO: 17545 - DNA, 18 bp, Artificial Sequence
  Synthetic DNA
tacttcgactctttatag

SEQ ID NO: 17546 - DNA, 18 bp, Artificial Sequence
  Synthetic DNA
tacttcgacttattatag

SEQ ID NO: 17547 - DNA, 18 bp, Artificial Sequence
  Synthetic DNA
tacttcgatccactatag

SEQ ID NO: 17548 - DNA, 18 bp, Artificial Sequence
  Synthetic DNA
tacttcgattaactatag

SEQ ID NO: 17549 - DNA, 18 bp, Artificial Sequence
  Synthetic DNA
tagaacgactcgatatag

SEQ ID NO: 17550 - DNA, 18 bp, Artificial Sequence
  Synthetic DNA
tagatcgactcactgtag

SEQ ID NO: 17551 - DNA, 18 bp, Artificial Sequence
  Synthetic DNA
tagcacaactcgctatag

SEQ ID NO: 17552 - DNA, 18 bp, Artificial Sequence
  Synthetic DNA
tagtaccactcgctttag

SEQ ID NO: 17553 - DNA, 18 bp, Artificial Sequence
  Synthetic DNA
tagtacgactaagtattg

SEQ ID NO: 17554 - DNA, 18 bp, Artificial Sequence
  Synthetic DNA
tagtacgactcaatgttg

SEQ ID NO: 17555 - DNA, 18 bp, Artificial Sequence
  Synthetic DNA
tagtacgactcgatttag

SEQ ID NO: 17556 - DNA, 18 bp, Artificial Sequence
  Synthetic DNA
tagtacggctctctattg

SEQ ID NO: 17557 - DNA, 18 bp, Artificial Sequence
  Synthetic DNA
tagtatgactcggtatag

SEQ ID NO: 17558 - DNA, 18 bp, Artificial Sequence
  Synthetic DNA
tagtccgagtcgctatag

SEQ ID NO: 17559 - DNA, 18 bp, Artificial Sequence
  Synthetic DNA
tagttcgactgacaatag

SEQ ID NO: 17560 - DNA, 18 bp, Artificial Sequence
  Synthetic DNA
tagttcgacttactatcg

SEQ ID NO: 17561 - DNA, 18 bp, Artificial Sequence
  Synthetic DNA
tagttcgtctcactgtag

SEQ ID NO: 17562 - DNA, 18 bp, Artificial Sequence
  Synthetic DNA
tataaggactcgctatag

SEQ ID NO: 17563 - DNA, 18 bp, Artificial Sequence
  Synthetic DNA
tatcacgactcactgttg

SEQ ID NO: 17564 - DNA, 18 bp, Artificial Sequence
  Synthetic DNA
tattaccactcgctagag

SEQ ID NO: 17565 - DNA, 18 bp, Artificial Sequence
  Synthetic DNA
tattacgaatcacgattg

SEQ ID NO: 17566 - DNA, 18 bp, Artificial Sequence
  Synthetic DNA
tattacgactcgtcatag

SEQ ID NO: 17567 - DNA, 18 bp, Artificial Sequence
  Synthetic DNA
tattacgacttgcaatag

SEQ ID NO: 17568 - DNA, 18 bp, Artificial Sequence
  Synthetic DNA
tattacgatccactattg

SEQ ID NO: 17569 - DNA, 18 bp, Artificial Sequence
  Synthetic DNA
tattacgtcgcgctatag

SEQ ID NO: 17570 - DNA, 18 bp, Artificial Sequence
  Synthetic DNA
tattacgtctgactattg

SEQ ID NO: 17571 - DNA, 18 bp, Artificial Sequence
  Synthetic DNA
tattgcaactcgctatag

SEQ ID NO: 17572 - DNA, 18 bp, Artificial Sequence
  Synthetic DNA
tattgcgactcaccattg

SEQ ID NO: 17573 - DNA, 18 bp, Artificial Sequence
  Synthetic DNA
tatttcgactcactctcg

SEQ ID NO: 17574 - DNA, 18 bp, Artificial Sequence
  Synthetic DNA
tatttcggcacactatag

SEQ ID NO: 17575 - DNA, 18 bp, Artificial Sequence
  Synthetic DNA
tattttaactcactatag

SEQ ID NO: 17576 - DNA, 18 bp, Artificial Sequence
  Synthetic DNA
tattttgactcactgtag

SEQ ID NO: 17577 - DNA, 18 bp, Artificial Sequence
  Synthetic DNA
tcactcgactcactatcg

SEQ ID NO: 17578 - DNA, 18 bp, Artificial Sequence
  Synthetic DNA
tcatacgacttactgttg

SEQ ID NO: 17579 - DNA, 18 bp, Artificial Sequence
  Synthetic DNA
tcatacgattcgctatgg

SEQ ID NO: 17580 - DNA, 18 bp, Artificial Sequence
  Synthetic DNA
tcattccactgactatag

SEQ ID NO: 17581 - DNA, 18 bp, Artificial Sequence
  Synthetic DNA
tcattccattcactatag

SEQ ID NO: 17582 - DNA, 18 bp, Artificial Sequence
  Synthetic DNA
tcattcgactcacttgag

SEQ ID NO: 17583 - DNA, 18 bp, Artificial Sequence
  Synthetic DNA
tcattcgagtcacaatag

SEQ ID NO: 17584 - DNA, 18 bp, Artificial Sequence
  Synthetic DNA
tcattcggctcactttag

SEQ ID NO: 17585 - DNA, 18 bp, Artificial Sequence
  Synthetic DNA
tcattggactcactaaag

SEQ ID NO: 17586 - DNA, 18 bp, Artificial Sequence
  Synthetic DNA
tccttctactcactatag

SEQ ID NO: 17587 - DNA, 18 bp, Artificial Sequence
  Synthetic DNA
tcgttagactcactatag

SEQ ID NO: 17588 - DNA, 18 bp, Artificial Sequence
  Synthetic DNA
tgatacgactggttatag

SEQ ID NO: 17589 - DNA, 18 bp, Artificial Sequence
  Synthetic DNA
tgatgcgtctcgctatag

SEQ ID NO: 17590 - DNA, 18 bp, Artificial Sequence
  Synthetic DNA
tgattcgaatcacaatag

SEQ ID NO: 17591 - DNA, 18 bp, Artificial Sequence
  Synthetic DNA
tgattcgactcagtacag

SEQ ID NO: 17592 - DNA, 18 bp, Artificial Sequence
  Synthetic DNA
tgattcgactcattacag

SEQ ID NO: 17593 - DNA, 18 bp, Artificial Sequence
  Synthetic DNA
tgattcgtctaactatag

SEQ ID NO: 17594 - DNA, 18 bp, Artificial Sequence
  Synthetic DNA
tgatttgactcaatatag

SEQ ID NO: 17595 - DNA, 18 bp, Artificial Sequence
  Synthetic DNA
tggtacgactgactattg

SEQ ID NO: 17596 - DNA, 18 bp, Artificial Sequence
  Synthetic DNA
ttaaaagactcgctatag

SEQ ID NO: 17597 - DNA, 18 bp, Artificial Sequence
  Synthetic DNA
ttataagaatcgctatag

SEQ ID NO: 17598 - DNA, 18 bp, Artificial Sequence
  Synthetic DNA
ttataagactcgccatag

SEQ ID NO: 17599 - DNA, 18 bp, Artificial Sequence
  Synthetic DNA
ttataccacccgctatag

SEQ ID NO: 17600 - DNA, 18 bp, Artificial Sequence
  Synthetic DNA
ttatacgacaagctatag

SEQ ID NO: 17601 - DNA, 18 bp, Artificial Sequence
  Synthetic DNA
ttatacgactcaccatta

SEQ ID NO: 17602 - DNA, 18 bp, Artificial Sequence
  Synthetic DNA
ttatacgactcactaata

SEQ ID NO: 17603 - DNA, 18 bp, Artificial Sequence
  Synthetic DNA
ttatacgactcattactg

SEQ ID NO: 17604 - DNA, 18 bp, Artificial Sequence
  Synthetic DNA
ttatacgactcgaaatag

SEQ ID NO: 17605 - DNA, 18 bp, Artificial Sequence
  Synthetic DNA
ttatacgactcgacatag

SEQ ID NO: 17606 - DNA, 18 bp, Artificial Sequence
  Synthetic DNA
ttataggactcgcaatag

SEQ ID NO: 17607 - DNA, 18 bp, Artificial Sequence
  Synthetic DNA
ttatccgactcactgttg

SEQ ID NO: 17608 - DNA, 18 bp, Artificial Sequence
  Synthetic DNA
ttatctgactcactattg

SEQ ID NO: 17609 - DNA, 18 bp, Artificial Sequence
  Synthetic DNA
ttatgcgacccactattg

SEQ ID NO: 17610 - DNA, 18 bp, Artificial Sequence
  Synthetic DNA
ttattcgactcactgaag

SEQ ID NO: 17611 - DNA, 18 bp, Artificial Sequence
  Synthetic DNA
ttattcgactcactttgg

SEQ ID NO: 17612 - DNA, 18 bp, Artificial Sequence
  Synthetic DNA
ttattcgcatcactatag

SEQ ID NO: 17613 - DNA, 18 bp, Artificial Sequence
  Synthetic DNA
ttatttgactcacgatag

SEQ ID NO: 17614 - DNA, 18 bp, Artificial Sequence
  Synthetic DNA
ttttacgactcaccattg

SEQ ID NO: 17615 - DNA, 18 bp, Artificial Sequence
  Synthetic DNA
aaaaacgacccactgtag

SEQ ID NO: 17616 - DNA, 18 bp, Artificial Sequence
  Synthetic DNA
aaaaacgactcactttcg

SEQ ID NO: 17617 - DNA, 18 bp, Artificial Sequence
  Synthetic DNA
aaaaactagtcactatag

SEQ ID NO: 17618 - DNA, 18 bp, Artificial Sequence
  Synthetic DNA
aaacaccactcattatag

SEQ ID NO: 17619 - DNA, 18 bp, Artificial Sequence
  Synthetic DNA
aaagactactcactctag

SEQ ID NO: 17620 - DNA, 18 bp, Artificial Sequence
  Synthetic DNA
aaataagactcactctgg

SEQ ID NO: 17621 - DNA, 18 bp, Artificial Sequence
  Synthetic DNA
aaatacaaagcactatag

SEQ ID NO: 17622 - DNA, 18 bp, Artificial Sequence
  Synthetic DNA
aaatacgaacgactatag

SEQ ID NO: 17623 - DNA, 18 bp, Artificial Sequence
  Synthetic DNA
aaatacgaatcacaatcg

SEQ ID NO: 17624 - DNA, 18 bp, Artificial Sequence
  Synthetic DNA
aaatacgacccaccaaag

SEQ ID NO: 17625 - DNA, 18 bp, Artificial Sequence
  Synthetic DNA
aaatacgactaccaatag

SEQ ID NO: 17626 - DNA, 18 bp, Artificial Sequence
  Synthetic DNA
aaatacgactcctaatag

SEQ ID NO: 17627 - DNA, 18 bp, Artificial Sequence
  Synthetic DNA
aaatacgactctatataa

SEQ ID NO: 17628 - DNA, 18 bp, Artificial Sequence
  Synthetic DNA
aaatacgacttactgtcg

SEQ ID NO: 17629 - DNA, 18 bp, Artificial Sequence
  Synthetic DNA
aaatacgactttccatag

SEQ ID NO: 17630 - DNA, 18 bp, Artificial Sequence
  Synthetic DNA
aaatacgatacacgatag

SEQ ID NO: 17631 - DNA, 18 bp, Artificial Sequence
  Synthetic DNA
aaatacgcctcacgatgg

SEQ ID NO: 17632 - DNA, 18 bp, Artificial Sequence
  Synthetic DNA
aaatacgtgttactatag

SEQ ID NO: 17633 - DNA, 18 bp, Artificial Sequence
  Synthetic DNA
aaatactactgattatag

SEQ ID NO: 17634 - DNA, 18 bp, Artificial Sequence
  Synthetic DNA
aaatactcctcactaaag

SEQ ID NO: 17635 - DNA, 18 bp, Artificial Sequence
  Synthetic DNA
aaatactgctcacgatag

SEQ ID NO: 17636 - DNA, 18 bp, Artificial Sequence
  Synthetic DNA
aaatatagctcactatag

SEQ ID NO: 17637 - DNA, 18 bp, Artificial Sequence
  Synthetic DNA
aaatcagactcactttag

SEQ ID NO: 17638 - DNA, 18 bp, Artificial Sequence
  Synthetic DNA
aaatccgactcaatagag

SEQ ID NO: 17639 - DNA, 18 bp, Artificial Sequence
  Synthetic DNA
aaatgcaactcattatag

SEQ ID NO: 17640 - DNA, 18 bp, Artificial Sequence
  Synthetic DNA
aaatgcgactcactcaag

SEQ ID NO: 17641 - DNA, 18 bp, Artificial Sequence
  Synthetic DNA
aaatgcgacttactagag

SEQ ID NO: 17642 - DNA, 18 bp, Artificial Sequence
  Synthetic DNA
aaatgcgcatcactatag

SEQ ID NO: 17643 - DNA, 18 bp, Artificial Sequence
  Synthetic DNA
aaatgctactcactgtag

SEQ ID NO: 17644 - DNA, 18 bp, Artificial Sequence
  Synthetic DNA
aaccacgactctctatag

SEQ ID NO: 17645 - DNA, 18 bp, Artificial Sequence
  Synthetic DNA
aactacaactgactatag

SEQ ID NO: 17646 - DNA, 18 bp, Artificial Sequence
  Synthetic DNA
aactaccactcactatgg

SEQ ID NO: 17647 - DNA, 18 bp, Artificial Sequence
  Synthetic DNA
aactacgactcacaatgg

SEQ ID NO: 17648 - DNA, 18 bp, Artificial Sequence
  Synthetic DNA
aactgcgaatcactatag

SEQ ID NO: 17649 - DNA, 18 bp, Artificial Sequence
  Synthetic DNA
aagcacgactcaccatag

SEQ ID NO: 17650 - DNA, 18 bp, Artificial Sequence
  Synthetic DNA
aagtacaactcacgatag

SEQ ID NO: 17651 - DNA, 18 bp, Artificial Sequence
  Synthetic DNA
aagtacgactcacgatgg

SEQ ID NO: 17652 - DNA, 18 bp, Artificial Sequence
  Synthetic DNA
aattaccactcagtatag

SEQ ID NO: 17653 - DNA, 18 bp, Artificial Sequence
  Synthetic DNA
aattacgactcactgaag

SEQ ID NO: 17654 - DNA, 18 bp, Artificial Sequence
  Synthetic DNA
aattacgtcccactatag

SEQ ID NO: 17655 - DNA, 18 bp, Artificial Sequence
  Synthetic DNA
aattccgactcactatcg

SEQ ID NO: 17656 - DNA, 18 bp, Artificial Sequence
  Synthetic DNA
acaaacgactcactctag

SEQ ID NO: 17657 - DNA, 18 bp, Artificial Sequence
  Synthetic DNA
acatacgattcattatag

SEQ ID NO: 17658 - DNA, 18 bp, Artificial Sequence
  Synthetic DNA
acatatgagtcactatag

SEQ ID NO: 17659 - DNA, 18 bp, Artificial Sequence
  Synthetic DNA
agacaccactcactatag

SEQ ID NO: 17660 - DNA, 18 bp, Artificial Sequence
  Synthetic DNA
agatacgactcaccttag

SEQ ID NO: 17661 - DNA, 18 bp, Artificial Sequence
  Synthetic DNA
agatacgcctcactgtag

SEQ ID NO: 17662 - DNA, 18 bp, Artificial Sequence
  Synthetic DNA
atatacagctcactatag

SEQ ID NO: 17663 - DNA, 18 bp, Artificial Sequence
  Synthetic DNA
atatacgaattactatag

SEQ ID NO: 17664 - DNA, 18 bp, Artificial Sequence
  Synthetic DNA
atatacgacaccctatag

SEQ ID NO: 17665 - DNA, 18 bp, Artificial Sequence
  Synthetic DNA
atatacgactcacggtag

SEQ ID NO: 17666 - DNA, 18 bp, Artificial Sequence
  Synthetic DNA
atatacgactcattctag

SEQ ID NO: 17667 - DNA, 18 bp, Artificial Sequence
  Synthetic DNA
caaaaccactctctatag

SEQ ID NO: 17668 - DNA, 18 bp, Artificial Sequence
  Synthetic DNA
caaaacgaccgactatag

SEQ ID NO: 17669 - DNA, 18 bp, Artificial Sequence
  Synthetic DNA
caaaacgtatcactatag

SEQ ID NO: 17670 - DNA, 18 bp, Artificial Sequence
  Synthetic DNA
caacaaaactcactatag

SEQ ID NO: 17671 - DNA, 18 bp, Artificial Sequence
  Synthetic DNA
caacaagacacactatag

SEQ ID NO: 17672 - DNA, 18 bp, Artificial Sequence
  Synthetic DNA
caagaagacttactatag

SEQ ID NO: 17673 - DNA, 18 bp, Artificial Sequence
  Synthetic DNA
caataagactcacaatgg

SEQ ID NO: 17674 - DNA, 18 bp, Artificial Sequence
  Synthetic DNA
caatacaactctcaatag

SEQ ID NO: 17675 - DNA, 18 bp, Artificial Sequence
  Synthetic DNA
caatacaacttaccatag

SEQ ID NO: 17676 - DNA, 18 bp, Artificial Sequence
  Synthetic DNA
caataccactcacaatgg

SEQ ID NO: 17677 - DNA, 18 bp, Artificial Sequence
  Synthetic DNA
caatacgaatttctatag

SEQ ID NO: 17678 - DNA, 18 bp, Artificial Sequence
  Synthetic DNA
caatacgactctcggtag

SEQ ID NO: 17679 - DNA, 18 bp, Artificial Sequence
  Synthetic DNA
caatacgactgataatag

SEQ ID NO: 17680 - DNA, 18 bp, Artificial Sequence
  Synthetic DNA
caatacgatccactatcg

SEQ ID NO: 17681 - DNA, 18 bp, Artificial Sequence
  Synthetic DNA
caatacgattcaaaatag

SEQ ID NO: 17682 - DNA, 18 bp, Artificial Sequence
  Synthetic DNA
caatactactctctacag

SEQ ID NO: 17683 - DNA, 18 bp, Artificial Sequence
  Synthetic DNA
caatactagtcactatcg

SEQ ID NO: 17684 - DNA, 18 bp, Artificial Sequence
  Synthetic DNA
caatataactcactatcg

SEQ ID NO: 17685 - DNA, 18 bp, Artificial Sequence
  Synthetic DNA
caatatgattcactagag

SEQ ID NO: 17686 - DNA, 18 bp, Artificial Sequence
  Synthetic DNA
caatccgactccctatcg

SEQ ID NO: 17687 - DNA, 18 bp, Artificial Sequence
  Synthetic DNA
caatccgacttagtatag

SEQ ID NO: 17688 - DNA, 18 bp, Artificial Sequence
  Synthetic DNA
caatccgcctcactttag

SEQ ID NO: 17689 - DNA, 18 bp, Artificial Sequence
  Synthetic DNA
caatgagactgactatag

SEQ ID NO: 17690 - DNA, 18 bp, Artificial Sequence
  Synthetic DNA
caatgctactcactgtag

SEQ ID NO: 17691 - DNA, 18 bp, Artificial Sequence
  Synthetic DNA
caatgctattcactatag

SEQ ID NO: 17692 - DNA, 18 bp, Artificial Sequence
  Synthetic DNA
cactccgactcactaaag

SEQ ID NO: 17693 - DNA, 18 bp, Artificial Sequence
  Synthetic DNA
cagtaccactcactttag

SEQ ID NO: 17694 - DNA, 18 bp, Artificial Sequence
  Synthetic DNA
cagtacgattcacaatag

SEQ ID NO: 17695 - DNA, 18 bp, Artificial Sequence
  Synthetic DNA
cattacgacgcactttag

SEQ ID NO: 17696 - DNA, 18 bp, Artificial Sequence
  Synthetic DNA
cattacgactcactacgg

SEQ ID NO: 17697 - DNA, 18 bp, Artificial Sequence
  Synthetic DNA
cattacgactcatcatag

SEQ ID NO: 17698 - DNA, 18 bp, Artificial Sequence
  Synthetic DNA
cattactactcactaaag

SEQ ID NO: 17699 - DNA, 18 bp, Artificial Sequence
  Synthetic DNA
cattaggaatcactatag

SEQ ID NO: 17700 - DNA, 18 bp, Artificial Sequence
  Synthetic DNA
ccatacaactctctatag

SEQ ID NO: 17701 - DNA, 18 bp, Artificial Sequence
  Synthetic DNA
ccatacgactcaataaag

SEQ ID NO: 17702 - DNA, 18 bp, Artificial Sequence
  Synthetic DNA
ccatactactcactgtag

SEQ ID NO: 17703 - DNA, 18 bp, Artificial Sequence
  Synthetic DNA
ccttaccactcactatag

SEQ ID NO: 17704 - DNA, 18 bp, Artificial Sequence
  Synthetic DNA
cgatacgactcaaaatag

SEQ ID NO: 17705 - DNA, 18 bp, Artificial Sequence
  Synthetic DNA
cgatacgactcattaaag

SEQ ID NO: 17706 - DNA, 18 bp, Artificial Sequence
  Synthetic DNA
cgatacgtcgcactatag

SEQ ID NO: 17707 - DNA, 18 bp, Artificial Sequence
  Synthetic DNA
cgatacgtctcagtatag

SEQ ID NO: 17708 - DNA, 18 bp, Artificial Sequence
  Synthetic DNA
ctaaacgtctcactatag

SEQ ID NO: 17709 - DNA, 18 bp, Artificial Sequence
  Synthetic DNA
ctatacccctcactatag

SEQ ID NO: 17710 - DNA, 18 bp, Artificial Sequence
  Synthetic DNA
gaaaacaattcactatag

SEQ ID NO: 17711 - DNA, 18 bp, Artificial Sequence
  Synthetic DNA
gaaaacgactaactatcg

SEQ ID NO: 17712 - DNA, 18 bp, Artificial Sequence
  Synthetic DNA
gaataagattaactatag

SEQ ID NO: 17713 - DNA, 18 bp, Artificial Sequence
  Synthetic DNA
gaatacgaatctctacag

SEQ ID NO: 17714 - DNA, 18 bp, Artificial Sequence
  Synthetic DNA
gaatacgactcaatcgag

SEQ ID NO: 17715 - DNA, 18 bp, Artificial Sequence
  Synthetic DNA
gaatacgactccccgtag

SEQ ID NO: 17716 - DNA, 18 bp, Artificial Sequence
  Synthetic DNA
gaatacgactgtctagag

SEQ ID NO: 17717 - DNA, 18 bp, Artificial Sequence
  Synthetic DNA
gaatacgacttaccaaag

SEQ ID NO: 17718 - DNA, 18 bp, Artificial Sequence
  Synthetic DNA
gaatacgagtaaccatag

SEQ ID NO: 17719 - DNA, 18 bp, Artificial Sequence
  Synthetic DNA
gaatatgacacacgatag

SEQ ID NO: 17720 - DNA, 18 bp, Artificial Sequence
  Synthetic DNA
gaatatgtttcactatag

SEQ ID NO: 17721 - DNA, 18 bp, Artificial Sequence
  Synthetic DNA
gaatccgacacacaatag

SEQ ID NO: 17722 - DNA, 18 bp, Artificial Sequence
  Synthetic DNA
gaatccgatttactatag

SEQ ID NO: 17723 - DNA, 18 bp, Artificial Sequence
  Synthetic DNA
gattacgactcaatatcg

SEQ ID NO: 17724 - DNA, 18 bp, Artificial Sequence
  Synthetic DNA
gattacgactcattttag

SEQ ID NO: 17725 - DNA, 18 bp, Artificial Sequence
  Synthetic DNA
gtacacgacacactatag

SEQ ID NO: 17726 - DNA, 18 bp, Artificial Sequence
  Synthetic DNA
taaaaagacctactatag

SEQ ID NO: 17727 - DNA, 18 bp, Artificial Sequence
  Synthetic DNA
taaaaagactcaataaag

SEQ ID NO: 17728 - DNA, 18 bp, Artificial Sequence
  Synthetic DNA
taaaaagactccctatgg

SEQ ID NO: 17729 - DNA, 18 bp, Artificial Sequence
  Synthetic DNA
taaaaccattcactaaag

SEQ ID NO: 17730 - DNA, 18 bp, Artificial Sequence
  Synthetic DNA
taaaacgaatcaagatag

SEQ ID NO: 17731 - DNA, 18 bp, Artificial Sequence
  Synthetic DNA
taaaacgaatcaatatcg

SEQ ID NO: 17732 - DNA, 18 bp, Artificial Sequence
  Synthetic DNA
taaaacgacgcacaatcg

SEQ ID NO: 17733 - DNA, 18 bp, Artificial Sequence
  Synthetic DNA
taaaacgactaattatgg

SEQ ID NO: 17734 - DNA, 18 bp, Artificial Sequence
  Synthetic DNA
taaaacgactcaccgaag

SEQ ID NO: 17735 - DNA, 18 bp, Artificial Sequence
  Synthetic DNA
taaaacgactcactcagg

SEQ ID NO: 17736 - DNA, 18 bp, Artificial Sequence
  Synthetic DNA
taaaacgactcagagtag

SEQ ID NO: 17737 - DNA, 18 bp, Artificial Sequence
  Synthetic DNA
taaaacgactcagcatgg

SEQ ID NO: 17738 - DNA, 18 bp, Artificial Sequence
  Synthetic DNA
taaaacgactctgtttag

SEQ ID NO: 17739 - DNA, 18 bp, Artificial Sequence
  Synthetic DNA
taaaacgacttacaatat

SEQ ID NO: 17740 - DNA, 18 bp, Artificial Sequence
  Synthetic DNA
taaaacgacttccaatag

SEQ ID NO: 17741 - DNA, 18 bp, Artificial Sequence
  Synthetic DNA
taaaacgaggcactgtag

SEQ ID NO: 17742 - DNA, 18 bp, Artificial Sequence
  Synthetic DNA
taaaacgagtcactttcg

SEQ ID NO: 17743 - DNA, 18 bp, Artificial Sequence
  Synthetic DNA
taaaacgattcagtacag

SEQ ID NO: 17744 - DNA, 18 bp, Artificial Sequence
  Synthetic DNA
taaaacgattccctaaag

SEQ ID NO: 17745 - DNA, 18 bp, Artificial Sequence
  Synthetic DNA
taaaacgcctccctctag

SEQ ID NO: 17746 - DNA, 18 bp, Artificial Sequence
  Synthetic DNA
taaaacggctaactatcg

SEQ ID NO: 17747 - DNA, 18 bp, Artificial Sequence
  Synthetic DNA
taaaactacacactatcg

SEQ ID NO: 17748 - DNA, 18 bp, Artificial Sequence
  Synthetic DNA
taaaactactaacgatag

SEQ ID NO: 17749 - DNA, 18 bp, Artificial Sequence
  Synthetic DNA
taaaactactgactatgg

SEQ ID NO: 17750 - DNA, 18 bp, Artificial Sequence
  Synthetic DNA
taaaactacttactctag

SEQ ID NO: 17751 - DNA, 18 bp, Artificial Sequence
  Synthetic DNA
taaaactcctcattatag

SEQ ID NO: 17752 - DNA, 18 bp, Artificial Sequence
  Synthetic DNA
taaaagcaatcactatag

SEQ ID NO: 17753 - DNA, 18 bp, Artificial Sequence
  Synthetic DNA
taaaatgacccagtatag

SEQ ID NO: 17754 - DNA, 18 bp, Artificial Sequence
  Synthetic DNA
taaaatgactcaacatag

SEQ ID NO: 17755 - DNA, 18 bp, Artificial Sequence
  Synthetic DNA
taaaatgcctctctatag

SEQ ID NO: 17756 - DNA, 18 bp, Artificial Sequence
  Synthetic DNA
taaaccgaatcacaatag

SEQ ID NO: 17757 - DNA, 18 bp, Artificial Sequence
  Synthetic DNA
taaagcggctcactacag

SEQ ID NO: 17758 - DNA, 18 bp, Artificial Sequence
  Synthetic DNA
taaagcggctcactctag

SEQ ID NO: 17759 - DNA, 18 bp, Artificial Sequence
  Synthetic DNA
taacaagacacacaatag

SEQ ID NO: 17760 - DNA, 18 bp, Artificial Sequence
  Synthetic DNA
taacaagacgcattatag

SEQ ID NO: 17761 - DNA, 18 bp, Artificial Sequence
  Synthetic DNA
taacaagactcacttcag

SEQ ID NO: 17762 - DNA, 18 bp, Artificial Sequence
  Synthetic DNA
taacacaacgcactttag

SEQ ID NO: 17763 - DNA, 18 bp, Artificial Sequence
  Synthetic DNA
taacacgaatctctctag

SEQ ID NO: 17764 - DNA, 18 bp, Artificial Sequence
  Synthetic DNA
taacacgacactgtatag

SEQ ID NO: 17765 - DNA, 18 bp, Artificial Sequence
  Synthetic DNA
taacacgaccttctatag

SEQ ID NO: 17766 - DNA, 18 bp, Artificial Sequence
  Synthetic DNA
taacacgacgctctatcg

SEQ ID NO: 17767 - DNA, 18 bp, Artificial Sequence
  Synthetic DNA
taacacgaggcacaatag

SEQ ID NO: 17768 - DNA, 18 bp, Artificial Sequence
  Synthetic DNA
taacacgattaactaaag

SEQ ID NO: 17769 - DNA, 18 bp, Artificial Sequence
  Synthetic DNA
taacacgcctcagtaaag

SEQ ID NO: 17770 - DNA, 18 bp, Artificial Sequence
  Synthetic DNA
taacacgcctgacgatag

SEQ ID NO: 17771 - DNA, 18 bp, Artificial Sequence
  Synthetic DNA
taacacgcgtcactagag

SEQ ID NO: 17772 - DNA, 18 bp, Artificial Sequence
  Synthetic DNA
taacacggctatctatag

SEQ ID NO: 17773 - DNA, 18 bp, Artificial Sequence
  Synthetic DNA
taacacggctcaccgtag

SEQ ID NO: 17774 - DNA, 18 bp, Artificial Sequence
  Synthetic DNA
taacacgtctcaggatag

SEQ ID NO: 17775 - DNA, 18 bp, Artificial Sequence
  Synthetic DNA
taacacgtctgactaaag

SEQ ID NO: 17776 - DNA, 18 bp, Artificial Sequence
  Synthetic DNA
taacacgtgtcactgtag

SEQ ID NO: 17777 - DNA, 18 bp, Artificial Sequence
  Synthetic DNA
taacacttctcactatcg

SEQ ID NO: 17778 - DNA, 18 bp, Artificial Sequence
  Synthetic DNA
taacatgactcaccttag

SEQ ID NO: 17779 - DNA, 18 bp, Artificial Sequence
  Synthetic DNA
taacatgacttactacag

SEQ ID NO: 17780 - DNA, 18 bp, Artificial Sequence
  Synthetic DNA
taacatgagtcactaaag

SEQ ID NO: 17781 - DNA, 18 bp, Artificial Sequence
  Synthetic DNA
taacatgtttcactatag

SEQ ID NO: 17782 - DNA, 18 bp, Artificial Sequence
  Synthetic DNA
taacccgactgactaaag

SEQ ID NO: 17783 - DNA, 18 bp, Artificial Sequence
  Synthetic DNA
taaccctactcattatag

SEQ ID NO: 17784 - DNA, 18 bp, Artificial Sequence
  Synthetic DNA
taacgcgacagactatag

SEQ ID NO: 17785 - DNA, 18 bp, Artificial Sequence
  Synthetic DNA
taacgcgtcacactatag

SEQ ID NO: 17786 - DNA, 18 bp, Artificial Sequence
  Synthetic DNA
taagaagactaactttag

SEQ ID NO: 17787 - DNA, 18 bp, Artificial Sequence
  Synthetic DNA
taagacgaatatctatag

SEQ ID NO: 17788 - DNA, 18 bp, Artificial Sequence
  Synthetic DNA
taagacgacaccctacag

SEQ ID NO: 17789 - DNA, 18 bp, Artificial Sequence
  Synthetic DNA
taagacgacatactgtag

SEQ ID NO: 17790 - DNA, 18 bp, Artificial Sequence
  Synthetic DNA
taagacgactctaaatag

SEQ ID NO: 17791 - DNA, 18 bp, Artificial Sequence
  Synthetic DNA
taagacgactgacttaag

SEQ ID NO: 17792 - DNA, 18 bp, Artificial Sequence
  Synthetic DNA
taagacgataaactatag

SEQ ID NO: 17793 - DNA, 18 bp, Artificial Sequence
  Synthetic DNA
taagacggctcacaaaag

SEQ ID NO: 17794 - DNA, 18 bp, Artificial Sequence
  Synthetic DNA
taagacgtctccttatag

SEQ ID NO: 17795 - DNA, 18 bp, Artificial Sequence
  Synthetic DNA
taagacgtctctctttag

SEQ ID NO: 17796 - DNA, 18 bp, Artificial Sequence
  Synthetic DNA
taagatcagtcactatag

SEQ ID NO: 17797 - DNA, 18 bp, Artificial Sequence
  Synthetic DNA
taagccgactaattatag

SEQ ID NO: 17798 - DNA, 18 bp, Artificial Sequence
  Synthetic DNA
taataaaaatcactatgg

SEQ ID NO: 17799 - DNA, 18 bp, Artificial Sequence
  Synthetic DNA
taataaaacacactctag

SEQ ID NO: 17800 - DNA, 18 bp, Artificial Sequence
  Synthetic DNA
taataaaacccactatcg

SEQ ID NO: 17801 - DNA, 18 bp, Artificial Sequence
  Synthetic DNA
taataacacccactgtag

SEQ ID NO: 17802 - DNA, 18 bp, Artificial Sequence
  Synthetic DNA
taataacactcacaatcg

SEQ ID NO: 17803 - DNA, 18 bp, Artificial Sequence
  Synthetic DNA
taataagaatcactctcg

SEQ ID NO: 17804 - DNA, 18 bp, Artificial Sequence
  Synthetic DNA
taataagacacactccag

SEQ ID NO: 17805 - DNA, 18 bp, Artificial Sequence
  Synthetic DNA
taataagacaccctctag

SEQ ID NO: 17806 - DNA, 18 bp, Artificial Sequence
  Synthetic DNA
taataagactaacaatcg

SEQ ID NO: 17807 - DNA, 18 bp, Artificial Sequence
  Synthetic DNA
taataagactccttgtag

SEQ ID NO: 17808 - DNA, 18 bp, Artificial Sequence
  Synthetic DNA
taataagactttctacag

SEQ ID NO: 17809 - DNA, 18 bp, Artificial Sequence
  Synthetic DNA
taataagattcacgaaag

SEQ ID NO: 17810 - DNA, 18 bp, Artificial Sequence
  Synthetic DNA
taataagatttacaatag

SEQ ID NO: 17811 - DNA, 18 bp, Artificial Sequence
  Synthetic DNA
taataagtaccactatag

SEQ ID NO: 17812 - DNA, 18 bp, Artificial Sequence
  Synthetic DNA
taataagtctcacgacag

SEQ ID NO: 17813 - DNA, 18 bp, Artificial Sequence
  Synthetic DNA
taataagtctcactttgg

SEQ ID NO: 17814 - DNA, 18 bp, Artificial Sequence
  Synthetic DNA
taataataatcaatatag

SEQ ID NO: 17815 - DNA, 18 bp, Artificial Sequence
  Synthetic DNA
taatacaaccctttatag

SEQ ID NO: 17816 - DNA, 18 bp, Artificial Sequence
  Synthetic DNA
taatacaactaacaacag

SEQ ID NO: 17817 - DNA, 18 bp, Artificial Sequence
  Synthetic DNA
taatacaactcacagtgg

SEQ ID NO: 17818 - DNA, 18 bp, Artificial Sequence
  Synthetic DNA
taatacaactcagggtag

SEQ ID NO: 17819 - DNA, 18 bp, Artificial Sequence
  Synthetic DNA
taatacaactcccattag

SEQ ID NO: 17820 - DNA, 18 bp, Artificial Sequence
  Synthetic DNA
taatacaactgaaaatag

SEQ ID NO: 17821 - DNA, 18 bp, Artificial Sequence
  Synthetic DNA
taatacaagtctgtatag

SEQ ID NO: 17822 - DNA, 18 bp, Artificial Sequence
  Synthetic DNA
taatacaataccctatag

SEQ ID NO: 17823 - DNA, 18 bp, Artificial Sequence
  Synthetic DNA
taatacaatctactatag

SEQ ID NO: 17824 - DNA, 18 bp, Artificial Sequence
  Synthetic DNA
taatacaattacctatag

SEQ ID NO: 17825 - DNA, 18 bp, Artificial Sequence
  Synthetic DNA
taatacacctcaatacag

SEQ ID NO: 17826 - DNA, 18 bp, Artificial Sequence
  Synthetic DNA
taatacacctcacgctag

SEQ ID NO: 17827 - DNA, 18 bp, Artificial Sequence
  Synthetic DNA
taatacatcccactacag

SEQ ID NO: 17828 - DNA, 18 bp, Artificial Sequence
  Synthetic DNA
taatacatctcattatgg

SEQ ID NO: 17829 - DNA, 18 bp, Artificial Sequence
  Synthetic DNA
taataccaataattatag

SEQ ID NO: 17830 - DNA, 18 bp, Artificial Sequence
  Synthetic DNA
taataccactcaccttcg

SEQ ID NO: 17831 - DNA, 18 bp, Artificial Sequence
  Synthetic DNA
taataccactctccatgg

SEQ ID NO: 17832 - DNA, 18 bp, Artificial Sequence
  Synthetic DNA
taataccgcacactacag

SEQ ID NO: 17833 - DNA, 18 bp, Artificial Sequence
  Synthetic DNA
taatacgaaacactgaag

SEQ ID NO: 17834 - DNA, 18 bp, Artificial Sequence
  Synthetic DNA
taatacgaatcagttaag

SEQ ID NO: 17835 - DNA, 18 bp, Artificial Sequence
  Synthetic DNA
taatacgaatcattttgg

SEQ ID NO: 17836 - DNA, 18 bp, Artificial Sequence
  Synthetic DNA
taatacgacaccatttag

SEQ ID NO: 17837 - DNA, 18 bp, Artificial Sequence
  Synthetic DNA
taatacgacactatacag

SEQ ID NO: 17838 - DNA, 18 bp, Artificial Sequence
  Synthetic DNA
taatacgacactatatcg

SEQ ID NO: 17839 - DNA, 18 bp, Artificial Sequence
  Synthetic DNA
taatacgacccatttaag

SEQ ID NO: 17840 - DNA, 18 bp, Artificial Sequence
  Synthetic DNA
taatacgaccctgaatag

SEQ ID NO: 17841 - DNA, 18 bp, Artificial Sequence
  Synthetic DNA
taatacgaccgtctttag

SEQ ID NO: 17842 - DNA, 18 bp, Artificial Sequence
  Synthetic DNA
taatacgaccgtttatag

SEQ ID NO: 17843 - DNA, 18 bp, Artificial Sequence
  Synthetic DNA
taatacgactatcactag

SEQ ID NO: 17844 - DNA, 18 bp, Artificial Sequence
  Synthetic DNA
taatacgactctaaatgg

SEQ ID NO: 17845 - DNA, 18 bp, Artificial Sequence
  Synthetic DNA
taatacgactctccttgg

SEQ ID NO: 17846 - DNA, 18 bp, Artificial Sequence
  Synthetic DNA
taatacgactctttacgg

SEQ ID NO: 17847 - DNA, 18 bp, Artificial Sequence
  Synthetic DNA
taatacgacttaataagg

SEQ ID NO: 17848 - DNA, 18 bp, Artificial Sequence
  Synthetic DNA
taatacgacttacagaag

SEQ ID NO: 17849 - DNA, 18 bp, Artificial Sequence
  Synthetic DNA
taatacgacttatcatgg

SEQ ID NO: 17850 - DNA, 18 bp, Artificial Sequence
  Synthetic DNA
taatacgacttcaaatag

SEQ ID NO: 17851 - DNA, 18 bp, Artificial Sequence
  Synthetic DNA
taatacgactttctaccg

SEQ ID NO: 17852 - DNA, 18 bp, Artificial Sequence
  Synthetic DNA
taatacgactttgtacag

SEQ ID NO: 17853 - DNA, 18 bp, Artificial Sequence
  Synthetic DNA
taatacgagcctcgatag

SEQ ID NO: 17854 - DNA, 18 bp, Artificial Sequence
  Synthetic DNA
taatacgagtcactgacg

SEQ ID NO: 17855 - DNA, 18 bp, Artificial Sequence
  Synthetic DNA
taatacgagtcccgatcg

SEQ ID NO: 17856 - DNA, 18 bp, Artificial Sequence
  Synthetic DNA
taatacgatcgactacag

SEQ ID NO: 17857 - DNA, 18 bp, Artificial Sequence
  Synthetic DNA
taatacgatgctatatag

SEQ ID NO: 17858 - DNA, 18 bp, Artificial Sequence
  Synthetic DNA
taatacgattaactttcg

SEQ ID NO: 17859 - DNA, 18 bp, Artificial Sequence
  Synthetic DNA
taatacgattcacagtgg

SEQ ID NO: 17860 - DNA, 18 bp, Artificial Sequence
  Synthetic DNA
taatacgattcacttcgg

SEQ ID NO: 17861 - DNA, 18 bp, Artificial Sequence
  Synthetic DNA
taatacgatttagaatag

SEQ ID NO: 17862 - DNA, 18 bp, Artificial Sequence
  Synthetic DNA
taatacgcaacactaaag

SEQ ID NO: 17863 - DNA, 18 bp, Artificial Sequence
  Synthetic DNA
taatacgcatctgtatag

SEQ ID NO: 17864 - DNA, 18 bp, Artificial Sequence
  Synthetic DNA
taatacgcccccctagag

SEQ ID NO: 17865 - DNA, 18 bp, Artificial Sequence
  Synthetic DNA
taatacgccgtacaatag

SEQ ID NO: 17866 - DNA, 18 bp, Artificial Sequence
  Synthetic DNA
taatacgccgtactgtag

SEQ ID NO: 17867 - DNA, 18 bp, Artificial Sequence
  Synthetic DNA
taatacgccttattacag

SEQ ID NO: 17868 - DNA, 18 bp, Artificial Sequence
  Synthetic DNA
taatacgcgttactacag

SEQ ID NO: 17869 - DNA, 18 bp, Artificial Sequence
  Synthetic DNA
taatacgcttcaataaag

SEQ ID NO: 17870 - DNA, 18 bp, Artificial Sequence
  Synthetic DNA
taatacggctctaaatag

SEQ ID NO: 17871 - DNA, 18 bp, Artificial Sequence
  Synthetic DNA
taatacggcttcccatag

SEQ ID NO: 17872 - DNA, 18 bp, Artificial Sequence
  Synthetic DNA
taatacggctttcaatag

SEQ ID NO: 17873 - DNA, 18 bp, Artificial Sequence
  Synthetic DNA
taatacgtcacattagag

SEQ ID NO: 17874 - DNA, 18 bp, Artificial Sequence
  Synthetic DNA
taatacgtccaactttag

SEQ ID NO: 17875 - DNA, 18 bp, Artificial Sequence
  Synthetic DNA
taatacgtcgcaaaatag

SEQ ID NO: 17876 - DNA, 18 bp, Artificial Sequence
  Synthetic DNA
taatacgtctatccatag

SEQ ID NO: 17877 - DNA, 18 bp, Artificial Sequence
  Synthetic DNA
taatacgtctcaatgaag

SEQ ID NO: 17878 - DNA, 18 bp, Artificial Sequence
  Synthetic DNA
taatacgtctcactacct

SEQ ID NO: 17879 - DNA, 18 bp, Artificial Sequence
  Synthetic DNA
taatacgtctcagaagag

SEQ ID NO: 17880 - DNA, 18 bp, Artificial Sequence
  Synthetic DNA
taatacgtcttactaagg

SEQ ID NO: 17881 - DNA, 18 bp, Artificial Sequence
  Synthetic DNA
taatacgtcttagtacag

SEQ ID NO: 17882 - DNA, 18 bp, Artificial Sequence
  Synthetic DNA
taatactacatactctag

SEQ ID NO: 17883 - DNA, 18 bp, Artificial Sequence
  Synthetic DNA
taatactacccattttag

SEQ ID NO: 17884 - DNA, 18 bp, Artificial Sequence
  Synthetic DNA
taatactacgctatatag

SEQ ID NO: 17885 - DNA, 18 bp, Artificial Sequence
  Synthetic DNA
taatactactccccctag

SEQ ID NO: 17886 - DNA, 18 bp, Artificial Sequence
  Synthetic DNA
taatactactctctaaaa

SEQ ID NO: 17887 - DNA, 18 bp, Artificial Sequence
  Synthetic DNA
taatactactctttagag

SEQ ID NO: 17888 - DNA, 18 bp, Artificial Sequence
  Synthetic DNA
taatacttcgcactaaag

SEQ ID NO: 17889 - DNA, 18 bp, Artificial Sequence
  Synthetic DNA
taatagaaatctctatag

SEQ ID NO: 17890 - DNA, 18 bp, Artificial Sequence
  Synthetic DNA
taatagaacccacaatag

SEQ ID NO: 17891 - DNA, 18 bp, Artificial Sequence
  Synthetic DNA
taataggactgattttag

SEQ ID NO: 17892 - DNA, 18 bp, Artificial Sequence
  Synthetic DNA
taataggacttattacag

SEQ ID NO: 17893 - DNA, 18 bp, Artificial Sequence
  Synthetic DNA
taataggactttcaatag

SEQ ID NO: 17894 - DNA, 18 bp, Artificial Sequence
  Synthetic DNA
taataggattaactgtag

SEQ ID NO: 17895 - DNA, 18 bp, Artificial Sequence
  Synthetic DNA
taataggattgtctatag

SEQ ID NO: 17896 - DNA, 18 bp, Artificial Sequence
  Synthetic DNA
taatagggcacaatatag

SEQ ID NO: 17897 - DNA, 18 bp, Artificial Sequence
  Synthetic DNA
taataggtctcacttgag

SEQ ID NO: 17898 - DNA, 18 bp, Artificial Sequence
  Synthetic DNA
taataggttacactatag

SEQ ID NO: 17899 - DNA, 18 bp, Artificial Sequence
  Synthetic DNA
taatataacgcactttag

SEQ ID NO: 17900 - DNA, 18 bp, Artificial Sequence
  Synthetic DNA
taatataactaactttag

SEQ ID NO: 17901 - DNA, 18 bp, Artificial Sequence
  Synthetic DNA
taatataactcacagtag

SEQ ID NO: 17902 - DNA, 18 bp, Artificial Sequence
  Synthetic DNA
taatataactcacgatgg

SEQ ID NO: 17903 - DNA, 18 bp, Artificial Sequence
  Synthetic DNA
taatataactcattctag

SEQ ID NO: 17904 - DNA, 18 bp, Artificial Sequence
  Synthetic DNA
taatataagacactatag

SEQ ID NO: 17905 - DNA, 18 bp, Artificial Sequence
  Synthetic DNA
taatatacttcactatag

SEQ ID NO: 17906 - DNA, 18 bp, Artificial Sequence
  Synthetic DNA
taatatatctcagtatag

SEQ ID NO: 17907 - DNA, 18 bp, Artificial Sequence
  Synthetic DNA
taatatcactcactgtcg

SEQ ID NO: 17908 - DNA, 18 bp, Artificial Sequence
  Synthetic DNA
taatatccctcactatgg

SEQ ID NO: 17909 - DNA, 18 bp, Artificial Sequence
  Synthetic DNA
taatatgaaccaccatag

SEQ ID NO: 17910 - DNA, 18 bp, Artificial Sequence
  Synthetic DNA
taatatgaatgactatcg

SEQ ID NO: 17911 - DNA, 18 bp, Artificial Sequence
  Synthetic DNA
taatatgactaaccatcg

SEQ ID NO: 17912 - DNA, 18 bp, Artificial Sequence
  Synthetic DNA
taatatgactaactctcg

SEQ ID NO: 17913 - DNA, 18 bp, Artificial Sequence
  Synthetic DNA
taatatgactatccatag

SEQ ID NO: 17914 - DNA, 18 bp, Artificial Sequence
  Synthetic DNA
taatatgactatctttag

SEQ ID NO: 17915 - DNA, 18 bp, Artificial Sequence
  Synthetic DNA
taatatgactccatatgg

SEQ ID NO: 17916 - DNA, 18 bp, Artificial Sequence
  Synthetic DNA
taatatgacttattatcg

SEQ ID NO: 17917 - DNA, 18 bp, Artificial Sequence
  Synthetic DNA
taatatgatccactttag

SEQ ID NO: 17918 - DNA, 18 bp, Artificial Sequence
  Synthetic DNA
taatatgatgaactatag

SEQ ID NO: 17919 - DNA, 18 bp, Artificial Sequence
  Synthetic DNA
taatatgattcagtgtag

SEQ ID NO: 17920 - DNA, 18 bp, Artificial Sequence
  Synthetic DNA
taatatggcacactagag

SEQ ID NO: 17921 - DNA, 18 bp, Artificial Sequence
  Synthetic DNA
taatatgtcctactatag

SEQ ID NO: 17922 - DNA, 18 bp, Artificial Sequence
  Synthetic DNA
taatatgtctctctatgg

SEQ ID NO: 17923 - DNA, 18 bp, Artificial Sequence
  Synthetic DNA
taatattactcaatatgg

SEQ ID NO: 17924 - DNA, 18 bp, Artificial Sequence
  Synthetic DNA
taatattactcaccttag

SEQ ID NO: 17925 - DNA, 18 bp, Artificial Sequence
  Synthetic DNA
taatattagtcactaaag

SEQ ID NO: 17926 - DNA, 18 bp, Artificial Sequence
  Synthetic DNA
taatattattgactatag

SEQ ID NO: 17927 - DNA, 18 bp, Artificial Sequence
  Synthetic DNA
taatatttctcaccatag

SEQ ID NO: 17928 - DNA, 18 bp, Artificial Sequence
  Synthetic DNA
taatcaaactcactatcg

SEQ ID NO: 17929 - DNA, 18 bp, Artificial Sequence
  Synthetic DNA
taatcaaacttactatag

SEQ ID NO: 17930 - DNA, 18 bp, Artificial Sequence
  Synthetic DNA
taatcagactctctttag

SEQ ID NO: 17931 - DNA, 18 bp, Artificial Sequence
  Synthetic DNA
taatcagattcactatcg

SEQ ID NO: 17932 - DNA, 18 bp, Artificial Sequence
  Synthetic DNA
taatccaacccactgtag

SEQ ID NO: 17933 - DNA, 18 bp, Artificial Sequence
  Synthetic DNA
taatccaactccctttag

SEQ ID NO: 17934 - DNA, 18 bp, Artificial Sequence
  Synthetic DNA
taatccaacttactatcg

SEQ ID NO: 17935 - DNA, 18 bp, Artificial Sequence
  Synthetic DNA
taatccaattaactatag

SEQ ID NO: 17936 - DNA, 18 bp, Artificial Sequence
  Synthetic DNA
taatcccacccactctag

SEQ ID NO: 17937 - DNA, 18 bp, Artificial Sequence
  Synthetic DNA
taatccgaatcaatacag

SEQ ID NO: 17938 - DNA, 18 bp, Artificial Sequence
  Synthetic DNA
taatccgactaaccatcg

SEQ ID NO: 17939 - DNA, 18 bp, Artificial Sequence
  Synthetic DNA
taatccgactacctttag

SEQ ID NO: 17940 - DNA, 18 bp, Artificial Sequence
  Synthetic DNA
taatccgacttcttatag

SEQ ID NO: 17941 - DNA, 18 bp, Artificial Sequence
  Synthetic DNA
taatccgagttactaaag

SEQ ID NO: 17942 - DNA, 18 bp, Artificial Sequence
  Synthetic DNA
taatccgataaactatag

SEQ ID NO: 17943 - DNA, 18 bp, Artificial Sequence
  Synthetic DNA
taatccgcctcactccag

SEQ ID NO: 17944 - DNA, 18 bp, Artificial Sequence
  Synthetic DNA
taatccgccttaatatag

SEQ ID NO: 17945 - DNA, 18 bp, Artificial Sequence
  Synthetic DNA
taatccggcttacaatag

SEQ ID NO: 17946 - DNA, 18 bp, Artificial Sequence
  Synthetic DNA
taatccgtctcaatatcg

SEQ ID NO: 17947 - DNA, 18 bp, Artificial Sequence
  Synthetic DNA
taatccgtctctctacag

SEQ ID NO: 17948 - DNA, 18 bp, Artificial Sequence
  Synthetic DNA
taatccgtgacactatag

SEQ ID NO: 17949 - DNA, 18 bp, Artificial Sequence
  Synthetic DNA
taatcctactcactaacg

SEQ ID NO: 17950 - DNA, 18 bp, Artificial Sequence
  Synthetic DNA
taatcctactcattacag

SEQ ID NO: 17951 - DNA, 18 bp, Artificial Sequence
  Synthetic DNA
taatcctattcactttag

SEQ ID NO: 17952 - DNA, 18 bp, Artificial Sequence
  Synthetic DNA
taatcggacacacaatag

SEQ ID NO: 17953 - DNA, 18 bp, Artificial Sequence
  Synthetic DNA
taatcggactcaataaag

SEQ ID NO: 17954 - DNA, 18 bp, Artificial Sequence
  Synthetic DNA
taatctgacacactttag

SEQ ID NO: 17955 - DNA, 18 bp, Artificial Sequence
  Synthetic DNA
taatctgacccactagag

SEQ ID NO: 17956 - DNA, 18 bp, Artificial Sequence
  Synthetic DNA
taatgacaatcactatag

SEQ ID NO: 17957 - DNA, 18 bp, Artificial Sequence
  Synthetic DNA
taatgacactcactaaag

SEQ ID NO: 17958 - DNA, 18 bp, Artificial Sequence
  Synthetic DNA
taatgagaatctctatag

SEQ ID NO: 17959 - DNA, 18 bp, Artificial Sequence
  Synthetic DNA
taatgagacatactatag

SEQ ID NO: 17960 - DNA, 18 bp, Artificial Sequence
  Synthetic DNA
taatgagactcaaaatag

SEQ ID NO: 17961 - DNA, 18 bp, Artificial Sequence
  Synthetic DNA
taatgagactctatatag

SEQ ID NO: 17962 - DNA, 18 bp, Artificial Sequence
  Synthetic DNA
taatgcaactaactaaag

SEQ ID NO: 17963 - DNA, 18 bp, Artificial Sequence
  Synthetic DNA
taatgcatctcagtatag

SEQ ID NO: 17964 - DNA, 18 bp, Artificial Sequence
  Synthetic DNA
taatgccactcactttcg

SEQ ID NO: 17965 - DNA, 18 bp, Artificial Sequence
  Synthetic DNA
taatgccactctctttag

SEQ ID NO: 17966 - DNA, 18 bp, Artificial Sequence
  Synthetic DNA
taatgcgaccaaatatag

SEQ ID NO: 17967 - DNA, 18 bp, Artificial Sequence
  Synthetic DNA
taatgcgacgcactgaag

SEQ ID NO: 17968 - DNA, 18 bp, Artificial Sequence
  Synthetic DNA
taatgcgacgctctatcg

SEQ ID NO: 17969 - DNA, 18 bp, Artificial Sequence
  Synthetic DNA
taatgcgactccccttag

SEQ ID NO: 17970 - DNA, 18 bp, Artificial Sequence
  Synthetic DNA
taatgcgactcctcatag

SEQ ID NO: 17971 - DNA, 18 bp, Artificial Sequence
  Synthetic DNA
taatgcgactctctaagg

SEQ ID NO: 17972 - DNA, 18 bp, Artificial Sequence
  Synthetic DNA
taatgcgacttactcgag

SEQ ID NO: 17973 - DNA, 18 bp, Artificial Sequence
  Synthetic DNA
taatgcgattcactcaag

SEQ ID NO: 17974 - DNA, 18 bp, Artificial Sequence
  Synthetic DNA
taatgcgcctcattttag

SEQ ID NO: 17975 - DNA, 18 bp, Artificial Sequence
  Synthetic DNA
taatgcgcctctctacag

SEQ ID NO: 17976 - DNA, 18 bp, Artificial Sequence
  Synthetic DNA
taatgcgtctctctaaag

SEQ ID NO: 17977 - DNA, 18 bp, Artificial Sequence
  Synthetic DNA
taatgctgctaactatag

SEQ ID NO: 17978 - DNA, 18 bp, Artificial Sequence
  Synthetic DNA
taatggcactcactaaag

SEQ ID NO: 17979 - DNA, 18 bp, Artificial Sequence
  Synthetic DNA
taatgtaacacactatag

SEQ ID NO: 17980 - DNA, 18 bp, Artificial Sequence
  Synthetic DNA
taatgtgacccacaatag

SEQ ID NO: 17981 - DNA, 18 bp, Artificial Sequence
  Synthetic DNA
taatgtgactcacaatgg

SEQ ID NO: 17982 - DNA, 18 bp, Artificial Sequence
  Synthetic DNA
taatgtgactcacattag

SEQ ID NO: 17983 - DNA, 18 bp, Artificial Sequence
  Synthetic DNA
taatgtgtctcactagag

SEQ ID NO: 17984 - DNA, 18 bp, Artificial Sequence
  Synthetic DNA
tacaacaaatcactatag

SEQ ID NO: 17985 - DNA, 18 bp, Artificial Sequence
  Synthetic DNA
tacaacgactcaaaatag

SEQ ID NO: 17986 - DNA, 18 bp, Artificial Sequence
  Synthetic DNA
tacaacgactcactgaag

SEQ ID NO: 17987 - DNA, 18 bp, Artificial Sequence
  Synthetic DNA
tactaacactcactacag

SEQ ID NO: 17988 - DNA, 18 bp, Artificial Sequence
  Synthetic DNA
tactaagagtcaccatag

SEQ ID NO: 17989 - DNA, 18 bp, Artificial Sequence
  Synthetic DNA
tactaccacactctatag

SEQ ID NO: 17990 - DNA, 18 bp, Artificial Sequence
  Synthetic DNA
tactacccctcactatgg

SEQ ID NO: 17991 - DNA, 18 bp, Artificial Sequence
  Synthetic DNA
tactacgacaatctatag

SEQ ID NO: 17992 - DNA, 18 bp, Artificial Sequence
  Synthetic DNA
tactacgacgctttatag

SEQ ID NO: 17993 - DNA, 18 bp, Artificial Sequence
  Synthetic DNA
tactacgtcttactgtag

SEQ ID NO: 17994 - DNA, 18 bp, Artificial Sequence
  Synthetic DNA
tactactacccattatag

SEQ ID NO: 17995 - DNA, 18 bp, Artificial Sequence
  Synthetic DNA
tactactattcaatatag

SEQ ID NO: 17996 - DNA, 18 bp, Artificial Sequence
  Synthetic DNA
tactatgactccctaaag

SEQ ID NO: 17997 - DNA, 18 bp, Artificial Sequence
  Synthetic DNA
tactccgacttactatcg

SEQ ID NO: 17998 - DNA, 18 bp, Artificial Sequence
  Synthetic DNA
tactgtgactctctatag

SEQ ID NO: 17999 - DNA, 18 bp, Artificial Sequence
  Synthetic DNA
tagaaacactcactatag

SEQ ID NO: 18000 - DNA, 18 bp, Artificial Sequence
  Synthetic DNA
tagaacgactccctatgg

SEQ ID NO: 18001 - DNA, 18 bp, Artificial Sequence
  Synthetic DNA
tagcacgactcactaacg

SEQ ID NO: 18002 - DNA, 18 bp, Artificial Sequence
  Synthetic DNA
tagcacgacttattatag

SEQ ID NO: 18003 - DNA, 18 bp, Artificial Sequence
  Synthetic DNA
tagcactactcactacag

SEQ ID NO: 18004 - DNA, 18 bp, Artificial Sequence
  Synthetic DNA
tagtaaccctcactatag

SEQ ID NO: 18005 - DNA, 18 bp, Artificial Sequence
  Synthetic DNA
tagtaagactcagtaaag

SEQ ID NO: 18006 - DNA, 18 bp, Artificial Sequence
  Synthetic DNA
tagtaagacttactttag

SEQ ID NO: 18007 - DNA, 18 bp, Artificial Sequence
  Synthetic DNA
tagtacaactcagtaaag

SEQ ID NO: 18008 - DNA, 18 bp, Artificial Sequence
  Synthetic DNA
tagtacaactctccatag

SEQ ID NO: 18009 - DNA, 18 bp, Artificial Sequence
  Synthetic DNA
tagtacgaatcattatcg

SEQ ID NO: 18010 - DNA, 18 bp, Artificial Sequence
  Synthetic DNA
tagtacgacactctaaag

SEQ ID NO: 18011 - DNA, 18 bp, Artificial Sequence
  Synthetic DNA
tagtacgactcacaacgg

SEQ ID NO: 18012 - DNA, 18 bp, Artificial Sequence
  Synthetic DNA
tagtacgatttattatag

SEQ ID NO: 18013 - DNA, 18 bp, Artificial Sequence
  Synthetic DNA
tagtacgatttcctatag

SEQ ID NO: 18014 - DNA, 18 bp, Artificial Sequence
  Synthetic DNA
tagtacgcctcaatacag

SEQ ID NO: 18015 - DNA, 18 bp, Artificial Sequence
  Synthetic DNA
tagtacggctcataatag

SEQ ID NO: 18016 - DNA, 18 bp, Artificial Sequence
  Synthetic DNA
tagtactactccccatag

SEQ ID NO: 18017 - DNA, 18 bp, Artificial Sequence
  Synthetic DNA
tagtaggacacagtatag

SEQ ID NO: 18018 - DNA, 18 bp, Artificial Sequence
  Synthetic DNA
tagtatgagttactatag

SEQ ID NO: 18019 - DNA, 18 bp, Artificial Sequence
  Synthetic DNA
tagtatgattcactacag

SEQ ID NO: 18020 - DNA, 18 bp, Artificial Sequence
  Synthetic DNA
tagtccgactctctaaag

SEQ ID NO: 18021 - DNA, 18 bp, Artificial Sequence
  Synthetic DNA
tagtccgacttacaatag

SEQ ID NO: 18022 - DNA, 18 bp, Artificial Sequence
  Synthetic DNA
tagtgcgtctcactatcg

SEQ ID NO: 18023 - DNA, 18 bp, Artificial Sequence
  Synthetic DNA
tagtgctactcactacag

SEQ ID NO: 18024 - DNA, 18 bp, Artificial Sequence
  Synthetic DNA
tataccgactcaatatag

SEQ ID NO: 18025 - DNA, 18 bp, Artificial Sequence
  Synthetic DNA
tataccgactgactatag

SEQ ID NO: 18026 - DNA, 18 bp, Artificial Sequence
  Synthetic DNA
tatcacggttcactatag

SEQ ID NO: 18027 - DNA, 18 bp, Artificial Sequence
  Synthetic DNA
tatcacgtctcacgatag

SEQ ID NO: 18028 - DNA, 18 bp, Artificial Sequence
  Synthetic DNA
tatgacgattccctatag

SEQ ID NO: 18029 - DNA, 18 bp, Artificial Sequence
  Synthetic DNA
tatgacggctcaccatag

SEQ ID NO: 18030 - DNA, 18 bp, Artificial Sequence
  Synthetic DNA
tattaagactaactgtag

SEQ ID NO: 18031 - DNA, 18 bp, Artificial Sequence
  Synthetic DNA
tattaagcctcactagag

SEQ ID NO: 18032 - DNA, 18 bp, Artificial Sequence
  Synthetic DNA
tattacaactcaccaaag

SEQ ID NO: 18033 - DNA, 18 bp, Artificial Sequence
  Synthetic DNA
tattaccacgcactatcg

SEQ ID NO: 18034 - DNA, 18 bp, Artificial Sequence
  Synthetic DNA
tattaccccccactatag

SEQ ID NO: 18035 - DNA, 18 bp, Artificial Sequence
  Synthetic DNA
tattaccgctcactttag

SEQ ID NO: 18036 - DNA, 18 bp, Artificial Sequence
  Synthetic DNA
tattacgaaacactatgg

SEQ ID NO: 18037 - DNA, 18 bp, Artificial Sequence
  Synthetic DNA
tattacgaaacactctag

SEQ ID NO: 18038 - DNA, 18 bp, Artificial Sequence
  Synthetic DNA
tattacgaccgactaaag

SEQ ID NO: 18039 - DNA, 18 bp, Artificial Sequence
  Synthetic DNA
tattacgacgcacgaaag

SEQ ID NO: 18040 - DNA, 18 bp, Artificial Sequence
  Synthetic DNA
tattacgactaattctag

SEQ ID NO: 18041 - DNA, 18 bp, Artificial Sequence
  Synthetic DNA
tattacgactcaattgag

SEQ ID NO: 18042 - DNA, 18 bp, Artificial Sequence
  Synthetic DNA
tattacgactcagtctgg

SEQ ID NO: 18043 - DNA, 18 bp, Artificial Sequence
  Synthetic DNA
tattacgacttaatctag

SEQ ID NO: 18044 - DNA, 18 bp, Artificial Sequence
  Synthetic DNA
tattacgacttatgatag

SEQ ID NO: 18045 - DNA, 18 bp, Artificial Sequence
  Synthetic DNA
tattacgacttattacag

SEQ ID NO: 18046 - DNA, 18 bp, Artificial Sequence
  Synthetic DNA
tattacgattccctttag

SEQ ID NO: 18047 - DNA, 18 bp, Artificial Sequence
  Synthetic DNA
tattacgcctcaatctag

SEQ ID NO: 18048 - DNA, 18 bp, Artificial Sequence
  Synthetic DNA
tattacgcctcacactag

SEQ ID NO: 18049 - DNA, 18 bp, Artificial Sequence
  Synthetic DNA
tattacggctcaatatcg

SEQ ID NO: 18050 - DNA, 18 bp, Artificial Sequence
  Synthetic DNA
tattacggctcacaatcg

SEQ ID NO: 18051 - DNA, 18 bp, Artificial Sequence
  Synthetic DNA
tattacgtctcaccatcg

SEQ ID NO: 18052 - DNA, 18 bp, Artificial Sequence
  Synthetic DNA
tattactacgcattatag

SEQ ID NO: 18053 - DNA, 18 bp, Artificial Sequence
  Synthetic DNA
tattaggacacactacag

SEQ ID NO: 18054 - DNA, 18 bp, Artificial Sequence
  Synthetic DNA
tattaggactaactaaag

SEQ ID NO: 18055 - DNA, 18 bp, Artificial Sequence
  Synthetic DNA
tattaggactcacaatgg

SEQ ID NO: 18056 - DNA, 18 bp, Artificial Sequence
  Synthetic DNA
tattaggatccactatag

SEQ ID NO: 18057 - DNA, 18 bp, Artificial Sequence
  Synthetic DNA
tattatgactctctagag

SEQ ID NO: 18058 - DNA, 18 bp, Artificial Sequence
  Synthetic DNA
tattatgcctcactaaag

SEQ ID NO: 18059 - DNA, 18 bp, Artificial Sequence
  Synthetic DNA
tattccgtctctctatag

SEQ ID NO: 18060 - DNA, 18 bp, Artificial Sequence
  Synthetic DNA
tattgagattcactatag

SEQ ID NO: 18061 - DNA, 18 bp, Artificial Sequence
  Synthetic DNA
tattgcaactcactttag

SEQ ID NO: 18062 - DNA, 18 bp, Artificial Sequence
  Synthetic DNA
tattgccaatcactatag

SEQ ID NO: 18063 - DNA, 18 bp, Artificial Sequence
  Synthetic DNA
tattgcgacacactatcg

SEQ ID NO: 18064 - DNA, 18 bp, Artificial Sequence
  Synthetic DNA
tattgcgactttctatag

SEQ ID NO: 18065 - DNA, 18 bp, Artificial Sequence
  Synthetic DNA
tattgcgattctctatag

SEQ ID NO: 18066 - DNA, 18 bp, Artificial Sequence
  Synthetic DNA
tattgcgcgtcactatag

SEQ ID NO: 18067 - DNA, 18 bp, Artificial Sequence
  Synthetic DNA
tcaaaagactcaccatag

SEQ ID NO: 18068 - DNA, 18 bp, Artificial Sequence
  Synthetic DNA
tcaaacgacacattatag

SEQ ID NO: 18069 - DNA, 18 bp, Artificial Sequence
  Synthetic DNA
tcacacgaaacactatag

SEQ ID NO: 18070 - DNA, 18 bp, Artificial Sequence
  Synthetic DNA
tcagacgatttactatag

SEQ ID NO: 18071 - DNA, 18 bp, Artificial Sequence
  Synthetic DNA
tcataacactcactacag

SEQ ID NO: 18072 - DNA, 18 bp, Artificial Sequence
  Synthetic DNA
tcatacaactaactaaag

SEQ ID NO: 18073 - DNA, 18 bp, Artificial Sequence
  Synthetic DNA
tcatacaactacctatag

SEQ ID NO: 18074 - DNA, 18 bp, Artificial Sequence
  Synthetic DNA
tcatacaactcacttaag

SEQ ID NO: 18075 - DNA, 18 bp, Artificial Sequence
  Synthetic DNA
tcatacatctgactatag

SEQ ID NO: 18076 - DNA, 18 bp, Artificial Sequence
  Synthetic DNA
tcatacgactcacttgcg

SEQ ID NO: 18077 - DNA, 18 bp, Artificial Sequence
  Synthetic DNA
tcatacgagtcacattag

SEQ ID NO: 18078 - DNA, 18 bp, Artificial Sequence
  Synthetic DNA
tcatacgccttactatcg

SEQ ID NO: 18079 - DNA, 18 bp, Artificial Sequence
  Synthetic DNA
tcatacgccttcctatag

SEQ ID NO: 18080 - DNA, 18 bp, Artificial Sequence
  Synthetic DNA
tcatacggctcacaaaag

SEQ ID NO: 18081 - DNA, 18 bp, Artificial Sequence
  Synthetic DNA
tcatacgtctctctgtag

SEQ ID NO: 18082 - DNA, 18 bp, Artificial Sequence
  Synthetic DNA
tcatactactcactctgg

SEQ ID NO: 18083 - DNA, 18 bp, Artificial Sequence
  Synthetic DNA
tcatagtactgactatag

SEQ ID NO: 18084 - DNA, 18 bp, Artificial Sequence
  Synthetic DNA
tcatatgaatcactaaag

SEQ ID NO: 18085 - DNA, 18 bp, Artificial Sequence
  Synthetic DNA
tcatatgactcaggatag

SEQ ID NO: 18086 - DNA, 18 bp, Artificial Sequence
  Synthetic DNA
tcatccgacccagtatag

SEQ ID NO: 18087 - DNA, 18 bp, Artificial Sequence
  Synthetic DNA
tcatcctactcaatatag

SEQ ID NO: 18088 - DNA, 18 bp, Artificial Sequence
  Synthetic DNA
tcatgcgacgaactatag

SEQ ID NO: 18089 - DNA, 18 bp, Artificial Sequence
  Synthetic DNA
tcatgcgactcacttaag

SEQ ID NO: 18090 - DNA, 18 bp, Artificial Sequence
  Synthetic DNA
tcatgcgactttctatag

SEQ ID NO: 18091 - DNA, 18 bp, Artificial Sequence
  Synthetic DNA
tcatgcgccgcactatag

SEQ ID NO: 18092 - DNA, 18 bp, Artificial Sequence
  Synthetic DNA
tcctacgacttactatcg

SEQ ID NO: 18093 - DNA, 18 bp, Artificial Sequence
  Synthetic DNA
tcctacgattcactaaag

SEQ ID NO: 18094 - DNA, 18 bp, Artificial Sequence
  Synthetic DNA
tcctacgattcactctag

SEQ ID NO: 18095 - DNA, 18 bp, Artificial Sequence
  Synthetic DNA
tcctatgacacactatag

SEQ ID NO: 18096 - DNA, 18 bp, Artificial Sequence
  Synthetic DNA
tcgaacgactctctatag

SEQ ID NO: 18097 - DNA, 18 bp, Artificial Sequence
  Synthetic DNA
tcttaccactcacaatag

SEQ ID NO: 18098 - DNA, 18 bp, Artificial Sequence
  Synthetic DNA
tcttacgaatcactaaag

SEQ ID NO: 18099 - DNA, 18 bp, Artificial Sequence
  Synthetic DNA
tcttacgactcaccacag

SEQ ID NO: 18100 - DNA, 18 bp, Artificial Sequence
  Synthetic DNA
tcttacgactccatatag

SEQ ID NO: 18101 - DNA, 18 bp, Artificial Sequence
  Synthetic DNA
tcttacgactctctctag

SEQ ID NO: 18102 - DNA, 18 bp, Artificial Sequence
  Synthetic DNA
tcttacgtctcacgatag

SEQ ID NO: 18103 - DNA, 18 bp, Artificial Sequence
  Synthetic DNA
tcttacttctcactatag

SEQ ID NO: 18104 - DNA, 18 bp, Artificial Sequence
  Synthetic DNA
tgaaacgacacattatag

SEQ ID NO: 18105 - DNA, 18 bp, Artificial Sequence
  Synthetic DNA
tgaaacgactcacttaag

SEQ ID NO: 18106 - DNA, 18 bp, Artificial Sequence
  Synthetic DNA
tgaaacgactctctatcg

SEQ ID NO: 18107 - DNA, 18 bp, Artificial Sequence
  Synthetic DNA
tgaaacgcctaactatag

SEQ ID NO: 18108 - DNA, 18 bp, Artificial Sequence
  Synthetic DNA
tgaagcgactcaatatag

SEQ ID NO: 18109 - DNA, 18 bp, Artificial Sequence
  Synthetic DNA
tgagacgacacattatag

SEQ ID NO: 18110 - DNA, 18 bp, Artificial Sequence
  Synthetic DNA
tgataaaactaactatag

SEQ ID NO: 18111 - DNA, 18 bp, Artificial Sequence
  Synthetic DNA
tgatacaactcaccaaag

SEQ ID NO: 18112 - DNA, 18 bp, Artificial Sequence
  Synthetic DNA
tgataccaataactatag

SEQ ID NO: 18113 - DNA, 18 bp, Artificial Sequence
  Synthetic DNA
tgataccacacactttag

SEQ ID NO: 18114 - DNA, 18 bp, Artificial Sequence
  Synthetic DNA
tgataccactcactaacg

SEQ ID NO: 18115 - DNA, 18 bp, Artificial Sequence
  Synthetic DNA
tgatacgaaagactatag

SEQ ID NO: 18116 - DNA, 18 bp, Artificial Sequence
  Synthetic DNA
tgatacgaagcactatgg

SEQ ID NO: 18117 - DNA, 18 bp, Artificial Sequence
  Synthetic DNA
tgatacgaatcactttgg

SEQ ID NO: 18118 - DNA, 18 bp, Artificial Sequence
  Synthetic DNA
tgatacgacacactcaag

SEQ ID NO: 18119 - DNA, 18 bp, Artificial Sequence
  Synthetic DNA
tgatacgacttagtaaag

SEQ ID NO: 18120 - DNA, 18 bp, Artificial Sequence
  Synthetic DNA
tgatacgagtctctacag

SEQ ID NO: 18121 - DNA, 18 bp, Artificial Sequence
  Synthetic DNA
tgatacgattaaatatag

SEQ ID NO: 18122 - DNA, 18 bp, Artificial Sequence
  Synthetic DNA
tgatacgattccctttag

SEQ ID NO: 18123 - DNA, 18 bp, Artificial Sequence
  Synthetic DNA
tgatacgatttactttag

SEQ ID NO: 18124 - DNA, 18 bp, Artificial Sequence
  Synthetic DNA
tgatacggctcactctgg

SEQ ID NO: 18125 - DNA, 18 bp, Artificial Sequence
  Synthetic DNA
tgatacgtctcaatatgg

SEQ ID NO: 18126 - DNA, 18 bp, Artificial Sequence
  Synthetic DNA
tgatactactcagtaaag

SEQ ID NO: 18127 - DNA, 18 bp, Artificial Sequence
  Synthetic DNA
tgataggacttaatatag

SEQ ID NO: 18128 - DNA, 18 bp, Artificial Sequence
  Synthetic DNA
tgataggattcacaatag

SEQ ID NO: 18129 - DNA, 18 bp, Artificial Sequence
  Synthetic DNA
tgatatgactcaataaag

SEQ ID NO: 18130 - DNA, 18 bp, Artificial Sequence
  Synthetic DNA
tgatattacccactatag

SEQ ID NO: 18131 - DNA, 18 bp, Artificial Sequence
  Synthetic DNA
tgatgtgtctcactatag

SEQ ID NO: 18132 - DNA, 18 bp, Artificial Sequence
  Synthetic DNA
tgctaagactcactaaag

SEQ ID NO: 18133 - DNA, 18 bp, Artificial Sequence
  Synthetic DNA
tgctacgactaactgtag

SEQ ID NO: 18134 - DNA, 18 bp, Artificial Sequence
  Synthetic DNA
tgctacgactcacttgag

SEQ ID NO: 18135 - DNA, 18 bp, Artificial Sequence
  Synthetic DNA
tggtatgtctcactatag

SEQ ID NO: 18136 - DNA, 18 bp, Artificial Sequence
  Synthetic DNA
tgtcacgactctctatag

SEQ ID NO: 18137 - DNA, 18 bp, Artificial Sequence
  Synthetic DNA
tgttacaactcacaatag

SEQ ID NO: 18138 - DNA, 18 bp, Artificial Sequence
  Synthetic DNA
tgttacaactcactctag

SEQ ID NO: 18139 - DNA, 18 bp, Artificial Sequence
  Synthetic DNA
tgttaccacttactatag

SEQ ID NO: 18140 - DNA, 18 bp, Artificial Sequence
  Synthetic DNA
ttaaacgacgcattatag

SEQ ID NO: 18141 - DNA, 18 bp, Artificial Sequence
  Synthetic DNA
ttaaacgactcactgtgg

SEQ ID NO: 18142 - DNA, 18 bp, Artificial Sequence
  Synthetic DNA
ttaaacgagtcactacag

SEQ ID NO: 18143 - DNA, 18 bp, Artificial Sequence
  Synthetic DNA
ttaaacgattcactctag

SEQ ID NO: 18144 - DNA, 18 bp, Artificial Sequence
  Synthetic DNA
ttaaaggactcactacag

SEQ ID NO: 18145 - DNA, 18 bp, Artificial Sequence
  Synthetic DNA
ttaaaggcctcactatag

SEQ ID NO: 18146 - DNA, 18 bp, Artificial Sequence
  Synthetic DNA
ttaagcgcctcactatag

SEQ ID NO: 18147 - DNA, 18 bp, Artificial Sequence
  Synthetic DNA
ttaagcggctcactatag

SEQ ID NO: 18148 - DNA, 18 bp, Artificial Sequence
  Synthetic DNA
ttacacatctcactatag

SEQ ID NO: 18149 - DNA, 18 bp, Artificial Sequence
  Synthetic DNA
ttacacgactcacttcag

SEQ ID NO: 18150 - DNA, 18 bp, Artificial Sequence
  Synthetic DNA
ttacacgacttaccatag

SEQ ID NO: 18151 - DNA, 18 bp, Artificial Sequence
  Synthetic DNA
ttagacttctcactatag

SEQ ID NO: 18152 - DNA, 18 bp, Artificial Sequence
  Synthetic DNA
ttataagcatcactatag

SEQ ID NO: 18153 - DNA, 18 bp, Artificial Sequence
  Synthetic DNA
ttatacaacgtactatag

SEQ ID NO: 18154 - DNA, 18 bp, Artificial Sequence
  Synthetic DNA
ttataccactaactaaag

SEQ ID NO: 18155 - DNA, 18 bp, Artificial Sequence
  Synthetic DNA
ttataccactaactatcg

SEQ ID NO: 18156 - DNA, 18 bp, Artificial Sequence
  Synthetic DNA
ttataccactcaccttag

SEQ ID NO: 18157 - DNA, 18 bp, Artificial Sequence
  Synthetic DNA
ttataccactgactttag

SEQ ID NO: 18158 - DNA, 18 bp, Artificial Sequence
  Synthetic DNA
ttatacgaatcaagatag

SEQ ID NO: 18159 - DNA, 18 bp, Artificial Sequence
  Synthetic DNA
ttatacgacacaccctag

SEQ ID NO: 18160 - DNA, 18 bp, Artificial Sequence
  Synthetic DNA
ttatacgacactctacag

SEQ ID NO: 18161 - DNA, 18 bp, Artificial Sequence
  Synthetic DNA
ttatacgactcacaagcg

SEQ ID NO: 18162 - DNA, 18 bp, Artificial Sequence
  Synthetic DNA
ttatacgactcagaagag

SEQ ID NO: 18163 - DNA, 18 bp, Artificial Sequence
  Synthetic DNA
ttatacgactccccatgg

SEQ ID NO: 18164 - DNA, 18 bp, Artificial Sequence
  Synthetic DNA
ttatacgactctttctag

SEQ ID NO: 18165 - DNA, 18 bp, Artificial Sequence
  Synthetic DNA
ttatacgagtaaccatag

SEQ ID NO: 18166 - DNA, 18 bp, Artificial Sequence
  Synthetic DNA
ttatacgagtcactagcg

SEQ ID NO: 18167 - DNA, 18 bp, Artificial Sequence
  Synthetic DNA
ttatacgagtccctttag

SEQ ID NO: 18168 - DNA, 18 bp, Artificial Sequence
  Synthetic DNA
ttatacgagtctctatcg

SEQ ID NO: 18169 - DNA, 18 bp, Artificial Sequence
  Synthetic DNA
ttatacgattccctacag

SEQ ID NO: 18170 - DNA, 18 bp, Artificial Sequence
  Synthetic DNA
ttatacgcccctctatag

SEQ ID NO: 18171 - DNA, 18 bp, Artificial Sequence
  Synthetic DNA
ttatacgcgccactatag

SEQ ID NO: 18172 - DNA, 18 bp, Artificial Sequence
  Synthetic DNA
ttatacgcgtcactttag

SEQ ID NO: 18173 - DNA, 18 bp, Artificial Sequence
  Synthetic DNA
ttatacggctcattaaag

SEQ ID NO: 18174 - DNA, 18 bp, Artificial Sequence
  Synthetic DNA
ttatacggctcattatgg

SEQ ID NO: 18175 - DNA, 18 bp, Artificial Sequence
  Synthetic DNA
ttatacggctctatatag

SEQ ID NO: 18176 - DNA, 18 bp, Artificial Sequence
  Synthetic DNA
ttatacgtcccagtatag

SEQ ID NO: 18177 - DNA, 18 bp, Artificial Sequence
  Synthetic DNA
ttatactacgaactatag

SEQ ID NO: 18178 - DNA, 18 bp, Artificial Sequence
  Synthetic DNA
ttatactactaactatcg

SEQ ID NO: 18179 - DNA, 18 bp, Artificial Sequence
  Synthetic DNA
ttatactactcactaccg

SEQ ID NO: 18180 - DNA, 18 bp, Artificial Sequence
  Synthetic DNA
ttatactactcactgtgg

SEQ ID NO: 18181 - DNA, 18 bp, Artificial Sequence
  Synthetic DNA
ttatactactcagtgtag

SEQ ID NO: 18182 - DNA, 18 bp, Artificial Sequence
  Synthetic DNA
ttatactactgaatatag

SEQ ID NO: 18183 - DNA, 18 bp, Artificial Sequence
  Synthetic DNA
ttatactaggcactatag

SEQ ID NO: 18184 - DNA, 18 bp, Artificial Sequence
  Synthetic DNA
ttataggagttactatag

SEQ ID NO: 18185 - DNA, 18 bp, Artificial Sequence
  Synthetic DNA
ttataggcctcactctag

SEQ ID NO: 18186 - DNA, 18 bp, Artificial Sequence
  Synthetic DNA
ttatatcactcactatgg

SEQ ID NO: 18187 - DNA, 18 bp, Artificial Sequence
  Synthetic DNA
ttatatgactcaccatcg

SEQ ID NO: 18188 - DNA, 18 bp, Artificial Sequence
  Synthetic DNA
ttatatgactcactagcg

SEQ ID NO: 18189 - DNA, 18 bp, Artificial Sequence
  Synthetic DNA
ttatccgactcagtatgg

SEQ ID NO: 18190 - DNA, 18 bp, Artificial Sequence
  Synthetic DNA
ttatccgacttcctatag

SEQ ID NO: 18191 - DNA, 18 bp, Artificial Sequence
  Synthetic DNA
ttatgcgactcaaaatag

SEQ ID NO: 18192 - DNA, 18 bp, Artificial Sequence
  Synthetic DNA
ttatgggactctctatag

SEQ ID NO: 18193 - DNA, 18 bp, Artificial Sequence
  Synthetic DNA
ttctaagactcactatgg

SEQ ID NO: 18194 - DNA, 18 bp, Artificial Sequence
  Synthetic DNA
ttctacaactcaccatag

SEQ ID NO: 18195 - DNA, 18 bp, Artificial Sequence
  Synthetic DNA
ttctacgactaaccatag

SEQ ID NO: 18196 - DNA, 18 bp, Artificial Sequence
  Synthetic DNA
ttctacgccccactatag

SEQ ID NO: 18197 - DNA, 18 bp, Artificial Sequence
  Synthetic DNA
ttgcacgactcagtatag

SEQ ID NO: 18198 - DNA, 18 bp, Artificial Sequence
  Synthetic DNA
ttggaagactcactatag

SEQ ID NO: 18199 - DNA, 18 bp, Artificial Sequence
  Synthetic DNA
ttgtacgacacactttag

SEQ ID NO: 18200 - DNA, 18 bp, Artificial Sequence
  Synthetic DNA
ttgtacgactaactaaag

SEQ ID NO: 18201 - DNA, 18 bp, Artificial Sequence
  Synthetic DNA
ttgtacgactcactaacg

SEQ ID NO: 18202 - DNA, 18 bp, Artificial Sequence
  Synthetic DNA
ttgtacgactcattaaag

SEQ ID NO: 18203 - DNA, 18 bp, Artificial Sequence
  Synthetic DNA
ttgtacgcctcactacag

SEQ ID NO: 18204 - DNA, 18 bp, Artificial Sequence
  Synthetic DNA
ttgtacggctcactacag

SEQ ID NO: 18205 - DNA, 18 bp, Artificial Sequence
  Synthetic DNA
ttgtgcgactcactatcg

SEQ ID NO: 18206 - DNA, 18 bp, Artificial Sequence
  Synthetic DNA
ttttaagactcagtatag

SEQ ID NO: 18207 - DNA, 18 bp, Artificial Sequence
  Synthetic DNA
ttttataactcactatag

SEQ ID NO: 18208 - DNA, 18 bp, Artificial Sequence
  Synthetic DNA
ttttatcactcactatag

SEQ ID NO: 18209 - DNA, 18 bp, Artificial Sequence
  Synthetic DNA
ttttatgactgactatag

SEQ ID NO: 18210 - DNA, 18 bp, Artificial Sequence
  Synthetic DNA
ttttccgactcactatcg

SEQ ID NO: 18211 - DNA, 18 bp, Artificial Sequence
  Synthetic DNA
ttttccgactcactttag

SEQ ID NO: 18212 - DNA, 18 bp, Artificial Sequence
  Synthetic DNA
ttaaaagactcactattg

SEQ ID NO: 18213 - DNA, 18 bp, Artificial Sequence
  Synthetic DNA
aattacgactcacttttg

SEQ ID NO: 18214 - DNA, 18 bp, Artificial Sequence
  Synthetic DNA
aaattcgactcacaaaag

SEQ ID NO: 18215 - DNA, 18 bp, Artificial Sequence
  Synthetic DNA
tttaacgtctcactatag

SEQ ID NO: 18216 - DNA, 18 bp, Artificial Sequence
  Synthetic DNA
taattggactcacttaag

SEQ ID NO: 18217 - DNA, 18 bp, Artificial Sequence
  Synthetic DNA
ttattcggctcactgtag

SEQ ID NO: 18218 - DNA, 18 bp, Artificial Sequence
  Synthetic DNA
aaacacggctcactattg

SEQ ID NO: 18219 - DNA, 18 bp, Artificial Sequence
  Synthetic DNA
aaatatgactcactgttg

SEQ ID NO: 18220 - DNA, 18 bp, Artificial Sequence
  Synthetic DNA
taattcttatcactatag

SEQ ID NO: 18221 - DNA, 18 bp, Artificial Sequence
  Synthetic DNA
taattgaactcacaatag

SEQ ID NO: 18222 - DNA, 18 bp, Artificial Sequence
  Synthetic DNA
taatttgactcactcaag

SEQ ID NO: 18223 - DNA, 18 bp, Artificial Sequence
  Synthetic DNA
tgattcgtctcactaaag

SEQ ID NO: 18224 - DNA, 18 bp, Artificial Sequence
  Synthetic DNA
ttattcgactcactgtgg

SEQ ID NO: 18225 - DNA, 18 bp, Artificial Sequence
  Synthetic DNA
gaatacaattcactaaag

SEQ ID NO: 18226 - DNA, 18 bp, Artificial Sequence
  Synthetic DNA
taaaacgacttacaaaag

SEQ ID NO: 18227 - DNA, 18 bp, Artificial Sequence
  Synthetic DNA
taatacgaataaatctag

SEQ ID NO: 18228 - DNA, 18 bp, Artificial Sequence
  Synthetic DNA
ttcaacgactcactgtag

SEQ ID NO: 18229 - DNA, 18 bp, Artificial Sequence
  Synthetic DNA
taataagactcgccattg

SEQ ID NO: 18230 - DNA, 18 bp, Artificial Sequence
  Synthetic DNA
ttatacgactggctattg

SEQ ID NO: 18231 - DNA, 18 bp, Artificial Sequence
  Synthetic DNA
taaaacgactcagtgttg

SEQ ID NO: 18232 - DNA, 18 bp, Artificial Sequence
  Synthetic DNA
taatacgcgacactattg

SEQ ID NO: 18233 - DNA, 18 bp, Artificial Sequence
  Synthetic DNA
taatagaactcacttttg

SEQ ID NO: 18234 - DNA, 18 bp, Artificial Sequence
  Synthetic DNA
taataggactcacttatg

SEQ ID NO: 18235 - DNA, 18 bp, Artificial Sequence
  Synthetic DNA
taattagtctcaatatag

SEQ ID NO: 18236 - DNA, 18 bp, Artificial Sequence
  Synthetic DNA
taattgaactcaccatag

SEQ ID NO: 18237 - DNA, 18 bp, Artificial Sequence
  Synthetic DNA
tgtttcgactcactaaag

SEQ ID NO: 18238 - DNA, 18 bp, Artificial Sequence
  Synthetic DNA
ttataggactcgctttag

SEQ ID NO: 18239 - DNA, 18 bp, Artificial Sequence
  Synthetic DNA
aaaaacgactcattaaag

SEQ ID NO: 18240 - DNA, 18 bp, Artificial Sequence
  Synthetic DNA
aaacaccactcactttag

SEQ ID NO: 18241 - DNA, 18 bp, Artificial Sequence
  Synthetic DNA
aaatactacccactttag

SEQ ID NO: 18242 - DNA, 18 bp, Artificial Sequence
  Synthetic DNA
atttgcgactcactatag

SEQ ID NO: 18243 - DNA, 18 bp, Artificial Sequence
  Synthetic DNA
caatacgactcaatccag

SEQ ID NO: 18244 - DNA, 18 bp, Artificial Sequence
  Synthetic DNA
gaaagcgtctcactatag

SEQ ID NO: 18245 - DNA, 18 bp, Artificial Sequence
  Synthetic DNA
taataagactcacattgg

SEQ ID NO: 18246 - DNA, 18 bp, Artificial Sequence
  Synthetic DNA
taatacgtgtcacaaaag

SEQ ID NO: 18247 - DNA, 18 bp, Artificial Sequence
  Synthetic DNA
taatagatctctctatag

SEQ ID NO: 18248 - DNA, 18 bp, Artificial Sequence
  Synthetic DNA
taatatgattctctacag

SEQ ID NO: 18249 - DNA, 18 bp, Artificial Sequence
  Synthetic DNA
tattatgacatactatag

SEQ ID NO: 18250 - DNA, 18 bp, Artificial Sequence
  Synthetic DNA
tcacactactcactaaag

SEQ ID NO: 18251 - DNA, 18 bp, Artificial Sequence
  Synthetic DNA
ttataagactctctgtag

SEQ ID NO: 18252 - DNA, 18 bp, Artificial Sequence
  Synthetic DNA
tattccgacttactattg

SEQ ID NO: 18253 - DNA, 18 bp, Artificial Sequence
  Synthetic DNA
taatacgtctgtccatag

SEQ ID NO: 18254 - DNA, 18 bp, Artificial Sequence
  Synthetic DNA
ttttacgtctcagtatag

SEQ ID NO: 18255 - DNA, 18 bp, Artificial Sequence
  Synthetic DNA
taataagtctcgctattg

SEQ ID NO: 18256 - DNA, 18 bp, Artificial Sequence
  Synthetic DNA
taataagacacgctattg

SEQ ID NO: 18257 - DNA, 18 bp, Artificial Sequence
  Synthetic DNA
taatttgactcactactg

SEQ ID NO: 18258 - DNA, 18 bp, Artificial Sequence
  Synthetic DNA
ttatacgactcgctgttg

SEQ ID NO: 18259 - DNA, 18 bp, Artificial Sequence
  Synthetic DNA
aaaatcgaatcactatag

SEQ ID NO: 18260 - DNA, 18 bp, Artificial Sequence
  Synthetic DNA
aaattcgactcacactag

SEQ ID NO: 18261 - DNA, 18 bp, Artificial Sequence
  Synthetic DNA
caatccgactcactaatg

SEQ ID NO: 18262 - DNA, 18 bp, Artificial Sequence
  Synthetic DNA
caattcaactcattatag

SEQ ID NO: 18263 - DNA, 18 bp, Artificial Sequence
  Synthetic DNA
taaaaacactcactattg

SEQ ID NO: 18264 - DNA, 18 bp, Artificial Sequence
  Synthetic DNA
taacacgatacactattg

SEQ ID NO: 18265 - DNA, 18 bp, Artificial Sequence
  Synthetic DNA
taatacaactcacccttg

SEQ ID NO: 18266 - DNA, 18 bp, Artificial Sequence
  Synthetic DNA
taatacgtatcaccattg

SEQ ID NO: 18267 - DNA, 18 bp, Artificial Sequence
  Synthetic DNA
taatagaactcactaatg

SEQ ID NO: 18268 - DNA, 18 bp, Artificial Sequence
  Synthetic DNA
taataggtctcagtattg

SEQ ID NO: 18269 - DNA, 18 bp, Artificial Sequence
  Synthetic DNA
taatccgacaaactattg

SEQ ID NO: 18270 - DNA, 18 bp, Artificial Sequence
  Synthetic DNA
taatgccactcactaatg

SEQ ID NO: 18271 - DNA, 18 bp, Artificial Sequence
  Synthetic DNA
taattagtgtcactatag

SEQ ID NO: 18272 - DNA, 18 bp, Artificial Sequence
  Synthetic DNA
taattccacttacaatag

SEQ ID NO: 18273 - DNA, 18 bp, Artificial Sequence
  Synthetic DNA
taattcgactaaccaaag

SEQ ID NO: 18274 - DNA, 18 bp, Artificial Sequence
  Synthetic DNA
taattcgactcaatgcag

SEQ ID NO: 18275 - DNA, 18 bp, Artificial Sequence
  Synthetic DNA
taattcgtctaactctag

SEQ ID NO: 18276 - DNA, 18 bp, Artificial Sequence
  Synthetic DNA
taattcgtctcactgcag

SEQ ID NO: 18277 - DNA, 18 bp, Artificial Sequence
  Synthetic DNA
tagcacgagtcactattg

SEQ ID NO: 18278 - DNA, 18 bp, Artificial Sequence
  Synthetic DNA
tagtacgacttgttatag

SEQ ID NO: 18279 - DNA, 18 bp, Artificial Sequence
  Synthetic DNA
tagttcgactcactaagg

SEQ ID NO: 18280 - DNA, 18 bp, Artificial Sequence
  Synthetic DNA
tattacgactcactgatg

SEQ ID NO: 18281 - DNA, 18 bp, Artificial Sequence
  Synthetic DNA
tattaggacgcactattg

SEQ ID NO: 18282 - DNA, 18 bp, Artificial Sequence
  Synthetic DNA
tatttcgtctcactctag

SEQ ID NO: 18283 - DNA, 18 bp, Artificial Sequence
  Synthetic DNA
tcatacgaatcacttttg

SEQ ID NO: 18284 - DNA, 18 bp, Artificial Sequence
  Synthetic DNA
tcatacgacttagtattg

SEQ ID NO: 18285 - DNA, 18 bp, Artificial Sequence
  Synthetic DNA
tcgtacgacacactattg

SEQ ID NO: 18286 - DNA, 18 bp, Artificial Sequence
  Synthetic DNA
tgatacaactcattattg

SEQ ID NO: 18287 - DNA, 18 bp, Artificial Sequence
  Synthetic DNA
tgattcgacttactaaag

SEQ ID NO: 18288 - DNA, 18 bp, Artificial Sequence
  Synthetic DNA
ttctacggctcactattg

SEQ ID NO: 18289 - DNA, 18 bp, Artificial Sequence
  Synthetic DNA
tttttcgactcaccatag

SEQ ID NO: 18290 - DNA, 18 bp, Artificial Sequence
  Synthetic DNA
tttttcgactcacgatag

SEQ ID NO: 18291 - DNA, 18 bp, Artificial Sequence
  Synthetic DNA
aaaaacgtgtcactatag

SEQ ID NO: 18292 - DNA, 18 bp, Artificial Sequence
  Synthetic DNA
aaatacggcttactttag

SEQ ID NO: 18293 - DNA, 18 bp, Artificial Sequence
  Synthetic DNA
aaatatgaatcactttag

SEQ ID NO: 18294 - DNA, 18 bp, Artificial Sequence
  Synthetic DNA
aaatatgactctctagag

SEQ ID NO: 18295 - DNA, 18 bp, Artificial Sequence
  Synthetic DNA
aaatgccacttactatag

SEQ ID NO: 18296 - DNA, 18 bp, Artificial Sequence
  Synthetic DNA
acttacgactcactacag

SEQ ID NO: 18297 - DNA, 18 bp, Artificial Sequence
  Synthetic DNA
agctacgactcacaatag

SEQ ID NO: 18298 - DNA, 18 bp, Artificial Sequence
  Synthetic DNA
atgtacgactcactatgg

SEQ ID NO: 18299 - DNA, 18 bp, Artificial Sequence
  Synthetic DNA
caatacgacccacaagag

SEQ ID NO: 18300 - DNA, 18 bp, Artificial Sequence
  Synthetic DNA
caatactacactctatag

SEQ ID NO: 18301 - DNA, 18 bp, Artificial Sequence
  Synthetic DNA
caatactattcactttag

SEQ ID NO: 18302 - DNA, 18 bp, Artificial Sequence
  Synthetic DNA
caatccgacccactttag

SEQ ID NO: 18303 - DNA, 18 bp, Artificial Sequence
  Synthetic DNA
caatctgactcaccatag

SEQ ID NO: 18304 - DNA, 18 bp, Artificial Sequence
  Synthetic DNA
caatgcgtctcactgtag

SEQ ID NO: 18305 - DNA, 18 bp, Artificial Sequence
  Synthetic DNA
cgaaacgactcaccatag

SEQ ID NO: 18306 - DNA, 18 bp, Artificial Sequence
  Synthetic DNA
gaatacgactctcttcag

SEQ ID NO: 18307 - DNA, 18 bp, Artificial Sequence
  Synthetic DNA
gattactactctctatag

SEQ ID NO: 18308 - DNA, 18 bp, Artificial Sequence
  Synthetic DNA
gtagacgtctcactatag

SEQ ID NO: 18309 - DNA, 18 bp, Artificial Sequence
  Synthetic DNA
taaaacgactcaatccag

SEQ ID NO: 18310 - DNA, 18 bp, Artificial Sequence
  Synthetic DNA
taaaactactaaatatag

SEQ ID NO: 18311 - DNA, 18 bp, Artificial Sequence
  Synthetic DNA
taaaatcactcactaaag

SEQ ID NO: 18312 - DNA, 18 bp, Artificial Sequence
  Synthetic DNA
taaagcgactgactaaag

SEQ ID NO: 18313 - DNA, 18 bp, Artificial Sequence
  Synthetic DNA
taacaagaatctctatag

SEQ ID NO: 18314 - DNA, 18 bp, Artificial Sequence
  Synthetic DNA
taacacaactgactaaag

SEQ ID NO: 18315 - DNA, 18 bp, Artificial Sequence
  Synthetic DNA
taacacgagtccctaaag

SEQ ID NO: 18316 - DNA, 18 bp, Artificial Sequence
  Synthetic DNA
taacatgtctcactacag

SEQ ID NO: 18317 - DNA, 18 bp, Artificial Sequence
  Synthetic DNA
taagacgtctaactgtag

SEQ ID NO: 18318 - DNA, 18 bp, Artificial Sequence
  Synthetic DNA
taataaaactcacagtag

SEQ ID NO: 18319 - DNA, 18 bp, Artificial Sequence
  Synthetic DNA
taataagacgctctttag

SEQ ID NO: 18320 - DNA, 18 bp, Artificial Sequence
  Synthetic DNA
taataagactttctgtag

SEQ ID NO: 18321 - DNA, 18 bp, Artificial Sequence
  Synthetic DNA
taataagattctctacag

SEQ ID NO: 18322 - DNA, 18 bp, Artificial Sequence
  Synthetic DNA
taatacagcttacaatag

SEQ ID NO: 18323 - DNA, 18 bp, Artificial Sequence
  Synthetic DNA
taataccaattagtatag

SEQ ID NO: 18324 - DNA, 18 bp, Artificial Sequence
  Synthetic DNA
taatacgactaagactag

SEQ ID NO: 18325 - DNA, 18 bp, Artificial Sequence
  Synthetic DNA
taatacgacttattaagg

SEQ ID NO: 18326 - DNA, 18 bp, Artificial Sequence
  Synthetic DNA
taatacgagacactttgg

SEQ ID NO: 18327 - DNA, 18 bp, Artificial Sequence
  Synthetic DNA
taatacgtagcactttag

SEQ ID NO: 18328 - DNA, 18 bp, Artificial Sequence
  Synthetic DNA
taatacgtatcaaaatag

SEQ ID NO: 18329 - DNA, 18 bp, Artificial Sequence
  Synthetic DNA
taatacgtcaccctacag

SEQ ID NO: 18330 - DNA, 18 bp, Artificial Sequence
  Synthetic DNA
taatacgtctcatgaaag

SEQ ID NO: 18331 - DNA, 18 bp, Artificial Sequence
  Synthetic DNA
taatacgtgttactttag

SEQ ID NO: 18332 - DNA, 18 bp, Artificial Sequence
  Synthetic DNA
taatacgttttactatgg

SEQ ID NO: 18333 - DNA, 18 bp, Artificial Sequence
  Synthetic DNA
taatactactcatcttag

SEQ ID NO: 18334 - DNA, 18 bp, Artificial Sequence
  Synthetic DNA
taatactgctatctatag

SEQ ID NO: 18335 - DNA, 18 bp, Artificial Sequence
  Synthetic DNA
taatacttctcactaggg

SEQ ID NO: 18336 - DNA, 18 bp, Artificial Sequence
  Synthetic DNA
taataggcctcacaaaag

SEQ ID NO: 18337 - DNA, 18 bp, Artificial Sequence
  Synthetic DNA
taatatgaatcataatag

SEQ ID NO: 18338 - DNA, 18 bp, Artificial Sequence
  Synthetic DNA
taatcttactaactatag

SEQ ID NO: 18339 - DNA, 18 bp, Artificial Sequence
  Synthetic DNA
taatgcgactgactgtcg

SEQ ID NO: 18340 - DNA, 18 bp, Artificial Sequence
  Synthetic DNA
tacaacgactcacaagag

SEQ ID NO: 18341 - DNA, 18 bp, Artificial Sequence
  Synthetic DNA
tacaccgactcacaatag

SEQ ID NO: 18342 - DNA, 18 bp, Artificial Sequence
  Synthetic DNA
tacgacaacacactatag

SEQ ID NO: 18343 - DNA, 18 bp, Artificial Sequence
  Synthetic DNA
tagtacttctctctatag

SEQ ID NO: 18344 - DNA, 18 bp, Artificial Sequence
  Synthetic DNA
tatagcgaatcactatag

SEQ ID NO: 18345 - DNA, 18 bp, Artificial Sequence
  Synthetic DNA
tatcacgccccactatag

SEQ ID NO: 18346 - DNA, 18 bp, Artificial Sequence
  Synthetic DNA
tatcccgactcactatcg

SEQ ID NO: 18347 - DNA, 18 bp, Artificial Sequence
  Synthetic DNA
tatgacgattcactttag

SEQ ID NO: 18348 - DNA, 18 bp, Artificial Sequence
  Synthetic DNA
tattacgaatcaatgtag

SEQ ID NO: 18349 - DNA, 18 bp, Artificial Sequence
  Synthetic DNA
tattacgacatattatag

SEQ ID NO: 18350 - DNA, 18 bp, Artificial Sequence
  Synthetic DNA
tattacgactcccttcag

SEQ ID NO: 18351 - DNA, 18 bp, Artificial Sequence
  Synthetic DNA
tattacgccacaatatag

SEQ ID NO: 18352 - DNA, 18 bp, Artificial Sequence
  Synthetic DNA
tattatgactcacgctag

SEQ ID NO: 18353 - DNA, 18 bp, Artificial Sequence
  Synthetic DNA
tcctacggctcactatcg

SEQ ID NO: 18354 - DNA, 18 bp, Artificial Sequence
  Synthetic DNA
tgagacgactcagtacag

SEQ ID NO: 18355 - DNA, 18 bp, Artificial Sequence
  Synthetic DNA
tgatacgactcaccgcag

SEQ ID NO: 18356 - DNA, 18 bp, Artificial Sequence
  Synthetic DNA
tgatacgactcagtgcag

SEQ ID NO: 18357 - DNA, 18 bp, Artificial Sequence
  Synthetic DNA
tgatacgcttcactagag

SEQ ID NO: 18358 - DNA, 18 bp, Artificial Sequence
  Synthetic DNA
tgataggacgcactatgg

SEQ ID NO: 18359 - DNA, 18 bp, Artificial Sequence
  Synthetic DNA
tgatattactcactacag

SEQ ID NO: 18360 - DNA, 18 bp, Artificial Sequence
  Synthetic DNA
tgtaacgcctcactatag

SEQ ID NO: 18361 - DNA, 18 bp, Artificial Sequence
  Synthetic DNA
tgttacgaatcactatcg

SEQ ID NO: 18362 - DNA, 18 bp, Artificial Sequence
  Synthetic DNA
tgttacggctaactatag

SEQ ID NO: 18363 - DNA, 18 bp, Artificial Sequence
  Synthetic DNA
ttaaacgactcagtagag

SEQ ID NO: 18364 - DNA, 18 bp, Artificial Sequence
  Synthetic DNA
ttacacgacacactacag

SEQ ID NO: 18365 - DNA, 18 bp, Artificial Sequence
  Synthetic DNA
ttatacagctcaccatag

SEQ ID NO: 18366 - DNA, 18 bp, Artificial Sequence
  Synthetic DNA
ttatacgcgtcattatag

SEQ ID NO: 18367 - DNA, 18 bp, Artificial Sequence
  Synthetic DNA
ttatatgactcactcaag

SEQ ID NO: 18368 - DNA, 18 bp, Artificial Sequence
  Synthetic DNA
ttatgtaactcactatag

SEQ ID NO: 18369 - DNA, 18 bp, Artificial Sequence
  Synthetic DNA
ttctacgattcaccatag

SEQ ID NO: 18370 - DNA, 18 bp, Artificial Sequence
  Synthetic DNA
ttttaagactcactacag

SEQ ID NO: 18371 - DNA, 18 bp, Artificial Sequence
  Synthetic DNA
ttaatagactcactatag

SEQ ID NO: 18372 - DNA, 18 bp, Artificial Sequence
  Synthetic DNA
taattcgactctttattg

SEQ ID NO: 18373 - DNA, 18 bp, Artificial Sequence
  Synthetic DNA
tatttcgactcgctctag

SEQ ID NO: 18374 - DNA, 18 bp, Artificial Sequence
  Synthetic DNA
taattcgactcacactgg

SEQ ID NO: 18375 - DNA, 18 bp, Artificial Sequence
  Synthetic DNA
ttatgagactcactattg

SEQ ID NO: 18376 - DNA, 18 bp, Artificial Sequence
  Synthetic DNA
ttattggtctcactatag

SEQ ID NO: 18377 - DNA, 18 bp, Artificial Sequence
  Synthetic DNA
ttttacgactcgctctag

SEQ ID NO: 18378 - DNA, 18 bp, Artificial Sequence
  Synthetic DNA
aaaaacgactctatatag

SEQ ID NO: 18379 - DNA, 18 bp, Artificial Sequence
  Synthetic DNA
aagaacaactcactatag

SEQ ID NO: 18380 - DNA, 18 bp, Artificial Sequence
  Synthetic DNA
aattgcgtctcactatag

SEQ ID NO: 18381 - DNA, 18 bp, Artificial Sequence
  Synthetic DNA
taaaaagtatcactatag

SEQ ID NO: 18382 - DNA, 18 bp, Artificial Sequence
  Synthetic DNA
taatacgagtatctatgg

SEQ ID NO: 18383 - DNA, 18 bp, Artificial Sequence
  Synthetic DNA
tacaacgattcactacag

SEQ ID NO: 18384 - DNA, 18 bp, Artificial Sequence
  Synthetic DNA
tgacccgactcacaatag

SEQ ID NO: 18385 - DNA, 18 bp, Artificial Sequence
  Synthetic DNA
tgataaggctcactatgg

SEQ ID NO: 18386 - DNA, 18 bp, Artificial Sequence
  Synthetic DNA
ttataagactcacttcag

SEQ ID NO: 18387 - DNA, 18 bp, Artificial Sequence
  Synthetic DNA
ttatacgaatctatatag

SEQ ID NO: 18388 - DNA, 18 bp, Artificial Sequence
  Synthetic DNA
ttatgcgactcaataaag

SEQ ID NO: 18389 - DNA, 18 bp, Artificial Sequence
  Synthetic DNA
tattccaactcactctag

SEQ ID NO: 18390 - DNA, 18 bp, Artificial Sequence
  Synthetic DNA
taattagactcactgttg

SEQ ID NO: 18391 - DNA, 18 bp, Artificial Sequence
  Synthetic DNA
taattcgactcgacatag

SEQ ID NO: 18392 - DNA, 18 bp, Artificial Sequence
  Synthetic DNA
taattcggatcactattg

SEQ ID NO: 18393 - DNA, 18 bp, Artificial Sequence
  Synthetic DNA
caaaactactcactattg

SEQ ID NO: 18394 - DNA, 18 bp, Artificial Sequence
  Synthetic DNA
tatttcgactgcctatag

SEQ ID NO: 18395 - DNA, 18 bp, Artificial Sequence
  Synthetic DNA
tttttcgactcactctag

SEQ ID NO: 18396 - DNA, 18 bp, Artificial Sequence
  Synthetic DNA
aaaaaggactcactgtag

SEQ ID NO: 18397 - DNA, 18 bp, Artificial Sequence
  Synthetic DNA
atataggactcactctag

SEQ ID NO: 18398 - DNA, 18 bp, Artificial Sequence
  Synthetic DNA
caatatgacagactatag

SEQ ID NO: 18399 - DNA, 18 bp, Artificial Sequence
  Synthetic DNA
taaaacgactcataatcg

SEQ ID NO: 18400 - DNA, 18 bp, Artificial Sequence
  Synthetic DNA
taatacgaataaatttag

SEQ ID NO: 18401 - DNA, 18 bp, Artificial Sequence
  Synthetic DNA
tcatacgtctccctttag

SEQ ID NO: 18402 - DNA, 18 bp, Artificial Sequence
  Synthetic DNA
tgaaacgtctcactctag

SEQ ID NO: 18403 - DNA, 18 bp, Artificial Sequence
  Synthetic DNA
ttttacgtctcactagag

SEQ ID NO: 18404 - DNA, 18 bp, Artificial Sequence
  Synthetic DNA
ttatacgtctcacttaag

SEQ ID NO: 18405 - DNA, 18 bp, Artificial Sequence
  Synthetic DNA
taattcggcacactttag

SEQ ID NO: 18406 - DNA, 18 bp, Artificial Sequence
  Synthetic DNA
ctttacgtctcactatag

SEQ ID NO: 18407 - DNA, 18 bp, Artificial Sequence
  Synthetic DNA
taatacgactttcttaag

SEQ ID NO: 18408 - DNA, 18 bp, Artificial Sequence
  Synthetic DNA
ttaaacgactcacttaag

SEQ ID NO: 18409 - DNA, 18 bp, Artificial Sequence
  Synthetic DNA
taaatagactcactctag

SEQ ID NO: 18410 - DNA, 18 bp, Artificial Sequence
  Synthetic DNA
aagtacgactaactttag

SEQ ID NO: 18411 - DNA, 18 bp, Artificial Sequence
  Synthetic DNA
taataaaactcacttaag

SEQ ID NO: 18412 - DNA, 18 bp, Artificial Sequence
  Synthetic DNA
taaatcgtctcactattg

SEQ ID NO: 18413 - DNA, 18 bp, Artificial Sequence
  Synthetic DNA
taattcgactagctaaag

SEQ ID NO: 18414 - DNA, 18 bp, Artificial Sequence
  Synthetic DNA
ttatacgactagctattg

SEQ ID NO: 18415 - DNA, 18 bp, Artificial Sequence
  Synthetic DNA
ttattcgcctcgctatag

SEQ ID NO: 18416 - DNA, 18 bp, Artificial Sequence
  Synthetic DNA
atatacaactcgctatag

SEQ ID NO: 18417 - DNA, 18 bp, Artificial Sequence
  Synthetic DNA
gatttcgactcactaaag

SEQ ID NO: 18418 - DNA, 18 bp, Artificial Sequence
  Synthetic DNA
taaatcccctcactatag

SEQ ID NO: 18419 - DNA, 18 bp, Artificial Sequence
  Synthetic DNA
taatacgactcaattatg

SEQ ID NO: 18420 - DNA, 18 bp, Artificial Sequence
  Synthetic DNA
taattctactcactttgg

SEQ ID NO: 18421 - DNA, 18 bp, Artificial Sequence
  Synthetic DNA
tgtttcgcctcactatag

SEQ ID NO: 18422 - DNA, 18 bp, Artificial Sequence
  Synthetic DNA
ttatacgactcactgatg

SEQ ID NO: 18423 - DNA, 18 bp, Artificial Sequence
  Synthetic DNA
aaatacgacttaccctag

SEQ ID NO: 18424 - DNA, 18 bp, Artificial Sequence
  Synthetic DNA
aaatacggttcattatag

SEQ ID NO: 18425 - DNA, 18 bp, Artificial Sequence
  Synthetic DNA
taaaacgagtcacagtag

SEQ ID NO: 18426 - DNA, 18 bp, Artificial Sequence
  Synthetic DNA
taaaacggatcacaatag

SEQ ID NO: 18427 - DNA, 18 bp, Artificial Sequence
  Synthetic DNA
taacaccactcaaaatag

SEQ ID NO: 18428 - DNA, 18 bp, Artificial Sequence
  Synthetic DNA
taacataactcattatag

SEQ ID NO: 18429 - DNA, 18 bp, Artificial Sequence
  Synthetic DNA
taatacgacattccatag

SEQ ID NO: 18430 - DNA, 18 bp, Artificial Sequence
  Synthetic DNA
taatgcgtctcaataaag

SEQ ID NO: 18431 - DNA, 18 bp, Artificial Sequence
  Synthetic DNA
tataatgactcaatatag

SEQ ID NO: 18432 - DNA, 18 bp, Artificial Sequence
  Synthetic DNA
tattacgagacactaaag

SEQ ID NO: 18433 - DNA, 18 bp, Artificial Sequence
  Synthetic DNA
tattacgtctctctacag

SEQ ID NO: 18434 - DNA, 18 bp, Artificial Sequence
  Synthetic DNA
tattgcgtctcactctag

SEQ ID NO: 18435 - DNA, 18 bp, Artificial Sequence
  Synthetic DNA
ttataagatacactatag

SEQ ID NO: 18436 - DNA, 18 bp, Artificial Sequence
  Synthetic DNA
ttgtacgtctcactaaag

SEQ ID NO: 18437 - DNA, 18 bp, Artificial Sequence
  Synthetic DNA
aaaaacgactcgctattg

SEQ ID NO: 18438 - DNA, 18 bp, Artificial Sequence
  Synthetic DNA
aaattcgactcactcttg

SEQ ID NO: 18439 - DNA, 18 bp, Artificial Sequence
  Synthetic DNA
atatacgactcgctattg

SEQ ID NO: 18440 - DNA, 18 bp, Artificial Sequence
  Synthetic DNA
caattcgactcgatatag

SEQ ID NO: 18441 - DNA, 18 bp, Artificial Sequence
  Synthetic DNA
taaaacgactcgctgttg

SEQ ID NO: 18442 - DNA, 18 bp, Artificial Sequence
  Synthetic DNA
taacatgactcgctattg

SEQ ID NO: 18443 - DNA, 18 bp, Artificial Sequence
  Synthetic DNA
taactcgacccactattg

SEQ ID NO: 18444 - DNA, 18 bp, Artificial Sequence
  Synthetic DNA
taataagactcgctaatg

SEQ ID NO: 18445 - DNA, 18 bp, Artificial Sequence
  Synthetic DNA
taatacaactcgttattg

SEQ ID NO: 18446 - DNA, 18 bp, Artificial Sequence
  Synthetic DNA
taatacgactcgcttatg

SEQ ID NO: 18447 - DNA, 18 bp, Artificial Sequence
  Synthetic DNA
taatacggctcgcttttg

SEQ ID NO: 18448 - DNA, 18 bp, Artificial Sequence
  Synthetic DNA
taattagactcactagtg

SEQ ID NO: 18449 - DNA, 18 bp, Artificial Sequence
  Synthetic DNA
taattagactcgctctag

SEQ ID NO: 18450 - DNA, 18 bp, Artificial Sequence
  Synthetic DNA
taattagacttgctatag

SEQ ID NO: 18451 - DNA, 18 bp, Artificial Sequence
  Synthetic DNA
taattcgaccgactattg

SEQ ID NO: 18452 - DNA, 18 bp, Artificial Sequence
  Synthetic DNA
taattcgattcgctacag

SEQ ID NO: 18453 - DNA, 18 bp, Artificial Sequence
  Synthetic DNA
taattcgccacgctatag

SEQ ID NO: 18454 - DNA, 18 bp, Artificial Sequence
  Synthetic DNA
tacttcgactcgctttag

SEQ ID NO: 18455 - DNA, 18 bp, Artificial Sequence
  Synthetic DNA
tatttcgactcgatatag

SEQ ID NO: 18456 - DNA, 18 bp, Artificial Sequence
  Synthetic DNA
tcattcgactcgctatcg

SEQ ID NO: 18457 - DNA, 18 bp, Artificial Sequence
  Synthetic DNA
tcattcgacttactattg

SEQ ID NO: 18458 - DNA, 18 bp, Artificial Sequence
  Synthetic DNA
tcattcgacttgctatag

SEQ ID NO: 18459 - DNA, 18 bp, Artificial Sequence
  Synthetic DNA
ttatacgactcgctatta

SEQ ID NO: 18460 - DNA, 18 bp, Artificial Sequence
  Synthetic DNA
ttgtacgactcgctattg

SEQ ID NO: 18461 - DNA, 18 bp, Artificial Sequence
  Synthetic DNA
aaagacgactcattattg

SEQ ID NO: 18462 - DNA, 18 bp, Artificial Sequence
  Synthetic DNA
aaatacgactgattattg

SEQ ID NO: 18463 - DNA, 18 bp, Artificial Sequence
  Synthetic DNA
aaatacgcttcgctatag

SEQ ID NO: 18464 - DNA, 18 bp, Artificial Sequence
  Synthetic DNA
aaatacgtctcgcgatag

SEQ ID NO: 18465 - DNA, 18 bp, Artificial Sequence
  Synthetic DNA
aaataggaatcactattg

SEQ ID NO: 18466 - DNA, 18 bp, Artificial Sequence
  Synthetic DNA
aaattcggctaactatag

SEQ ID NO: 18467 - DNA, 18 bp, Artificial Sequence
  Synthetic DNA
aagtacgactcagtattg

SEQ ID NO: 18468 - DNA, 18 bp, Artificial Sequence
  Synthetic DNA
acatactactcgctatag

SEQ ID NO: 18469 - DNA, 18 bp, Artificial Sequence
  Synthetic DNA
agattcgactcattatag

SEQ ID NO: 18470 - DNA, 18 bp, Artificial Sequence
  Synthetic DNA
atatacgactggctatag

SEQ ID NO: 18471 - DNA, 18 bp, Artificial Sequence
  Synthetic DNA
atattcgactcactatcg

SEQ ID NO: 18472 - DNA, 18 bp, Artificial Sequence
  Synthetic DNA
caaaacgagtcactattg

SEQ ID NO: 18473 - DNA, 18 bp, Artificial Sequence
  Synthetic DNA
caaatcgactgactatag

SEQ ID NO: 18474 - DNA, 18 bp, Artificial Sequence
  Synthetic DNA
caagacgactcacaattg

SEQ ID NO: 18475 - DNA, 18 bp, Artificial Sequence
  Synthetic DNA
caataccactcgctatcg

SEQ ID NO: 18476 - DNA, 18 bp, Artificial Sequence
  Synthetic DNA
caatacctctcgctatag

SEQ ID NO: 18477 - DNA, 18 bp, Artificial Sequence
  Synthetic DNA
caataggactaactattg

SEQ ID NO: 18478 - DNA, 18 bp, Artificial Sequence
  Synthetic DNA
caataggactcgctttag

SEQ ID NO: 18479 - DNA, 18 bp, Artificial Sequence
  Synthetic DNA
caatgcgaatcactattg

SEQ ID NO: 18480 - DNA, 18 bp, Artificial Sequence
  Synthetic DNA
caattcggctcacaatag

SEQ ID NO: 18481 - DNA, 18 bp, Artificial Sequence
  Synthetic DNA
caattcgtctcaccatag

SEQ ID NO: 18482 - DNA, 18 bp, Artificial Sequence
  Synthetic DNA
caatttgactaactatag

SEQ ID NO: 18483 - DNA, 18 bp, Artificial Sequence
  Synthetic DNA
cacttcgacacactatag

SEQ ID NO: 18484 - DNA, 18 bp, Artificial Sequence
  Synthetic DNA
ctatacgaatcactattg

SEQ ID NO: 18485 - DNA, 18 bp, Artificial Sequence
  Synthetic DNA
ctatacgactcgctaaag

SEQ ID NO: 18486 - DNA, 18 bp, Artificial Sequence
  Synthetic DNA
gaaaactactcactattg

SEQ ID NO: 18487 - DNA, 18 bp, Artificial Sequence
  Synthetic DNA
gaactcgactcactaaag

SEQ ID NO: 18488 - DNA, 18 bp, Artificial Sequence
  Synthetic DNA
gaatatcactcactattg

SEQ ID NO: 18489 - DNA, 18 bp, Artificial Sequence
  Synthetic DNA
gaattccactaactatag

SEQ ID NO: 18490 - DNA, 18 bp, Artificial Sequence
  Synthetic DNA
gaattcgagtcactgtag

SEQ ID NO: 18491 - DNA, 18 bp, Artificial Sequence
  Synthetic DNA
gcattcgacacactatag

SEQ ID NO: 18492 - DNA, 18 bp, Artificial Sequence
  Synthetic DNA
taaaacaactcgctttag

SEQ ID NO: 18493 - DNA, 18 bp, Artificial Sequence
  Synthetic DNA
taaaacgactagctctag

SEQ ID NO: 18494 - DNA, 18 bp, Artificial Sequence
  Synthetic DNA
taaaacgactctccattg

SEQ ID NO: 18495 - DNA, 18 bp, Artificial Sequence
  Synthetic DNA
taaaactactcactactg

SEQ ID NO: 18496 - DNA, 18 bp, Artificial Sequence
  Synthetic DNA
taaaccgactcactatta

SEQ ID NO: 18497 - DNA, 18 bp, Artificial Sequence
  Synthetic DNA
taaaccgactcagtattg

SEQ ID NO: 18498 - DNA, 18 bp, Artificial Sequence
  Synthetic DNA
taaatcgaatcaccatag

SEQ ID NO: 18499 - DNA, 18 bp, Artificial Sequence
  Synthetic DNA
taaatcgattccctatag

SEQ ID NO: 18500 - DNA, 18 bp, Artificial Sequence
  Synthetic DNA
taaatcgcctcactatcg

SEQ ID NO: 18501 - DNA, 18 bp, Artificial Sequence
  Synthetic DNA
taaattgacgcactatag

SEQ ID NO: 18502 - DNA, 18 bp, Artificial Sequence
  Synthetic DNA
taacaagactcgctaaag

SEQ ID NO: 18503 - DNA, 18 bp, Artificial Sequence
  Synthetic DNA
taacactactcactcttg

SEQ ID NO: 18504 - DNA, 18 bp, Artificial Sequence
  Synthetic DNA
taactcccctcactatag

SEQ ID NO: 18505 - DNA, 18 bp, Artificial Sequence
  Synthetic DNA
taactcgactcataatag

SEQ ID NO: 18506 - DNA, 18 bp, Artificial Sequence
  Synthetic DNA
taactcgactctccatag

SEQ ID NO: 18507 - DNA, 18 bp, Artificial Sequence
  Synthetic DNA
taacttgactcactaaag

SEQ ID NO: 18508 - DNA, 18 bp, Artificial Sequence
  Synthetic DNA
taagacgacacactagtg

SEQ ID NO: 18509 - DNA, 18 bp, Artificial Sequence
  Synthetic DNA
taagacgagtcattattg

SEQ ID NO: 18510 - DNA, 18 bp, Artificial Sequence
  Synthetic DNA
taagactactcgcaatag

SEQ ID NO: 18511 - DNA, 18 bp, Artificial Sequence
  Synthetic DNA
taataaaactcactactg

SEQ ID NO: 18512 - DNA, 18 bp, Artificial Sequence
  Synthetic DNA
taataagacacgctctag

SEQ ID NO: 18513 - DNA, 18 bp, Artificial Sequence
  Synthetic DNA
taataagactccgtattg

SEQ ID NO: 18514 - DNA, 18 bp, Artificial Sequence
  Synthetic DNA
taataagactcgctaacg

SEQ ID NO: 18515 - DNA, 18 bp, Artificial Sequence
  Synthetic DNA
taataagagtcgctatcg

SEQ ID NO: 18516 - DNA, 18 bp, Artificial Sequence
  Synthetic DNA
taataatacacgctatag

SEQ ID NO: 18517 - DNA, 18 bp, Artificial Sequence
  Synthetic DNA
taatacaacacgctgtag

SEQ ID NO: 18518 - DNA, 18 bp, Artificial Sequence
  Synthetic DNA
taatacaacgctctattg

SEQ ID NO: 18519 - DNA, 18 bp, Artificial Sequence
  Synthetic DNA
taatacaactcacgtttg

SEQ ID NO: 18520 - DNA, 18 bp, Artificial Sequence
  Synthetic DNA
taatacacctcactactg

SEQ ID NO: 18521 - DNA, 18 bp, Artificial Sequence
  Synthetic DNA
taataccaatcacgattg

SEQ ID NO: 18522 - DNA, 18 bp, Artificial Sequence
  Synthetic DNA
taataccaccctctattg

SEQ ID NO: 18523 - DNA, 18 bp, Artificial Sequence
  Synthetic DNA
taataccactccctgttg

SEQ ID NO: 18524 - DNA, 18 bp, Artificial Sequence
  Synthetic DNA
taatacgaaaccctattg

SEQ ID NO: 18525 - DNA, 18 bp, Artificial Sequence
  Synthetic DNA
taatacgacacactgctg

SEQ ID NO: 18526 - DNA, 18 bp, Artificial Sequence
  Synthetic DNA
taatacgacacagtaatg

SEQ ID NO: 18527 - DNA, 18 bp, Artificial Sequence
  Synthetic DNA
taatacgacacgatgtag

SEQ ID NO: 18528 - DNA, 18 bp, Artificial Sequence
  Synthetic DNA
taatacgacagacgattg

SEQ ID NO: 18529 - DNA, 18 bp, Artificial Sequence
  Synthetic DNA
taatacgacccactcatg

SEQ ID NO: 18530 - DNA, 18 bp, Artificial Sequence
  Synthetic DNA
taatacgacgctatattg

SEQ ID NO: 18531 - DNA, 18 bp, Artificial Sequence
  Synthetic DNA
taatacgacgtaatattg

SEQ ID NO: 18532 - DNA, 18 bp, Artificial Sequence
  Synthetic DNA
taatacgactaacttctg

SEQ ID NO: 18533 - DNA, 18 bp, Artificial Sequence
  Synthetic DNA
taatacgactagatacag

SEQ ID NO: 18534 - DNA, 18 bp, Artificial Sequence
  Synthetic DNA
taatacgactaggtgtag

SEQ ID NO: 18535 - DNA, 18 bp, Artificial Sequence
  Synthetic DNA
taatacgactagttatgg

SEQ ID NO: 18536 - DNA, 18 bp, Artificial Sequence
  Synthetic DNA
taatacgactcagtcatg

SEQ ID NO: 18537 - DNA, 18 bp, Artificial Sequence
  Synthetic DNA
taatacgactctccagtg

SEQ ID NO: 18538 - DNA, 18 bp, Artificial Sequence
  Synthetic DNA
taatacgactgcatattg

SEQ ID NO: 18539 - DNA, 18 bp, Artificial Sequence
  Synthetic DNA
taatacgacttgctcaag

SEQ ID NO: 18540 - DNA, 18 bp, Artificial Sequence
  Synthetic DNA
taatacgagacattattg

SEQ ID NO: 18541 - DNA, 18 bp, Artificial Sequence
  Synthetic DNA
taatacgagtttctattg

SEQ ID NO: 18542 - DNA, 18 bp, Artificial Sequence
  Synthetic DNA
taatacgattagcaatag

SEQ ID NO: 18543 - DNA, 18 bp, Artificial Sequence
  Synthetic DNA
taatacgattcacttctg

SEQ ID NO: 18544 - DNA, 18 bp, Artificial Sequence
  Synthetic DNA
taatacgattcgatatcg

SEQ ID NO: 18545 - DNA, 18 bp, Artificial Sequence
  Synthetic DNA
taatacgcgtcagtattg

SEQ ID NO: 18546 - DNA, 18 bp, Artificial Sequence
  Synthetic DNA
taatacgtctcgctccag

SEQ ID NO: 18547 - DNA, 18 bp, Artificial Sequence
  Synthetic DNA
taatacgtgtaactattg

SEQ ID NO: 18548 - DNA, 18 bp, Artificial Sequence
  Synthetic DNA
taatacgtgtcactcttg

SEQ ID NO: 18549 - DNA, 18 bp, Artificial Sequence
  Synthetic DNA
taatactaccgactattg

SEQ ID NO: 18550 - DNA, 18 bp, Artificial Sequence
  Synthetic DNA
taatactacgcgccatag

SEQ ID NO: 18551 - DNA, 18 bp, Artificial Sequence
  Synthetic DNA
taatactactcagaattg

SEQ ID NO: 18552 - DNA, 18 bp, Artificial Sequence
  Synthetic DNA
taatactactccctgttg

SEQ ID NO: 18553 - DNA, 18 bp, Artificial Sequence
  Synthetic DNA
taatactactcgatctag

SEQ ID NO: 18554 - DNA, 18 bp, Artificial Sequence
  Synthetic DNA
taatactattcattattg

SEQ ID NO: 18555 - DNA, 18 bp, Artificial Sequence
  Synthetic DNA
taatactgctcaccattg

SEQ ID NO: 18556 - DNA, 18 bp, Artificial Sequence
  Synthetic DNA
taataggactcattaatg

SEQ ID NO: 18557 - DNA, 18 bp, Artificial Sequence
  Synthetic DNA
taatatgactagctacag

SEQ ID NO: 18558 - DNA, 18 bp, Artificial Sequence
  Synthetic DNA
taatatgactcgttacag

SEQ ID NO: 18559 - DNA, 18 bp, Artificial Sequence
  Synthetic DNA
taatatgacttactgttg

SEQ ID NO: 18560 - DNA, 18 bp, Artificial Sequence
  Synthetic DNA
taatatgattcacgattg

SEQ ID NO: 18561 - DNA, 18 bp, Artificial Sequence
  Synthetic DNA
taatatgtctcacgattg

SEQ ID NO: 18562 - DNA, 18 bp, Artificial Sequence
  Synthetic DNA
taatccaactggctatag

SEQ ID NO: 18563 - DNA, 18 bp, Artificial Sequence
  Synthetic DNA
taatccgactcccttttg

SEQ ID NO: 18564 - DNA, 18 bp, Artificial Sequence
  Synthetic DNA
taatccgacttacgattg

SEQ ID NO: 18565 - DNA, 18 bp, Artificial Sequence
  Synthetic DNA
taatcttactcgctatag

SEQ ID NO: 18566 - DNA, 18 bp, Artificial Sequence
  Synthetic DNA
taatgcgacgctctattg

SEQ ID NO: 18567 - DNA, 18 bp, Artificial Sequence
  Synthetic DNA
taatgctactaactattg

SEQ ID NO: 18568 - DNA, 18 bp, Artificial Sequence
  Synthetic DNA
taatgggactcacaattg

SEQ ID NO: 18569 - DNA, 18 bp, Artificial Sequence
  Synthetic DNA
taattagaaacactatag

SEQ ID NO: 18570 - DNA, 18 bp, Artificial Sequence
  Synthetic DNA
taattagactcattgtag

SEQ ID NO: 18571 - DNA, 18 bp, Artificial Sequence
  Synthetic DNA
taattaggctcaccatag

SEQ ID NO: 18572 - DNA, 18 bp, Artificial Sequence
  Synthetic DNA
taattcaactcacgagag

SEQ ID NO: 18573 - DNA, 18 bp, Artificial Sequence
  Synthetic DNA
taattcaactcacgatcg

SEQ ID NO: 18574 - DNA, 18 bp, Artificial Sequence
  Synthetic DNA
taattccactctccatag

SEQ ID NO: 18575 - DNA, 18 bp, Artificial Sequence
  Synthetic DNA
taattcgaataaatatag

SEQ ID NO: 18576 - DNA, 18 bp, Artificial Sequence
  Synthetic DNA
taattcgacaaaatatag

SEQ ID NO: 18577 - DNA, 18 bp, Artificial Sequence
  Synthetic DNA
taattcgacccactaacg

SEQ ID NO: 18578 - DNA, 18 bp, Artificial Sequence
  Synthetic DNA
taattcgaccgactttag

SEQ ID NO: 18579 - DNA, 18 bp, Artificial Sequence
  Synthetic DNA
taattcgactcatcatgg

SEQ ID NO: 18580 - DNA, 18 bp, Artificial Sequence
  Synthetic DNA
taattcgactcatgaaag

SEQ ID NO: 18581 - DNA, 18 bp, Artificial Sequence
  Synthetic DNA
taattcgactctatatgg

SEQ ID NO: 18582 - DNA, 18 bp, Artificial Sequence
  Synthetic DNA
taattcgactctgaatag

SEQ ID NO: 18583 - DNA, 18 bp, Artificial Sequence
  Synthetic DNA
taattcgactctttatcg

SEQ ID NO: 18584 - DNA, 18 bp, Artificial Sequence
  Synthetic DNA
taattcgacttagcatag

SEQ ID NO: 18585 - DNA, 18 bp, Artificial Sequence
  Synthetic DNA
taattcgggacactatag

SEQ ID NO: 18586 - DNA, 18 bp, Artificial Sequence
  Synthetic DNA
taattcgtctcactcaag

SEQ ID NO: 18587 - DNA, 18 bp, Artificial Sequence
  Synthetic DNA
taattcgtgccactatag

SEQ ID NO: 18588 - DNA, 18 bp, Artificial Sequence
  Synthetic DNA
taattctattaactatag

SEQ ID NO: 18589 - DNA, 18 bp, Artificial Sequence
  Synthetic DNA
taattctgctcactatgg

SEQ ID NO: 18590 - DNA, 18 bp, Artificial Sequence
  Synthetic DNA
taattggactcacaagag

SEQ ID NO: 18591 - DNA, 18 bp, Artificial Sequence
  Synthetic DNA
taattggactcactgaag

SEQ ID NO: 18592 - DNA, 18 bp, Artificial Sequence
  Synthetic DNA
taattggacttacaatag

SEQ ID NO: 18593 - DNA, 18 bp, Artificial Sequence
  Synthetic DNA
taatttgacccactctag

SEQ ID NO: 18594 - DNA, 18 bp, Artificial Sequence
  Synthetic DNA
tacaacgactcactcttg

SEQ ID NO: 18595 - DNA, 18 bp, Artificial Sequence
  Synthetic DNA
tacaacgactcgccatag

SEQ ID NO: 18596 - DNA, 18 bp, Artificial Sequence
  Synthetic DNA
tacagcgactcgctatag

SEQ ID NO: 18597 - DNA, 18 bp, Artificial Sequence
  Synthetic DNA
tacctcgacacactatag

SEQ ID NO: 18598 - DNA, 18 bp, Artificial Sequence
  Synthetic DNA
tactacgactcccaattg

SEQ ID NO: 18599 - DNA, 18 bp, Artificial Sequence
  Synthetic DNA
tactacgactcgcaacag

SEQ ID NO: 18600 - DNA, 18 bp, Artificial Sequence
  Synthetic DNA
tactacgactcgtcatag

SEQ ID NO: 18601 - DNA, 18 bp, Artificial Sequence
  Synthetic DNA
tactactactccctattg

SEQ ID NO: 18602 - DNA, 18 bp, Artificial Sequence
  Synthetic DNA
tactaggactcgctacag

SEQ ID NO: 18603 - DNA, 18 bp, Artificial Sequence
  Synthetic DNA
tactatgcctcactattg

SEQ ID NO: 18604 - DNA, 18 bp, Artificial Sequence
  Synthetic DNA
tacttcgactctctgtag

SEQ ID NO: 18605 - DNA, 18 bp, Artificial Sequence
  Synthetic DNA
tagctcgactcattatag

SEQ ID NO: 18606 - DNA, 18 bp, Artificial Sequence
  Synthetic DNA
tagtacaacccgctatag

SEQ ID NO: 18607 - DNA, 18 bp, Artificial Sequence
  Synthetic DNA
tagtacgaatcgctaaag

SEQ ID NO: 18608 - DNA, 18 bp, Artificial Sequence
  Synthetic DNA
tagtacgactcaatactg

SEQ ID NO: 18609 - DNA, 18 bp, Artificial Sequence
  Synthetic DNA
tagtacgtctcgctttag

SEQ ID NO: 18610 - DNA, 18 bp, Artificial Sequence
  Synthetic DNA
tagtacgtctctctattg

SEQ ID NO: 18611 - DNA, 18 bp, Artificial Sequence
  Synthetic DNA
tagtatgactctctattg

SEQ ID NO: 18612 - DNA, 18 bp, Artificial Sequence
  Synthetic DNA
tagtccgactcattattg

SEQ ID NO: 18613 - DNA, 18 bp, Artificial Sequence
  Synthetic DNA
tagttagtctcactatag

SEQ ID NO: 18614 - DNA, 18 bp, Artificial Sequence
  Synthetic DNA
tagttcgactaacaatag

SEQ ID NO: 18615 - DNA, 18 bp, Artificial Sequence
  Synthetic DNA
tagttcgactcaccgtag

SEQ ID NO: 18616 - DNA, 18 bp, Artificial Sequence
  Synthetic DNA
tagttcgattcagtatag

SEQ ID NO: 18617 - DNA, 18 bp, Artificial Sequence
  Synthetic DNA
tagttcgatttactatag

SEQ ID NO: 18618 - DNA, 18 bp, Artificial Sequence
  Synthetic DNA
tataacgactcactaatg

SEQ ID NO: 18619 - DNA, 18 bp, Artificial Sequence
  Synthetic DNA
tattacaacttgctatag

SEQ ID NO: 18620 - DNA, 18 bp, Artificial Sequence
  Synthetic DNA
tattaccactcgctaaag

SEQ ID NO: 18621 - DNA, 18 bp, Artificial Sequence
  Synthetic DNA
tattacgaatcgcaatag

SEQ ID NO: 18622 - DNA, 18 bp, Artificial Sequence
  Synthetic DNA
tattacgacccaccattg

SEQ ID NO: 18623 - DNA, 18 bp, Artificial Sequence
  Synthetic DNA
tattacgactcacgactg

SEQ ID NO: 18624 - DNA, 18 bp, Artificial Sequence
  Synthetic DNA
tattacgactcgataaag

SEQ ID NO: 18625 - DNA, 18 bp, Artificial Sequence
  Synthetic DNA
tattacgaggcactattg

SEQ ID NO: 18626 - DNA, 18 bp, Artificial Sequence
  Synthetic DNA
tattacggctcgccatag

SEQ ID NO: 18627 - DNA, 18 bp, Artificial Sequence
  Synthetic DNA
tattactacccactattg

SEQ ID NO: 18628 - DNA, 18 bp, Artificial Sequence
  Synthetic DNA
tattatgattcgctatag

SEQ ID NO: 18629 - DNA, 18 bp, Artificial Sequence
  Synthetic DNA
tattgcgagtcactattg

SEQ ID NO: 18630 - DNA, 18 bp, Artificial Sequence
  Synthetic DNA
tattgggactcactattg

SEQ ID NO: 18631 - DNA, 18 bp, Artificial Sequence
  Synthetic DNA
tattgtgactcactattg

SEQ ID NO: 18632 - DNA, 18 bp, Artificial Sequence
  Synthetic DNA
tatttagactgactatag

SEQ ID NO: 18633 - DNA, 18 bp, Artificial Sequence
  Synthetic DNA
tatttcgactcactttcg

SEQ ID NO: 18634 - DNA, 18 bp, Artificial Sequence
  Synthetic DNA
tatttcgactccctatcg

SEQ ID NO: 18635 - DNA, 18 bp, Artificial Sequence
  Synthetic DNA
tatttcgactgaatatag

SEQ ID NO: 18636 - DNA, 18 bp, Artificial Sequence
  Synthetic DNA
tatttcggctgactatag

SEQ ID NO: 18637 - DNA, 18 bp, Artificial Sequence
  Synthetic DNA
tatttcgtctcactaaag

SEQ ID NO: 18638 - DNA, 18 bp, Artificial Sequence
  Synthetic DNA
tcaatcgactcactatgg

SEQ ID NO: 18639 - DNA, 18 bp, Artificial Sequence
  Synthetic DNA
tcatacgactcattaatg

SEQ ID NO: 18640 - DNA, 18 bp, Artificial Sequence
  Synthetic DNA
tcatcctactcactattg

SEQ ID NO: 18641 - DNA, 18 bp, Artificial Sequence
  Synthetic DNA
tcatgcgactcagtattg

SEQ ID NO: 18642 - DNA, 18 bp, Artificial Sequence
  Synthetic DNA
tcatgcgactcgctctag

SEQ ID NO: 18643 - DNA, 18 bp, Artificial Sequence
  Synthetic DNA
tcattcgaatcactacag

SEQ ID NO: 18644 - DNA, 18 bp, Artificial Sequence
  Synthetic DNA
tcattcgagtaactatag

SEQ ID NO: 18645 - DNA, 18 bp, Artificial Sequence
  Synthetic DNA
tcattctcctcactatag

SEQ ID NO: 18646 - DNA, 18 bp, Artificial Sequence
  Synthetic DNA
tcattggactcaatatag

SEQ ID NO: 18647 - DNA, 18 bp, Artificial Sequence
  Synthetic DNA
tccttcaactcactatag

SEQ ID NO: 18648 - DNA, 18 bp, Artificial Sequence
  Synthetic DNA
tcgttcgactcactaaag

SEQ ID NO: 18649 - DNA, 18 bp, Artificial Sequence
  Synthetic DNA
tgaaacgacttactattg

SEQ ID NO: 18650 - DNA, 18 bp, Artificial Sequence
  Synthetic DNA
tgaatcgactcagtatag

SEQ ID NO: 18651 - DNA, 18 bp, Artificial Sequence
  Synthetic DNA
tgaatcgattcactatag

SEQ ID NO: 18652 - DNA, 18 bp, Artificial Sequence
  Synthetic DNA
tgacaccactcactattg

SEQ ID NO: 18653 - DNA, 18 bp, Artificial Sequence
  Synthetic DNA
tgactcgactcagtatag

SEQ ID NO: 18654 - DNA, 18 bp, Artificial Sequence
  Synthetic DNA
tgataagcctcactattg

SEQ ID NO: 18655 - DNA, 18 bp, Artificial Sequence
  Synthetic DNA
tgatacgactctctgttg

SEQ ID NO: 18656 - DNA, 18 bp, Artificial Sequence
  Synthetic DNA
tgatgagactcactattg

SEQ ID NO: 18657 - DNA, 18 bp, Artificial Sequence
  Synthetic DNA
tgatgcgactaactattg

SEQ ID NO: 18658 - DNA, 18 bp, Artificial Sequence
  Synthetic DNA
tgattcaacgcactatag

SEQ ID NO: 18659 - DNA, 18 bp, Artificial Sequence
  Synthetic DNA
tgattcgaatctctatag

SEQ ID NO: 18660 - DNA, 18 bp, Artificial Sequence
  Synthetic DNA
tgattcgactaactatcg

SEQ ID NO: 18661 - DNA, 18 bp, Artificial Sequence
  Synthetic DNA
tgattcgacttaccatag

SEQ ID NO: 18662 - DNA, 18 bp, Artificial Sequence
  Synthetic DNA
tgattcgcatcactatag

SEQ ID NO: 18663 - DNA, 18 bp, Artificial Sequence
  Synthetic DNA
tgattggactcattatag

SEQ ID NO: 18664 - DNA, 18 bp, Artificial Sequence
  Synthetic DNA
tggtacgacccactattg

SEQ ID NO: 18665 - DNA, 18 bp, Artificial Sequence
  Synthetic DNA
ttaaaccactcactattg

SEQ ID NO: 18666 - DNA, 18 bp, Artificial Sequence
  Synthetic DNA
ttaaactactcgctatag

SEQ ID NO: 18667 - DNA, 18 bp, Artificial Sequence
  Synthetic DNA
ttaatcgactcactttag

SEQ ID NO: 18668 - DNA, 18 bp, Artificial Sequence
  Synthetic DNA
ttataagactcaatattg

SEQ ID NO: 18669 - DNA, 18 bp, Artificial Sequence
  Synthetic DNA
ttataccgctcactattg

SEQ ID NO: 18670 - DNA, 18 bp, Artificial Sequence
  Synthetic DNA
ttatacgaatcgatatag

SEQ ID NO: 18671 - DNA, 18 bp, Artificial Sequence
  Synthetic DNA
ttatacgaatcgttatag

SEQ ID NO: 18672 - DNA, 18 bp, Artificial Sequence
  Synthetic DNA
ttatacgactcattagtg

SEQ ID NO: 18673 - DNA, 18 bp, Artificial Sequence
  Synthetic DNA
ttatacgactcgccttag

SEQ ID NO: 18674 - DNA, 18 bp, Artificial Sequence
  Synthetic DNA
ttatacgcctagctatag

SEQ ID NO: 18675 - DNA, 18 bp, Artificial Sequence
  Synthetic DNA
ttatccgactcactcttg

SEQ ID NO: 18676 - DNA, 18 bp, Artificial Sequence
  Synthetic DNA
ttatccgcctcactattg

SEQ ID NO: 18677 - DNA, 18 bp, Artificial Sequence
  Synthetic DNA
ttatgcgaatcactattg

SEQ ID NO: 18678 - DNA, 18 bp, Artificial Sequence
  Synthetic DNA
ttattcgactcaccacag

SEQ ID NO: 18679 - DNA, 18 bp, Artificial Sequence
  Synthetic DNA
ttattcgtctcactttag

SEQ ID NO: 18680 - DNA, 18 bp, Artificial Sequence
  Synthetic DNA
ttctacgactaactattg

SEQ ID NO: 18681 - DNA, 18 bp, Artificial Sequence
  Synthetic DNA
ttttacgacccgctatag

SEQ ID NO: 18682 - DNA, 18 bp, Artificial Sequence
  Synthetic DNA
aaaaacgacctactatag

SEQ ID NO: 18683 - DNA, 18 bp, Artificial Sequence
  Synthetic DNA
aaaaacgactcactcgag

SEQ ID NO: 18684 - DNA, 18 bp, Artificial Sequence
  Synthetic DNA
aaaaacgactctgtatag

SEQ ID NO: 18685 - DNA, 18 bp, Artificial Sequence
  Synthetic DNA
aaaaccgacttactatag

SEQ ID NO: 18686 - DNA, 18 bp, Artificial Sequence
  Synthetic DNA
aaacacggctcactacag

SEQ ID NO: 18687 - DNA, 18 bp, Artificial Sequence
  Synthetic DNA
aaagacgactttctatag

SEQ ID NO: 18688 - DNA, 18 bp, Artificial Sequence
  Synthetic DNA
aaataaaactcaccatag

SEQ ID NO: 18689 - DNA, 18 bp, Artificial Sequence
  Synthetic DNA
aaataacactcactttag

SEQ ID NO: 18690 - DNA, 18 bp, Artificial Sequence
  Synthetic DNA
aaataagactcacactag

SEQ ID NO: 18691 - DNA, 18 bp, Artificial Sequence
  Synthetic DNA
aaataagactgaccatag

SEQ ID NO: 18692 - DNA, 18 bp, Artificial Sequence
  Synthetic DNA
aaataagagtcactacag

SEQ ID NO: 18693 - DNA, 18 bp, Artificial Sequence
  Synthetic DNA
aaatacaaatcactttag

SEQ ID NO: 18694 - DNA, 18 bp, Artificial Sequence
  Synthetic DNA
aaatacaagtcactatgg

SEQ ID NO: 18695 - DNA, 18 bp, Artificial Sequence
  Synthetic DNA
aaatacaatacactatag

SEQ ID NO: 18696 - DNA, 18 bp, Artificial Sequence
  Synthetic DNA
aaatacacctctctatag

SEQ ID NO: 18697 - DNA, 18 bp, Artificial Sequence
  Synthetic DNA
aaatacgaatcagtaaag

SEQ ID NO: 18698 - DNA, 18 bp, Artificial Sequence
  Synthetic DNA
aaatacgaccaacaatag

SEQ ID NO: 18699 - DNA, 18 bp, Artificial Sequence
  Synthetic DNA
aaatacgactaaccatgg

SEQ ID NO: 18700 - DNA, 18 bp, Artificial Sequence
  Synthetic DNA
aaatacgactctgtatgg

SEQ ID NO: 18701 - DNA, 18 bp, Artificial Sequence
  Synthetic DNA
aaatacgactgattagag

SEQ ID NO: 18702 - DNA, 18 bp, Artificial Sequence
  Synthetic DNA
aaatacgagtcattaaag

SEQ ID NO: 18703 - DNA, 18 bp, Artificial Sequence
  Synthetic DNA
aaatacgagtcattacag

SEQ ID NO: 18704 - DNA, 18 bp, Artificial Sequence
  Synthetic DNA
aaatacgatccaatatag

SEQ ID NO: 18705 - DNA, 18 bp, Artificial Sequence
  Synthetic DNA
aaatacgattaactgtag

SEQ ID NO: 18706 - DNA, 18 bp, Artificial Sequence
  Synthetic DNA
aaatacgattaagtatag

SEQ ID NO: 18707 - DNA, 18 bp, Artificial Sequence
  Synthetic DNA
aaatacgattgtctatag

SEQ ID NO: 18708 - DNA, 18 bp, Artificial Sequence
  Synthetic DNA
aaatacgcgtcactttag

SEQ ID NO: 18709 - DNA, 18 bp, Artificial Sequence
  Synthetic DNA
aaatacggcacactctag

SEQ ID NO: 18710 - DNA, 18 bp, Artificial Sequence
  Synthetic DNA
aaatacgtcccactctag

SEQ ID NO: 18711 - DNA, 18 bp, Artificial Sequence
  Synthetic DNA
aaatacgtctcacttgag

SEQ ID NO: 18712 - DNA, 18 bp, Artificial Sequence
  Synthetic DNA
aaatactactcactcaag

SEQ ID NO: 18713 - DNA, 18 bp, Artificial Sequence
  Synthetic DNA
aaatactactcattttag

SEQ ID NO: 18714 - DNA, 18 bp, Artificial Sequence
  Synthetic DNA
aaataggactatctatag

SEQ ID NO: 18715 - DNA, 18 bp, Artificial Sequence
  Synthetic DNA
aaataggtctcattatag

SEQ ID NO: 18716 - DNA, 18 bp, Artificial Sequence
  Synthetic DNA
aaatataactgactatag

SEQ ID NO: 18717 - DNA, 18 bp, Artificial Sequence
  Synthetic DNA
aaatatgactcacgctag

SEQ ID NO: 18718 - DNA, 18 bp, Artificial Sequence
  Synthetic DNA
aaatatgactcagtagag

SEQ ID NO: 18719 - DNA, 18 bp, Artificial Sequence
  Synthetic DNA
aaatcagactaactatag

SEQ ID NO: 18720 - DNA, 18 bp, Artificial Sequence
  Synthetic DNA
aaatccgacggactatag

SEQ ID NO: 18721 - DNA, 18 bp, Artificial Sequence
  Synthetic DNA
aaatcggactcactttag

SEQ ID NO: 18722 - DNA, 18 bp, Artificial Sequence
  Synthetic DNA
aaatgagactcactaaag

SEQ ID NO: 18723 - DNA, 18 bp, Artificial Sequence
  Synthetic DNA
aaatgctattcactatag

SEQ ID NO: 18724 - DNA, 18 bp, Artificial Sequence
  Synthetic DNA
aaatgtcactcactatag

SEQ ID NO: 18725 - DNA, 18 bp, Artificial Sequence
  Synthetic DNA
aaccacgactcactaaag

SEQ ID NO: 18726 - DNA, 18 bp, Artificial Sequence
  Synthetic DNA
aactacaactcactttag

SEQ ID NO: 18727 - DNA, 18 bp, Artificial Sequence
  Synthetic DNA
aactacgacttactttag

SEQ ID NO: 18728 - DNA, 18 bp, Artificial Sequence
  Synthetic DNA
aactacgcctcaatatag

SEQ ID NO: 18729 - DNA, 18 bp, Artificial Sequence
  Synthetic DNA
aactgcgactcaatatag

SEQ ID NO: 18730 - DNA, 18 bp, Artificial Sequence
  Synthetic DNA
aagcacgagtcactatag

SEQ ID NO: 18731 - DNA, 18 bp, Artificial Sequence
  Synthetic DNA
aagtacgacttcctatag

SEQ ID NO: 18732 - DNA, 18 bp, Artificial Sequence
  Synthetic DNA
aagtactactctctatag

SEQ ID NO: 18733 - DNA, 18 bp, Artificial Sequence
  Synthetic DNA
aagtatgactcactacag

SEQ ID NO: 18734 - DNA, 18 bp, Artificial Sequence
  Synthetic DNA
aataatgactcactatag

SEQ ID NO: 18735 - DNA, 18 bp, Artificial Sequence
  Synthetic DNA
aattaggactctctatag

SEQ ID NO: 18736 - DNA, 18 bp, Artificial Sequence
  Synthetic DNA
aattatgactcactatcg

SEQ ID NO: 18737 - DNA, 18 bp, Artificial Sequence
  Synthetic DNA
acatacgaatcagtatag

SEQ ID NO: 18738 - DNA, 18 bp, Artificial Sequence
  Synthetic DNA
acatacgacacactacag

SEQ ID NO: 18739 - DNA, 18 bp, Artificial Sequence
  Synthetic DNA
acatacgactcaaaatag

SEQ ID NO: 18740 - DNA, 18 bp, Artificial Sequence
  Synthetic DNA
acctacgacacactatag

SEQ ID NO: 18741 - DNA, 18 bp, Artificial Sequence
  Synthetic DNA
agacacgactcactaaag

SEQ ID NO: 18742 - DNA, 18 bp, Artificial Sequence
  Synthetic DNA
agataagacacactatag

SEQ ID NO: 18743 - DNA, 18 bp, Artificial Sequence
  Synthetic DNA
agatacaactcactttag

SEQ ID NO: 18744 - DNA, 18 bp, Artificial Sequence
  Synthetic DNA
agatactacacactatag

SEQ ID NO: 18745 - DNA, 18 bp, Artificial Sequence
  Synthetic DNA
agatactactcaatatag

SEQ ID NO: 18746 - DNA, 18 bp, Artificial Sequence
  Synthetic DNA
agataggacccactatag

SEQ ID NO: 18747 - DNA, 18 bp, Artificial Sequence
  Synthetic DNA
agatccgtctcactatag

SEQ ID NO: 18748 - DNA, 18 bp, Artificial Sequence
  Synthetic DNA
agatcctactcactatag

SEQ ID NO: 18749 - DNA, 18 bp, Artificial Sequence
  Synthetic DNA
agctgcgactcactatag

SEQ ID NO: 18750 - DNA, 18 bp, Artificial Sequence
  Synthetic DNA
atacacgagtcactatag

SEQ ID NO: 18751 - DNA, 18 bp, Artificial Sequence
  Synthetic DNA
atataagactcactatgg

SEQ ID NO: 18752 - DNA, 18 bp, Artificial Sequence
  Synthetic DNA
atatacgacccaccatag

SEQ ID NO: 18753 - DNA, 18 bp, Artificial Sequence
  Synthetic DNA
atatacgcctcactacag

SEQ ID NO: 18754 - DNA, 18 bp, Artificial Sequence
  Synthetic DNA
atatacggctcattatag

SEQ ID NO: 18755 - DNA, 18 bp, Artificial Sequence
  Synthetic DNA
atgtacgactcacaatag

SEQ ID NO: 18756 - DNA, 18 bp, Artificial Sequence
  Synthetic DNA
caaaacgactcaatatcg

SEQ ID NO: 18757 - DNA, 18 bp, Artificial Sequence
  Synthetic DNA
caaaacgactcactaacg

SEQ ID NO: 18758 - DNA, 18 bp, Artificial Sequence
  Synthetic DNA
caaaacgactctctatgg

SEQ ID NO: 18759 - DNA, 18 bp, Artificial Sequence
  Synthetic DNA
caacacgactcataatag

SEQ ID NO: 18760 - DNA, 18 bp, Artificial Sequence
  Synthetic DNA
caatacaactcacattag

SEQ ID NO: 18761 - DNA, 18 bp, Artificial Sequence
  Synthetic DNA
caatacgaatcattacag

SEQ ID NO: 18762 - DNA, 18 bp, Artificial Sequence
  Synthetic DNA
caatacgaatgactacag

SEQ ID NO: 18763 - DNA, 18 bp, Artificial Sequence
  Synthetic DNA
caatacgacccaacatag

SEQ ID NO: 18764 - DNA, 18 bp, Artificial Sequence
  Synthetic DNA
caatacgactaaggatag

SEQ ID NO: 18765 - DNA, 18 bp, Artificial Sequence
  Synthetic DNA
caatacgactaataatag

SEQ ID NO: 18766 - DNA, 18 bp, Artificial Sequence
  Synthetic DNA
caatacgacttactcaag

SEQ ID NO: 18767 - DNA, 18 bp, Artificial Sequence
  Synthetic DNA
caatacgagtttctatag

SEQ ID NO: 18768 - DNA, 18 bp, Artificial Sequence
  Synthetic DNA
caatacggctcactttgg

SEQ ID NO: 18769 - DNA, 18 bp, Artificial Sequence
  Synthetic DNA
caatacgtctctccatag

SEQ ID NO: 18770 - DNA, 18 bp, Artificial Sequence
  Synthetic DNA
caatactactcagcatag

SEQ ID NO: 18771 - DNA, 18 bp, Artificial Sequence
  Synthetic DNA
caatactgcttactatag

SEQ ID NO: 18772 - DNA, 18 bp, Artificial Sequence
  Synthetic DNA
caatccgtctgactatag

SEQ ID NO: 18773 - DNA, 18 bp, Artificial Sequence
  Synthetic DNA
caatgccactcactttag

SEQ ID NO: 18774 - DNA, 18 bp, Artificial Sequence
  Synthetic DNA
caccacgacttactatag

SEQ ID NO: 18775 - DNA, 18 bp, Artificial Sequence
  Synthetic DNA
cagtacgactcattttag

SEQ ID NO: 18776 - DNA, 18 bp, Artificial Sequence
  Synthetic DNA
cataacgactcactgtag

SEQ ID NO: 18777 - DNA, 18 bp, Artificial Sequence
  Synthetic DNA
cattaccactcactaaag

SEQ ID NO: 18778 - DNA, 18 bp, Artificial Sequence
  Synthetic DNA
cattaccactccctatag

SEQ ID NO: 18779 - DNA, 18 bp, Artificial Sequence
  Synthetic DNA
cattacgactcccaatag

SEQ ID NO: 18780 - DNA, 18 bp, Artificial Sequence
  Synthetic DNA
cattacggctcagtatag

SEQ ID NO: 18781 - DNA, 18 bp, Artificial Sequence
  Synthetic DNA
ccatacgactcaacatag

SEQ ID NO: 18782 - DNA, 18 bp, Artificial Sequence
  Synthetic DNA
ccatacgactctctagag

SEQ ID NO: 18783 - DNA, 18 bp, Artificial Sequence
  Synthetic DNA
ccatactactcactaaag

SEQ ID NO: 18784 - DNA, 18 bp, Artificial Sequence
  Synthetic DNA
cgatatgactctctatag

SEQ ID NO: 18785 - DNA, 18 bp, Artificial Sequence
  Synthetic DNA
ctatacaactcagtatag

SEQ ID NO: 18786 - DNA, 18 bp, Artificial Sequence
  Synthetic DNA
ctatccgactaactatag

SEQ ID NO: 18787 - DNA, 18 bp, Artificial Sequence
  Synthetic DNA
ctatgcgactcacgatag

SEQ ID NO: 18788 - DNA, 18 bp, Artificial Sequence
  Synthetic DNA
gaaaaggactcactatgg

SEQ ID NO: 18789 - DNA, 18 bp, Artificial Sequence
  Synthetic DNA
gaacactactcattatag

SEQ ID NO: 18790 - DNA, 18 bp, Artificial Sequence
  Synthetic DNA
gaatacatcttactatag

SEQ ID NO: 18791 - DNA, 18 bp, Artificial Sequence
  Synthetic DNA
gaataccacacactagag

SEQ ID NO: 18792 - DNA, 18 bp, Artificial Sequence
  Synthetic DNA
gaataccactcactttgg

SEQ ID NO: 18793 - DNA, 18 bp, Artificial Sequence
  Synthetic DNA
gaatacgactcacagtgg

SEQ ID NO: 18794 - DNA, 18 bp, Artificial Sequence
  Synthetic DNA
gaatacgacttatcatag

SEQ ID NO: 18795 - DNA, 18 bp, Artificial Sequence
  Synthetic DNA
gaatactactcactcgag

SEQ ID NO: 18796 - DNA, 18 bp, Artificial Sequence
  Synthetic DNA
gaatactactgaccatag

SEQ ID NO: 18797 - DNA, 18 bp, Artificial Sequence
  Synthetic DNA
gaatatgagtcactatcg

SEQ ID NO: 18798 - DNA, 18 bp, Artificial Sequence
  Synthetic DNA
gaatatgattcattatag

SEQ ID NO: 18799 - DNA, 18 bp, Artificial Sequence
  Synthetic DNA
gaccgcgactcactatag

SEQ ID NO: 18800 - DNA, 18 bp, Artificial Sequence
  Synthetic DNA
gagtacgtctaactatag

SEQ ID NO: 18801 - DNA, 18 bp, Artificial Sequence
  Synthetic DNA
gattatgactcacgatag

SEQ ID NO: 18802 - DNA, 18 bp, Artificial Sequence
  Synthetic DNA
gcatacgactcattgtag

SEQ ID NO: 18803 - DNA, 18 bp, Artificial Sequence
  Synthetic DNA
ggatccgactctctatag

SEQ ID NO: 18804 - DNA, 18 bp, Artificial Sequence
  Synthetic DNA
gtagacgactcaatatag

SEQ ID NO: 18805 - DNA, 18 bp, Artificial Sequence
  Synthetic DNA
gtatacgactcattatcg

SEQ ID NO: 18806 - DNA, 18 bp, Artificial Sequence
  Synthetic DNA
gtttatgactcactatag

SEQ ID NO: 18807 - DNA, 18 bp, Artificial Sequence
  Synthetic DNA
taaaaagcctgactatag

SEQ ID NO: 18808 - DNA, 18 bp, Artificial Sequence
  Synthetic DNA
taaaacaactcagtagag

SEQ ID NO: 18809 - DNA, 18 bp, Artificial Sequence
  Synthetic DNA
taaaacatctccctatag

SEQ ID NO: 18810 - DNA, 18 bp, Artificial Sequence
  Synthetic DNA
taaaaccaatcattatag

SEQ ID NO: 18811 - DNA, 18 bp, Artificial Sequence
  Synthetic DNA
taaaaccactcaatttag

SEQ ID NO: 18812 - DNA, 18 bp, Artificial Sequence
  Synthetic DNA
taaaaccagtcaccatag

SEQ ID NO: 18813 - DNA, 18 bp, Artificial Sequence
  Synthetic DNA
taaaacgacactctatcg

SEQ ID NO: 18814 - DNA, 18 bp, Artificial Sequence
  Synthetic DNA
taaaacgacgcattatgg

SEQ ID NO: 18815 - DNA, 18 bp, Artificial Sequence
  Synthetic DNA
taaaacgactaacttgag

SEQ ID NO: 18816 - DNA, 18 bp, Artificial Sequence
  Synthetic DNA
taaaacgactaattctag

SEQ ID NO: 18817 - DNA, 18 bp, Artificial Sequence
  Synthetic DNA
taaaacgactgaatatgg

SEQ ID NO: 18818 - DNA, 18 bp, Artificial Sequence
  Synthetic DNA
taaaacgacttactctgg

SEQ ID NO: 18819 - DNA, 18 bp, Artificial Sequence
  Synthetic DNA
taaaacgagtaaatatag

SEQ ID NO: 18820 - DNA, 18 bp, Artificial Sequence
  Synthetic DNA
taaaacgcctcactcaag

SEQ ID NO: 18821 - DNA, 18 bp, Artificial Sequence
  Synthetic DNA
taaaacggaacactatag

SEQ ID NO: 18822 - DNA, 18 bp, Artificial Sequence
  Synthetic DNA
taaaacgtgtcactatcg

SEQ ID NO: 18823 - DNA, 18 bp, Artificial Sequence
  Synthetic DNA
taaaacgtgtcactgtag

SEQ ID NO: 18824 - DNA, 18 bp, Artificial Sequence
  Synthetic DNA
taaaactacacactatgg

SEQ ID NO: 18825 - DNA, 18 bp, Artificial Sequence
  Synthetic DNA
taaaactacgcactgtag

SEQ ID NO: 18826 - DNA, 18 bp, Artificial Sequence
  Synthetic DNA
taaaactacttagtatag

SEQ ID NO: 18827 - DNA, 18 bp, Artificial Sequence
  Synthetic DNA
taaaactagtcactttag

SEQ ID NO: 18828 - DNA, 18 bp, Artificial Sequence
  Synthetic DNA
taaaaggaatcaatatag

SEQ ID NO: 18829 - DNA, 18 bp, Artificial Sequence
  Synthetic DNA
taaaaggcctcactacag

SEQ ID NO: 18830 - DNA, 18 bp, Artificial Sequence
  Synthetic DNA
taaaatgcctcacaatag

SEQ ID NO: 18831 - DNA, 18 bp, Artificial Sequence
  Synthetic DNA
taaagcggctaactatag

SEQ ID NO: 18832 - DNA, 18 bp, Artificial Sequence
  Synthetic DNA
taacaagactgactaaag

SEQ ID NO: 18833 - DNA, 18 bp, Artificial Sequence
  Synthetic DNA
taacacaagtcactttag

SEQ ID NO: 18834 - DNA, 18 bp, Artificial Sequence
  Synthetic DNA
taacacaagttactatag

SEQ ID NO: 18835 - DNA, 18 bp, Artificial Sequence
  Synthetic DNA
taacaccccacactatag

SEQ ID NO: 18836 - DNA, 18 bp, Artificial Sequence
  Synthetic DNA
taacacgaatatctatag

SEQ ID NO: 18837 - DNA, 18 bp, Artificial Sequence
  Synthetic DNA
taacacgacactctacag

SEQ ID NO: 18838 - DNA, 18 bp, Artificial Sequence
  Synthetic DNA
taacacgacatactttag

SEQ ID NO: 18839 - DNA, 18 bp, Artificial Sequence
  Synthetic DNA
taacacgagtcacattag

SEQ ID NO: 18840 - DNA, 18 bp, Artificial Sequence
  Synthetic DNA
taacacgattaactgtag

SEQ ID NO: 18841 - DNA, 18 bp, Artificial Sequence
  Synthetic DNA
taacacgcatcaccatag

SEQ ID NO: 18842 - DNA, 18 bp, Artificial Sequence
  Synthetic DNA
taacacggctcacaatgg

SEQ ID NO: 18843 - DNA, 18 bp, Artificial Sequence
  Synthetic DNA
taacacgttccactatag

SEQ ID NO: 18844 - DNA, 18 bp, Artificial Sequence
  Synthetic DNA
taacaggattcacaatag

SEQ ID NO: 18845 - DNA, 18 bp, Artificial Sequence
  Synthetic DNA
taacatgactcagcatag

SEQ ID NO: 18846 - DNA, 18 bp, Artificial Sequence
  Synthetic DNA
taacatgcctcacaatag

SEQ ID NO: 18847 - DNA, 18 bp, Artificial Sequence
  Synthetic DNA
taaccctacacactatag

SEQ ID NO: 18848 - DNA, 18 bp, Artificial Sequence
  Synthetic DNA
taacctcactcactatag

SEQ ID NO: 18849 - DNA, 18 bp, Artificial Sequence
  Synthetic DNA
taagaagtctcaatatag

SEQ ID NO: 18850 - DNA, 18 bp, Artificial Sequence
  Synthetic DNA
taagacgactcattgtcg

SEQ ID NO: 18851 - DNA, 18 bp, Artificial Sequence
  Synthetic DNA
taagacgactttatatag

SEQ ID NO: 18852 - DNA, 18 bp, Artificial Sequence
  Synthetic DNA
taagacgccttacgatag

SEQ ID NO: 18853 - DNA, 18 bp, Artificial Sequence
  Synthetic DNA
taagacggctcactcaag

SEQ ID NO: 18854 - DNA, 18 bp, Artificial Sequence
  Synthetic DNA
taagacgtcgcactaaag

SEQ ID NO: 18855 - DNA, 18 bp, Artificial Sequence
  Synthetic DNA
taagactacacaccatag

SEQ ID NO: 18856 - DNA, 18 bp, Artificial Sequence
  Synthetic DNA
taagactcctcactttag

SEQ ID NO: 18857 - DNA, 18 bp, Artificial Sequence
  Synthetic DNA
taagatgacacaccatag

SEQ ID NO: 18858 - DNA, 18 bp, Artificial Sequence
  Synthetic DNA
taagatggctcaatatag

SEQ ID NO: 18859 - DNA, 18 bp, Artificial Sequence
  Synthetic DNA
taagatggctcactttag

SEQ ID NO: 18860 - DNA, 18 bp, Artificial Sequence
  Synthetic DNA
taagccgatacactatag

SEQ ID NO: 18861 - DNA, 18 bp, Artificial Sequence
  Synthetic DNA
taaggcgacacacaatag

SEQ ID NO: 18862 - DNA, 18 bp, Artificial Sequence
  Synthetic DNA
taataaaactcattagag

SEQ ID NO: 18863 - DNA, 18 bp, Artificial Sequence
  Synthetic DNA
taataagacaaattatag

SEQ ID NO: 18864 - DNA, 18 bp, Artificial Sequence
  Synthetic DNA
taataagactcaccgtcg

SEQ ID NO: 18865 - DNA, 18 bp, Artificial Sequence
  Synthetic DNA
taataagatacactacag

SEQ ID NO: 18866 - DNA, 18 bp, Artificial Sequence
  Synthetic DNA
taataagccgcactgtag

SEQ ID NO: 18867 - DNA, 18 bp, Artificial Sequence
  Synthetic DNA
taataaggataactatag

SEQ ID NO: 18868 - DNA, 18 bp, Artificial Sequence
  Synthetic DNA
taataagtttcactatgg

SEQ ID NO: 18869 - DNA, 18 bp, Artificial Sequence
  Synthetic DNA
taataatacacactatgg

SEQ ID NO: 18870 - DNA, 18 bp, Artificial Sequence
  Synthetic DNA
taataatactccctgtag

SEQ ID NO: 18871 - DNA, 18 bp, Artificial Sequence
  Synthetic DNA
taatacaacaaactatgg

SEQ ID NO: 18872 - DNA, 18 bp, Artificial Sequence
  Synthetic DNA
taatacaacaccatatag

SEQ ID NO: 18873 - DNA, 18 bp, Artificial Sequence
  Synthetic DNA
taatacaacaccctctag

SEQ ID NO: 18874 - DNA, 18 bp, Artificial Sequence
  Synthetic DNA
taatacaacagactatgg

SEQ ID NO: 18875 - DNA, 18 bp, Artificial Sequence
  Synthetic DNA
taatacaacggactaaag

SEQ ID NO: 18876 - DNA, 18 bp, Artificial Sequence
  Synthetic DNA
taatacaactcccactag

SEQ ID NO: 18877 - DNA, 18 bp, Artificial Sequence
  Synthetic DNA
taatacaacttacaatcg

SEQ ID NO: 18878 - DNA, 18 bp, Artificial Sequence
  Synthetic DNA
taatacaattaactttag

SEQ ID NO: 18879 - DNA, 18 bp, Artificial Sequence
  Synthetic DNA
taatacaattcaatgtag

SEQ ID NO: 18880 - DNA, 18 bp, Artificial Sequence
  Synthetic DNA
taatacaattcacgatcg

SEQ ID NO: 18881 - DNA, 18 bp, Artificial Sequence
  Synthetic DNA
taatacaccacactacag

SEQ ID NO: 18882 - DNA, 18 bp, Artificial Sequence
  Synthetic DNA
taatacacctcacagtag

SEQ ID NO: 18883 - DNA, 18 bp, Artificial Sequence
  Synthetic DNA
taatacaggtcactctag

SEQ ID NO: 18884 - DNA, 18 bp, Artificial Sequence
  Synthetic DNA
taataccaattacaatag

SEQ ID NO: 18885 - DNA, 18 bp, Artificial Sequence
  Synthetic DNA
taataccacacacaagag

SEQ ID NO: 18886 - DNA, 18 bp, Artificial Sequence
  Synthetic DNA
taataccacatacaatag

SEQ ID NO: 18887 - DNA, 18 bp, Artificial Sequence
  Synthetic DNA
taataccactcatagtag

SEQ ID NO: 18888 - DNA, 18 bp, Artificial Sequence
  Synthetic DNA
taataccactgaacatag

SEQ ID NO: 18889 - DNA, 18 bp, Artificial Sequence
  Synthetic DNA
taataccacttacagtag

SEQ ID NO: 18890 - DNA, 18 bp, Artificial Sequence
  Synthetic DNA
taataccatgaactatag

SEQ ID NO: 18891 - DNA, 18 bp, Artificial Sequence
  Synthetic DNA
taataccattcacttcag

SEQ ID NO: 18892 - DNA, 18 bp, Artificial Sequence
  Synthetic DNA
taatacctctcactaacg

SEQ ID NO: 18893 - DNA, 18 bp, Artificial Sequence
  Synthetic DNA
taatacgaaacaaaatag

SEQ ID NO: 18894 - DNA, 18 bp, Artificial Sequence
  Synthetic DNA
taatacgaaacaatagag

SEQ ID NO: 18895 - DNA, 18 bp, Artificial Sequence
  Synthetic DNA
taatacgaaacacgttag

SEQ ID NO: 18896 - DNA, 18 bp, Artificial Sequence
  Synthetic DNA
taatacgaaatagtatag

SEQ ID NO: 18897 - DNA, 18 bp, Artificial Sequence
  Synthetic DNA
taatacgaactacaatag

SEQ ID NO: 18898 - DNA, 18 bp, Artificial Sequence
  Synthetic DNA
taatacgaatcacattac

SEQ ID NO: 18899 - DNA, 18 bp, Artificial Sequence
  Synthetic DNA
taatacgaatcagtacgg

SEQ ID NO: 18900 - DNA, 18 bp, Artificial Sequence
  Synthetic DNA
taatacgaatctatatcg

SEQ ID NO: 18901 - DNA, 18 bp, Artificial Sequence
  Synthetic DNA
taatacgaatgacattag

SEQ ID NO: 18902 - DNA, 18 bp, Artificial Sequence
  Synthetic DNA
taatacgaattaatagag

SEQ ID NO: 18903 - DNA, 18 bp, Artificial Sequence
  Synthetic DNA
taatacgacacccaacag

SEQ ID NO: 18904 - DNA, 18 bp, Artificial Sequence
  Synthetic DNA
taatacgacactatgtag

SEQ ID NO: 18905 - DNA, 18 bp, Artificial Sequence
  Synthetic DNA
taatacgacagaagatag

SEQ ID NO: 18906 - DNA, 18 bp, Artificial Sequence
  Synthetic DNA
taatacgacatactttgg

SEQ ID NO: 18907 - DNA, 18 bp, Artificial Sequence
  Synthetic DNA
taatacgaccatctctag

SEQ ID NO: 18908 - DNA, 18 bp, Artificial Sequence
  Synthetic DNA
taatacgactaagttcag

SEQ ID NO: 18909 - DNA, 18 bp, Artificial Sequence
  Synthetic DNA
taatacgactatcggtag

SEQ ID NO: 18910 - DNA, 18 bp, Artificial Sequence
  Synthetic DNA
taatacgactcagagaag

SEQ ID NO: 18911 - DNA, 18 bp, Artificial Sequence
  Synthetic DNA
taatacgactccgaacag

SEQ ID NO: 18912 - DNA, 18 bp, Artificial Sequence
  Synthetic DNA
taatacgactccggttag

SEQ ID NO: 18913 - DNA, 18 bp, Artificial Sequence
  Synthetic DNA
taatacgactctatatca

SEQ ID NO: 18914 - DNA, 18 bp, Artificial Sequence
  Synthetic DNA
taatacgactctatcaag

SEQ ID NO: 18915 - DNA, 18 bp, Artificial Sequence
  Synthetic DNA
taatacgactctctgacg

SEQ ID NO: 18916 - DNA, 18 bp, Artificial Sequence
  Synthetic DNA
taatacgactcttaatcg

SEQ ID NO: 18917 - DNA, 18 bp, Artificial Sequence
  Synthetic DNA
taatacgacttaacaaag

SEQ ID NO: 18918 - DNA, 18 bp, Artificial Sequence
  Synthetic DNA
taatacgacttaagaaag

SEQ ID NO: 18919 - DNA, 18 bp, Artificial Sequence
  Synthetic DNA
taatacgacttacgtaag

SEQ ID NO: 18920 - DNA, 18 bp, Artificial Sequence
  Synthetic DNA
taatacgactttctaagg

SEQ ID NO: 18921 - DNA, 18 bp, Artificial Sequence
  Synthetic DNA
taatacgagcatctatag

SEQ ID NO: 18922 - DNA, 18 bp, Artificial Sequence
  Synthetic DNA
taatacgagccaacatag

SEQ ID NO: 18923 - DNA, 18 bp, Artificial Sequence
  Synthetic DNA
taatacgagcgactgtag

SEQ ID NO: 18924 - DNA, 18 bp, Artificial Sequence
  Synthetic DNA
taatacgaggcacattag

SEQ ID NO: 18925 - DNA, 18 bp, Artificial Sequence
  Synthetic DNA
taatacgagtaattttag

SEQ ID NO: 18926 - DNA, 18 bp, Artificial Sequence
  Synthetic DNA
taatacgagtctccgtag

SEQ ID NO: 18927 - DNA, 18 bp, Artificial Sequence
  Synthetic DNA
taatacgagtctgtttag

SEQ ID NO: 18928 - DNA, 18 bp, Artificial Sequence
  Synthetic DNA
taatacgattaataatag

SEQ ID NO: 18929 - DNA, 18 bp, Artificial Sequence
  Synthetic DNA
taatacgattacctacag

SEQ ID NO: 18930 - DNA, 18 bp, Artificial Sequence
  Synthetic DNA
taatacgattcagcagag

SEQ ID NO: 18931 - DNA, 18 bp, Artificial Sequence
  Synthetic DNA
taatacgattccgtttag

SEQ ID NO: 18932 - DNA, 18 bp, Artificial Sequence
  Synthetic DNA
taatacgcatcaataaag

SEQ ID NO: 18933 - DNA, 18 bp, Artificial Sequence
  Synthetic DNA
taatacgccacacactag

SEQ ID NO: 18934 - DNA, 18 bp, Artificial Sequence
  Synthetic DNA
taatacgccacactaacg

SEQ ID NO: 18935 - DNA, 18 bp, Artificial Sequence
  Synthetic DNA
taatacgcctcacttacg

SEQ ID NO: 18936 - DNA, 18 bp, Artificial Sequence
  Synthetic DNA
taatacgcttcccaatag

SEQ ID NO: 18937 - DNA, 18 bp, Artificial Sequence
  Synthetic DNA
taatacggataattatag

SEQ ID NO: 18938 - DNA, 18 bp, Artificial Sequence
  Synthetic DNA
taatacggctcacatcag

SEQ ID NO: 18939 - DNA, 18 bp, Artificial Sequence
  Synthetic DNA
taatacggctcacgctgg

SEQ ID NO: 18940 - DNA, 18 bp, Artificial Sequence
  Synthetic DNA
taatacggttttctatag

SEQ ID NO: 18941 - DNA, 18 bp, Artificial Sequence
  Synthetic DNA
taatacgtcacactagcg

SEQ ID NO: 18942 - DNA, 18 bp, Artificial Sequence
  Synthetic DNA
taatacgtccccctatcg

SEQ ID NO: 18943 - DNA, 18 bp, Artificial Sequence
  Synthetic DNA
taatacgtctcaattcag

SEQ ID NO: 18944 - DNA, 18 bp, Artificial Sequence
  Synthetic DNA
taatacgtctcacttggg

SEQ ID NO: 18945 - DNA, 18 bp, Artificial Sequence
  Synthetic DNA
taatacgtcttactaccg

SEQ ID NO: 18946 - DNA, 18 bp, Artificial Sequence
  Synthetic DNA
taatactaatcagtatcg

SEQ ID NO: 18947 - DNA, 18 bp, Artificial Sequence
  Synthetic DNA
taatactaatcccaatag

SEQ ID NO: 18948 - DNA, 18 bp, Artificial Sequence
  Synthetic DNA
taatactacacacttgag

SEQ ID NO: 18949 - DNA, 18 bp, Artificial Sequence
  Synthetic DNA
taatactacacattaaag

SEQ ID NO: 18950 - DNA, 18 bp, Artificial Sequence
  Synthetic DNA
taatactacgctctagag

SEQ ID NO: 18951 - DNA, 18 bp, Artificial Sequence
  Synthetic DNA
taatactactaagcatag

SEQ ID NO: 18952 - DNA, 18 bp, Artificial Sequence
  Synthetic DNA
taatactactatctctag

SEQ ID NO: 18953 - DNA, 18 bp, Artificial Sequence
  Synthetic DNA
taatactactcagaatgg

SEQ ID NO: 18954 - DNA, 18 bp, Artificial Sequence
  Synthetic DNA
taatactactccatatcg

SEQ ID NO: 18955 - DNA, 18 bp, Artificial Sequence
  Synthetic DNA
taatactagtaagtatag

SEQ ID NO: 18956 - DNA, 18 bp, Artificial Sequence
  Synthetic DNA
taatactagtctctttag

SEQ ID NO: 18957 - DNA, 18 bp, Artificial Sequence
  Synthetic DNA
taatacttcttcctatag

SEQ ID NO: 18958 - DNA, 18 bp, Artificial Sequence
  Synthetic DNA
taatagaaatcactctag

SEQ ID NO: 18959 - DNA, 18 bp, Artificial Sequence
  Synthetic DNA
taatagaactctctgtag

SEQ ID NO: 18960 - DNA, 18 bp, Artificial Sequence
  Synthetic DNA
taatagatctgactatag

SEQ ID NO: 18961 - DNA, 18 bp, Artificial Sequence
  Synthetic DNA
taatagcactcattacag

SEQ ID NO: 18962 - DNA, 18 bp, Artificial Sequence
  Synthetic DNA
taataggaataactttag

SEQ ID NO: 18963 - DNA, 18 bp, Artificial Sequence
  Synthetic DNA
taataggacccccgatag

SEQ ID NO: 18964 - DNA, 18 bp, Artificial Sequence
  Synthetic DNA
taataggactcaatttcg

SEQ ID NO: 18965 - DNA, 18 bp, Artificial Sequence
  Synthetic DNA
taataggactctgtacag

SEQ ID NO: 18966 - DNA, 18 bp, Artificial Sequence
  Synthetic DNA
taataggattcacaaaag

SEQ ID NO: 18967 - DNA, 18 bp, Artificial Sequence
  Synthetic DNA
taataggattctgtatag

SEQ ID NO: 18968 - DNA, 18 bp, Artificial Sequence
  Synthetic DNA
taatagggcacactttag

SEQ ID NO: 18969 - DNA, 18 bp, Artificial Sequence
  Synthetic DNA
taatagggcttaatatag

SEQ ID NO: 18970 - DNA, 18 bp, Artificial Sequence
  Synthetic DNA
taataggtatcactaaag

SEQ ID NO: 18971 - DNA, 18 bp, Artificial Sequence
  Synthetic DNA
taatagtactaacaatag

SEQ ID NO: 18972 - DNA, 18 bp, Artificial Sequence
  Synthetic DNA
taatagtactaactatcg

SEQ ID NO: 18973 - DNA, 18 bp, Artificial Sequence
  Synthetic DNA
taatataactcaccctag

SEQ ID NO: 18974 - DNA, 18 bp, Artificial Sequence
  Synthetic DNA
taatatcagtcactttag

SEQ ID NO: 18975 - DNA, 18 bp, Artificial Sequence
  Synthetic DNA
taatatgaatacctatag

SEQ ID NO: 18976 - DNA, 18 bp, Artificial Sequence
  Synthetic DNA
taatatgaattactaaag

SEQ ID NO: 18977 - DNA, 18 bp, Artificial Sequence
  Synthetic DNA
taatatgacaccctatcg

SEQ ID NO: 18978 - DNA, 18 bp, Artificial Sequence
  Synthetic DNA
taatatgactcaagagag

SEQ ID NO: 18979 - DNA, 18 bp, Artificial Sequence
  Synthetic DNA
taatatgactgactttcg

SEQ ID NO: 18980 - DNA, 18 bp, Artificial Sequence
  Synthetic DNA
taatatgacttaatatcg

SEQ ID NO: 18981 - DNA, 18 bp, Artificial Sequence
  Synthetic DNA
taatatgagtcactgcag

SEQ ID NO: 18982 - DNA, 18 bp, Artificial Sequence
  Synthetic DNA
taatatgtctcagaatag

SEQ ID NO: 18983 - DNA, 18 bp, Artificial Sequence
  Synthetic DNA
taatatgtctcattacag

SEQ ID NO: 18984 - DNA, 18 bp, Artificial Sequence
  Synthetic DNA
taatatgtctccgtatag

SEQ ID NO: 18985 - DNA, 18 bp, Artificial Sequence
  Synthetic DNA
taatattactaagtatag

SEQ ID NO: 18986 - DNA, 18 bp, Artificial Sequence
  Synthetic DNA
taatattacttactatcg

SEQ ID NO: 18987 - DNA, 18 bp, Artificial Sequence
  Synthetic DNA
taatatttgtcactatag

SEQ ID NO: 18988 - DNA, 18 bp, Artificial Sequence
  Synthetic DNA
taatcagaatcacaatag

SEQ ID NO: 18989 - DNA, 18 bp, Artificial Sequence
  Synthetic DNA
taatcatactcactatcg

SEQ ID NO: 18990 - DNA, 18 bp, Artificial Sequence
  Synthetic DNA
taatccatctcaatatag

SEQ ID NO: 18991 - DNA, 18 bp, Artificial Sequence
  Synthetic DNA
taatccgaagcactatgg

SEQ ID NO: 18992 - DNA, 18 bp, Artificial Sequence
  Synthetic DNA
taatccgaatcaccaaag

SEQ ID NO: 18993 - DNA, 18 bp, Artificial Sequence
  Synthetic DNA
taatccgacagtctatag

SEQ ID NO: 18994 - DNA, 18 bp, Artificial Sequence
  Synthetic DNA
taatccgacgcactgaag

SEQ ID NO: 18995 - DNA, 18 bp, Artificial Sequence
  Synthetic DNA
taatccgactaacttaag

SEQ ID NO: 18996 - DNA, 18 bp, Artificial Sequence
  Synthetic DNA
taatccgactcaacaaag

SEQ ID NO: 18997 - DNA, 18 bp, Artificial Sequence
  Synthetic DNA
taatccgatccactttag

SEQ ID NO: 18998 - DNA, 18 bp, Artificial Sequence
  Synthetic DNA
taatccgccacagtatag

SEQ ID NO: 18999 - DNA, 18 bp, Artificial Sequence
  Synthetic DNA
taatcctacatactatag

SEQ ID NO: 19000 - DNA, 18 bp, Artificial Sequence
  Synthetic DNA
taatcggacccattatag

SEQ ID NO: 19001 - DNA, 18 bp, Artificial Sequence
  Synthetic DNA
taatctgactcaataaag

SEQ ID NO: 19002 - DNA, 18 bp, Artificial Sequence
  Synthetic DNA
taatctgactcacaatgg

SEQ ID NO: 19003 - DNA, 18 bp, Artificial Sequence
  Synthetic DNA
taatctgactctctagag

SEQ ID NO: 19004 - DNA, 18 bp, Artificial Sequence
  Synthetic DNA
taatctgactctctatcg

SEQ ID NO: 19005 - DNA, 18 bp, Artificial Sequence
  Synthetic DNA
taatgacacgcactatag

SEQ ID NO: 19006 - DNA, 18 bp, Artificial Sequence
  Synthetic DNA
taatgagaatcaccatag

SEQ ID NO: 19007 - DNA, 18 bp, Artificial Sequence
  Synthetic DNA
taatgagactcacactag

SEQ ID NO: 19008 - DNA, 18 bp, Artificial Sequence
  Synthetic DNA
taatgagtcttactatag

SEQ ID NO: 19009 - DNA, 18 bp, Artificial Sequence
  Synthetic DNA
taatgcaaatctctatag

SEQ ID NO: 19010 - DNA, 18 bp, Artificial Sequence
  Synthetic DNA
taatgcatctcacaatag

SEQ ID NO: 19011 - DNA, 18 bp, Artificial Sequence
  Synthetic DNA
taatgcatctctctatag

SEQ ID NO: 19012 - DNA, 18 bp, Artificial Sequence
  Synthetic DNA
taatgccacacaccatag

SEQ ID NO: 19013 - DNA, 18 bp, Artificial Sequence
  Synthetic DNA
taatgccacacactctag

SEQ ID NO: 19014 - DNA, 18 bp, Artificial Sequence
  Synthetic DNA
taatgccattcactaaag

SEQ ID NO: 19015 - DNA, 18 bp, Artificial Sequence
  Synthetic DNA
taatgcgaatcaccaaag

SEQ ID NO: 19016 - DNA, 18 bp, Artificial Sequence
  Synthetic DNA
taatgcgacacactgcag

SEQ ID NO: 19017 - DNA, 18 bp, Artificial Sequence
  Synthetic DNA
taatgcgactacctaaag

SEQ ID NO: 19018 - DNA, 18 bp, Artificial Sequence
  Synthetic DNA
taatgcgactcaaaacag

SEQ ID NO: 19019 - DNA, 18 bp, Artificial Sequence
  Synthetic DNA
taatgcgactcacgaccg

SEQ ID NO: 19020 - DNA, 18 bp, Artificial Sequence
  Synthetic DNA
taatgcgactcataatgg

SEQ ID NO: 19021 - DNA, 18 bp, Artificial Sequence
  Synthetic DNA
taatgcgactctacatag

SEQ ID NO: 19022 - DNA, 18 bp, Artificial Sequence
  Synthetic DNA
taatgcgatgcactaaag

SEQ ID NO: 19023 - DNA, 18 bp, Artificial Sequence
  Synthetic DNA
taatgcgattcaaaatag

SEQ ID NO: 19024 - DNA, 18 bp, Artificial Sequence
  Synthetic DNA
taatgcgcatcaccatag

SEQ ID NO: 19025 - DNA, 18 bp, Artificial Sequence
  Synthetic DNA
taatgcgtcacagtatag

SEQ ID NO: 19026 - DNA, 18 bp, Artificial Sequence
  Synthetic DNA
taatgcgtcttactgtag

SEQ ID NO: 19027 - DNA, 18 bp, Artificial Sequence
  Synthetic DNA
taatgcgtttcattatag

SEQ ID NO: 19028 - DNA, 18 bp, Artificial Sequence
  Synthetic DNA
taatgctacacacaatag

SEQ ID NO: 19029 - DNA, 18 bp, Artificial Sequence
  Synthetic DNA
taatgtaactcactctag

SEQ ID NO: 19030 - DNA, 18 bp, Artificial Sequence
  Synthetic DNA
taatgtgtgtcactatag

SEQ ID NO: 19031 - DNA, 18 bp, Artificial Sequence
  Synthetic DNA
taccaagactcattatag

SEQ ID NO: 19032 - DNA, 18 bp, Artificial Sequence
  Synthetic DNA
taccacgacacactttag

SEQ ID NO: 19033 - DNA, 18 bp, Artificial Sequence
  Synthetic DNA
taccacgccccactatag

SEQ ID NO: 19034 - DNA, 18 bp, Artificial Sequence
  Synthetic DNA
taccaggacgcactatag

SEQ ID NO: 19035 - DNA, 18 bp, Artificial Sequence
  Synthetic DNA
tactaactctcactatag

SEQ ID NO: 19036 - DNA, 18 bp, Artificial Sequence
  Synthetic DNA
tactaagacttacgatag

SEQ ID NO: 19037 - DNA, 18 bp, Artificial Sequence
  Synthetic DNA
tactacaactcactttcg

SEQ ID NO: 19038 - DNA, 18 bp, Artificial Sequence
  Synthetic DNA
tactacgaatctctttag

SEQ ID NO: 19039 - DNA, 18 bp, Artificial Sequence
  Synthetic DNA
tactacgacacacaatcg

SEQ ID NO: 19040 - DNA, 18 bp, Artificial Sequence
  Synthetic DNA
tactacgaccaagtatag

SEQ ID NO: 19041 - DNA, 18 bp, Artificial Sequence
  Synthetic DNA
tactacgactacgtatag

SEQ ID NO: 19042 - DNA, 18 bp, Artificial Sequence
  Synthetic DNA
tactacgactctatagag

SEQ ID NO: 19043 - DNA, 18 bp, Artificial Sequence
  Synthetic DNA
tactacgactgtcaatag

SEQ ID NO: 19044 - DNA, 18 bp, Artificial Sequence
  Synthetic DNA
tactacgagttactttag

SEQ ID NO: 19045 - DNA, 18 bp, Artificial Sequence
  Synthetic DNA
tactacgattatctatag

SEQ ID NO: 19046 - DNA, 18 bp, Artificial Sequence
  Synthetic DNA
tactacgcctcacattag

SEQ ID NO: 19047 - DNA, 18 bp, Artificial Sequence
  Synthetic DNA
tactacgcctctctttag

SEQ ID NO: 19048 - DNA, 18 bp, Artificial Sequence
  Synthetic DNA
tactactactcaacatag

SEQ ID NO: 19049 - DNA, 18 bp, Artificial Sequence
  Synthetic DNA
tactactactcactgtcg

SEQ ID NO: 19050 - DNA, 18 bp, Artificial Sequence
  Synthetic DNA
tactaggagtcactaaag

SEQ ID NO: 19051 - DNA, 18 bp, Artificial Sequence
  Synthetic DNA
tactaggcctcactttag

SEQ ID NO: 19052 - DNA, 18 bp, Artificial Sequence
  Synthetic DNA
tactatgactcagtaaag

SEQ ID NO: 19053 - DNA, 18 bp, Artificial Sequence
  Synthetic DNA
tactatgactcagtctag

SEQ ID NO: 19054 - DNA, 18 bp, Artificial Sequence
  Synthetic DNA
tactccaactcactgtag

SEQ ID NO: 19055 - DNA, 18 bp, Artificial Sequence
  Synthetic DNA
tactccggctcactaaag

SEQ ID NO: 19056 - DNA, 18 bp, Artificial Sequence
  Synthetic DNA
tactgggactcattatag

SEQ ID NO: 19057 - DNA, 18 bp, Artificial Sequence
  Synthetic DNA
tagaacgacggactatag

SEQ ID NO: 19058 - DNA, 18 bp, Artificial Sequence
  Synthetic DNA
tagcacgactcccaatag

SEQ ID NO: 19059 - DNA, 18 bp, Artificial Sequence
  Synthetic DNA
tagcactattcactatag

SEQ ID NO: 19060 - DNA, 18 bp, Artificial Sequence
  Synthetic DNA
tagtaaaactcactatgg

SEQ ID NO: 19061 - DNA, 18 bp, Artificial Sequence
  Synthetic DNA
tagtaagactcaatctag

SEQ ID NO: 19062 - DNA, 18 bp, Artificial Sequence
  Synthetic DNA
tagtaagatgcactatag

SEQ ID NO: 19063 - DNA, 18 bp, Artificial Sequence
  Synthetic DNA
tagtacaactcacttaag

SEQ ID NO: 19064 - DNA, 18 bp, Artificial Sequence
  Synthetic DNA
tagtacaactcataatag

SEQ ID NO: 19065 - DNA, 18 bp, Artificial Sequence
  Synthetic DNA
tagtacaactcattttag

SEQ ID NO: 19066 - DNA, 18 bp, Artificial Sequence
  Synthetic DNA
tagtacaactctatatag

SEQ ID NO: 19067 - DNA, 18 bp, Artificial Sequence
  Synthetic DNA
tagtaccacatactatag

SEQ ID NO: 19068 - DNA, 18 bp, Artificial Sequence
  Synthetic DNA
tagtaccactcaccaaag

SEQ ID NO: 19069 - DNA, 18 bp, Artificial Sequence
  Synthetic DNA
tagtacgaaacaatatag

SEQ ID NO: 19070 - DNA, 18 bp, Artificial Sequence
  Synthetic DNA
tagtacgaatctctacag

SEQ ID NO: 19071 - DNA, 18 bp, Artificial Sequence
  Synthetic DNA
tagtacgactaacaagag

SEQ ID NO: 19072 - DNA, 18 bp, Artificial Sequence
  Synthetic DNA
tagtacgactaactttcg

SEQ ID NO: 19073 - DNA, 18 bp, Artificial Sequence
  Synthetic DNA
tagtacgactccacatag

SEQ ID NO: 19074 - DNA, 18 bp, Artificial Sequence
  Synthetic DNA
tagtacgagttcctatag

SEQ ID NO: 19075 - DNA, 18 bp, Artificial Sequence
  Synthetic DNA
tagtacgattccgtatag

SEQ ID NO: 19076 - DNA, 18 bp, Artificial Sequence
  Synthetic DNA
tagtacgcctaactttag

SEQ ID NO: 19077 - DNA, 18 bp, Artificial Sequence
  Synthetic DNA
tagtacggctaactacag

SEQ ID NO: 19078 - DNA, 18 bp, Artificial Sequence
  Synthetic DNA
tagtacggctcacaaaag

SEQ ID NO: 19079 - DNA, 18 bp, Artificial Sequence
  Synthetic DNA
tagtacgtatcactctag

SEQ ID NO: 19080 - DNA, 18 bp, Artificial Sequence
  Synthetic DNA
tagtacgtcagactatag

SEQ ID NO: 19081 - DNA, 18 bp, Artificial Sequence
  Synthetic DNA
tagtacgtctcaccatgg

SEQ ID NO: 19082 - DNA, 18 bp, Artificial Sequence
  Synthetic DNA
tagtacgtctcactttgg

SEQ ID NO: 19083 - DNA, 18 bp, Artificial Sequence
  Synthetic DNA
tagtacgtctcattctag

SEQ ID NO: 19084 - DNA, 18 bp, Artificial Sequence
  Synthetic DNA
tagtactactcaatttag

SEQ ID NO: 19085 - DNA, 18 bp, Artificial Sequence
  Synthetic DNA
tagtactagtccctatag

SEQ ID NO: 19086 - DNA, 18 bp, Artificial Sequence
  Synthetic DNA
tagtagtacacactatag

SEQ ID NO: 19087 - DNA, 18 bp, Artificial Sequence
  Synthetic DNA
tagtatgattcacaatag

SEQ ID NO: 19088 - DNA, 18 bp, Artificial Sequence
  Synthetic DNA
tagtattactcactatcg

SEQ ID NO: 19089 - DNA, 18 bp, Artificial Sequence
  Synthetic DNA
tagtgaaactcactatag

SEQ ID NO: 19090 - DNA, 18 bp, Artificial Sequence
  Synthetic DNA
tagtgcgaatcactatcg

SEQ ID NO: 19091 - DNA, 18 bp, Artificial Sequence
  Synthetic DNA
tagtgcgtcgcactatag

SEQ ID NO: 19092 - DNA, 18 bp, Artificial Sequence
  Synthetic DNA
tagtgctactctctatag

SEQ ID NO: 19093 - DNA, 18 bp, Artificial Sequence
  Synthetic DNA
tataacgactcacgaaag

SEQ ID NO: 19094 - DNA, 18 bp, Artificial Sequence
  Synthetic DNA
tataacgactccctgtag

SEQ ID NO: 19095 - DNA, 18 bp, Artificial Sequence
  Synthetic DNA
tataacgactgaccatag

SEQ ID NO: 19096 - DNA, 18 bp, Artificial Sequence
  Synthetic DNA
tataacgagtcattatag

SEQ ID NO: 19097 - DNA, 18 bp, Artificial Sequence
  Synthetic DNA
tataaggactcactagag

SEQ ID NO: 19098 - DNA, 18 bp, Artificial Sequence
  Synthetic DNA
tataccgactcattatag

SEQ ID NO: 19099 - DNA, 18 bp, Artificial Sequence
  Synthetic DNA
tatcacgacccactctag

SEQ ID NO: 19100 - DNA, 18 bp, Artificial Sequence
  Synthetic DNA
tatcaggactcaatatag

SEQ ID NO: 19101 - DNA, 18 bp, Artificial Sequence
  Synthetic DNA
tatgacgaataactatag

SEQ ID NO: 19102 - DNA, 18 bp, Artificial Sequence
  Synthetic DNA
tatggcgactctctatag

SEQ ID NO: 19103 - DNA, 18 bp, Artificial Sequence
  Synthetic DNA
tattaagactcacggtag

SEQ ID NO: 19104 - DNA, 18 bp, Artificial Sequence
  Synthetic DNA
tattaagactccttatag

SEQ ID NO: 19105 - DNA, 18 bp, Artificial Sequence
  Synthetic DNA
tattaaggcttactatag

SEQ ID NO: 19106 - DNA, 18 bp, Artificial Sequence
  Synthetic DNA
tattacaaatcacgatag

SEQ ID NO: 19107 - DNA, 18 bp, Artificial Sequence
  Synthetic DNA
tattacaacgcactctag

SEQ ID NO: 19108 - DNA, 18 bp, Artificial Sequence
  Synthetic DNA
tattacaactcaccatgg

SEQ ID NO: 19109 - DNA, 18 bp, Artificial Sequence
  Synthetic DNA
tattacaacttactctag

SEQ ID NO: 19110 - DNA, 18 bp, Artificial Sequence
  Synthetic DNA
tattaccaccaactatag

SEQ ID NO: 19111 - DNA, 18 bp, Artificial Sequence
  Synthetic DNA
tattaccactaactttag

SEQ ID NO: 19112 - DNA, 18 bp, Artificial Sequence
  Synthetic DNA
tattacgaaccactctag

SEQ ID NO: 19113 - DNA, 18 bp, Artificial Sequence
  Synthetic DNA
tattacgaatcaatctag

SEQ ID NO: 19114 - DNA, 18 bp, Artificial Sequence
  Synthetic DNA
tattacgacagaatatag

SEQ ID NO: 19115 - DNA, 18 bp, Artificial Sequence
  Synthetic DNA
tattacgacatactagag

SEQ ID NO: 19116 - DNA, 18 bp, Artificial Sequence
  Synthetic DNA
tattacgacatcctatag

SEQ ID NO: 19117 - DNA, 18 bp, Artificial Sequence
  Synthetic DNA
tattacgacccagtaaag

SEQ ID NO: 19118 - DNA, 18 bp, Artificial Sequence
  Synthetic DNA
tattacgactcattccag

SEQ ID NO: 19119 - DNA, 18 bp, Artificial Sequence
  Synthetic DNA
tattacgactccctttgg

SEQ ID NO: 19120 - DNA, 18 bp, Artificial Sequence
  Synthetic DNA
tattacgactccgaatag

SEQ ID NO: 19121 - DNA, 18 bp, Artificial Sequence
  Synthetic DNA
tattacgactccttagag

SEQ ID NO: 19122 - DNA, 18 bp, Artificial Sequence
  Synthetic DNA
tattacgactctatctag

SEQ ID NO: 19123 - DNA, 18 bp, Artificial Sequence
  Synthetic DNA
tattacgactgactaacg

SEQ ID NO: 19124 - DNA, 18 bp, Artificial Sequence
  Synthetic DNA
tattacggcacactatcg

SEQ ID NO: 19125 - DNA, 18 bp, Artificial Sequence
  Synthetic DNA
tattacggctaactatcg

SEQ ID NO: 19126 - DNA, 18 bp, Artificial Sequence
  Synthetic DNA
tattacgtcacactataa

SEQ ID NO: 19127 - DNA, 18 bp, Artificial Sequence
  Synthetic DNA
tattacgtcccaatatag

SEQ ID NO: 19128 - DNA, 18 bp, Artificial Sequence
  Synthetic DNA
tattacgtctgactaaag

SEQ ID NO: 19129 - DNA, 18 bp, Artificial Sequence
  Synthetic DNA
tattacgtgtcactctag

SEQ ID NO: 19130 - DNA, 18 bp, Artificial Sequence
  Synthetic DNA
tattactattcaccatag

SEQ ID NO: 19131 - DNA, 18 bp, Artificial Sequence
  Synthetic DNA
tattaggactcaatctag

SEQ ID NO: 19132 - DNA, 18 bp, Artificial Sequence
  Synthetic DNA
tattaggtcacactatag

SEQ ID NO: 19133 - DNA, 18 bp, Artificial Sequence
  Synthetic DNA
tattaggtctcaatatag

SEQ ID NO: 19134 - DNA, 18 bp, Artificial Sequence
  Synthetic DNA
tattatgacgcacgatag

SEQ ID NO: 19135 - DNA, 18 bp, Artificial Sequence
  Synthetic DNA
tattatgactcacagtag

SEQ ID NO: 19136 - DNA, 18 bp, Artificial Sequence
  Synthetic DNA
tattatgactccctctag

SEQ ID NO: 19137 - DNA, 18 bp, Artificial Sequence
  Synthetic DNA
tattatgcctcagtatag

SEQ ID NO: 19138 - DNA, 18 bp, Artificial Sequence
  Synthetic DNA
tattatgtctcactatgg

SEQ ID NO: 19139 - DNA, 18 bp, Artificial Sequence
  Synthetic DNA
tattattgctcactatag

SEQ ID NO: 19140 - DNA, 18 bp, Artificial Sequence
  Synthetic DNA
tattccgactcactcgag

SEQ ID NO: 19141 - DNA, 18 bp, Artificial Sequence
  Synthetic DNA
tattccgactgacaatag

SEQ ID NO: 19142 - DNA, 18 bp, Artificial Sequence
  Synthetic DNA
tattcctagtcactatag

SEQ ID NO: 19143 - DNA, 18 bp, Artificial Sequence
  Synthetic DNA
tattgcgaatcacaatag

SEQ ID NO: 19144 - DNA, 18 bp, Artificial Sequence
  Synthetic DNA
tattgcgactcactgaag

SEQ ID NO: 19145 - DNA, 18 bp, Artificial Sequence
  Synthetic DNA
tattgcgactgactatcg

SEQ ID NO: 19146 - DNA, 18 bp, Artificial Sequence
  Synthetic DNA
tcaaaccactcattatag

SEQ ID NO: 19147 - DNA, 18 bp, Artificial Sequence
  Synthetic DNA
tcaaacgactccctttag

SEQ ID NO: 19148 - DNA, 18 bp, Artificial Sequence
  Synthetic DNA
tcacacgacatactatag

SEQ ID NO: 19149 - DNA, 18 bp, Artificial Sequence
  Synthetic DNA
tcataagaggcactatag

SEQ ID NO: 19150 - DNA, 18 bp, Artificial Sequence
  Synthetic DNA
tcatacaactcactttgg

SEQ ID NO: 19151 - DNA, 18 bp, Artificial Sequence
  Synthetic DNA
tcatacaattctctatag

SEQ ID NO: 19152 - DNA, 18 bp, Artificial Sequence
  Synthetic DNA
tcatacgaatcacaacag

SEQ ID NO: 19153 - DNA, 18 bp, Artificial Sequence
  Synthetic DNA
tcatacgacacagtaaag

SEQ ID NO: 19154 - DNA, 18 bp, Artificial Sequence
  Synthetic DNA
tcatacgacccacttgag

SEQ ID NO: 19155 - DNA, 18 bp, Artificial Sequence
  Synthetic DNA
tcatacgactcacactcg

SEQ ID NO: 19156 - DNA, 18 bp, Artificial Sequence
  Synthetic DNA
tcatacgactcacgcaag

SEQ ID NO: 19157 - DNA, 18 bp, Artificial Sequence
  Synthetic DNA
tcatacgactcatcgtag

SEQ ID NO: 19158 - DNA, 18 bp, Artificial Sequence
  Synthetic DNA
tcatacgactcccttaag

SEQ ID NO: 19159 - DNA, 18 bp, Artificial Sequence
  Synthetic DNA
tcatacgactgcctatgg

SEQ ID NO: 19160 - DNA, 18 bp, Artificial Sequence
  Synthetic DNA
tcatacggctcacaacag

SEQ ID NO: 19161 - DNA, 18 bp, Artificial Sequence
  Synthetic DNA
tcatacgtcccactaaag

SEQ ID NO: 19162 - DNA, 18 bp, Artificial Sequence
  Synthetic DNA
tcatacgtctcagtacag

SEQ ID NO: 19163 - DNA, 18 bp, Artificial Sequence
  Synthetic DNA
tcatactaatcattatag

SEQ ID NO: 19164 - DNA, 18 bp, Artificial Sequence
  Synthetic DNA
tcatactaccgactatag

SEQ ID NO: 19165 - DNA, 18 bp, Artificial Sequence
  Synthetic DNA
tcatactactctatatag

SEQ ID NO: 19166 - DNA, 18 bp, Artificial Sequence
  Synthetic DNA
tcatatgcctcactctag

SEQ ID NO: 19167 - DNA, 18 bp, Artificial Sequence
  Synthetic DNA
tcatccaactcactttag

SEQ ID NO: 19168 - DNA, 18 bp, Artificial Sequence
  Synthetic DNA
tcatccgactcattttag

SEQ ID NO: 19169 - DNA, 18 bp, Artificial Sequence
  Synthetic DNA
tcatctgacttactatag

SEQ ID NO: 19170 - DNA, 18 bp, Artificial Sequence
  Synthetic DNA
tcatgcgattcacaatag

SEQ ID NO: 19171 - DNA, 18 bp, Artificial Sequence
  Synthetic DNA
tccaacgactcacaatag

SEQ ID NO: 19172 - DNA, 18 bp, Artificial Sequence
  Synthetic DNA
tcctacgacacactgtag

SEQ ID NO: 19173 - DNA, 18 bp, Artificial Sequence
  Synthetic DNA
tcctacgacacactttag

SEQ ID NO: 19174 - DNA, 18 bp, Artificial Sequence
  Synthetic DNA
tcctacgtctcacaatag

SEQ ID NO: 19175 - DNA, 18 bp, Artificial Sequence
  Synthetic DNA
tcctatgcctcactatag

SEQ ID NO: 19176 - DNA, 18 bp, Artificial Sequence
  Synthetic DNA
tcgaacgactcactatcg

SEQ ID NO: 19177 - DNA, 18 bp, Artificial Sequence
  Synthetic DNA
tcgtacgaatcactctag

SEQ ID NO: 19178 - DNA, 18 bp, Artificial Sequence
  Synthetic DNA
tcgtacgactcacaaaag

SEQ ID NO: 19179 - DNA, 18 bp, Artificial Sequence
  Synthetic DNA
tcgtactactgactatag

SEQ ID NO: 19180 - DNA, 18 bp, Artificial Sequence
  Synthetic DNA
tcgtatgactcacaatag

SEQ ID NO: 19181 - DNA, 18 bp, Artificial Sequence
  Synthetic DNA
tctaacgactcactatcg

SEQ ID NO: 19182 - DNA, 18 bp, Artificial Sequence
  Synthetic DNA
tcttacgacacactatcg

SEQ ID NO: 19183 - DNA, 18 bp, Artificial Sequence
  Synthetic DNA
tcttacgactcaccagag

SEQ ID NO: 19184 - DNA, 18 bp, Artificial Sequence
  Synthetic DNA
tcttactactcactacag

SEQ ID NO: 19185 - DNA, 18 bp, Artificial Sequence
  Synthetic DNA
tgaaacgacctactatag

SEQ ID NO: 19186 - DNA, 18 bp, Artificial Sequence
  Synthetic DNA
tgacacaactcactctag

SEQ ID NO: 19187 - DNA, 18 bp, Artificial Sequence
  Synthetic DNA
tgagacgaatctctatag

SEQ ID NO: 19188 - DNA, 18 bp, Artificial Sequence
  Synthetic DNA
tgataagactaacaatag

SEQ ID NO: 19189 - DNA, 18 bp, Artificial Sequence
  Synthetic DNA
tgataagactcactccag

SEQ ID NO: 19190 - DNA, 18 bp, Artificial Sequence
  Synthetic DNA
tgataagactcagtacag

SEQ ID NO: 19191 - DNA, 18 bp, Artificial Sequence
  Synthetic DNA
tgatacaacgcactatcg

SEQ ID NO: 19192 - DNA, 18 bp, Artificial Sequence
  Synthetic DNA
tgatacacctcaatatag

SEQ ID NO: 19193 - DNA, 18 bp, Artificial Sequence
  Synthetic DNA
tgatacgaatcactaagg

SEQ ID NO: 19194 - DNA, 18 bp, Artificial Sequence
  Synthetic DNA
tgatacgactcacagtgg

SEQ ID NO: 19195 - DNA, 18 bp, Artificial Sequence
  Synthetic DNA
tgatacgactcagcttag

SEQ ID NO: 19196 - DNA, 18 bp, Artificial Sequence
  Synthetic DNA
tgatacgactcatttgag

SEQ ID NO: 19197 - DNA, 18 bp, Artificial Sequence
  Synthetic DNA
tgatacgactgacattag

SEQ ID NO: 19198 - DNA, 18 bp, Artificial Sequence
  Synthetic DNA
tgatacgacttattttag

SEQ ID NO: 19199 - DNA, 18 bp, Artificial Sequence
  Synthetic DNA
tgatacgagtcactgaag

SEQ ID NO: 19200 - DNA, 18 bp, Artificial Sequence
  Synthetic DNA
tgatacgtctcacactag

SEQ ID NO: 19201 - DNA, 18 bp, Artificial Sequence
  Synthetic DNA
tgatactactctctatcg

SEQ ID NO: 19202 - DNA, 18 bp, Artificial Sequence
  Synthetic DNA
tgataggactcactttgg

SEQ ID NO: 19203 - DNA, 18 bp, Artificial Sequence
  Synthetic DNA
tgatatgacacacaatag

SEQ ID NO: 19204 - DNA, 18 bp, Artificial Sequence
  Synthetic DNA
tgatatgcctcagtatag

SEQ ID NO: 19205 - DNA, 18 bp, Artificial Sequence
  Synthetic DNA
tgatattactcactataa

SEQ ID NO: 19206 - DNA, 18 bp, Artificial Sequence
  Synthetic DNA
tgatctgactctctatag

SEQ ID NO: 19207 - DNA, 18 bp, Artificial Sequence
  Synthetic DNA
tgatgcctctcactatag

SEQ ID NO: 19208 - DNA, 18 bp, Artificial Sequence
  Synthetic DNA
tgatgcgacacactttag

SEQ ID NO: 19209 - DNA, 18 bp, Artificial Sequence
  Synthetic DNA
tgatgcgactaaatatag

SEQ ID NO: 19210 - DNA, 18 bp, Artificial Sequence
  Synthetic DNA
tgatgcgcctcactttag

SEQ ID NO: 19211 - DNA, 18 bp, Artificial Sequence
  Synthetic DNA
tgccacgactcaatatag

SEQ ID NO: 19212 - DNA, 18 bp, Artificial Sequence
  Synthetic DNA
tgctccgtctcactatag

SEQ ID NO: 19213 - DNA, 18 bp, Artificial Sequence
  Synthetic DNA
tggtacggcacactatag

SEQ ID NO: 19214 - DNA, 18 bp, Artificial Sequence
  Synthetic DNA
tgttacgagtcactctag

SEQ ID NO: 19215 - DNA, 18 bp, Artificial Sequence
  Synthetic DNA
tgttatcactcactatag

SEQ ID NO: 19216 - DNA, 18 bp, Artificial Sequence
  Synthetic DNA
tgttgcgtctcactatag

SEQ ID NO: 19217 - DNA, 18 bp, Artificial Sequence
  Synthetic DNA
ttaaacctctcactatag

SEQ ID NO: 19218 - DNA, 18 bp, Artificial Sequence
  Synthetic DNA
ttaaacgactaattatag

SEQ ID NO: 19219 - DNA, 18 bp, Artificial Sequence
  Synthetic DNA
ttaaacgactctctacag

SEQ ID NO: 19220 - DNA, 18 bp, Artificial Sequence
  Synthetic DNA
ttaaaggactcactatcg

SEQ ID NO: 19221 - DNA, 18 bp, Artificial Sequence
  Synthetic DNA
ttacaagactctctatag

SEQ ID NO: 19222 - DNA, 18 bp, Artificial Sequence
  Synthetic DNA
ttagacgacttactatcg

SEQ ID NO: 19223 - DNA, 18 bp, Artificial Sequence
  Synthetic DNA
ttataagactaacgatag

SEQ ID NO: 19224 - DNA, 18 bp, Artificial Sequence
  Synthetic DNA
ttataagactccgtatag

SEQ ID NO: 19225 - DNA, 18 bp, Artificial Sequence
  Synthetic DNA
ttataagagtcactgtag

SEQ ID NO: 19226 - DNA, 18 bp, Artificial Sequence
  Synthetic DNA
ttatacaactcaccacag

SEQ ID NO: 19227 - DNA, 18 bp, Artificial Sequence
  Synthetic DNA
ttatacctctcactctag

SEQ ID NO: 19228 - DNA, 18 bp, Artificial Sequence
  Synthetic DNA
ttatacgacacacactag

SEQ ID NO: 19229 - DNA, 18 bp, Artificial Sequence
  Synthetic DNA
ttatacgacagagtatag

SEQ ID NO: 19230 - DNA, 18 bp, Artificial Sequence
  Synthetic DNA
ttatacgactcacaaggg

SEQ ID NO: 19231 - DNA, 18 bp, Artificial Sequence
  Synthetic DNA
ttatacgactcatcagag

SEQ ID NO: 19232 - DNA, 18 bp, Artificial Sequence
  Synthetic DNA
ttatacgactctccgtag

SEQ ID NO: 19233 - DNA, 18 bp, Artificial Sequence
  Synthetic DNA
ttatacgacttatcatag

SEQ ID NO: 19234 - DNA, 18 bp, Artificial Sequence
  Synthetic DNA
ttatacgacttattagag

SEQ ID NO: 19235 - DNA, 18 bp, Artificial Sequence
  Synthetic DNA
ttatacgagacactctag

SEQ ID NO: 19236 - DNA, 18 bp, Artificial Sequence
  Synthetic DNA
ttatacgagtaactatcg

SEQ ID NO: 19237 - DNA, 18 bp, Artificial Sequence
  Synthetic DNA
ttatacgattctccatag

SEQ ID NO: 19238 - DNA, 18 bp, Artificial Sequence
  Synthetic DNA
ttatacgcatccctatag

SEQ ID NO: 19239 - DNA, 18 bp, Artificial Sequence
  Synthetic DNA
ttatacggcccattatag

SEQ ID NO: 19240 - DNA, 18 bp, Artificial Sequence
  Synthetic DNA
ttatacggctcaatacag

SEQ ID NO: 19241 - DNA, 18 bp, Artificial Sequence
  Synthetic DNA
ttatacggctcacgatcg

SEQ ID NO: 19242 - DNA, 18 bp, Artificial Sequence
  Synthetic DNA
ttatacgtctaactatcg

SEQ ID NO: 19243 - DNA, 18 bp, Artificial Sequence
  Synthetic DNA
ttatacgtctcaatatcg

SEQ ID NO: 19244 - DNA, 18 bp, Artificial Sequence
  Synthetic DNA
ttatacgtctcagtatcg

SEQ ID NO: 19245 - DNA, 18 bp, Artificial Sequence
  Synthetic DNA
ttatacgtgtcactctag

SEQ ID NO: 19246 - DNA, 18 bp, Artificial Sequence
  Synthetic DNA
ttatactactcacaatcg

SEQ ID NO: 19247 - DNA, 18 bp, Artificial Sequence
  Synthetic DNA
ttatactgctcactttag

SEQ ID NO: 19248 - DNA, 18 bp, Artificial Sequence
  Synthetic DNA
ttatagatctcactatag

SEQ ID NO: 19249 - DNA, 18 bp, Artificial Sequence
  Synthetic DNA
ttataggacacactagag

SEQ ID NO: 19250 - DNA, 18 bp, Artificial Sequence
  Synthetic DNA
ttataggactaactaaag

SEQ ID NO: 19251 - DNA, 18 bp, Artificial Sequence
  Synthetic DNA
ttataggactcattttag

SEQ ID NO: 19252 - DNA, 18 bp, Artificial Sequence
  Synthetic DNA
ttataggagccactatag

SEQ ID NO: 19253 - DNA, 18 bp, Artificial Sequence
  Synthetic DNA
ttatagtactcactatgg

SEQ ID NO: 19254 - DNA, 18 bp, Artificial Sequence
  Synthetic DNA
ttatatgactcaatatcg

SEQ ID NO: 19255 - DNA, 18 bp, Artificial Sequence
  Synthetic DNA
ttatattactcaatatag

SEQ ID NO: 19256 - DNA, 18 bp, Artificial Sequence
  Synthetic DNA
ttatccgacccactacag

SEQ ID NO: 19257 - DNA, 18 bp, Artificial Sequence
  Synthetic DNA
ttatccgactcactccag

SEQ ID NO: 19258 - DNA, 18 bp, Artificial Sequence
  Synthetic DNA
ttatccgtctcactacag

SEQ ID NO: 19259 - DNA, 18 bp, Artificial Sequence
  Synthetic DNA
ttatgcgactaactttag

SEQ ID NO: 19260 - DNA, 18 bp, Artificial Sequence
  Synthetic DNA
ttatgcgactcataatag

SEQ ID NO: 19261 - DNA, 18 bp, Artificial Sequence
  Synthetic DNA
ttatgcgcctcactatgg

SEQ ID NO: 19262 - DNA, 18 bp, Artificial Sequence
  Synthetic DNA
ttatgcgcctcactgtag

SEQ ID NO: 19263 - DNA, 18 bp, Artificial Sequence
  Synthetic DNA
ttatgtgcctcactatag

SEQ ID NO: 19264 - DNA, 18 bp, Artificial Sequence
  Synthetic DNA
ttccacgactcactacag

SEQ ID NO: 19265 - DNA, 18 bp, Artificial Sequence
  Synthetic DNA
ttctaagcctcactatag

SEQ ID NO: 19266 - DNA, 18 bp, Artificial Sequence
  Synthetic DNA
ttctacgactacctatag

SEQ ID NO: 19267 - DNA, 18 bp, Artificial Sequence
  Synthetic DNA
ttctacgactcacaacag

SEQ ID NO: 19268 - DNA, 18 bp, Artificial Sequence
  Synthetic DNA
ttctacgactcaggatag

SEQ ID NO: 19269 - DNA, 18 bp, Artificial Sequence
  Synthetic DNA
ttctccgactcattatag

SEQ ID NO: 19270 - DNA, 18 bp, Artificial Sequence
  Synthetic DNA
ttctgcgactctctatag

SEQ ID NO: 19271 - DNA, 18 bp, Artificial Sequence
  Synthetic DNA
ttgaacgactccctatag

SEQ ID NO: 19272 - DNA, 18 bp, Artificial Sequence
  Synthetic DNA
ttgtaagactcactaaag

SEQ ID NO: 19273 - DNA, 18 bp, Artificial Sequence
  Synthetic DNA
ttgtaccgctcactatag

SEQ ID NO: 19274 - DNA, 18 bp, Artificial Sequence
  Synthetic DNA
ttgtacgtcttactatag

SEQ ID NO: 19275 - DNA, 18 bp, Artificial Sequence
  Synthetic DNA
ttttacgactcacaagag

SEQ ID NO: 19276 - DNA, 18 bp, Artificial Sequence
  Synthetic DNA
ttttacgagtcactttag

SEQ ID NO: 19277 - DNA, 18 bp, Artificial Sequence
  Synthetic DNA
ttttaggacccactatag

SEQ ID NO: 19278 - DNA, 18 bp, Artificial Sequence
  Synthetic DNA
ttttaggactcactacag

SEQ ID NO: 19279 - DNA, 18 bp, Artificial Sequence
  Synthetic DNA
ttttccgactctctatag

SEQ ID NO: 19280 - DNA, 18 bp, Artificial Sequence
  Synthetic DNA
ttattcgtctcactacag

SEQ ID NO: 19281 - DNA, 18 bp, Artificial Sequence
  Synthetic DNA
ctattagactcactatag

SEQ ID NO: 19282 - DNA, 18 bp, Artificial Sequence
  Synthetic DNA
ttatacgactcattaatg

SEQ ID NO: 19283 - DNA, 18 bp, Artificial Sequence
  Synthetic DNA
tgtaacgtctcactatag

SEQ ID NO: 19284 - DNA, 18 bp, Artificial Sequence
  Synthetic DNA
caattcaactcactgtag

SEQ ID NO: 19285 - DNA, 18 bp, Artificial Sequence
  Synthetic DNA
ttattagactcactttag

SEQ ID NO: 19286 - DNA, 18 bp, Artificial Sequence
  Synthetic DNA
tttttcgactcactaaag

SEQ ID NO: 19287 - DNA, 18 bp, Artificial Sequence
  Synthetic DNA
taatacgacactatattg

SEQ ID NO: 19288 - DNA, 18 bp, Artificial Sequence
  Synthetic DNA
ctataagactcacaatag

SEQ ID NO: 19289 - DNA, 18 bp, Artificial Sequence
  Synthetic DNA
tactacgactcacataag

SEQ ID NO: 19290 - DNA, 18 bp, Artificial Sequence
  Synthetic DNA
tgttacgactaactaaag

SEQ ID NO: 19291 - DNA, 18 bp, Artificial Sequence
  Synthetic DNA
ttgtacgattctctatag

SEQ ID NO: 19292 - DNA, 18 bp, Artificial Sequence
  Synthetic DNA
ttgtactactcactaaag

SEQ ID NO: 19293 - DNA, 18 bp, Artificial Sequence
  Synthetic DNA
atttacgactcactacag

SEQ ID NO: 19294 - DNA, 18 bp, Artificial Sequence
  Synthetic DNA
tttaacgactcactttag

SEQ ID NO: 19295 - DNA, 18 bp, Artificial Sequence
  Synthetic DNA
taattagactcactactg

SEQ ID NO: 19296 - DNA, 18 bp, Artificial Sequence
  Synthetic DNA
taaaatgactcgctttag

SEQ ID NO: 19297 - DNA, 18 bp, Artificial Sequence
  Synthetic DNA
taatacgactcgcttacg

SEQ ID NO: 19298 - DNA, 18 bp, Artificial Sequence
  Synthetic DNA
taatacggctctctaatg

SEQ ID NO: 19299 - DNA, 18 bp, Artificial Sequence
  Synthetic DNA
tcatacgaataactattg

SEQ ID NO: 19300 - DNA, 18 bp, Artificial Sequence
  Synthetic DNA
tcatacggctctctattg

SEQ ID NO: 19301 - DNA, 18 bp, Artificial Sequence
  Synthetic DNA
cattacgactcaatttag

SEQ ID NO: 19302 - DNA, 18 bp, Artificial Sequence
  Synthetic DNA
taaaacgaaacagtatag

SEQ ID NO: 19303 - DNA, 18 bp, Artificial Sequence
  Synthetic DNA
taaaacgtctcactacgg

SEQ ID NO: 19304 - DNA, 18 bp, Artificial Sequence
  Synthetic DNA
taaaaggactcacagtag

SEQ ID NO: 19305 - DNA, 18 bp, Artificial Sequence
  Synthetic DNA
taataagattcactttcg

SEQ ID NO: 19306 - DNA, 18 bp, Artificial Sequence
  Synthetic DNA
taatactacaccatatag

SEQ ID NO: 19307 - DNA, 18 bp, Artificial Sequence
  Synthetic DNA
taatatgtatcactaaag

SEQ ID NO: 19308 - DNA, 18 bp, Artificial Sequence
  Synthetic DNA
taatcagtcacactatag

SEQ ID NO: 19309 - DNA, 18 bp, Artificial Sequence
  Synthetic DNA
tattacgactcacggaag

SEQ ID NO: 19310 - DNA, 18 bp, Artificial Sequence
  Synthetic DNA
tattacgactctctaagg

SEQ ID NO: 19311 - DNA, 18 bp, Artificial Sequence
  Synthetic DNA
tattacggattactatag

SEQ ID NO: 19312 - DNA, 18 bp, Artificial Sequence
  Synthetic DNA
tattcctacttactatag

SEQ ID NO: 19313 - DNA, 18 bp, Artificial Sequence
  Synthetic DNA
tgttacgtctcactaaag

SEQ ID NO: 19314 - DNA, 18 bp, Artificial Sequence
  Synthetic DNA
ttatcctactctctatag

SEQ ID NO: 19315 - DNA, 18 bp, Artificial Sequence
  Synthetic DNA
ttgtactactcacaatag

SEQ ID NO: 19316 - DNA, 18 bp, Artificial Sequence
  Synthetic DNA
ttttacgtatcactatag

SEQ ID NO: 19317 - DNA, 18 bp, Artificial Sequence
  Synthetic DNA
atatacgactcacagtag

SEQ ID NO: 19318 - DNA, 18 bp, Artificial Sequence
  Synthetic DNA
ttttacgactcactaatg

SEQ ID NO: 19319 - DNA, 18 bp, Artificial Sequence
  Synthetic DNA
ttttacaactcactttag

SEQ ID NO: 19320 - DNA, 18 bp, Artificial Sequence
  Synthetic DNA
ttattcgcctcactacag

SEQ ID NO: 19321 - DNA, 18 bp, Artificial Sequence
  Synthetic DNA
taaaacgactcacctttg

SEQ ID NO: 19322 - DNA, 18 bp, Artificial Sequence
  Synthetic DNA
tattacaactcactaatg

SEQ ID NO: 19323 - DNA, 18 bp, Artificial Sequence
  Synthetic DNA
tattacgtctcacttaag

SEQ ID NO: 19324 - DNA, 18 bp, Artificial Sequence
  Synthetic DNA
taatataactcgctattg

SEQ ID NO: 19325 - DNA, 18 bp, Artificial Sequence
  Synthetic DNA
taattcgacccaccattg

SEQ ID NO: 19326 - DNA, 18 bp, Artificial Sequence
  Synthetic DNA
taattcgattcagtattg

SEQ ID NO: 19327 - DNA, 18 bp, Artificial Sequence
  Synthetic DNA
aaatacgaatcgccatag

SEQ ID NO: 19328 - DNA, 18 bp, Artificial Sequence
  Synthetic DNA
aaataggactcactaatg

SEQ ID NO: 19329 - DNA, 18 bp, Artificial Sequence
  Synthetic DNA
aaattcgtcccactatag

SEQ ID NO: 19330 - DNA, 18 bp, Artificial Sequence
  Synthetic DNA
aaatttgactcattatag

SEQ ID NO: 19331 - DNA, 18 bp, Artificial Sequence
  Synthetic DNA
atatacgactcacgattg

SEQ ID NO: 19332 - DNA, 18 bp, Artificial Sequence
  Synthetic DNA
caactcgacgcactatag

SEQ ID NO: 19333 - DNA, 18 bp, Artificial Sequence
  Synthetic DNA
cattacaactcactattg

SEQ ID NO: 19334 - DNA, 18 bp, Artificial Sequence
  Synthetic DNA
cattatgactcactattg

SEQ ID NO: 19335 - DNA, 18 bp, Artificial Sequence
  Synthetic DNA
ccatttgactcactatag

SEQ ID NO: 19336 - DNA, 18 bp, Artificial Sequence
  Synthetic DNA
gaatacgacttactcttg

SEQ ID NO: 19337 - DNA, 18 bp, Artificial Sequence
  Synthetic DNA
taaaacaactcgctctag

SEQ ID NO: 19338 - DNA, 18 bp, Artificial Sequence
  Synthetic DNA
taaatcaactcactctag

SEQ ID NO: 19339 - DNA, 18 bp, Artificial Sequence
  Synthetic DNA
taaatcgcgtcactatag

SEQ ID NO: 19340 - DNA, 18 bp, Artificial Sequence
  Synthetic DNA
taataagactcacacttg

SEQ ID NO: 19341 - DNA, 18 bp, Artificial Sequence
  Synthetic DNA
taatacacttcactattg

SEQ ID NO: 19342 - DNA, 18 bp, Artificial Sequence
  Synthetic DNA
taatacctttcactattg

SEQ ID NO: 19343 - DNA, 18 bp, Artificial Sequence
  Synthetic DNA
taatacgacacaccgttg

SEQ ID NO: 19344 - DNA, 18 bp, Artificial Sequence
  Synthetic DNA
taatacgactttctgttg

SEQ ID NO: 19345 - DNA, 18 bp, Artificial Sequence
  Synthetic DNA
taatacgtctcacccttg

SEQ ID NO: 19346 - DNA, 18 bp, Artificial Sequence
  Synthetic DNA
taatacgtctcgccaaag

SEQ ID NO: 19347 - DNA, 18 bp, Artificial Sequence
  Synthetic DNA
taatatgactcacatttg

SEQ ID NO: 19348 - DNA, 18 bp, Artificial Sequence
  Synthetic DNA
taatccgactcactgatg

SEQ ID NO: 19349 - DNA, 18 bp, Artificial Sequence
  Synthetic DNA
taattagacacactatgg

SEQ ID NO: 19350 - DNA, 18 bp, Artificial Sequence
  Synthetic DNA
taattctacttactgtag

SEQ ID NO: 19351 - DNA, 18 bp, Artificial Sequence
  Synthetic DNA
tacttcgactcaatacag

SEQ ID NO: 19352 - DNA, 18 bp, Artificial Sequence
  Synthetic DNA
tactttgacacactatag

SEQ ID NO: 19353 - DNA, 18 bp, Artificial Sequence
  Synthetic DNA
tatatcgactccctatag

SEQ ID NO: 19354 - DNA, 18 bp, Artificial Sequence
  Synthetic DNA
tatgtcgtctcactatag

SEQ ID NO: 19355 - DNA, 18 bp, Artificial Sequence
  Synthetic DNA
tattacgacgcacgattg

SEQ ID NO: 19356 - DNA, 18 bp, Artificial Sequence
  Synthetic DNA
tcatacaactcacaattg

SEQ ID NO: 19357 - DNA, 18 bp, Artificial Sequence
  Synthetic DNA
tgattctacccactatag

SEQ ID NO: 19358 - DNA, 18 bp, Artificial Sequence
  Synthetic DNA
ttacacgactcactactg

SEQ ID NO: 19359 - DNA, 18 bp, Artificial Sequence
  Synthetic DNA
ttatactagtcactattg

SEQ ID NO: 19360 - DNA, 18 bp, Artificial Sequence
  Synthetic DNA
ttattcgactcacaagag

SEQ ID NO: 19361 - DNA, 18 bp, Artificial Sequence
  Synthetic DNA
aaataagagtcacaatag

SEQ ID NO: 19362 - DNA, 18 bp, Artificial Sequence
  Synthetic DNA
aaataccacacactagag

SEQ ID NO: 19363 - DNA, 18 bp, Artificial Sequence
  Synthetic DNA
aaataccacccagtatag

SEQ ID NO: 19364 - DNA, 18 bp, Artificial Sequence
  Synthetic DNA
aaatattaatcactatag

SEQ ID NO: 19365 - DNA, 18 bp, Artificial Sequence
  Synthetic DNA
aattccgactctctatag

SEQ ID NO: 19366 - DNA, 18 bp, Artificial Sequence
  Synthetic DNA
agatgcgactcattatag

SEQ ID NO: 19367 - DNA, 18 bp, Artificial Sequence
  Synthetic DNA
caatacgattcagtaaag

SEQ ID NO: 19368 - DNA, 18 bp, Artificial Sequence
  Synthetic DNA
caatacgtcccactgtag

SEQ ID NO: 19369 - DNA, 18 bp, Artificial Sequence
  Synthetic DNA
caatctgactcactttag

SEQ ID NO: 19370 - DNA, 18 bp, Artificial Sequence
  Synthetic DNA
caatgcaactaactatag

SEQ ID NO: 19371 - DNA, 18 bp, Artificial Sequence
  Synthetic DNA
caatgcgattcactagag

SEQ ID NO: 19372 - DNA, 18 bp, Artificial Sequence
  Synthetic DNA
gaatacgattcactaacg

SEQ ID NO: 19373 - DNA, 18 bp, Artificial Sequence
  Synthetic DNA
gtttacgactcactaaag

SEQ ID NO: 19374 - DNA, 18 bp, Artificial Sequence
  Synthetic DNA
taaaaaaactcactgtag

SEQ ID NO: 19375 - DNA, 18 bp, Artificial Sequence
  Synthetic DNA
taaaacgactcagtgtcg

SEQ ID NO: 19376 - DNA, 18 bp, Artificial Sequence
  Synthetic DNA
taaaacgactccctttaa

SEQ ID NO: 19377 - DNA, 18 bp, Artificial Sequence
  Synthetic DNA
taacatgacacactatcg

SEQ ID NO: 19378 - DNA, 18 bp, Artificial Sequence
  Synthetic DNA
taacatgactaaccatag

SEQ ID NO: 19379 - DNA, 18 bp, Artificial Sequence
  Synthetic DNA
taataagtctcactcaag

SEQ ID NO: 19380 - DNA, 18 bp, Artificial Sequence
  Synthetic DNA
taataatgctctctatag

SEQ ID NO: 19381 - DNA, 18 bp, Artificial Sequence
  Synthetic DNA
taatacaactcccaaaag

SEQ ID NO: 19382 - DNA, 18 bp, Artificial Sequence
  Synthetic DNA
taatacaactctttctag

SEQ ID NO: 19383 - DNA, 18 bp, Artificial Sequence
  Synthetic DNA
taatacaagttactagag

SEQ ID NO: 19384 - DNA, 18 bp, Artificial Sequence
  Synthetic DNA
taatacaatacactttag

SEQ ID NO: 19385 - DNA, 18 bp, Artificial Sequence
  Synthetic DNA
taatacgacaatctatcg

SEQ ID NO: 19386 - DNA, 18 bp, Artificial Sequence
  Synthetic DNA
taatacgactcaggctcg

SEQ ID NO: 19387 - DNA, 18 bp, Artificial Sequence
  Synthetic DNA
taatacgacttatcagag

SEQ ID NO: 19388 - DNA, 18 bp, Artificial Sequence
  Synthetic DNA
taatacgatacacgaaag

SEQ ID NO: 19389 - DNA, 18 bp, Artificial Sequence
  Synthetic DNA
taatacgcttaattatag

SEQ ID NO: 19390 - DNA, 18 bp, Artificial Sequence
  Synthetic DNA
taatacttctgaatatag

SEQ ID NO: 19391 - DNA, 18 bp, Artificial Sequence
  Synthetic DNA
taatattactcaataaag

SEQ ID NO: 19392 - DNA, 18 bp, Artificial Sequence
  Synthetic DNA
taatattagtctctatag

SEQ ID NO: 19393 - DNA, 18 bp, Artificial Sequence
  Synthetic DNA
taatcagtctcactgtag

SEQ ID NO: 19394 - DNA, 18 bp, Artificial Sequence
  Synthetic DNA
taatccgactctttttag

SEQ ID NO: 19395 - DNA, 18 bp, Artificial Sequence
  Synthetic DNA
taatccgatacactgtag

SEQ ID NO: 19396 - DNA, 18 bp, Artificial Sequence
  Synthetic DNA
taatcctaatcactatcg

SEQ ID NO: 19397 - DNA, 18 bp, Artificial Sequence
  Synthetic DNA
taatgccacactctatag

SEQ ID NO: 19398 - DNA, 18 bp, Artificial Sequence
  Synthetic DNA
taatgcgactccttatcg

SEQ ID NO: 19399 - DNA, 18 bp, Artificial Sequence
  Synthetic DNA
tagtatcactcactagag

SEQ ID NO: 19400 - DNA, 18 bp, Artificial Sequence
  Synthetic DNA
tataaagattcactatag

SEQ ID NO: 19401 - DNA, 18 bp, Artificial Sequence
  Synthetic DNA
tataacaactcactttag

SEQ ID NO: 19402 - DNA, 18 bp, Artificial Sequence
  Synthetic DNA
tataacgactaactaaag

SEQ ID NO: 19403 - DNA, 18 bp, Artificial Sequence
  Synthetic DNA
tatcaagactcacaatag

SEQ ID NO: 19404 - DNA, 18 bp, Artificial Sequence
  Synthetic DNA
tatcacgactcccaatag

SEQ ID NO: 19405 - DNA, 18 bp, Artificial Sequence
  Synthetic DNA
tatcacgacttaccatag

SEQ ID NO: 19406 - DNA, 18 bp, Artificial Sequence
  Synthetic DNA
tattacacctcactatcg

SEQ ID NO: 19407 - DNA, 18 bp, Artificial Sequence
  Synthetic DNA
tattacgacacactctcg

SEQ ID NO: 19408 - DNA, 18 bp, Artificial Sequence
  Synthetic DNA
tattattacttactatag

SEQ ID NO: 19409 - DNA, 18 bp, Artificial Sequence
  Synthetic DNA
tattcagactcactaaag

SEQ ID NO: 19410 - DNA, 18 bp, Artificial Sequence
  Synthetic DNA
tattccgtctcactaaag

SEQ ID NO: 19411 - DNA, 18 bp, Artificial Sequence
  Synthetic DNA
tattgcgacacactgtag

SEQ ID NO: 19412 - DNA, 18 bp, Artificial Sequence
  Synthetic DNA
tcatacttcttactatag

SEQ ID NO: 19413 - DNA, 18 bp, Artificial Sequence
  Synthetic DNA
tcataggactcaccacag

SEQ ID NO: 19414 - DNA, 18 bp, Artificial Sequence
  Synthetic DNA
tgtcacgactcattatag

SEQ ID NO: 19415 - DNA, 18 bp, Artificial Sequence
  Synthetic DNA
tgttacgattcacaatag

SEQ ID NO: 19416 - DNA, 18 bp, Artificial Sequence
  Synthetic DNA
ttataccactaactttag

SEQ ID NO: 19417 - DNA, 18 bp, Artificial Sequence
  Synthetic DNA
ttataccactcactagcg

SEQ ID NO: 19418 - DNA, 18 bp, Artificial Sequence
  Synthetic DNA
ttataccagtctctatag

SEQ ID NO: 19419 - DNA, 18 bp, Artificial Sequence
  Synthetic DNA
ttatacgacacagcatag

SEQ ID NO: 19420 - DNA, 18 bp, Artificial Sequence
  Synthetic DNA
ttatacgactaacaaaag

SEQ ID NO: 19421 - DNA, 18 bp, Artificial Sequence
  Synthetic DNA
ttatagaactcactaaag

SEQ ID NO: 19422 - DNA, 18 bp, Artificial Sequence
  Synthetic DNA
ttatccatctcactatag

SEQ ID NO: 19423 - DNA, 18 bp, Artificial Sequence
  Synthetic DNA
ttatccgcctcactagag

SEQ ID NO: 19424 - DNA, 18 bp, Artificial Sequence
  Synthetic DNA
ttctacgattcacaatag

SEQ ID NO: 19425 - DNA, 18 bp, Artificial Sequence
  Synthetic DNA
ttgtaagcctcactatag

SEQ ID NO: 19426 - DNA, 18 bp, Artificial Sequence
  Synthetic DNA
ttgtacgacttcctatag

SEQ ID NO: 19427 - DNA, 18 bp, Artificial Sequence
  Synthetic DNA
ttttacgaccaactatag

SEQ ID NO: 19428 - DNA, 18 bp, Artificial Sequence
  Synthetic DNA
ttttactactcactttag

SEQ ID NO: 19429 - DNA, 18 bp, Artificial Sequence
  Synthetic DNA
aaattcgactctctgtag

SEQ ID NO: 19430 - DNA, 18 bp, Artificial Sequence
  Synthetic DNA
aagttcgactcacaatag

SEQ ID NO: 19431 - DNA, 18 bp, Artificial Sequence
  Synthetic DNA
taaatcgactaactacag

SEQ ID NO: 19432 - DNA, 18 bp, Artificial Sequence
  Synthetic DNA
taatacaattcgctatcg

SEQ ID NO: 19433 - DNA, 18 bp, Artificial Sequence
  Synthetic DNA
taattcgtctcaccatcg

SEQ ID NO: 19434 - DNA, 18 bp, Artificial Sequence
  Synthetic DNA
tatttagactcactgtag

SEQ ID NO: 19435 - DNA, 18 bp, Artificial Sequence
  Synthetic DNA
tgaagcgactcactattg

SEQ ID NO: 19436 - DNA, 18 bp, Artificial Sequence
  Synthetic DNA
ttatacgactctctcttg

SEQ ID NO: 19437 - DNA, 18 bp, Artificial Sequence
  Synthetic DNA
ttatactacgcactattg

SEQ ID NO: 19438 - DNA, 18 bp, Artificial Sequence
  Synthetic DNA
aaatacaactgactttag

SEQ ID NO: 19439 - DNA, 18 bp, Artificial Sequence
  Synthetic DNA
aattacgaattactatag

SEQ ID NO: 19440 - DNA, 18 bp, Artificial Sequence
  Synthetic DNA
acatacgaatcactttag

SEQ ID NO: 19441 - DNA, 18 bp, Artificial Sequence
  Synthetic DNA
caatccgtctcactttag

SEQ ID NO: 19442 - DNA, 18 bp, Artificial Sequence
  Synthetic DNA
taaaagaactcactaaag

SEQ ID NO: 19443 - DNA, 18 bp, Artificial Sequence
  Synthetic DNA
taacacgactgacattag

SEQ ID NO: 19444 - DNA, 18 bp, Artificial Sequence
  Synthetic DNA
taacacgatacacgatag

SEQ ID NO: 19445 - DNA, 18 bp, Artificial Sequence
  Synthetic DNA
taacacgattcattttag

SEQ ID NO: 19446 - DNA, 18 bp, Artificial Sequence
  Synthetic DNA
taatacgaccctcgaaag

SEQ ID NO: 19447 - DNA, 18 bp, Artificial Sequence
  Synthetic DNA
tattacctctcaatatag

SEQ ID NO: 19448 - DNA, 18 bp, Artificial Sequence
  Synthetic DNA
tattacgcatcactacag

SEQ ID NO: 19449 - DNA, 18 bp, Artificial Sequence
  Synthetic DNA
tggtacgaatcactttag

SEQ ID NO: 19450 - DNA, 18 bp, Artificial Sequence
  Synthetic DNA
ttaaatgactcaccatag

SEQ ID NO: 19451 - DNA, 18 bp, Artificial Sequence
  Synthetic DNA
ttataccacttactatcg

SEQ ID NO: 19452 - DNA, 18 bp, Artificial Sequence
  Synthetic DNA
ttatacgtcttaatatag

SEQ ID NO: 19453 - DNA, 18 bp, Artificial Sequence
  Synthetic DNA
ttgaacgactcacaatag

SEQ ID NO: 19454 - DNA, 18 bp, Artificial Sequence
  Synthetic DNA
aaaatcgactcacaatag

SEQ ID NO: 19455 - DNA, 18 bp, Artificial Sequence
  Synthetic DNA
taattcgattccctatgg

SEQ ID NO: 19456 - DNA, 18 bp, Artificial Sequence
  Synthetic DNA
tattaaaactcgctatag

SEQ ID NO: 19457 - DNA, 18 bp, Artificial Sequence
  Synthetic DNA
atatacgattccctatag

SEQ ID NO: 19458 - DNA, 18 bp, Artificial Sequence
  Synthetic DNA
taaaacgaatctctttag

SEQ ID NO: 19459 - DNA, 18 bp, Artificial Sequence
  Synthetic DNA
ttttacaacacactatag

SEQ ID NO: 19460 - DNA, 18 bp, Artificial Sequence
  Synthetic DNA
ttattcgactcacttttg

SEQ ID NO: 19461 - DNA, 18 bp, Artificial Sequence
  Synthetic DNA
taattcgtctcaccaaag

SEQ ID NO: 19462 - DNA, 18 bp, Artificial Sequence
  Synthetic DNA
taaatcgtctcgctatag

SEQ ID NO: 19463 - DNA, 18 bp, Artificial Sequence
  Synthetic DNA
taatacgacgcgctactg

SEQ ID NO: 19464 - DNA, 18 bp, Artificial Sequence
  Synthetic DNA
taatacgactagcttttg

SEQ ID NO: 19465 - DNA, 18 bp, Artificial Sequence
  Synthetic DNA
taatactactagctattg

SEQ ID NO: 19466 - DNA, 18 bp, Artificial Sequence
  Synthetic DNA
taattcgactcaataatg

SEQ ID NO: 19467 - DNA, 18 bp, Artificial Sequence
  Synthetic DNA
taattcgactcactgctg

SEQ ID NO: 19468 - DNA, 18 bp, Artificial Sequence
  Synthetic DNA
taattcgactcggtttag

SEQ ID NO: 19469 - DNA, 18 bp, Artificial Sequence
  Synthetic DNA
taattcgactctctactg

SEQ ID NO: 19470 - DNA, 18 bp, Artificial Sequence
  Synthetic DNA
taattcggcgcactattg

SEQ ID NO: 19471 - DNA, 18 bp, Artificial Sequence
  Synthetic DNA
taattctacccactattg

SEQ ID NO: 19472 - DNA, 18 bp, Artificial Sequence
  Synthetic DNA
taatttgactcgcaatag

SEQ ID NO: 19473 - DNA, 18 bp, Artificial Sequence
  Synthetic DNA
tagtacaactcgctattg

SEQ ID NO: 19474 - DNA, 18 bp, Artificial Sequence
  Synthetic DNA
tattacgactcgctatta

SEQ ID NO: 19475 - DNA, 18 bp, Artificial Sequence
  Synthetic DNA
tatttagactcgctatag

SEQ ID NO: 19476 - DNA, 18 bp, Artificial Sequence
  Synthetic DNA
tatttcgactcacgattg

SEQ ID NO: 19477 - DNA, 18 bp, Artificial Sequence
  Synthetic DNA
aaacacgactcaatattg

SEQ ID NO: 19478 - DNA, 18 bp, Artificial Sequence
  Synthetic DNA
aaacacgactcgctttag

SEQ ID NO: 19479 - DNA, 18 bp, Artificial Sequence
  Synthetic DNA
aaagtcgactcaccatag

SEQ ID NO: 19480 - DNA, 18 bp, Artificial Sequence
  Synthetic DNA
aaatacgacacactcttg

SEQ ID NO: 19481 - DNA, 18 bp, Artificial Sequence
  Synthetic DNA
aaatacgacccgcaatag

SEQ ID NO: 19482 - DNA, 18 bp, Artificial Sequence
  Synthetic DNA
aaatacgactcgataaag

SEQ ID NO: 19483 - DNA, 18 bp, Artificial Sequence
  Synthetic DNA
aaatacgactcgccctag

SEQ ID NO: 19484 - DNA, 18 bp, Artificial Sequence
  Synthetic DNA
aaatgcgaatcactattg

SEQ ID NO: 19485 - DNA, 18 bp, Artificial Sequence
  Synthetic DNA
aaattagactcactagag

SEQ ID NO: 19486 - DNA, 18 bp, Artificial Sequence
  Synthetic DNA
aactacgactcacttttg

SEQ ID NO: 19487 - DNA, 18 bp, Artificial Sequence
  Synthetic DNA
aacttcgacttactatag

SEQ ID NO: 19488 - DNA, 18 bp, Artificial Sequence
  Synthetic DNA
aagtacgcctcactattg

SEQ ID NO: 19489 - DNA, 18 bp, Artificial Sequence
  Synthetic DNA
aattacgacgcgctatag

SEQ ID NO: 19490 - DNA, 18 bp, Artificial Sequence
  Synthetic DNA
aattacgactcgctttag

SEQ ID NO: 19491 - DNA, 18 bp, Artificial Sequence
  Synthetic DNA
acagacgactcactattg

SEQ ID NO: 19492 - DNA, 18 bp, Artificial Sequence
  Synthetic DNA
acatacgcctcgctatag

SEQ ID NO: 19493 - DNA, 18 bp, Artificial Sequence
  Synthetic DNA
atatacgactcgccatag

SEQ ID NO: 19494 - DNA, 18 bp, Artificial Sequence
  Synthetic DNA
atatccgactcactattg

SEQ ID NO: 19495 - DNA, 18 bp, Artificial Sequence
  Synthetic DNA
caaatcgactcactatgg

SEQ ID NO: 19496 - DNA, 18 bp, Artificial Sequence
  Synthetic DNA
caagacgacttactattg

SEQ ID NO: 19497 - DNA, 18 bp, Artificial Sequence
  Synthetic DNA
caatacgactctccattg

SEQ ID NO: 19498 - DNA, 18 bp, Artificial Sequence
  Synthetic DNA
caatagaactcactattg

SEQ ID NO: 19499 - DNA, 18 bp, Artificial Sequence
  Synthetic DNA
caatctgactcactattg

SEQ ID NO: 19500 - DNA, 18 bp, Artificial Sequence
  Synthetic DNA
caattcgactctctatgg

SEQ ID NO: 19501 - DNA, 18 bp, Artificial Sequence
  Synthetic DNA
caattcgacttaccatag

SEQ ID NO: 19502 - DNA, 18 bp, Artificial Sequence
  Synthetic DNA
caattctactcaccatag

SEQ ID NO: 19503 - DNA, 18 bp, Artificial Sequence
  Synthetic DNA
cacttccactcactatag

SEQ ID NO: 19504 - DNA, 18 bp, Artificial Sequence
  Synthetic DNA
ccaaacgactcactattg

SEQ ID NO: 19505 - DNA, 18 bp, Artificial Sequence
  Synthetic DNA
ccatactactcactattg

SEQ ID NO: 19506 - DNA, 18 bp, Artificial Sequence
  Synthetic DNA
ccattcgactcacaatag

SEQ ID NO: 19507 - DNA, 18 bp, Artificial Sequence
  Synthetic DNA
cctttcgactcactatag

SEQ ID NO: 19508 - DNA, 18 bp, Artificial Sequence
  Synthetic DNA
gaatacaactctctattg

SEQ ID NO: 19509 - DNA, 18 bp, Artificial Sequence
  Synthetic DNA
gaatacgactcagtaatg

SEQ ID NO: 19510 - DNA, 18 bp, Artificial Sequence
  Synthetic DNA
gaatacgtctcacttttg

SEQ ID NO: 19511 - DNA, 18 bp, Artificial Sequence
  Synthetic DNA
gaatacgtctgactattg

SEQ ID NO: 19512 - DNA, 18 bp, Artificial Sequence
  Synthetic DNA
gaattcgactcacaatcg

SEQ ID NO: 19513 - DNA, 18 bp, Artificial Sequence
  Synthetic DNA
gaattcgagtcactttag

SEQ ID NO: 19514 - DNA, 18 bp, Artificial Sequence
  Synthetic DNA
ggatacaactcactattg

SEQ ID NO: 19515 - DNA, 18 bp, Artificial Sequence
  Synthetic DNA
gtattcgactcaccatag

SEQ ID NO: 19516 - DNA, 18 bp, Artificial Sequence
  Synthetic DNA
taaaaccactcagtattg

SEQ ID NO: 19517 - DNA, 18 bp, Artificial Sequence
  Synthetic DNA
taaaaccactcattattg

SEQ ID NO: 19518 - DNA, 18 bp, Artificial Sequence
  Synthetic DNA
taaaacgaatcgctatcg

SEQ ID NO: 19519 - DNA, 18 bp, Artificial Sequence
  Synthetic DNA
taaatcgaatcactacag

SEQ ID NO: 19520 - DNA, 18 bp, Artificial Sequence
  Synthetic DNA
taaatcgcctctctatag

SEQ ID NO: 19521 - DNA, 18 bp, Artificial Sequence
  Synthetic DNA
taaatgtactcactatag

SEQ ID NO: 19522 - DNA, 18 bp, Artificial Sequence
  Synthetic DNA
taacaagactcgcaatag

SEQ ID NO: 19523 - DNA, 18 bp, Artificial Sequence
  Synthetic DNA
taacacgactcacttatg

SEQ ID NO: 19524 - DNA, 18 bp, Artificial Sequence
  Synthetic DNA
taacactactcgcaatag

SEQ ID NO: 19525 - DNA, 18 bp, Artificial Sequence
  Synthetic DNA
taactagactcaccatag

SEQ ID NO: 19526 - DNA, 18 bp, Artificial Sequence
  Synthetic DNA
taactccacccactatag

SEQ ID NO: 19527 - DNA, 18 bp, Artificial Sequence
  Synthetic DNA
taactcgactcaatatgg

SEQ ID NO: 19528 - DNA, 18 bp, Artificial Sequence
  Synthetic DNA
taactcgactgacaatag

SEQ ID NO: 19529 - DNA, 18 bp, Artificial Sequence
  Synthetic DNA
taacttgactcactatcg

SEQ ID NO: 19530 - DNA, 18 bp, Artificial Sequence
  Synthetic DNA
taagacgactcgttttag

SEQ ID NO: 19531 - DNA, 18 bp, Artificial Sequence
  Synthetic DNA
taagactcctcactattg

SEQ ID NO: 19532 - DNA, 18 bp, Artificial Sequence
  Synthetic DNA
taataagagtcactaatg

SEQ ID NO: 19533 - DNA, 18 bp, Artificial Sequence
  Synthetic DNA
taataagattcactactg

SEQ ID NO: 19534 - DNA, 18 bp, Artificial Sequence
  Synthetic DNA
taataagcctaactattg

SEQ ID NO: 19535 - DNA, 18 bp, Artificial Sequence
  Synthetic DNA
taataaggctagctatag

SEQ ID NO: 19536 - DNA, 18 bp, Artificial Sequence
  Synthetic DNA
taatacaacacgctttag

SEQ ID NO: 19537 - DNA, 18 bp, Artificial Sequence
  Synthetic DNA
taatacaactccatattg

SEQ ID NO: 19538 - DNA, 18 bp, Artificial Sequence
  Synthetic DNA
taatacaactctctgttg

SEQ ID NO: 19539 - DNA, 18 bp, Artificial Sequence
  Synthetic DNA
taataccacggactattg

SEQ ID NO: 19540 - DNA, 18 bp, Artificial Sequence
  Synthetic DNA
taataccactcccttttg

SEQ ID NO: 19541 - DNA, 18 bp, Artificial Sequence
  Synthetic DNA
taataccactttctattg

SEQ ID NO: 19542 - DNA, 18 bp, Artificial Sequence
  Synthetic DNA
taatacctcgcgctatag

SEQ ID NO: 19543 - DNA, 18 bp, Artificial Sequence
  Synthetic DNA
taatacgaataactgttg

SEQ ID NO: 19544 - DNA, 18 bp, Artificial Sequence
  Synthetic DNA
taatacgaatcgcttaag

SEQ ID NO: 19545 - DNA, 18 bp, Artificial Sequence
  Synthetic DNA
taatacgacacaatactg

SEQ ID NO: 19546 - DNA, 18 bp, Artificial Sequence
  Synthetic DNA
taatacgacccgttaaag

SEQ ID NO: 19547 - DNA, 18 bp, Artificial Sequence
  Synthetic DNA
taatacgacgcattactg

SEQ ID NO: 19548 - DNA, 18 bp, Artificial Sequence
  Synthetic DNA
taatacgacggaccattg

SEQ ID NO: 19549 - DNA, 18 bp, Artificial Sequence
  Synthetic DNA
taatacgactaactgatg

SEQ ID NO: 19550 - DNA, 18 bp, Artificial Sequence
  Synthetic DNA
taatacgactaagtaatg

SEQ ID NO: 19551 - DNA, 18 bp, Artificial Sequence
  Synthetic DNA
taatacgactagcactag

SEQ ID NO: 19552 - DNA, 18 bp, Artificial Sequence
  Synthetic DNA
taatacgactagttttag

SEQ ID NO: 19553 - DNA, 18 bp, Artificial Sequence
  Synthetic DNA
taatacgactatcgattg

SEQ ID NO: 19554 - DNA, 18 bp, Artificial Sequence
  Synthetic DNA
taatacgactcgcataag

SEQ ID NO: 19555 - DNA, 18 bp, Artificial Sequence
  Synthetic DNA
taatacgactcggactag

SEQ ID NO: 19556 - DNA, 18 bp, Artificial Sequence
  Synthetic DNA
taatacgactctatgttg

SEQ ID NO: 19557 - DNA, 18 bp, Artificial Sequence
  Synthetic DNA
taatacgactctttagtg

SEQ ID NO: 19558 - DNA, 18 bp, Artificial Sequence
  Synthetic DNA
taatacgacttaatgttg

SEQ ID NO: 19559 - DNA, 18 bp, Artificial Sequence
  Synthetic DNA
taatacgacttcatattg

SEQ ID NO: 19560 - DNA, 18 bp, Artificial Sequence
  Synthetic DNA
taatacgagccattattg

SEQ ID NO: 19561 - DNA, 18 bp, Artificial Sequence
  Synthetic DNA
taatacgagtaacttttg

SEQ ID NO: 19562 - DNA, 18 bp, Artificial Sequence
  Synthetic DNA
taatacgagtcaattttg

SEQ ID NO: 19563 - DNA, 18 bp, Artificial Sequence
  Synthetic DNA
taatacgagttacgattg

SEQ ID NO: 19564 - DNA, 18 bp, Artificial Sequence
  Synthetic DNA
taatacgatacgttatag

SEQ ID NO: 19565 - DNA, 18 bp, Artificial Sequence
  Synthetic DNA
taatacgattaagtattg

SEQ ID NO: 19566 - DNA, 18 bp, Artificial Sequence
  Synthetic DNA
taatacgattcactgctg

SEQ ID NO: 19567 - DNA, 18 bp, Artificial Sequence
  Synthetic DNA
taatacgcgtaactattg

SEQ ID NO: 19568 - DNA, 18 bp, Artificial Sequence
  Synthetic DNA
taatacggcttacttttg

SEQ ID NO: 19569 - DNA, 18 bp, Artificial Sequence
  Synthetic DNA
taatacggttaactattg

SEQ ID NO: 19570 - DNA, 18 bp, Artificial Sequence
  Synthetic DNA
taatacggtttgctatag

SEQ ID NO: 19571 - DNA, 18 bp, Artificial Sequence
  Synthetic DNA
taatacgtcccactgttg

SEQ ID NO: 19572 - DNA, 18 bp, Artificial Sequence
  Synthetic DNA
taatacgtctcgccttag

SEQ ID NO: 19573 - DNA, 18 bp, Artificial Sequence
  Synthetic DNA
taatacgtctcggtatgg

SEQ ID NO: 19574 - DNA, 18 bp, Artificial Sequence
  Synthetic DNA
taatacgtgtcactgttg

SEQ ID NO: 19575 - DNA, 18 bp, Artificial Sequence
  Synthetic DNA
taatactactcagtaatg

SEQ ID NO: 19576 - DNA, 18 bp, Artificial Sequence
  Synthetic DNA
taatactactcgaaatag

SEQ ID NO: 19577 - DNA, 18 bp, Artificial Sequence
  Synthetic DNA
taataggacgcattattg

SEQ ID NO: 19578 - DNA, 18 bp, Artificial Sequence
  Synthetic DNA
taataggactaactcttg

SEQ ID NO: 19579 - DNA, 18 bp, Artificial Sequence
  Synthetic DNA
taataggactcacatttg

SEQ ID NO: 19580 - DNA, 18 bp, Artificial Sequence
  Synthetic DNA
taataggactgcctattg

SEQ ID NO: 19581 - DNA, 18 bp, Artificial Sequence
  Synthetic DNA
taataggacttaatattg

SEQ ID NO: 19582 - DNA, 18 bp, Artificial Sequence
  Synthetic DNA
taataggattccctattg

SEQ ID NO: 19583 - DNA, 18 bp, Artificial Sequence
  Synthetic DNA
taatatgacacgcaatag

SEQ ID NO: 19584 - DNA, 18 bp, Artificial Sequence
  Synthetic DNA
taatatgacccaatattg

SEQ ID NO: 19585 - DNA, 18 bp, Artificial Sequence
  Synthetic DNA
taatatgactaaccattg

SEQ ID NO: 19586 - DNA, 18 bp, Artificial Sequence
  Synthetic DNA
taatatgactcacacttg

SEQ ID NO: 19587 - DNA, 18 bp, Artificial Sequence
  Synthetic DNA
taatatgactcacctttg

SEQ ID NO: 19588 - DNA, 18 bp, Artificial Sequence
  Synthetic DNA
taatatgactctctagtg

SEQ ID NO: 19589 - DNA, 18 bp, Artificial Sequence
  Synthetic DNA
taatccgacccattattg

SEQ ID NO: 19590 - DNA, 18 bp, Artificial Sequence
  Synthetic DNA
taatccgtctgactattg

SEQ ID NO: 19591 - DNA, 18 bp, Artificial Sequence
  Synthetic DNA
taatcctactccctattg

SEQ ID NO: 19592 - DNA, 18 bp, Artificial Sequence
  Synthetic DNA
taatcctacttgctatag

SEQ ID NO: 19593 - DNA, 18 bp, Artificial Sequence
  Synthetic DNA
taatgcgaatcactactg

SEQ ID NO: 19594 - DNA, 18 bp, Artificial Sequence
  Synthetic DNA
taatgcgactaactaatg

SEQ ID NO: 19595 - DNA, 18 bp, Artificial Sequence
  Synthetic DNA
taatgcgactagctaaag

SEQ ID NO: 19596 - DNA, 18 bp, Artificial Sequence
  Synthetic DNA
taatgcgactcacttctg

SEQ ID NO: 19597 - DNA, 18 bp, Artificial Sequence
  Synthetic DNA
taatgcgattcactactg

SEQ ID NO: 19598 - DNA, 18 bp, Artificial Sequence
  Synthetic DNA
taatgcgtcttactattg

SEQ ID NO: 19599 - DNA, 18 bp, Artificial Sequence
  Synthetic DNA
taatgcgtttcactattg

SEQ ID NO: 19600 - DNA, 18 bp, Artificial Sequence
  Synthetic DNA
taatgtgacttactattg

SEQ ID NO: 19601 - DNA, 18 bp, Artificial Sequence
  Synthetic DNA
taattacactctctatag

SEQ ID NO: 19602 - DNA, 18 bp, Artificial Sequence
  Synthetic DNA
taattagactcccaatag

SEQ ID NO: 19603 - DNA, 18 bp, Artificial Sequence
  Synthetic DNA
taattagactgactacag

SEQ ID NO: 19604 - DNA, 18 bp, Artificial Sequence
  Synthetic DNA
taattagatccactatag

SEQ ID NO: 19605 - DNA, 18 bp, Artificial Sequence
  Synthetic DNA
taattagcctcactatgg

SEQ ID NO: 19606 - DNA, 18 bp, Artificial Sequence
  Synthetic DNA
taattcaaatcaccatag

SEQ ID NO: 19607 - DNA, 18 bp, Artificial Sequence
  Synthetic DNA
taattcaactctctatgg

SEQ ID NO: 19608 - DNA, 18 bp, Artificial Sequence
  Synthetic DNA
taattcaattaactatag

SEQ ID NO: 19609 - DNA, 18 bp, Artificial Sequence
  Synthetic DNA
taattcaattcagtatag

SEQ ID NO: 19610 - DNA, 18 bp, Artificial Sequence
  Synthetic DNA
taattccactaagtatag

SEQ ID NO: 19611 - DNA, 18 bp, Artificial Sequence
  Synthetic DNA
taattcccctcactttag

SEQ ID NO: 19612 - DNA, 18 bp, Artificial Sequence
  Synthetic DNA
taattcctctcaccatag

SEQ ID NO: 19613 - DNA, 18 bp, Artificial Sequence
  Synthetic DNA
taattcgaatcaatgtag

SEQ ID NO: 19614 - DNA, 18 bp, Artificial Sequence
  Synthetic DNA
taattcgacacaccgtag

SEQ ID NO: 19615 - DNA, 18 bp, Artificial Sequence
  Synthetic DNA
taattcgacaccccatag

SEQ ID NO: 19616 - DNA, 18 bp, Artificial Sequence
  Synthetic DNA
taattcgacgcaatttag

SEQ ID NO: 19617 - DNA, 18 bp, Artificial Sequence
  Synthetic DNA
taattcgactaaccacag

SEQ ID NO: 19618 - DNA, 18 bp, Artificial Sequence
  Synthetic DNA
taattcgactcaatacgg

SEQ ID NO: 19619 - DNA, 18 bp, Artificial Sequence
  Synthetic DNA
taattcgactgattgtag

SEQ ID NO: 19620 - DNA, 18 bp, Artificial Sequence
  Synthetic DNA
taattcgactgcctaaag

SEQ ID NO: 19621 - DNA, 18 bp, Artificial Sequence
  Synthetic DNA
taattcgacttcatatag

SEQ ID NO: 19622 - DNA, 18 bp, Artificial Sequence
  Synthetic DNA
taattcgagacactctag

SEQ ID NO: 19623 - DNA, 18 bp, Artificial Sequence
  Synthetic DNA
taattcgattaactacag

SEQ ID NO: 19624 - DNA, 18 bp, Artificial Sequence
  Synthetic DNA
taattcggcacactaaag

SEQ ID NO: 19625 - DNA, 18 bp, Artificial Sequence
  Synthetic DNA
taattcggctccctctag

SEQ ID NO: 19626 - DNA, 18 bp, Artificial Sequence
  Synthetic DNA
taattcggcttactgtag

SEQ ID NO: 19627 - DNA, 18 bp, Artificial Sequence
  Synthetic DNA
taattctaatcactatcg

SEQ ID NO: 19628 - DNA, 18 bp, Artificial Sequence
  Synthetic DNA
taattctactcactaccg

SEQ ID NO: 19629 - DNA, 18 bp, Artificial Sequence
  Synthetic DNA
taattctacttactatgg

SEQ ID NO: 19630 - DNA, 18 bp, Artificial Sequence
  Synthetic DNA
taattctccccactatag

SEQ ID NO: 19631 - DNA, 18 bp, Artificial Sequence
  Synthetic DNA
taattggactaagtatag

SEQ ID NO: 19632 - DNA, 18 bp, Artificial Sequence
  Synthetic DNA
taattggactcagtacag

SEQ ID NO: 19633 - DNA, 18 bp, Artificial Sequence
  Synthetic DNA
taattggactctttatag

SEQ ID NO: 19634 - DNA, 18 bp, Artificial Sequence
  Synthetic DNA
taattggccacactatag

SEQ ID NO: 19635 - DNA, 18 bp, Artificial Sequence
  Synthetic DNA
taattggccccactatag

SEQ ID NO: 19636 - DNA, 18 bp, Artificial Sequence
  Synthetic DNA
taattgggctctctatag

SEQ ID NO: 19637 - DNA, 18 bp, Artificial Sequence
  Synthetic DNA
taatttaactctctatag

SEQ ID NO: 19638 - DNA, 18 bp, Artificial Sequence
  Synthetic DNA
tacaacgacttgctatag

SEQ ID NO: 19639 - DNA, 18 bp, Artificial Sequence
  Synthetic DNA
tactacgaatcaccattg

SEQ ID NO: 19640 - DNA, 18 bp, Artificial Sequence
  Synthetic DNA
tactacgagtccctattg

SEQ ID NO: 19641 - DNA, 18 bp, Artificial Sequence
  Synthetic DNA
tactactattcgctatag

SEQ ID NO: 19642 - DNA, 18 bp, Artificial Sequence
  Synthetic DNA
tactgcaactcgctatag

SEQ ID NO: 19643 - DNA, 18 bp, Artificial Sequence
  Synthetic DNA
tacttcaaatcactatag

SEQ ID NO: 19644 - DNA, 18 bp, Artificial Sequence
  Synthetic DNA
tacttccactcactacag

SEQ ID NO: 19645 - DNA, 18 bp, Artificial Sequence
  Synthetic DNA
tacttccactcactctag

SEQ ID NO: 19646 - DNA, 18 bp, Artificial Sequence
  Synthetic DNA
tacttcgacccactacag

SEQ ID NO: 19647 - DNA, 18 bp, Artificial Sequence
  Synthetic DNA
tacttcgaccgactatag

SEQ ID NO: 19648 - DNA, 18 bp, Artificial Sequence
  Synthetic DNA
tacttcgactctatatag

SEQ ID NO: 19649 - DNA, 18 bp, Artificial Sequence
  Synthetic DNA
tactttgactcaccatag

SEQ ID NO: 19650 - DNA, 18 bp, Artificial Sequence
  Synthetic DNA
tagaacgactcaatattg

SEQ ID NO: 19651 - DNA, 18 bp, Artificial Sequence
  Synthetic DNA
tagctcgactcactatgg

SEQ ID NO: 19652 - DNA, 18 bp, Artificial Sequence
  Synthetic DNA
tagtacgaatcacaattg

SEQ ID NO: 19653 - DNA, 18 bp, Artificial Sequence
  Synthetic DNA
tagtacgacaagctatag

SEQ ID NO: 19654 - DNA, 18 bp, Artificial Sequence
  Synthetic DNA
tagtatgacttactattg

SEQ ID NO: 19655 - DNA, 18 bp, Artificial Sequence
  Synthetic DNA
tagttatactcactatag

SEQ ID NO: 19656 - DNA, 18 bp, Artificial Sequence
  Synthetic DNA
tagttccactcactaaag

SEQ ID NO: 19657 - DNA, 18 bp, Artificial Sequence
  Synthetic DNA
tagttcgatccactatag

SEQ ID NO: 19658 - DNA, 18 bp, Artificial Sequence
  Synthetic DNA
tagttcgtctcacaatag

SEQ ID NO: 19659 - DNA, 18 bp, Artificial Sequence
  Synthetic DNA
tatctcgactcaccatag

SEQ ID NO: 19660 - DNA, 18 bp, Artificial Sequence
  Synthetic DNA
tattacaactcactagtg

SEQ ID NO: 19661 - DNA, 18 bp, Artificial Sequence
  Synthetic DNA
tattacacctcgctatag

SEQ ID NO: 19662 - DNA, 18 bp, Artificial Sequence
  Synthetic DNA
tattacgacacagtattg

SEQ ID NO: 19663 - DNA, 18 bp, Artificial Sequence
  Synthetic DNA
tattacgacacgctacag

SEQ ID NO: 19664 - DNA, 18 bp, Artificial Sequence
  Synthetic DNA
tattacgactggcaatag

SEQ ID NO: 19665 - DNA, 18 bp, Artificial Sequence
  Synthetic DNA
tattacgagccgctatag

SEQ ID NO: 19666 - DNA, 18 bp, Artificial Sequence
  Synthetic DNA
tattacgagttgctatag

SEQ ID NO: 19667 - DNA, 18 bp, Artificial Sequence
  Synthetic DNA
tattactactagctatag

SEQ ID NO: 19668 - DNA, 18 bp, Artificial Sequence
  Synthetic DNA
tattactagtcactattg

SEQ ID NO: 19669 - DNA, 18 bp, Artificial Sequence
  Synthetic DNA
tattaggacccgctatag

SEQ ID NO: 19670 - DNA, 18 bp, Artificial Sequence
  Synthetic DNA
tattatgacgcactattg

SEQ ID NO: 19671 - DNA, 18 bp, Artificial Sequence
  Synthetic DNA
tattatgactcgctatcg

SEQ ID NO: 19672 - DNA, 18 bp, Artificial Sequence
  Synthetic DNA
tattatgactcgctatgg

SEQ ID NO: 19673 - DNA, 18 bp, Artificial Sequence
  Synthetic DNA
tattgcgactcgatatag

SEQ ID NO: 19674 - DNA, 18 bp, Artificial Sequence
  Synthetic DNA
tatttcgacgaactatag

SEQ ID NO: 19675 - DNA, 18 bp, Artificial Sequence
  Synthetic DNA
tatttcggctcacaatag

SEQ ID NO: 19676 - DNA, 18 bp, Artificial Sequence
  Synthetic DNA
tatttggcctcactatag

SEQ ID NO: 19677 - DNA, 18 bp, Artificial Sequence
  Synthetic DNA
tcacatgactcgctatag

SEQ ID NO: 19678 - DNA, 18 bp, Artificial Sequence
  Synthetic DNA
tcatacgacttaatattg

SEQ ID NO: 19679 - DNA, 18 bp, Artificial Sequence
  Synthetic DNA
tcatacgacttaccattg

SEQ ID NO: 19680 - DNA, 18 bp, Artificial Sequence
  Synthetic DNA
tcatacgtctcattattg

SEQ ID NO: 19681 - DNA, 18 bp, Artificial Sequence
  Synthetic DNA
tcatacgtctcgctatgg

SEQ ID NO: 19682 - DNA, 18 bp, Artificial Sequence
  Synthetic DNA
tcatactactcgctttag

SEQ ID NO: 19683 - DNA, 18 bp, Artificial Sequence
  Synthetic DNA
tcatatgactcgctgtag

SEQ ID NO: 19684 - DNA, 18 bp, Artificial Sequence
  Synthetic DNA
tcatccgtctcactattg

SEQ ID NO: 19685 - DNA, 18 bp, Artificial Sequence
  Synthetic DNA
tcattcgcctcactatgg

SEQ ID NO: 19686 - DNA, 18 bp, Artificial Sequence
  Synthetic DNA
tcattcgcctctctatag

SEQ ID NO: 19687 - DNA, 18 bp, Artificial Sequence
  Synthetic DNA
tcctacgactctctattg

SEQ ID NO: 19688 - DNA, 18 bp, Artificial Sequence
  Synthetic DNA
tcttacgactcgctatgg

SEQ ID NO: 19689 - DNA, 18 bp, Artificial Sequence
  Synthetic DNA
tgatacgcctaactattg

SEQ ID NO: 19690 - DNA, 18 bp, Artificial Sequence
  Synthetic DNA
tgatatgactcagtattg

SEQ ID NO: 19691 - DNA, 18 bp, Artificial Sequence
  Synthetic DNA
tgatccgactctctattg

SEQ ID NO: 19692 - DNA, 18 bp, Artificial Sequence
  Synthetic DNA
tgattcaactcattatag

SEQ ID NO: 19693 - DNA, 18 bp, Artificial Sequence
  Synthetic DNA
tgattcgacaaactatag

SEQ ID NO: 19694 - DNA, 18 bp, Artificial Sequence
  Synthetic DNA
tgcttccactcactatag

SEQ ID NO: 19695 - DNA, 18 bp, Artificial Sequence
  Synthetic DNA
tgcttcgattcactatag

SEQ ID NO: 19696 - DNA, 18 bp, Artificial Sequence
  Synthetic DNA
tgttacgactcactcttg

SEQ ID NO: 19697 - DNA, 18 bp, Artificial Sequence
  Synthetic DNA
tgttacgacttactattg

SEQ ID NO: 19698 - DNA, 18 bp, Artificial Sequence
  Synthetic DNA
tgttacgattcgctatag

SEQ ID NO: 19699 - DNA, 18 bp, Artificial Sequence
  Synthetic DNA
ttacacgactcagtattg

SEQ ID NO: 19700 - DNA, 18 bp, Artificial Sequence
  Synthetic DNA
ttataagactcgcaatag

SEQ ID NO: 19701 - DNA, 18 bp, Artificial Sequence
  Synthetic DNA
ttatacgacacagtattg

SEQ ID NO: 19702 - DNA, 18 bp, Artificial Sequence
  Synthetic DNA
ttatacgacacgatatag

SEQ ID NO: 19703 - DNA, 18 bp, Artificial Sequence
  Synthetic DNA
ttatacgacccactcttg

SEQ ID NO: 19704 - DNA, 18 bp, Artificial Sequence
  Synthetic DNA
ttatacgactagctttag

SEQ ID NO: 19705 - DNA, 18 bp, Artificial Sequence
  Synthetic DNA
ttatacgactcgccctag

SEQ ID NO: 19706 - DNA, 18 bp, Artificial Sequence
  Synthetic DNA
ttatacgacttgccatag

SEQ ID NO: 19707 - DNA, 18 bp, Artificial Sequence
  Synthetic DNA
ttatacgcctcgctacag

SEQ ID NO: 19708 - DNA, 18 bp, Artificial Sequence
  Synthetic DNA
ttatacggcacgctatag

SEQ ID NO: 19709 - DNA, 18 bp, Artificial Sequence
  Synthetic DNA
ttatacgtgtcgctatag

SEQ ID NO: 19710 - DNA, 18 bp, Artificial Sequence
  Synthetic DNA
ttatactactccctattg

SEQ ID NO: 19711 - DNA, 18 bp, Artificial Sequence
  Synthetic DNA
ttatataactcgctatag

SEQ ID NO: 19712 - DNA, 18 bp, Artificial Sequence
  Synthetic DNA
ttatcagactcgctatag

SEQ ID NO: 19713 - DNA, 18 bp, Artificial Sequence
  Synthetic DNA
ttatgctactcactattg

SEQ ID NO: 19714 - DNA, 18 bp, Artificial Sequence
  Synthetic DNA
ttattccactcaatatag

SEQ ID NO: 19715 - DNA, 18 bp, Artificial Sequence
  Synthetic DNA
ttattcgacgcactatcg

SEQ ID NO: 19716 - DNA, 18 bp, Artificial Sequence
  Synthetic DNA
ttattcgacgcactatgg

SEQ ID NO: 19717 - DNA, 18 bp, Artificial Sequence
  Synthetic DNA
ttattcgactaaccatag

SEQ ID NO: 19718 - DNA, 18 bp, Artificial Sequence
  Synthetic DNA
ttattcgactcactaacg

SEQ ID NO: 19719 - DNA, 18 bp, Artificial Sequence
  Synthetic DNA
ttattcggcccactatag

SEQ ID NO: 19720 - DNA, 18 bp, Artificial Sequence
  Synthetic DNA
ttattggactaactatag

SEQ ID NO: 19721 - DNA, 18 bp, Artificial Sequence
  Synthetic DNA
ttatttgactgactatag

SEQ ID NO: 19722 - DNA, 18 bp, Artificial Sequence
  Synthetic DNA
ttgtacgactcacgattg

SEQ ID NO: 19723 - DNA, 18 bp, Artificial Sequence
  Synthetic DNA
ttgttcgactcaccatag

SEQ ID NO: 19724 - DNA, 18 bp, Artificial Sequence
  Synthetic DNA
ttttacgactcgttatag

SEQ ID NO: 19725 - DNA, 18 bp, Artificial Sequence
  Synthetic DNA
aaaaacgactaaatatag

SEQ ID NO: 19726 - DNA, 18 bp, Artificial Sequence
  Synthetic DNA
aaaaacgactccttatag

SEQ ID NO: 19727 - DNA, 18 bp, Artificial Sequence
  Synthetic DNA
aaaaacgattcagtatag

SEQ ID NO: 19728 - DNA, 18 bp, Artificial Sequence
  Synthetic DNA
aaaaacgtctccctatag

SEQ ID NO: 19729 - DNA, 18 bp, Artificial Sequence
  Synthetic DNA
aaacacaactcacaatag

SEQ ID NO: 19730 - DNA, 18 bp, Artificial Sequence
  Synthetic DNA
aaacacaactcactagag

SEQ ID NO: 19731 - DNA, 18 bp, Artificial Sequence
  Synthetic DNA
aaacacgaattactatag

SEQ ID NO: 19732 - DNA, 18 bp, Artificial Sequence
  Synthetic DNA
aaacacgactccctgtag

SEQ ID NO: 19733 - DNA, 18 bp, Artificial Sequence
  Synthetic DNA
aaacacgactgacaatag

SEQ ID NO: 19734 - DNA, 18 bp, Artificial Sequence
  Synthetic DNA
aaagacaactcactaaag

SEQ ID NO: 19735 - DNA, 18 bp, Artificial Sequence
  Synthetic DNA
aaagacgatttactatag

SEQ ID NO: 19736 - DNA, 18 bp, Artificial Sequence
  Synthetic DNA
aaataagacttaccatag

SEQ ID NO: 19737 - DNA, 18 bp, Artificial Sequence
  Synthetic DNA
aaatacaacccaccatag

SEQ ID NO: 19738 - DNA, 18 bp, Artificial Sequence
  Synthetic DNA
aaatacaactaactctag

SEQ ID NO: 19739 - DNA, 18 bp, Artificial Sequence
  Synthetic DNA
aaatacaactgactgtag

SEQ ID NO: 19740 - DNA, 18 bp, Artificial Sequence
  Synthetic DNA
aaataccaatcacaatag

SEQ ID NO: 19741 - DNA, 18 bp, Artificial Sequence
  Synthetic DNA
aaataccacttactatgg

SEQ ID NO: 19742 - DNA, 18 bp, Artificial Sequence
  Synthetic DNA
aaataccacttactctag

SEQ ID NO: 19743 - DNA, 18 bp, Artificial Sequence
  Synthetic DNA
aaatacgaaaaactatag

SEQ ID NO: 19744 - DNA, 18 bp, Artificial Sequence
  Synthetic DNA
aaatacgaaacactctag

SEQ ID NO: 19745 - DNA, 18 bp, Artificial Sequence
  Synthetic DNA
aaatacgaattactaaag

SEQ ID NO: 19746 - DNA, 18 bp, Artificial Sequence
  Synthetic DNA
aaatacgacacactgtgg

SEQ ID NO: 19747 - DNA, 18 bp, Artificial Sequence
  Synthetic DNA
aaatacgacccacgttag

SEQ ID NO: 19748 - DNA, 18 bp, Artificial Sequence
  Synthetic DNA
aaatacgacttactgaag

SEQ ID NO: 19749 - DNA, 18 bp, Artificial Sequence
  Synthetic DNA
aaatacgacttagtacag

SEQ ID NO: 19750 - DNA, 18 bp, Artificial Sequence
  Synthetic DNA
aaatacgagtttctatag

SEQ ID NO: 19751 - DNA, 18 bp, Artificial Sequence
  Synthetic DNA
aaatacgccacactaaag

SEQ ID NO: 19752 - DNA, 18 bp, Artificial Sequence
  Synthetic DNA
aaatacgcctcaatatcg

SEQ ID NO: 19753 - DNA, 18 bp, Artificial Sequence
  Synthetic DNA
aaatacggcgcacaatag

SEQ ID NO: 19754 - DNA, 18 bp, Artificial Sequence
  Synthetic DNA
aaatacggctcaataaag

SEQ ID NO: 19755 - DNA, 18 bp, Artificial Sequence
  Synthetic DNA
aaatacgtcccacaatag

SEQ ID NO: 19756 - DNA, 18 bp, Artificial Sequence
  Synthetic DNA
aaatactacttactgtag

SEQ ID NO: 19757 - DNA, 18 bp, Artificial Sequence
  Synthetic DNA
aaataggcctaactatag

SEQ ID NO: 19758 - DNA, 18 bp, Artificial Sequence
  Synthetic DNA
aaatatgatgcactatag

SEQ ID NO: 19759 - DNA, 18 bp, Artificial Sequence
  Synthetic DNA
aaatgcgattcactatcg

SEQ ID NO: 19760 - DNA, 18 bp, Artificial Sequence
  Synthetic DNA
aactacaactcacaatag

SEQ ID NO: 19761 - DNA, 18 bp, Artificial Sequence
  Synthetic DNA
aattaccactgactatag

SEQ ID NO: 19762 - DNA, 18 bp, Artificial Sequence
  Synthetic DNA
aattacgacgaactatag

SEQ ID NO: 19763 - DNA, 18 bp, Artificial Sequence
  Synthetic DNA
acaaacgactcactaaag

SEQ ID NO: 19764 - DNA, 18 bp, Artificial Sequence
  Synthetic DNA
acatacgactcaatttag

SEQ ID NO: 19765 - DNA, 18 bp, Artificial Sequence
  Synthetic DNA
acatatgactcacaatag

SEQ ID NO: 19766 - DNA, 18 bp, Artificial Sequence
  Synthetic DNA
acatccgactcattatag

SEQ ID NO: 19767 - DNA, 18 bp, Artificial Sequence
  Synthetic DNA
agatacgactcacactag

SEQ ID NO: 19768 - DNA, 18 bp, Artificial Sequence
  Synthetic DNA
agatacggctcaatatag

SEQ ID NO: 19769 - DNA, 18 bp, Artificial Sequence
  Synthetic DNA
agatacggctcattatag

SEQ ID NO: 19770 - DNA, 18 bp, Artificial Sequence
  Synthetic DNA
agatacgtctgactatag

SEQ ID NO: 19771 - DNA, 18 bp, Artificial Sequence
  Synthetic DNA
atatataactcactatag

SEQ ID NO: 19772 - DNA, 18 bp, Artificial Sequence
  Synthetic DNA
atatccgactcactctag

SEQ ID NO: 19773 - DNA, 18 bp, Artificial Sequence
  Synthetic DNA
atatccgactcagtatag

SEQ ID NO: 19774 - DNA, 18 bp, Artificial Sequence
  Synthetic DNA
atatgcgactcactaaag

SEQ ID NO: 19775 - DNA, 18 bp, Artificial Sequence
  Synthetic DNA
atatgcgacttactatag

SEQ ID NO: 19776 - DNA, 18 bp, Artificial Sequence
  Synthetic DNA
caaaacgactcatcatag

SEQ ID NO: 19777 - DNA, 18 bp, Artificial Sequence
  Synthetic DNA
caaaacgagtaactatag

SEQ ID NO: 19778 - DNA, 18 bp, Artificial Sequence
  Synthetic DNA
caaaacgtctcattatag

SEQ ID NO: 19779 - DNA, 18 bp, Artificial Sequence
  Synthetic DNA
caaaatgactcactaaag

SEQ ID NO: 19780 - DNA, 18 bp, Artificial Sequence
  Synthetic DNA
caacacctctcactatag

SEQ ID NO: 19781 - DNA, 18 bp, Artificial Sequence
  Synthetic DNA
caacacgaatctctatag

SEQ ID NO: 19782 - DNA, 18 bp, Artificial Sequence
  Synthetic DNA
caacacgattcaatatag

SEQ ID NO: 19783 - DNA, 18 bp, Artificial Sequence
  Synthetic DNA
caataagacactctatag

SEQ ID NO: 19784 - DNA, 18 bp, Artificial Sequence
  Synthetic DNA
caataagactaagtatag

SEQ ID NO: 19785 - DNA, 18 bp, Artificial Sequence
  Synthetic DNA
caataccaatctctatag

SEQ ID NO: 19786 - DNA, 18 bp, Artificial Sequence
  Synthetic DNA
caataccacacattatag

SEQ ID NO: 19787 - DNA, 18 bp, Artificial Sequence
  Synthetic DNA
caatacgaatatctatag

SEQ ID NO: 19788 - DNA, 18 bp, Artificial Sequence
  Synthetic DNA
caatacgacacaatctag

SEQ ID NO: 19789 - DNA, 18 bp, Artificial Sequence
  Synthetic DNA
caatacgatatactatag

SEQ ID NO: 19790 - DNA, 18 bp, Artificial Sequence
  Synthetic DNA
caatacgatttactagag

SEQ ID NO: 19791 - DNA, 18 bp, Artificial Sequence
  Synthetic DNA
caatacgcaacactatag

SEQ ID NO: 19792 - DNA, 18 bp, Artificial Sequence
  Synthetic DNA
caatacggttccctatag

SEQ ID NO: 19793 - DNA, 18 bp, Artificial Sequence
  Synthetic DNA
caatacgttttactatag

SEQ ID NO: 19794 - DNA, 18 bp, Artificial Sequence
  Synthetic DNA
caatactacttactaaag

SEQ ID NO: 19795 - DNA, 18 bp, Artificial Sequence
  Synthetic DNA
caatagaacccactatag

SEQ ID NO: 19796 - DNA, 18 bp, Artificial Sequence
  Synthetic DNA
caataggactcaccttag

SEQ ID NO: 19797 - DNA, 18 bp, Artificial Sequence
  Synthetic DNA
caataggactttctatag

SEQ ID NO: 19798 - DNA, 18 bp, Artificial Sequence
  Synthetic DNA
caataggtcacactatag

SEQ ID NO: 19799 - DNA, 18 bp, Artificial Sequence
  Synthetic DNA
caataggtctcattatag

SEQ ID NO: 19800 - DNA, 18 bp, Artificial Sequence
  Synthetic DNA
caatatgacccactacag

SEQ ID NO: 19801 - DNA, 18 bp, Artificial Sequence
  Synthetic DNA
caatatgactcacttgag

SEQ ID NO: 19802 - DNA, 18 bp, Artificial Sequence
  Synthetic DNA
caatcagaatcactatag

SEQ ID NO: 19803 - DNA, 18 bp, Artificial Sequence
  Synthetic DNA
caatcatactcactatag

SEQ ID NO: 19804 - DNA, 18 bp, Artificial Sequence
  Synthetic DNA
caatccaactctctatag

SEQ ID NO: 19805 - DNA, 18 bp, Artificial Sequence
  Synthetic DNA
caatcccactcactttag

SEQ ID NO: 19806 - DNA, 18 bp, Artificial Sequence
  Synthetic DNA
caatccgaatcactgtag

SEQ ID NO: 19807 - DNA, 18 bp, Artificial Sequence
  Synthetic DNA
caatccgactctctaaag

SEQ ID NO: 19808 - DNA, 18 bp, Artificial Sequence
  Synthetic DNA
cactaggactcactttag

SEQ ID NO: 19809 - DNA, 18 bp, Artificial Sequence
  Synthetic DNA
cagtaagactcaccatag

SEQ ID NO: 19810 - DNA, 18 bp, Artificial Sequence
  Synthetic DNA
cagtacgccacactatag

SEQ ID NO: 19811 - DNA, 18 bp, Artificial Sequence
  Synthetic DNA
cattacgactctctatcg

SEQ ID NO: 19812 - DNA, 18 bp, Artificial Sequence
  Synthetic DNA
ccacacgactcactgtag

SEQ ID NO: 19813 - DNA, 18 bp, Artificial Sequence
  Synthetic DNA
cgaaaccactcactatag

SEQ ID NO: 19814 - DNA, 18 bp, Artificial Sequence
  Synthetic DNA
cgagacgacacactatag

SEQ ID NO: 19815 - DNA, 18 bp, Artificial Sequence
  Synthetic DNA
cgatacgactcaatgtag

SEQ ID NO: 19816 - DNA, 18 bp, Artificial Sequence
  Synthetic DNA
ctatacgacttacgatag

SEQ ID NO: 19817 - DNA, 18 bp, Artificial Sequence
  Synthetic DNA
ctatacgattcactaaag

SEQ ID NO: 19818 - DNA, 18 bp, Artificial Sequence
  Synthetic DNA
ctatacgtctgactatag

SEQ ID NO: 19819 - DNA, 18 bp, Artificial Sequence
  Synthetic DNA
ctttaagactcactatag

SEQ ID NO: 19820 - DNA, 18 bp, Artificial Sequence
  Synthetic DNA
gaaaacgacttactaaag

SEQ ID NO: 19821 - DNA, 18 bp, Artificial Sequence
  Synthetic DNA
gaacacgtttcactatag

SEQ ID NO: 19822 - DNA, 18 bp, Artificial Sequence
  Synthetic DNA
gaatacaaatcacaatag

SEQ ID NO: 19823 - DNA, 18 bp, Artificial Sequence
  Synthetic DNA
gaatacaacccactgtag

SEQ ID NO: 19824 - DNA, 18 bp, Artificial Sequence
  Synthetic DNA
gaatacaactcataatag

SEQ ID NO: 19825 - DNA, 18 bp, Artificial Sequence
  Synthetic DNA
gaatccgaatcaccatag

SEQ ID NO: 19826 - DNA, 18 bp, Artificial Sequence
  Synthetic DNA
gactaggactcaccatag

SEQ ID NO: 19827 - DNA, 18 bp, Artificial Sequence
  Synthetic DNA
gagtaagactcactatcg

SEQ ID NO: 19828 - DNA, 18 bp, Artificial Sequence
  Synthetic DNA
gattaccactcactacag

SEQ ID NO: 19829 - DNA, 18 bp, Artificial Sequence
  Synthetic DNA
gattatgactaactatag

SEQ ID NO: 19830 - DNA, 18 bp, Artificial Sequence
  Synthetic DNA
gcatacgagtcactatcg

SEQ ID NO: 19831 - DNA, 18 bp, Artificial Sequence
  Synthetic DNA
ggatatgactcactacag

SEQ ID NO: 19832 - DNA, 18 bp, Artificial Sequence
  Synthetic DNA
gtatacgactctctctag

SEQ ID NO: 19833 - DNA, 18 bp, Artificial Sequence
  Synthetic DNA
gtatacgacttattatag

SEQ ID NO: 19834 - DNA, 18 bp, Artificial Sequence
  Synthetic DNA
gtatacgtcttactatag

SEQ ID NO: 19835 - DNA, 18 bp, Artificial Sequence
  Synthetic DNA
gtatgcgtctcactatag

SEQ ID NO: 19836 - DNA, 18 bp, Artificial Sequence
  Synthetic DNA
gtttaggactcactatag

SEQ ID NO: 19837 - DNA, 18 bp, Artificial Sequence
  Synthetic DNA
taaaaagaatctctatag

SEQ ID NO: 19838 - DNA, 18 bp, Artificial Sequence
  Synthetic DNA
taaaaagacacactttag

SEQ ID NO: 19839 - DNA, 18 bp, Artificial Sequence
  Synthetic DNA
taaaaaggcttactatag

SEQ ID NO: 19840 - DNA, 18 bp, Artificial Sequence
  Synthetic DNA
taaaacatctcactagag

SEQ ID NO: 19841 - DNA, 18 bp, Artificial Sequence
  Synthetic DNA
taaaacctctctctatag

SEQ ID NO: 19842 - DNA, 18 bp, Artificial Sequence
  Synthetic DNA
taaaacgaatcaatatgg

SEQ ID NO: 19843 - DNA, 18 bp, Artificial Sequence
  Synthetic DNA
taaaacgacacaatatcg

SEQ ID NO: 19844 - DNA, 18 bp, Artificial Sequence
  Synthetic DNA
taaaacgacacacaagag

SEQ ID NO: 19845 - DNA, 18 bp, Artificial Sequence
  Synthetic DNA
taaaacgaccctctatgg

SEQ ID NO: 19846 - DNA, 18 bp, Artificial Sequence
  Synthetic DNA
taaaacgactcacatcag

SEQ ID NO: 19847 - DNA, 18 bp, Artificial Sequence
  Synthetic DNA
taaaacgactcaccttcg

SEQ ID NO: 19848 - DNA, 18 bp, Artificial Sequence
  Synthetic DNA
taaaacgactcagtgaag

SEQ ID NO: 19849 - DNA, 18 bp, Artificial Sequence
  Synthetic DNA
taaaacgactccaaatag

SEQ ID NO: 19850 - DNA, 18 bp, Artificial Sequence
  Synthetic DNA
taaaacgagtaagtatag

SEQ ID NO: 19851 - DNA, 18 bp, Artificial Sequence
  Synthetic DNA
taaaacgattcacaaaag

SEQ ID NO: 19852 - DNA, 18 bp, Artificial Sequence
  Synthetic DNA
taaaacgattcatcatag

SEQ ID NO: 19853 - DNA, 18 bp, Artificial Sequence
  Synthetic DNA
taaaacgccgcattatag

SEQ ID NO: 19854 - DNA, 18 bp, Artificial Sequence
  Synthetic DNA
taaaacgcctcaatttag

SEQ ID NO: 19855 - DNA, 18 bp, Artificial Sequence
  Synthetic DNA
taaaacgtctcaccaaag

SEQ ID NO: 19856 - DNA, 18 bp, Artificial Sequence
  Synthetic DNA
taaaacgtctcactctcg

SEQ ID NO: 19857 - DNA, 18 bp, Artificial Sequence
  Synthetic DNA
taaaacgtctcactgcag

SEQ ID NO: 19858 - DNA, 18 bp, Artificial Sequence
  Synthetic DNA
taaaacgtctccctatcg

SEQ ID NO: 19859 - DNA, 18 bp, Artificial Sequence
  Synthetic DNA
taaaactacctactatag

SEQ ID NO: 19860 - DNA, 18 bp, Artificial Sequence
  Synthetic DNA
taaaactactcagtctag

SEQ ID NO: 19861 - DNA, 18 bp, Artificial Sequence
  Synthetic DNA
taaaactcctctctatag

SEQ ID NO: 19862 - DNA, 18 bp, Artificial Sequence
  Synthetic DNA
taaaagaactcactatcg

SEQ ID NO: 19863 - DNA, 18 bp, Artificial Sequence
  Synthetic DNA
taaaccgacatactatag

SEQ ID NO: 19864 - DNA, 18 bp, Artificial Sequence
  Synthetic DNA
taaaccgactatctatag

SEQ ID NO: 19865 - DNA, 18 bp, Artificial Sequence
  Synthetic DNA
taaaccgactcactaccg

SEQ ID NO: 19866 - DNA, 18 bp, Artificial Sequence
  Synthetic DNA
taaacctattcactatag

SEQ ID NO: 19867 - DNA, 18 bp, Artificial Sequence
  Synthetic DNA
taaacggactcactctag

SEQ ID NO: 19868 - DNA, 18 bp, Artificial Sequence
  Synthetic DNA
taaagatactcactatag

SEQ ID NO: 19869 - DNA, 18 bp, Artificial Sequence
  Synthetic DNA
taaagcgactacctatag

SEQ ID NO: 19870 - DNA, 18 bp, Artificial Sequence
  Synthetic DNA
taaagcgattcattatag

SEQ ID NO: 19871 - DNA, 18 bp, Artificial Sequence
  Synthetic DNA
taaagcggctcactgtag

SEQ ID NO: 19872 - DNA, 18 bp, Artificial Sequence
  Synthetic DNA
taacaacactcaatatag

SEQ ID NO: 19873 - DNA, 18 bp, Artificial Sequence
  Synthetic DNA
taacaacactcacaatag

SEQ ID NO: 19874 - DNA, 18 bp, Artificial Sequence
  Synthetic DNA
taacaagaatcagtatag

SEQ ID NO: 19875 - DNA, 18 bp, Artificial Sequence
  Synthetic DNA
taacaagactcattatgg

SEQ ID NO: 19876 - DNA, 18 bp, Artificial Sequence
  Synthetic DNA
taacaagactctatatag

SEQ ID NO: 19877 - DNA, 18 bp, Artificial Sequence
  Synthetic DNA
taacaagacttactttag

SEQ ID NO: 19878 - DNA, 18 bp, Artificial Sequence
  Synthetic DNA
taacaagattctctatag

SEQ ID NO: 19879 - DNA, 18 bp, Artificial Sequence
  Synthetic DNA
taacaatactaactatag

SEQ ID NO: 19880 - DNA, 18 bp, Artificial Sequence
  Synthetic DNA
taacaatactcactacag

SEQ ID NO: 19881 - DNA, 18 bp, Artificial Sequence
  Synthetic DNA
taacacaattcattatag

SEQ ID NO: 19882 - DNA, 18 bp, Artificial Sequence
  Synthetic DNA
taacaccacagactatag

SEQ ID NO: 19883 - DNA, 18 bp, Artificial Sequence
  Synthetic DNA
taacaccactcaataaag

SEQ ID NO: 19884 - DNA, 18 bp, Artificial Sequence
  Synthetic DNA
taacacgaacctctatag

SEQ ID NO: 19885 - DNA, 18 bp, Artificial Sequence
  Synthetic DNA
taacacgacacaatttag

SEQ ID NO: 19886 - DNA, 18 bp, Artificial Sequence
  Synthetic DNA
taacacgacagacaatag

SEQ ID NO: 19887 - DNA, 18 bp, Artificial Sequence
  Synthetic DNA
taacacgacccaccgtag

SEQ ID NO: 19888 - DNA, 18 bp, Artificial Sequence
  Synthetic DNA
taacacgactcagtcgag

SEQ ID NO: 19889 - DNA, 18 bp, Artificial Sequence
  Synthetic DNA
taacacgactctccacag

SEQ ID NO: 19890 - DNA, 18 bp, Artificial Sequence
  Synthetic DNA
taacacgagttacgatag

SEQ ID NO: 19891 - DNA, 18 bp, Artificial Sequence
  Synthetic DNA
taacacgattcacttaag

SEQ ID NO: 19892 - DNA, 18 bp, Artificial Sequence
  Synthetic DNA
taacacgattccctaaag

SEQ ID NO: 19893 - DNA, 18 bp, Artificial Sequence
  Synthetic DNA
taacacgattccctacag

SEQ ID NO: 19894 - DNA, 18 bp, Artificial Sequence
  Synthetic DNA
taacacgcctcactaagg

SEQ ID NO: 19895 - DNA, 18 bp, Artificial Sequence
  Synthetic DNA
taacacgcctcactctgg

SEQ ID NO: 19896 - DNA, 18 bp, Artificial Sequence
  Synthetic DNA
taacacgcttcaccatag

SEQ ID NO: 19897 - DNA, 18 bp, Artificial Sequence
  Synthetic DNA
taacacggcacactacag

SEQ ID NO: 19898 - DNA, 18 bp, Artificial Sequence
  Synthetic DNA
taacacggcacactttag

SEQ ID NO: 19899 - DNA, 18 bp, Artificial Sequence
  Synthetic DNA
taacacgtctaacgatag

SEQ ID NO: 19900 - DNA, 18 bp, Artificial Sequence
  Synthetic DNA
taacacgtctcattagag

SEQ ID NO: 19901 - DNA, 18 bp, Artificial Sequence
  Synthetic DNA
taacactactaactgtag

SEQ ID NO: 19902 - DNA, 18 bp, Artificial Sequence
  Synthetic DNA
taacactactctctaaag

SEQ ID NO: 19903 - DNA, 18 bp, Artificial Sequence
  Synthetic DNA
taacactactctctatcg

SEQ ID NO: 19904 - DNA, 18 bp, Artificial Sequence
  Synthetic DNA
taacaggactcacaaaag

SEQ ID NO: 19905 - DNA, 18 bp, Artificial Sequence
  Synthetic DNA
taacaggactcactttcg

SEQ ID NO: 19906 - DNA, 18 bp, Artificial Sequence
  Synthetic DNA
taacatgactctctaaag

SEQ ID NO: 19907 - DNA, 18 bp, Artificial Sequence
  Synthetic DNA
taacatgcctctctatag

SEQ ID NO: 19908 - DNA, 18 bp, Artificial Sequence
  Synthetic DNA
taacccgactcactgtgg

SEQ ID NO: 19909 - DNA, 18 bp, Artificial Sequence
  Synthetic DNA
taacgcggctcactctag

SEQ ID NO: 19910 - DNA, 18 bp, Artificial Sequence
  Synthetic DNA
taagaagactctatatag

SEQ ID NO: 19911 - DNA, 18 bp, Artificial Sequence
  Synthetic DNA
taagaataatcactatag

SEQ ID NO: 19912 - DNA, 18 bp, Artificial Sequence
  Synthetic DNA
taagacaactctccatag

SEQ ID NO: 19913 - DNA, 18 bp, Artificial Sequence
  Synthetic DNA
taagacaattctctatag

SEQ ID NO: 19914 - DNA, 18 bp, Artificial Sequence
  Synthetic DNA
taagacgacaaattatag

SEQ ID NO: 19915 - DNA, 18 bp, Artificial Sequence
  Synthetic DNA
taagacgacccattaaag

SEQ ID NO: 19916 - DNA, 18 bp, Artificial Sequence
  Synthetic DNA
taagacgacgcacaaaag

SEQ ID NO: 19917 - DNA, 18 bp, Artificial Sequence
  Synthetic DNA
taagacgactcataacag

SEQ ID NO: 19918 - DNA, 18 bp, Artificial Sequence
  Synthetic DNA
taagacgacttaatttag

SEQ ID NO: 19919 - DNA, 18 bp, Artificial Sequence
  Synthetic DNA
taagactactgtctatag

SEQ ID NO: 19920 - DNA, 18 bp, Artificial Sequence
  Synthetic DNA
taagacttctcaatatag

SEQ ID NO: 19921 - DNA, 18 bp, Artificial Sequence
  Synthetic DNA
taaggagacttactatag

SEQ ID NO: 19922 - DNA, 18 bp, Artificial Sequence
  Synthetic DNA
taaggctacacactatag

SEQ ID NO: 19923 - DNA, 18 bp, Artificial Sequence
  Synthetic DNA
taataaaactcaatacag

SEQ ID NO: 19924 - DNA, 18 bp, Artificial Sequence
  Synthetic DNA
taataaaactcactccag

SEQ ID NO: 19925 - DNA, 18 bp, Artificial Sequence
  Synthetic DNA
taataaaactctctatcg

SEQ ID NO: 19926 - DNA, 18 bp, Artificial Sequence
  Synthetic DNA
taataaaattcaatatag

SEQ ID NO: 19927 - DNA, 18 bp, Artificial Sequence
  Synthetic DNA
taataacactcacattag

SEQ ID NO: 19928 - DNA, 18 bp, Artificial Sequence
  Synthetic DNA
taataacactcagaatag

SEQ ID NO: 19929 - DNA, 18 bp, Artificial Sequence
  Synthetic DNA
taataagaatctctgtag

SEQ ID NO: 19930 - DNA, 18 bp, Artificial Sequence
  Synthetic DNA
taataagacgcccaatag

SEQ ID NO: 19931 - DNA, 18 bp, Artificial Sequence
  Synthetic DNA
taataagactatctgtag

SEQ ID NO: 19932 - DNA, 18 bp, Artificial Sequence
  Synthetic DNA
taataagactcagttcag

SEQ ID NO: 19933 - DNA, 18 bp, Artificial Sequence
  Synthetic DNA
taataagacttcctatgg

SEQ ID NO: 19934 - DNA, 18 bp, Artificial Sequence
  Synthetic DNA
taataagagtcacaaaag

SEQ ID NO: 19935 - DNA, 18 bp, Artificial Sequence
  Synthetic DNA
taataagattaactacag

SEQ ID NO: 19936 - DNA, 18 bp, Artificial Sequence
  Synthetic DNA
taataagattttctatag

SEQ ID NO: 19937 - DNA, 18 bp, Artificial Sequence
  Synthetic DNA
taataagcatcaatatag

SEQ ID NO: 19938 - DNA, 18 bp, Artificial Sequence
  Synthetic DNA
taataagccacactatcg

SEQ ID NO: 19939 - DNA, 18 bp, Artificial Sequence
  Synthetic DNA
taataagccgccctatag

SEQ ID NO: 19940 - DNA, 18 bp, Artificial Sequence
  Synthetic DNA
taataagcctcaatatcg

SEQ ID NO: 19941 - DNA, 18 bp, Artificial Sequence
  Synthetic DNA
taataaggcacactatcg

SEQ ID NO: 19942 - DNA, 18 bp, Artificial Sequence
  Synthetic DNA
taataaggctcaccatcg

SEQ ID NO: 19943 - DNA, 18 bp, Artificial Sequence
  Synthetic DNA
taataaggctcactgtcg

SEQ ID NO: 19944 - DNA, 18 bp, Artificial Sequence
  Synthetic DNA
taataaggctgaccatag

SEQ ID NO: 19945 - DNA, 18 bp, Artificial Sequence
  Synthetic DNA
taataagtatcactatcg

SEQ ID NO: 19946 - DNA, 18 bp, Artificial Sequence
  Synthetic DNA
taataagtctcaccatcg

SEQ ID NO: 19947 - DNA, 18 bp, Artificial Sequence
  Synthetic DNA
taataagtctctctctag

SEQ ID NO: 19948 - DNA, 18 bp, Artificial Sequence
  Synthetic DNA
taataagtctgtctatag

SEQ ID NO: 19949 - DNA, 18 bp, Artificial Sequence
  Synthetic DNA
taatacaaaacactctag

SEQ ID NO: 19950 - DNA, 18 bp, Artificial Sequence
  Synthetic DNA
taatacaacaccctttag

SEQ ID NO: 19951 - DNA, 18 bp, Artificial Sequence
  Synthetic DNA
taatacaacctacaatag

SEQ ID NO: 19952 - DNA, 18 bp, Artificial Sequence
  Synthetic DNA
taatacaactaactaacg

SEQ ID NO: 19953 - DNA, 18 bp, Artificial Sequence
  Synthetic DNA
taatacaactcaacttag

SEQ ID NO: 19954 - DNA, 18 bp, Artificial Sequence
  Synthetic DNA
taatacaactcactcagg

SEQ ID NO: 19955 - DNA, 18 bp, Artificial Sequence
  Synthetic DNA
taatacaactctatacag

SEQ ID NO: 19956 - DNA, 18 bp, Artificial Sequence
  Synthetic DNA
taatacaactctctgtcg

SEQ ID NO: 19957 - DNA, 18 bp, Artificial Sequence
  Synthetic DNA
taatacaactcttcatag

SEQ ID NO: 19958 - DNA, 18 bp, Artificial Sequence
  Synthetic DNA
taatacaagtaactatgg

SEQ ID NO: 19959 - DNA, 18 bp, Artificial Sequence
  Synthetic DNA
taatacagatcactatcg

SEQ ID NO: 19960 - DNA, 18 bp, Artificial Sequence
  Synthetic DNA
taatacatgtctctatag

SEQ ID NO: 19961 - DNA, 18 bp, Artificial Sequence
  Synthetic DNA
taataccaataactacag

SEQ ID NO: 19962 - DNA, 18 bp, Artificial Sequence
  Synthetic DNA
taataccaatcacttaag

SEQ ID NO: 19963 - DNA, 18 bp, Artificial Sequence
  Synthetic DNA
taataccacaaactctag

SEQ ID NO: 19964 - DNA, 18 bp, Artificial Sequence
  Synthetic DNA
taataccacacacaatcg

SEQ ID NO: 19965 - DNA, 18 bp, Artificial Sequence
  Synthetic DNA
taataccaccctcaatag

SEQ ID NO: 19966 - DNA, 18 bp, Artificial Sequence
  Synthetic DNA
taataccaggcaccatag

SEQ ID NO: 19967 - DNA, 18 bp, Artificial Sequence
  Synthetic DNA
taataccatttactaaag

SEQ ID NO: 19968 - DNA, 18 bp, Artificial Sequence
  Synthetic DNA
taatacccatcactatcg

SEQ ID NO: 19969 - DNA, 18 bp, Artificial Sequence
  Synthetic DNA
taataccgctcacattag

SEQ ID NO: 19970 - DNA, 18 bp, Artificial Sequence
  Synthetic DNA
taatacctccccctatag

SEQ ID NO: 19971 - DNA, 18 bp, Artificial Sequence
  Synthetic DNA
taatacgaaaaactatgg

SEQ ID NO: 19972 - DNA, 18 bp, Artificial Sequence
  Synthetic DNA
taatacgaaggcctatag

SEQ ID NO: 19973 - DNA, 18 bp, Artificial Sequence
  Synthetic DNA
taatacgaataacaatcg

SEQ ID NO: 19974 - DNA, 18 bp, Artificial Sequence
  Synthetic DNA
taatacgaataactccag

SEQ ID NO: 19975 - DNA, 18 bp, Artificial Sequence
  Synthetic DNA
taatacgaatacctttag

SEQ ID NO: 19976 - DNA, 18 bp, Artificial Sequence
  Synthetic DNA
taatacgacaaacaatgg

SEQ ID NO: 19977 - DNA, 18 bp, Artificial Sequence
  Synthetic DNA
taatacgacaaactaagg

SEQ ID NO: 19978 - DNA, 18 bp, Artificial Sequence
  Synthetic DNA
taatacgacaaactacgg

SEQ ID NO: 19979 - DNA, 18 bp, Artificial Sequence
  Synthetic DNA
taatacgacaaactctgg

SEQ ID NO: 19980 - DNA, 18 bp, Artificial Sequence
  Synthetic DNA
taatacgacaaattgtag

SEQ ID NO: 19981 - DNA, 18 bp, Artificial Sequence
  Synthetic DNA
taatacgacacaaactag

SEQ ID NO: 19982 - DNA, 18 bp, Artificial Sequence
  Synthetic DNA
taatacgacacactcgcg

SEQ ID NO: 19983 - DNA, 18 bp, Artificial Sequence
  Synthetic DNA
taatacgacacactttgc

SEQ ID NO: 19984 - DNA, 18 bp, Artificial Sequence
  Synthetic DNA
taatacgacccaccaagg

SEQ ID NO: 19985 - DNA, 18 bp, Artificial Sequence
  Synthetic DNA
taatacgacccacttagg

SEQ ID NO: 19986 - DNA, 18 bp, Artificial Sequence
  Synthetic DNA
taatacgacccatcaaag

SEQ ID NO: 19987 - DNA, 18 bp, Artificial Sequence
  Synthetic DNA
taatacgaccctcactag

SEQ ID NO: 19988 - DNA, 18 bp, Artificial Sequence
  Synthetic DNA
taatacgacctaatttag

SEQ ID NO: 19989 - DNA, 18 bp, Artificial Sequence
  Synthetic DNA
taatacgacctatcatag

SEQ ID NO: 19990 - DNA, 18 bp, Artificial Sequence
  Synthetic DNA
taatacgacgaattgtag

SEQ ID NO: 19991 - DNA, 18 bp, Artificial Sequence
  Synthetic DNA
taatacgactaaatatca

SEQ ID NO: 19992 - DNA, 18 bp, Artificial Sequence
  Synthetic DNA
taatacgactaaatccag

SEQ ID NO: 19993 - DNA, 18 bp, Artificial Sequence
  Synthetic DNA
taatacgactaaccttgg

SEQ ID NO: 19994 - DNA, 18 bp, Artificial Sequence
  Synthetic DNA
taatacgactctcatcag

SEQ ID NO: 19995 - DNA, 18 bp, Artificial Sequence
  Synthetic DNA
taatacgactctctcacg

SEQ ID NO: 19996 - DNA, 18 bp, Artificial Sequence
  Synthetic DNA
taatacgactgtcattag

SEQ ID NO: 19997 - DNA, 18 bp, Artificial Sequence
  Synthetic DNA
taatacgacttacctcag

SEQ ID NO: 19998 - DNA, 18 bp, Artificial Sequence
  Synthetic DNA
taatacgacttagagtag

SEQ ID NO: 19999 - DNA, 18 bp, Artificial Sequence
  Synthetic DNA
taatacgacttataaaag

SEQ ID NO: 20000 - DNA, 18 bp, Artificial Sequence
  Synthetic DNA
taatacgagacattatgg

SEQ ID NO: 20001 - DNA, 18 bp, Artificial Sequence
  Synthetic DNA
taatacgagtcaaactag

SEQ ID NO: 20002 - DNA, 18 bp, Artificial Sequence
  Synthetic DNA
taatacgagtctctgtgg

SEQ ID NO: 20003 - DNA, 18 bp, Artificial Sequence
  Synthetic DNA
taatacgatacactgaag

SEQ ID NO: 20004 - DNA, 18 bp, Artificial Sequence
  Synthetic DNA
taatacgatgcacaaaag

SEQ ID NO: 20005 - DNA, 18 bp, Artificial Sequence
  Synthetic DNA
taatacgatgcaccttag

SEQ ID NO: 20006 - DNA, 18 bp, Artificial Sequence
  Synthetic DNA
taatacgattaacaataa

SEQ ID NO: 20007 - DNA, 18 bp, Artificial Sequence
  Synthetic DNA
taatacgattaaccataa

SEQ ID NO: 20008 - DNA, 18 bp, Artificial Sequence
  Synthetic DNA
taatacgattaattatgg

SEQ ID NO: 20009 - DNA, 18 bp, Artificial Sequence
  Synthetic DNA
taatacgattcacaaggg

SEQ ID NO: 20010 - DNA, 18 bp, Artificial Sequence
  Synthetic DNA
taatacgattcacctcag

SEQ ID NO: 20011 - DNA, 18 bp, Artificial Sequence
  Synthetic DNA
taatacgattcatcctag

SEQ ID NO: 20012 - DNA, 18 bp, Artificial Sequence
  Synthetic DNA
taatacgattcattttcg

SEQ ID NO: 20013 - DNA, 18 bp, Artificial Sequence
  Synthetic DNA
taatacgattctctgaag

SEQ ID NO: 20014 - DNA, 18 bp, Artificial Sequence
  Synthetic DNA
taatacgattgattagag

SEQ ID NO: 20015 - DNA, 18 bp, Artificial Sequence
  Synthetic DNA
taatacgccgcaccttag

SEQ ID NO: 20016 - DNA, 18 bp, Artificial Sequence
  Synthetic DNA
taatacgcctaacagtag

SEQ ID NO: 20017 - DNA, 18 bp, Artificial Sequence
  Synthetic DNA
taatacgcctcactcacg

SEQ ID NO: 20018 - DNA, 18 bp, Artificial Sequence
  Synthetic DNA
taatacgccttattaaag

SEQ ID NO: 20019 - DNA, 18 bp, Artificial Sequence
  Synthetic DNA
taatacggcacattacag

SEQ ID NO: 20020 - DNA, 18 bp, Artificial Sequence
  Synthetic DNA
taatacggcagtctatag

SEQ ID NO: 20021 - DNA, 18 bp, Artificial Sequence
  Synthetic DNA
taatacggttatctatag

SEQ ID NO: 20022 - DNA, 18 bp, Artificial Sequence
  Synthetic DNA
taatacggttccctaaag

SEQ ID NO: 20023 - DNA, 18 bp, Artificial Sequence
  Synthetic DNA
taatacgtatccctctag

SEQ ID NO: 20024 - DNA, 18 bp, Artificial Sequence
  Synthetic DNA
taatacgtatccctgtag

SEQ ID NO: 20025 - DNA, 18 bp, Artificial Sequence
  Synthetic DNA
taatacgtcaaacgatag

SEQ ID NO: 20026 - DNA, 18 bp, Artificial Sequence
  Synthetic DNA
taatacgtccctatatag

SEQ ID NO: 20027 - DNA, 18 bp, Artificial Sequence
  Synthetic DNA
taatacgtccctcaatag

SEQ ID NO: 20028 - DNA, 18 bp, Artificial Sequence
  Synthetic DNA
taatacgtcgcaccttag

SEQ ID NO: 20029 - DNA, 18 bp, Artificial Sequence
  Synthetic DNA
taatacgtctaactaagg

SEQ ID NO: 20030 - DNA, 18 bp, Artificial Sequence
  Synthetic DNA
taatacgtctcagtccag

SEQ ID NO: 20031 - DNA, 18 bp, Artificial Sequence
  Synthetic DNA
taatacgtctctctaagg

SEQ ID NO: 20032 - DNA, 18 bp, Artificial Sequence
  Synthetic DNA
taatacgtgttaatatag

SEQ ID NO: 20033 - DNA, 18 bp, Artificial Sequence
  Synthetic DNA
taatactaatcaatctag

SEQ ID NO: 20034 - DNA, 18 bp, Artificial Sequence
  Synthetic DNA
taatactacagactttag

SEQ ID NO: 20035 - DNA, 18 bp, Artificial Sequence
  Synthetic DNA
taatactactctcgacag

SEQ ID NO: 20036 - DNA, 18 bp, Artificial Sequence
  Synthetic DNA
taatactactgcctaaag

SEQ ID NO: 20037 - DNA, 18 bp, Artificial Sequence
  Synthetic DNA
taatactacttcatatag

SEQ ID NO: 20038 - DNA, 18 bp, Artificial Sequence
  Synthetic DNA
taatactatccattatag

SEQ ID NO: 20039 - DNA, 18 bp, Artificial Sequence
  Synthetic DNA
taatactattcactttcg

SEQ ID NO: 20040 - DNA, 18 bp, Artificial Sequence
  Synthetic DNA
taatactatttagtatag

SEQ ID NO: 20041 - DNA, 18 bp, Artificial Sequence
  Synthetic DNA
taatactcatcactaaag

SEQ ID NO: 20042 - DNA, 18 bp, Artificial Sequence
  Synthetic DNA
taatactcctcacaatcg

SEQ ID NO: 20043 - DNA, 18 bp, Artificial Sequence
  Synthetic DNA
taatactgcacactacag

SEQ ID NO: 20044 - DNA, 18 bp, Artificial Sequence
  Synthetic DNA
taatactgctctctaaag

SEQ ID NO: 20045 - DNA, 18 bp, Artificial Sequence
  Synthetic DNA
taatacttcgtactatag

SEQ ID NO: 20046 - DNA, 18 bp, Artificial Sequence
  Synthetic DNA
taatacttctcccaatag

SEQ ID NO: 20047 - DNA, 18 bp, Artificial Sequence
  Synthetic DNA
taatacttcttactaaag

SEQ ID NO: 20048 - DNA, 18 bp, Artificial Sequence
  Synthetic DNA
taatacttgtcacaatag

SEQ ID NO: 20049 - DNA, 18 bp, Artificial Sequence
  Synthetic DNA
taatagaactcacagtag

SEQ ID NO: 20050 - DNA, 18 bp, Artificial Sequence
  Synthetic DNA
taatagaactcacttcag

SEQ ID NO: 20051 - DNA, 18 bp, Artificial Sequence
  Synthetic DNA
taatagcactcagtttag

SEQ ID NO: 20052 - DNA, 18 bp, Artificial Sequence
  Synthetic DNA
taataggaatcaatatcg

SEQ ID NO: 20053 - DNA, 18 bp, Artificial Sequence
  Synthetic DNA
taataggactcaacttag

SEQ ID NO: 20054 - DNA, 18 bp, Artificial Sequence
  Synthetic DNA
taataggccccactatgg

SEQ ID NO: 20055 - DNA, 18 bp, Artificial Sequence
  Synthetic DNA
taataggcttcacaatag

SEQ ID NO: 20056 - DNA, 18 bp, Artificial Sequence
  Synthetic DNA
taatagggatcactaaag

SEQ ID NO: 20057 - DNA, 18 bp, Artificial Sequence
  Synthetic DNA
taatagggctaaatatag

SEQ ID NO: 20058 - DNA, 18 bp, Artificial Sequence
  Synthetic DNA
taataggtctcattacag

SEQ ID NO: 20059 - DNA, 18 bp, Artificial Sequence
  Synthetic DNA
taataggtctctctacag

SEQ ID NO: 20060 - DNA, 18 bp, Artificial Sequence
  Synthetic DNA
taatagtattcactaaag

SEQ ID NO: 20061 - DNA, 18 bp, Artificial Sequence
  Synthetic DNA
taatagtgctcattatag

SEQ ID NO: 20062 - DNA, 18 bp, Artificial Sequence
  Synthetic DNA
taatataacacactgtag

SEQ ID NO: 20063 - DNA, 18 bp, Artificial Sequence
  Synthetic DNA
taatataacccactaaag

SEQ ID NO: 20064 - DNA, 18 bp, Artificial Sequence
  Synthetic DNA
taatatcactaactaaag

SEQ ID NO: 20065 - DNA, 18 bp, Artificial Sequence
  Synthetic DNA
taatatgaataactagag

SEQ ID NO: 20066 - DNA, 18 bp, Artificial Sequence
  Synthetic DNA
taatatgaatcaccaaag

SEQ ID NO: 20067 - DNA, 18 bp, Artificial Sequence
  Synthetic DNA
taatatgacaaacgatag

SEQ ID NO: 20068 - DNA, 18 bp, Artificial Sequence
  Synthetic DNA
taatatgacgcataatag

SEQ ID NO: 20069 - DNA, 18 bp, Artificial Sequence
  Synthetic DNA
taatatgacgttctatag

SEQ ID NO: 20070 - DNA, 18 bp, Artificial Sequence
  Synthetic DNA
taatatgactctatacag

SEQ ID NO: 20071 - DNA, 18 bp, Artificial Sequence
  Synthetic DNA
taatatgaggctctatag

SEQ ID NO: 20072 - DNA, 18 bp, Artificial Sequence
  Synthetic DNA
taatatgattaagtatag

SEQ ID NO: 20073 - DNA, 18 bp, Artificial Sequence
  Synthetic DNA
taatatgcttcactatac

SEQ ID NO: 20074 - DNA, 18 bp, Artificial Sequence
  Synthetic DNA
taatatgtatcactatcg

SEQ ID NO: 20075 - DNA, 18 bp, Artificial Sequence
  Synthetic DNA
taatatgtctaactacag

SEQ ID NO: 20076 - DNA, 18 bp, Artificial Sequence
  Synthetic DNA
taatatgtctcaccgtag

SEQ ID NO: 20077 - DNA, 18 bp, Artificial Sequence
  Synthetic DNA
taatattacccaccatag

SEQ ID NO: 20078 - DNA, 18 bp, Artificial Sequence
  Synthetic DNA
taatattactcaccatgg

SEQ ID NO: 20079 - DNA, 18 bp, Artificial Sequence
  Synthetic DNA
taatattactcacttgag

SEQ ID NO: 20080 - DNA, 18 bp, Artificial Sequence
  Synthetic DNA
taatcacactcactaaag

SEQ ID NO: 20081 - DNA, 18 bp, Artificial Sequence
  Synthetic DNA
taatcagaataactatag

SEQ ID NO: 20082 - DNA, 18 bp, Artificial Sequence
  Synthetic DNA
taatcagtttcactatag

SEQ ID NO: 20083 - DNA, 18 bp, Artificial Sequence
  Synthetic DNA
taatccaaatgactatag

SEQ ID NO: 20084 - DNA, 18 bp, Artificial Sequence
  Synthetic DNA
taatccaacttactagag

SEQ ID NO: 20085 - DNA, 18 bp, Artificial Sequence
  Synthetic DNA
taatcccactacctatag

SEQ ID NO: 20086 - DNA, 18 bp, Artificial Sequence
  Synthetic DNA
taatcccactgactatcg

SEQ ID NO: 20087 - DNA, 18 bp, Artificial Sequence
  Synthetic DNA
taatcccatttactatag

SEQ ID NO: 20088 - DNA, 18 bp, Artificial Sequence
  Synthetic DNA
taatcccgcacactatag

SEQ ID NO: 20089 - DNA, 18 bp, Artificial Sequence
  Synthetic DNA
taatccgaatcaataaag

SEQ ID NO: 20090 - DNA, 18 bp, Artificial Sequence
  Synthetic DNA
taatccgacacaatatcg

SEQ ID NO: 20091 - DNA, 18 bp, Artificial Sequence
  Synthetic DNA
taatccgacactctgtag

SEQ ID NO: 20092 - DNA, 18 bp, Artificial Sequence
  Synthetic DNA
taatccgaggcactaaag

SEQ ID NO: 20093 - DNA, 18 bp, Artificial Sequence
  Synthetic DNA
taatccgattcccaatag

SEQ ID NO: 20094 - DNA, 18 bp, Artificial Sequence
  Synthetic DNA
taatccgcctgagtatag

SEQ ID NO: 20095 - DNA, 18 bp, Artificial Sequence
  Synthetic DNA
taatccgtctcacaatcg

SEQ ID NO: 20096 - DNA, 18 bp, Artificial Sequence
  Synthetic DNA
taatcctacacacgatag

SEQ ID NO: 20097 - DNA, 18 bp, Artificial Sequence
  Synthetic DNA
taatcgtactcaccatag

SEQ ID NO: 20098 - DNA, 18 bp, Artificial Sequence
  Synthetic DNA
taatctcactcactctag

SEQ ID NO: 20099 - DNA, 18 bp, Artificial Sequence
  Synthetic DNA
taatctgactcaatttag

SEQ ID NO: 20100 - DNA, 18 bp, Artificial Sequence
  Synthetic DNA
taatctgactcagcatag

SEQ ID NO: 20101 - DNA, 18 bp, Artificial Sequence
  Synthetic DNA
taatctgattcactctag

SEQ ID NO: 20102 - DNA, 18 bp, Artificial Sequence
  Synthetic DNA
taatgaaactcactaaag

SEQ ID NO: 20103 - DNA, 18 bp, Artificial Sequence
  Synthetic DNA
taatgaacctcactatag

SEQ ID NO: 20104 - DNA, 18 bp, Artificial Sequence
  Synthetic DNA
taatgagaaccactatag

SEQ ID NO: 20105 - DNA, 18 bp, Artificial Sequence
  Synthetic DNA
taatgagacacactatgg

SEQ ID NO: 20106 - DNA, 18 bp, Artificial Sequence
  Synthetic DNA
taatgagtctcactacag

SEQ ID NO: 20107 - DNA, 18 bp, Artificial Sequence
  Synthetic DNA
taatgatactcactatcg

SEQ ID NO: 20108 - DNA, 18 bp, Artificial Sequence
  Synthetic DNA
taatgcaacatactatag

SEQ ID NO: 20109 - DNA, 18 bp, Artificial Sequence
  Synthetic DNA
taatgcaacccacaatag

SEQ ID NO: 20110 - DNA, 18 bp, Artificial Sequence
  Synthetic DNA
taatgcaacttattatag

SEQ ID NO: 20111 - DNA, 18 bp, Artificial Sequence
  Synthetic DNA
taatgcgaatcacaacag

SEQ ID NO: 20112 - DNA, 18 bp, Artificial Sequence
  Synthetic DNA
taatgcgactaacaagag

SEQ ID NO: 20113 - DNA, 18 bp, Artificial Sequence
  Synthetic DNA
taatgcgactaactaccg

SEQ ID NO: 20114 - DNA, 18 bp, Artificial Sequence
  Synthetic DNA
taatgcgactcatgttag

SEQ ID NO: 20115 - DNA, 18 bp, Artificial Sequence
  Synthetic DNA
taatgcgacttaaaatag

SEQ ID NO: 20116 - DNA, 18 bp, Artificial Sequence
  Synthetic DNA
taatgcgattcactacgg

SEQ ID NO: 20117 - DNA, 18 bp, Artificial Sequence
  Synthetic DNA
taatgcgccgcacgatag

SEQ ID NO: 20118 - DNA, 18 bp, Artificial Sequence
  Synthetic DNA
taatgcgccgcagtatag

SEQ ID NO: 20119 - DNA, 18 bp, Artificial Sequence
  Synthetic DNA
taatgggaccaactatag

SEQ ID NO: 20120 - DNA, 18 bp, Artificial Sequence
  Synthetic DNA
tacaacgactcacgaaag

SEQ ID NO: 20121 - DNA, 18 bp, Artificial Sequence
  Synthetic DNA
tacaacgactcacgctag

SEQ ID NO: 20122 - DNA, 18 bp, Artificial Sequence
  Synthetic DNA
taccacgacatactatag

SEQ ID NO: 20123 - DNA, 18 bp, Artificial Sequence
  Synthetic DNA
taccatgactcacaatag

SEQ ID NO: 20124 - DNA, 18 bp, Artificial Sequence
  Synthetic DNA
tacggcgactccctatag

SEQ ID NO: 20125 - DNA, 18 bp, Artificial Sequence
  Synthetic DNA
tactaagactcataatag

SEQ ID NO: 20126 - DNA, 18 bp, Artificial Sequence
  Synthetic DNA
tactacatctaactatag

SEQ ID NO: 20127 - DNA, 18 bp, Artificial Sequence
  Synthetic DNA
tactaccactcactttgg

SEQ ID NO: 20128 - DNA, 18 bp, Artificial Sequence
  Synthetic DNA
tactacgaatgactaaag

SEQ ID NO: 20129 - DNA, 18 bp, Artificial Sequence
  Synthetic DNA
tactacgacgtaatatag

SEQ ID NO: 20130 - DNA, 18 bp, Artificial Sequence
  Synthetic DNA
tactacgactcaatcaag

SEQ ID NO: 20131 - DNA, 18 bp, Artificial Sequence
  Synthetic DNA
tactacgattcactccag

SEQ ID NO: 20132 - DNA, 18 bp, Artificial Sequence
  Synthetic DNA
tactacgccggactatag

SEQ ID NO: 20133 - DNA, 18 bp, Artificial Sequence
  Synthetic DNA
tactacgcttgactatag

SEQ ID NO: 20134 - DNA, 18 bp, Artificial Sequence
  Synthetic DNA
tactacgtcacattatag

SEQ ID NO: 20135 - DNA, 18 bp, Artificial Sequence
  Synthetic DNA
tactactactcactgaag

SEQ ID NO: 20136 - DNA, 18 bp, Artificial Sequence
  Synthetic DNA
tactactacttagtatag

SEQ ID NO: 20137 - DNA, 18 bp, Artificial Sequence
  Synthetic DNA
tactactagtccctatag

SEQ ID NO: 20138 - DNA, 18 bp, Artificial Sequence
  Synthetic DNA
tactaggactctttatag

SEQ ID NO: 20139 - DNA, 18 bp, Artificial Sequence
  Synthetic DNA
tactatgactcagtttag

SEQ ID NO: 20140 - DNA, 18 bp, Artificial Sequence
  Synthetic DNA
tactatgactgcctatag

SEQ ID NO: 20141 - DNA, 18 bp, Artificial Sequence
  Synthetic DNA
tactatggctcactttag

SEQ ID NO: 20142 - DNA, 18 bp, Artificial Sequence
  Synthetic DNA
tactatgtctcacaatag

SEQ ID NO: 20143 - DNA, 18 bp, Artificial Sequence
  Synthetic DNA
tactccaactctctatag

SEQ ID NO: 20144 - DNA, 18 bp, Artificial Sequence
  Synthetic DNA
tactgcgactcactaacg

SEQ ID NO: 20145 - DNA, 18 bp, Artificial Sequence
  Synthetic DNA
tactgctacttactatag

SEQ ID NO: 20146 - DNA, 18 bp, Artificial Sequence
  Synthetic DNA
tagcaccactcaatatag

SEQ ID NO: 20147 - DNA, 18 bp, Artificial Sequence
  Synthetic DNA
tagcacgacgcactaaag

SEQ ID NO: 20148 - DNA, 18 bp, Artificial Sequence
  Synthetic DNA
tagcacggctcaccatag

SEQ ID NO: 20149 - DNA, 18 bp, Artificial Sequence
  Synthetic DNA
taggacgactcactcaag

SEQ ID NO: 20150 - DNA, 18 bp, Artificial Sequence
  Synthetic DNA
taggacgattcactttag

SEQ ID NO: 20151 - DNA, 18 bp, Artificial Sequence
  Synthetic DNA
tagtaagactcattaaag

SEQ ID NO: 20152 - DNA, 18 bp, Artificial Sequence
  Synthetic DNA
tagtaagattcactttag

SEQ ID NO: 20153 - DNA, 18 bp, Artificial Sequence
  Synthetic DNA
tagtacaacacaatatag

SEQ ID NO: 20154 - DNA, 18 bp, Artificial Sequence
  Synthetic DNA
tagtacaactgaatatag

SEQ ID NO: 20155 - DNA, 18 bp, Artificial Sequence
  Synthetic DNA
tagtacatctcaatatag

SEQ ID NO: 20156 - DNA, 18 bp, Artificial Sequence
  Synthetic DNA
tagtaccacccactaaag

SEQ ID NO: 20157 - DNA, 18 bp, Artificial Sequence
  Synthetic DNA
tagtacgaagccctatag

SEQ ID NO: 20158 - DNA, 18 bp, Artificial Sequence
  Synthetic DNA
tagtacgacacaccaaag

SEQ ID NO: 20159 - DNA, 18 bp, Artificial Sequence
  Synthetic DNA
tagtacgacacagtatcg

SEQ ID NO: 20160 - DNA, 18 bp, Artificial Sequence
  Synthetic DNA
tagtacgacccacaaaag

SEQ ID NO: 20161 - DNA, 18 bp, Artificial Sequence
  Synthetic DNA
tagtacgacctaatatag

SEQ ID NO: 20162 - DNA, 18 bp, Artificial Sequence
  Synthetic DNA
tagtacgactaagtacag

SEQ ID NO: 20163 - DNA, 18 bp, Artificial Sequence
  Synthetic DNA
tagtacgactaattacag

SEQ ID NO: 20164 - DNA, 18 bp, Artificial Sequence
  Synthetic DNA
tagtacgactcactgagg

SEQ ID NO: 20165 - DNA, 18 bp, Artificial Sequence
  Synthetic DNA
tagtacgactcccttcag

SEQ ID NO: 20166 - DNA, 18 bp, Artificial Sequence
  Synthetic DNA
tagtacgatacactctag

SEQ ID NO: 20167 - DNA, 18 bp, Artificial Sequence
  Synthetic DNA
tagtacgatacattatag

SEQ ID NO: 20168 - DNA, 18 bp, Artificial Sequence
  Synthetic DNA
tagtacgatttagtatag

SEQ ID NO: 20169 - DNA, 18 bp, Artificial Sequence
  Synthetic DNA
tagtacgtgtcactttag

SEQ ID NO: 20170 - DNA, 18 bp, Artificial Sequence
  Synthetic DNA
tagtacttctcactatcg

SEQ ID NO: 20171 - DNA, 18 bp, Artificial Sequence
  Synthetic DNA
tagtataactcaatatag

SEQ ID NO: 20172 - DNA, 18 bp, Artificial Sequence
  Synthetic DNA
tagtatgactcagaatag

SEQ ID NO: 20173 - DNA, 18 bp, Artificial Sequence
  Synthetic DNA
tagtattactcacaatag

SEQ ID NO: 20174 - DNA, 18 bp, Artificial Sequence
  Synthetic DNA
tagtgtgactctctatag

SEQ ID NO: 20175 - DNA, 18 bp, Artificial Sequence
  Synthetic DNA
tataaccactcaccatag

SEQ ID NO: 20176 - DNA, 18 bp, Artificial Sequence
  Synthetic DNA
tatagcgtctcactatag

SEQ ID NO: 20177 - DNA, 18 bp, Artificial Sequence
  Synthetic DNA
tatcacaactcactaaag

SEQ ID NO: 20178 - DNA, 18 bp, Artificial Sequence
  Synthetic DNA
tatcacgagtcactgtag

SEQ ID NO: 20179 - DNA, 18 bp, Artificial Sequence
  Synthetic DNA
tatcacgcatcactatag

SEQ ID NO: 20180 - DNA, 18 bp, Artificial Sequence
  Synthetic DNA
tatcatgactcaccatag

SEQ ID NO: 20181 - DNA, 18 bp, Artificial Sequence
  Synthetic DNA
tatgaaaactcactatag

SEQ ID NO: 20182 - DNA, 18 bp, Artificial Sequence
  Synthetic DNA
tatgaagactctctatag

SEQ ID NO: 20183 - DNA, 18 bp, Artificial Sequence
  Synthetic DNA
tatgacgactcactgaag

SEQ ID NO: 20184 - DNA, 18 bp, Artificial Sequence
  Synthetic DNA
tatgatgactaactatag

SEQ ID NO: 20185 - DNA, 18 bp, Artificial Sequence
  Synthetic DNA
tattaagactcacagtag

SEQ ID NO: 20186 - DNA, 18 bp, Artificial Sequence
  Synthetic DNA
tattaagactcattacag

SEQ ID NO: 20187 - DNA, 18 bp, Artificial Sequence
  Synthetic DNA
tattacaactcactttgg

SEQ ID NO: 20188 - DNA, 18 bp, Artificial Sequence
  Synthetic DNA
tattacaactcattacag

SEQ ID NO: 20189 - DNA, 18 bp, Artificial Sequence
  Synthetic DNA
tattaccaaccactatag

SEQ ID NO: 20190 - DNA, 18 bp, Artificial Sequence
  Synthetic DNA
tattaccaatcactagag

SEQ ID NO: 20191 - DNA, 18 bp, Artificial Sequence
  Synthetic DNA
tattaccactaactacag

SEQ ID NO: 20192 - DNA, 18 bp, Artificial Sequence
  Synthetic DNA
tattaccactctccatag

SEQ ID NO: 20193 - DNA, 18 bp, Artificial Sequence
  Synthetic DNA
tattaccattcactagag

SEQ ID NO: 20194 - DNA, 18 bp, Artificial Sequence
  Synthetic DNA
tattacgaaccaatatag

SEQ ID NO: 20195 - DNA, 18 bp, Artificial Sequence
  Synthetic DNA
tattacgaacgactatag

SEQ ID NO: 20196 - DNA, 18 bp, Artificial Sequence
  Synthetic DNA
tattacgacccacttcag

SEQ ID NO: 20197 - DNA, 18 bp, Artificial Sequence
  Synthetic DNA
tattacgactgtctacag

SEQ ID NO: 20198 - DNA, 18 bp, Artificial Sequence
  Synthetic DNA
tattacgacttacgctag

SEQ ID NO: 20199 - DNA, 18 bp, Artificial Sequence
  Synthetic DNA
tattacgacttcctctag

SEQ ID NO: 20200 - DNA, 18 bp, Artificial Sequence
  Synthetic DNA
tattacgagagactatag

SEQ ID NO: 20201 - DNA, 18 bp, Artificial Sequence
  Synthetic DNA
tattacgatgcactttag

SEQ ID NO: 20202 - DNA, 18 bp, Artificial Sequence
  Synthetic DNA
tattacgattaagtatag

SEQ ID NO: 20203 - DNA, 18 bp, Artificial Sequence
  Synthetic DNA
tattacgatttcctatag

SEQ ID NO: 20204 - DNA, 18 bp, Artificial Sequence
  Synthetic DNA
tattacgccacacgatag

SEQ ID NO: 20205 - DNA, 18 bp, Artificial Sequence
  Synthetic DNA
tattacgcctcaccaaag

SEQ ID NO: 20206 - DNA, 18 bp, Artificial Sequence
  Synthetic DNA
tattacgcctcccaatag

SEQ ID NO: 20207 - DNA, 18 bp, Artificial Sequence
  Synthetic DNA
tattacgtcccattatag

SEQ ID NO: 20208 - DNA, 18 bp, Artificial Sequence
  Synthetic DNA
tattacgtctcaagatag

SEQ ID NO: 20209 - DNA, 18 bp, Artificial Sequence
  Synthetic DNA
tattactactgactttag

SEQ ID NO: 20210 - DNA, 18 bp, Artificial Sequence
  Synthetic DNA
tattactgctcactatcg

SEQ ID NO: 20211 - DNA, 18 bp, Artificial Sequence
  Synthetic DNA
tattagcactcaatatag

SEQ ID NO: 20212 - DNA, 18 bp, Artificial Sequence
  Synthetic DNA
tattagcagtcactatag

SEQ ID NO: 20213 - DNA, 18 bp, Artificial Sequence
  Synthetic DNA
tattaggactcataatag

SEQ ID NO: 20214 - DNA, 18 bp, Artificial Sequence
  Synthetic DNA
tattaggcctcactgtag

SEQ ID NO: 20215 - DNA, 18 bp, Artificial Sequence
  Synthetic DNA
tattattactcaatatag

SEQ ID NO: 20216 - DNA, 18 bp, Artificial Sequence
  Synthetic DNA
tattcggactcactagag

SEQ ID NO: 20217 - DNA, 18 bp, Artificial Sequence
  Synthetic DNA
tattgcgacacactaaag

SEQ ID NO: 20218 - DNA, 18 bp, Artificial Sequence
  Synthetic DNA
tattgcgactcaatatgg

SEQ ID NO: 20219 - DNA, 18 bp, Artificial Sequence
  Synthetic DNA
tattgcgactgactaaag

SEQ ID NO: 20220 - DNA, 18 bp, Artificial Sequence
  Synthetic DNA
tattgcgagtcactacag

SEQ ID NO: 20221 - DNA, 18 bp, Artificial Sequence
  Synthetic DNA
tattgcggctgactatag

SEQ ID NO: 20222 - DNA, 18 bp, Artificial Sequence
  Synthetic DNA
tattgctactaactatag

SEQ ID NO: 20223 - DNA, 18 bp, Artificial Sequence
  Synthetic DNA
tcaaaagactaactatag

SEQ ID NO: 20224 - DNA, 18 bp, Artificial Sequence
  Synthetic DNA
tcaaacggctcactttag

SEQ ID NO: 20225 - DNA, 18 bp, Artificial Sequence
  Synthetic DNA
tcaaactattcactatag

SEQ ID NO: 20226 - DNA, 18 bp, Artificial Sequence
  Synthetic DNA
tcaaataactcactatag

SEQ ID NO: 20227 - DNA, 18 bp, Artificial Sequence
  Synthetic DNA
tcagacgattcacaatag

SEQ ID NO: 20228 - DNA, 18 bp, Artificial Sequence
  Synthetic DNA
tcataagattctctatag

SEQ ID NO: 20229 - DNA, 18 bp, Artificial Sequence
  Synthetic DNA
tcataagcctctctatag

SEQ ID NO: 20230 - DNA, 18 bp, Artificial Sequence
  Synthetic DNA
tcataagtctaactatag

SEQ ID NO: 20231 - DNA, 18 bp, Artificial Sequence
  Synthetic DNA
tcataatacgcactatag

SEQ ID NO: 20232 - DNA, 18 bp, Artificial Sequence
  Synthetic DNA
tcatacgattcaatctag

SEQ ID NO: 20233 - DNA, 18 bp, Artificial Sequence
  Synthetic DNA
tcatacgattgactttag

SEQ ID NO: 20234 - DNA, 18 bp, Artificial Sequence
  Synthetic DNA
tcatacgatttactatcg

SEQ ID NO: 20235 - DNA, 18 bp, Artificial Sequence
  Synthetic DNA
tcatacgcatcagtatag

SEQ ID NO: 20236 - DNA, 18 bp, Artificial Sequence
  Synthetic DNA
tcatacgccactctatag

SEQ ID NO: 20237 - DNA, 18 bp, Artificial Sequence
  Synthetic DNA
tcatacggctcacagtag

SEQ ID NO: 20238 - DNA, 18 bp, Artificial Sequence
  Synthetic DNA
tcatacgtcacactatgg

SEQ ID NO: 20239 - DNA, 18 bp, Artificial Sequence
  Synthetic DNA
tcatactactaaatatag

SEQ ID NO: 20240 - DNA, 18 bp, Artificial Sequence
  Synthetic DNA
tcatactattcactttag

SEQ ID NO: 20241 - DNA, 18 bp, Artificial Sequence
  Synthetic DNA
tcatagaactctctatag

SEQ ID NO: 20242 - DNA, 18 bp, Artificial Sequence
  Synthetic DNA
tcatataactctctatag

SEQ ID NO: 20243 - DNA, 18 bp, Artificial Sequence
  Synthetic DNA
tcatatcactcactaaag

SEQ ID NO: 20244 - DNA, 18 bp, Artificial Sequence
  Synthetic DNA
tcatatgactccctttag

SEQ ID NO: 20245 - DNA, 18 bp, Artificial Sequence
  Synthetic DNA
tcatatgattcacaatag

SEQ ID NO: 20246 - DNA, 18 bp, Artificial Sequence
  Synthetic DNA
tcatccgacacactctag

SEQ ID NO: 20247 - DNA, 18 bp, Artificial Sequence
  Synthetic DNA
tcatgcgaatcactgtag

SEQ ID NO: 20248 - DNA, 18 bp, Artificial Sequence
  Synthetic DNA
tcctaagactgactatag

SEQ ID NO: 20249 - DNA, 18 bp, Artificial Sequence
  Synthetic DNA
tcctacgaatcacaatag

SEQ ID NO: 20250 - DNA, 18 bp, Artificial Sequence
  Synthetic DNA
tcctacgactcacttaag

SEQ ID NO: 20251 - DNA, 18 bp, Artificial Sequence
  Synthetic DNA
tcctacgactcataatag

SEQ ID NO: 20252 - DNA, 18 bp, Artificial Sequence
  Synthetic DNA
tcctacgtctcaatatag

SEQ ID NO: 20253 - DNA, 18 bp, Artificial Sequence
  Synthetic DNA
tcgtatgactaactatag

SEQ ID NO: 20254 - DNA, 18 bp, Artificial Sequence
  Synthetic DNA
tcttacaactaactatag

SEQ ID NO: 20255 - DNA, 18 bp, Artificial Sequence
  Synthetic DNA
tcttacaactcactgtag

SEQ ID NO: 20256 - DNA, 18 bp, Artificial Sequence
  Synthetic DNA
tcttacgactcaatatcg

SEQ ID NO: 20257 - DNA, 18 bp, Artificial Sequence
  Synthetic DNA
tcttacgactcacttgag

SEQ ID NO: 20258 - DNA, 18 bp, Artificial Sequence
  Synthetic DNA
tcttacgcctgactatag

SEQ ID NO: 20259 - DNA, 18 bp, Artificial Sequence
  Synthetic DNA
tgaaacaactcactacag

SEQ ID NO: 20260 - DNA, 18 bp, Artificial Sequence
  Synthetic DNA
tgaaacgactcactgcag

SEQ ID NO: 20261 - DNA, 18 bp, Artificial Sequence
  Synthetic DNA
tgaaacgactcagtttag

SEQ ID NO: 20262 - DNA, 18 bp, Artificial Sequence
  Synthetic DNA
tgagaccacacactatag

SEQ ID NO: 20263 - DNA, 18 bp, Artificial Sequence
  Synthetic DNA
tgagacgacaaactatag

SEQ ID NO: 20264 - DNA, 18 bp, Artificial Sequence
  Synthetic DNA
tgagacgattcactaaag

SEQ ID NO: 20265 - DNA, 18 bp, Artificial Sequence
  Synthetic DNA
tgataagactctctatgg

SEQ ID NO: 20266 - DNA, 18 bp, Artificial Sequence
  Synthetic DNA
tgatacaactctctgtag

SEQ ID NO: 20267 - DNA, 18 bp, Artificial Sequence
  Synthetic DNA
tgatacaatccactatag

SEQ ID NO: 20268 - DNA, 18 bp, Artificial Sequence
  Synthetic DNA
tgataccactcaatgtag

SEQ ID NO: 20269 - DNA, 18 bp, Artificial Sequence
  Synthetic DNA
tgatacgaattattatag

SEQ ID NO: 20270 - DNA, 18 bp, Artificial Sequence
  Synthetic DNA
tgatacgacacaaaatag

SEQ ID NO: 20271 - DNA, 18 bp, Artificial Sequence
  Synthetic DNA
tgatacgacacacaaaag

SEQ ID NO: 20272 - DNA, 18 bp, Artificial Sequence
  Synthetic DNA
tgatacgacacaccctag

SEQ ID NO: 20273 - DNA, 18 bp, Artificial Sequence
  Synthetic DNA
tgatacgactaagtctag

SEQ ID NO: 20274 - DNA, 18 bp, Artificial Sequence
  Synthetic DNA
tgatacgactctatacag

SEQ ID NO: 20275 - DNA, 18 bp, Artificial Sequence
  Synthetic DNA
tgatacgactctttatgg

SEQ ID NO: 20276 - DNA, 18 bp, Artificial Sequence
  Synthetic DNA
tgatacgagtcagaatag

SEQ ID NO: 20277 - DNA, 18 bp, Artificial Sequence
  Synthetic DNA
tgatacgattctcgatag

SEQ ID NO: 20278 - DNA, 18 bp, Artificial Sequence
  Synthetic DNA
tgatacgcctgaatatag

SEQ ID NO: 20279 - DNA, 18 bp, Artificial Sequence
  Synthetic DNA
tgatacggctcattatcg

SEQ ID NO: 20280 - DNA, 18 bp, Artificial Sequence
  Synthetic DNA
tgatacgtcgctctatag

SEQ ID NO: 20281 - DNA, 18 bp, Artificial Sequence
  Synthetic DNA
tgatacgtctcactgtgg

SEQ ID NO: 20282 - DNA, 18 bp, Artificial Sequence
  Synthetic DNA
tgatacgtctctctgtag

SEQ ID NO: 20283 - DNA, 18 bp, Artificial Sequence
  Synthetic DNA
tgatacgttccactatag

SEQ ID NO: 20284 - DNA, 18 bp, Artificial Sequence
  Synthetic DNA
tgatactactaactacag

SEQ ID NO: 20285 - DNA, 18 bp, Artificial Sequence
  Synthetic DNA
tgataggagtcaatatag

SEQ ID NO: 20286 - DNA, 18 bp, Artificial Sequence
  Synthetic DNA
tgatagtacacactatag

SEQ ID NO: 20287 - DNA, 18 bp, Artificial Sequence
  Synthetic DNA
tgatatgacaccctatag

SEQ ID NO: 20288 - DNA, 18 bp, Artificial Sequence
  Synthetic DNA
tgatatgactcacaatgg

SEQ ID NO: 20289 - DNA, 18 bp, Artificial Sequence
  Synthetic DNA
tgatatgtctcactaaag

SEQ ID NO: 20290 - DNA, 18 bp, Artificial Sequence
  Synthetic DNA
tgatatgtctcactgtag

SEQ ID NO: 20291 - DNA, 18 bp, Artificial Sequence
  Synthetic DNA
tgatgcgactcacttaag

SEQ ID NO: 20292 - DNA, 18 bp, Artificial Sequence
  Synthetic DNA
tggtacgactccgtatag

SEQ ID NO: 20293 - DNA, 18 bp, Artificial Sequence
  Synthetic DNA
tggtacgtctcactttag

SEQ ID NO: 20294 - DNA, 18 bp, Artificial Sequence
  Synthetic DNA
tgttaagactcactacag

SEQ ID NO: 20295 - DNA, 18 bp, Artificial Sequence
  Synthetic DNA
tgttacgactcattaaag

SEQ ID NO: 20296 - DNA, 18 bp, Artificial Sequence
  Synthetic DNA
tgttacggctcacaatag

SEQ ID NO: 20297 - DNA, 18 bp, Artificial Sequence
  Synthetic DNA
tgttaggactcacaatag

SEQ ID NO: 20298 - DNA, 18 bp, Artificial Sequence
  Synthetic DNA
ttaaacgactaaccatag

SEQ ID NO: 20299 - DNA, 18 bp, Artificial Sequence
  Synthetic DNA
ttaaacggatcactatag

SEQ ID NO: 20300 - DNA, 18 bp, Artificial Sequence
  Synthetic DNA
ttaagctactcactatag

SEQ ID NO: 20301 - DNA, 18 bp, Artificial Sequence
  Synthetic DNA
ttacacgacacactatgg

SEQ ID NO: 20302 - DNA, 18 bp, Artificial Sequence
  Synthetic DNA
ttacacgactcaccaaag

SEQ ID NO: 20303 - DNA, 18 bp, Artificial Sequence
  Synthetic DNA
ttacacggcacactatag

SEQ ID NO: 20304 - DNA, 18 bp, Artificial Sequence
  Synthetic DNA
ttacactactcactacag

SEQ ID NO: 20305 - DNA, 18 bp, Artificial Sequence
  Synthetic DNA
ttacccgactcactagag

SEQ ID NO: 20306 - DNA, 18 bp, Artificial Sequence
  Synthetic DNA
ttagacaactgactatag

SEQ ID NO: 20307 - DNA, 18 bp, Artificial Sequence
  Synthetic DNA
ttagacgattcactacag

SEQ ID NO: 20308 - DNA, 18 bp, Artificial Sequence
  Synthetic DNA
ttagacgtatcactatag

SEQ ID NO: 20309 - DNA, 18 bp, Artificial Sequence
  Synthetic DNA
ttataagcctcactatgg

SEQ ID NO: 20310 - DNA, 18 bp, Artificial Sequence
  Synthetic DNA
ttataatactcactacag

SEQ ID NO: 20311 - DNA, 18 bp, Artificial Sequence
  Synthetic DNA
ttataatactcactgtag

SEQ ID NO: 20312 - DNA, 18 bp, Artificial Sequence
  Synthetic DNA
ttatacaactcaccgtag

SEQ ID NO: 20313 - DNA, 18 bp, Artificial Sequence
  Synthetic DNA
ttatacaactcattgtag

SEQ ID NO: 20314 - DNA, 18 bp, Artificial Sequence
  Synthetic DNA
ttatacagctcactatgg

SEQ ID NO: 20315 - DNA, 18 bp, Artificial Sequence
  Synthetic DNA
ttataccacacactgtag

SEQ ID NO: 20316 - DNA, 18 bp, Artificial Sequence
  Synthetic DNA
ttatacgaatcacagtag

SEQ ID NO: 20317 - DNA, 18 bp, Artificial Sequence
  Synthetic DNA
ttatacgaatcattacag

SEQ ID NO: 20318 - DNA, 18 bp, Artificial Sequence
  Synthetic DNA
ttatacgacagacaatag

SEQ ID NO: 20319 - DNA, 18 bp, Artificial Sequence
  Synthetic DNA
ttatacgacagactctag

SEQ ID NO: 20320 - DNA, 18 bp, Artificial Sequence
  Synthetic DNA
ttatacgactatcaatag

SEQ ID NO: 20321 - DNA, 18 bp, Artificial Sequence
  Synthetic DNA
ttatacgactcagactag

SEQ ID NO: 20322 - DNA, 18 bp, Artificial Sequence
  Synthetic DNA
ttatacgactctccagag

SEQ ID NO: 20323 - DNA, 18 bp, Artificial Sequence
  Synthetic DNA
ttatacgactgacagtag

SEQ ID NO: 20324 - DNA, 18 bp, Artificial Sequence
  Synthetic DNA
ttatacgacttactgtaa

SEQ ID NO: 20325 - DNA, 18 bp, Artificial Sequence
  Synthetic DNA
ttatacgacttcttatag

SEQ ID NO: 20326 - DNA, 18 bp, Artificial Sequence
  Synthetic DNA
ttatacgagctactatag

SEQ ID NO: 20327 - DNA, 18 bp, Artificial Sequence
  Synthetic DNA
ttatacgaggcagtatag

SEQ ID NO: 20328 - DNA, 18 bp, Artificial Sequence
  Synthetic DNA
ttatacgagtcaatatgg

SEQ ID NO: 20329 - DNA, 18 bp, Artificial Sequence
  Synthetic DNA
ttatacgagtcactttgg

SEQ ID NO: 20330 - DNA, 18 bp, Artificial Sequence
  Synthetic DNA
ttatacgattcaagatag

SEQ ID NO: 20331 - DNA, 18 bp, Artificial Sequence
  Synthetic DNA
ttatacggcaccctatag

SEQ ID NO: 20332 - DNA, 18 bp, Artificial Sequence
  Synthetic DNA
ttatacggttcattatag

SEQ ID NO: 20333 - DNA, 18 bp, Artificial Sequence
  Synthetic DNA
ttatacgtatcactctag

SEQ ID NO: 20334 - DNA, 18 bp, Artificial Sequence
  Synthetic DNA
ttatacgtcacactatgg

SEQ ID NO: 20335 - DNA, 18 bp, Artificial Sequence
  Synthetic DNA
ttatactacacacgatag

SEQ ID NO: 20336 - DNA, 18 bp, Artificial Sequence
  Synthetic DNA
ttatactacccactacag

SEQ ID NO: 20337 - DNA, 18 bp, Artificial Sequence
  Synthetic DNA
ttatactacttcctatag

SEQ ID NO: 20338 - DNA, 18 bp, Artificial Sequence
  Synthetic DNA
ttatagcagtcactatag

SEQ ID NO: 20339 - DNA, 18 bp, Artificial Sequence
  Synthetic DNA
ttatagtactaactatag

SEQ ID NO: 20340 - DNA, 18 bp, Artificial Sequence
  Synthetic DNA
ttatagtactcactatcg

SEQ ID NO: 20341 - DNA, 18 bp, Artificial Sequence
  Synthetic DNA
ttatatgacccaatatag

SEQ ID NO: 20342 - DNA, 18 bp, Artificial Sequence
  Synthetic DNA
ttatatgacgctctatag

SEQ ID NO: 20343 - DNA, 18 bp, Artificial Sequence
  Synthetic DNA
ttatatgactcactttcg

SEQ ID NO: 20344 - DNA, 18 bp, Artificial Sequence
  Synthetic DNA
ttatatgactgactacag

SEQ ID NO: 20345 - DNA, 18 bp, Artificial Sequence
  Synthetic DNA
ttatattactcacgatag

SEQ ID NO: 20346 - DNA, 18 bp, Artificial Sequence
  Synthetic DNA
ttatcagactcattatag

SEQ ID NO: 20347 - DNA, 18 bp, Artificial Sequence
  Synthetic DNA
ttatcagactctctatag

SEQ ID NO: 20348 - DNA, 18 bp, Artificial Sequence
  Synthetic DNA
ttatcccacttactatag

SEQ ID NO: 20349 - DNA, 18 bp, Artificial Sequence
  Synthetic DNA
ttatccgactcaagatag

SEQ ID NO: 20350 - DNA, 18 bp, Artificial Sequence
  Synthetic DNA
ttatctgaatcactatag

SEQ ID NO: 20351 - DNA, 18 bp, Artificial Sequence
  Synthetic DNA
ttatgcaactcaatatag

SEQ ID NO: 20352 - DNA, 18 bp, Artificial Sequence
  Synthetic DNA
ttatgcgactctctctag

SEQ ID NO: 20353 - DNA, 18 bp, Artificial Sequence
  Synthetic DNA
ttctacacctcactatag

SEQ ID NO: 20354 - DNA, 18 bp, Artificial Sequence
  Synthetic DNA
ttctactacccactatag

SEQ ID NO: 20355 - DNA, 18 bp, Artificial Sequence
  Synthetic DNA
ttctgccactcactatag

SEQ ID NO: 20356 - DNA, 18 bp, Artificial Sequence
  Synthetic DNA
ttgcacgacacactatag

SEQ ID NO: 20357 - DNA, 18 bp, Artificial Sequence
  Synthetic DNA
ttgtacgattcactacag

SEQ ID NO: 20358 - DNA, 18 bp, Artificial Sequence
  Synthetic DNA
ttgtacgtctcaccatag

SEQ ID NO: 20359 - DNA, 18 bp, Artificial Sequence
  Synthetic DNA
ttgtactactcactatcg

SEQ ID NO: 20360 - DNA, 18 bp, Artificial Sequence
  Synthetic DNA
tttaacgactcactagag

SEQ ID NO: 20361 - DNA, 18 bp, Artificial Sequence
  Synthetic DNA
ttttaaaactcactatag

SEQ ID NO: 20362 - DNA, 18 bp, Artificial Sequence
  Synthetic DNA
ttttatgactcactacag

SEQ ID NO: 20363 - DNA, 18 bp, Artificial Sequence
  Synthetic DNA
ttttattactcactatag

SEQ ID NO: 20364 - DNA, 18 bp, Artificial Sequence
  Synthetic DNA
ttttctgactcactatag

SEQ ID NO: 20365 - DNA, 18 bp, Artificial Sequence
  Synthetic DNA
ttttgcgactcattatag

SEQ ID NO: 20366 - DNA, 18 bp, Artificial Sequence
  Synthetic DNA
taaaacgtctcgctattg

SEQ ID NO: 20367 - DNA, 18 bp, Artificial Sequence
  Synthetic DNA
taaatagaatcactatag

SEQ ID NO: 20368 - DNA, 18 bp, Artificial Sequence
  Synthetic DNA
taataagcatcactattg

SEQ ID NO: 20369 - DNA, 18 bp, Artificial Sequence
  Synthetic DNA
taatacgattcactgatg

SEQ ID NO: 20370 - DNA, 18 bp, Artificial Sequence
  Synthetic DNA
taatgcgtctctctattg

SEQ ID NO: 20371 - DNA, 18 bp, Artificial Sequence
  Synthetic DNA
taattaaactcaccatag

SEQ ID NO: 20372 - DNA, 18 bp, Artificial Sequence
  Synthetic DNA
taattcaactctcgatag

SEQ ID NO: 20373 - DNA, 18 bp, Artificial Sequence
  Synthetic DNA
taatttgactcattaaag

SEQ ID NO: 20374 - DNA, 18 bp, Artificial Sequence
  Synthetic DNA
tatatcgagtcactatag

SEQ ID NO: 20375 - DNA, 18 bp, Artificial Sequence
  Synthetic DNA
tcattcgactctctacag

SEQ ID NO: 20376 - DNA, 18 bp, Artificial Sequence
  Synthetic DNA
tcgttcgactcactgtag

SEQ ID NO: 20377 - DNA, 18 bp, Artificial Sequence
  Synthetic DNA
tgataccactcactaatg

SEQ ID NO: 20378 - DNA, 18 bp, Artificial Sequence
  Synthetic DNA
tgattcaactcactctag

SEQ ID NO: 20379 - DNA, 18 bp, Artificial Sequence
  Synthetic DNA
taaaacaactaaccatag

SEQ ID NO: 20380 - DNA, 18 bp, Artificial Sequence
  Synthetic DNA
taataagactctttgtag

SEQ ID NO: 20381 - DNA, 18 bp, Artificial Sequence
  Synthetic DNA
taataggaaactctatag

SEQ ID NO: 20382 - DNA, 18 bp, Artificial Sequence
  Synthetic DNA
taatatgattcacaatgg

SEQ ID NO: 20383 - DNA, 18 bp, Artificial Sequence
  Synthetic DNA
taatatggctcaataaag

SEQ ID NO: 20384 - DNA, 18 bp, Artificial Sequence
  Synthetic DNA
tacaacgactcactaacg

SEQ ID NO: 20385 - DNA, 18 bp, Artificial Sequence
  Synthetic DNA
tacaacgtctcaccatag

SEQ ID NO: 20386 - DNA, 18 bp, Artificial Sequence
  Synthetic DNA
tattaccactcacaaaag

SEQ ID NO: 20387 - DNA, 18 bp, Artificial Sequence
  Synthetic DNA
tattacggctcacttaag

SEQ ID NO: 20388 - DNA, 18 bp, Artificial Sequence
  Synthetic DNA
tattatgactaaccatag

SEQ ID NO: 20389 - DNA, 18 bp, Artificial Sequence
  Synthetic DNA
tattgcgtctaactatag

SEQ ID NO: 20390 - DNA, 18 bp, Artificial Sequence
  Synthetic DNA
tcatatgacacactttag

SEQ ID NO: 20391 - DNA, 18 bp, Artificial Sequence
  Synthetic DNA
ttataagcctaactatag

SEQ ID NO: 20392 - DNA, 18 bp, Artificial Sequence
  Synthetic DNA
ttatacgaaacaatatag

SEQ ID NO: 20393 - DNA, 18 bp, Artificial Sequence
  Synthetic DNA
ttatacgactgacttcag

SEQ ID NO: 20394 - DNA, 18 bp, Artificial Sequence
  Synthetic DNA
ttatacgatttactaaag

SEQ ID NO: 20395 - DNA, 18 bp, Artificial Sequence
  Synthetic DNA
ttatacgtatcactttag

SEQ ID NO: 20396 - DNA, 18 bp, Artificial Sequence
  Synthetic DNA
ttgtgcgactcacgatag

SEQ ID NO: 20397 - DNA, 18 bp, Artificial Sequence
  Synthetic DNA
ttaaacgtatcactatag

SEQ ID NO: 20398 - DNA, 18 bp, Artificial Sequence
  Synthetic DNA
atatacgactcactactg

SEQ ID NO: 20399 - DNA, 18 bp, Artificial Sequence
  Synthetic DNA
tatttcgacttactaaag

SEQ ID NO: 20400 - DNA, 18 bp, Artificial Sequence
  Synthetic DNA
taatatgattcacttaag

SEQ ID NO: 20401 - DNA, 18 bp, Artificial Sequence
  Synthetic DNA
tattacgcctcactcaag

SEQ ID NO: 20402 - DNA, 18 bp, Artificial Sequence
  Synthetic DNA
tttcacaactcactatag

SEQ ID NO: 20403 - DNA, 18 bp, Artificial Sequence
  Synthetic DNA
ctattcgactcactttag

SEQ ID NO: 20404 - DNA, 18 bp, Artificial Sequence
  Synthetic DNA
taatacaactcacacttg

SEQ ID NO: 20405 - DNA, 18 bp, Artificial Sequence
  Synthetic DNA
taattcaactctccatag

SEQ ID NO: 20406 - DNA, 18 bp, Artificial Sequence
  Synthetic DNA
tattacgactgattattg

SEQ ID NO: 20407 - DNA, 18 bp, Artificial Sequence
  Synthetic DNA
aattgcgactcactttag

SEQ ID NO: 20408 - DNA, 18 bp, Artificial Sequence
  Synthetic DNA
tcattcgtctcactattg

SEQ ID NO: 20409 - DNA, 18 bp, Artificial Sequence
  Synthetic DNA
aaatacgtctcactaatg

SEQ ID NO: 20410 - DNA, 18 bp, Artificial Sequence
  Synthetic DNA
taaaccgtctcactattg

SEQ ID NO: 20411 - DNA, 18 bp, Artificial Sequence
  Synthetic DNA
taactcgatacactatag

SEQ ID NO: 20412 - DNA, 18 bp, Artificial Sequence
  Synthetic DNA
taatacgtctaaccattg

SEQ ID NO: 20413 - DNA, 18 bp, Artificial Sequence
  Synthetic DNA
taattagactcagtaaag

SEQ ID NO: 20414 - DNA, 18 bp, Artificial Sequence
  Synthetic DNA
taattcgagacactgtag

SEQ ID NO: 20415 - DNA, 18 bp, Artificial Sequence
  Synthetic DNA
taattcgtttcactatcg

SEQ ID NO: 20416 - DNA, 18 bp, Artificial Sequence
  Synthetic DNA
taattctactcaccgtag

SEQ ID NO: 20417 - DNA, 18 bp, Artificial Sequence
  Synthetic DNA
tacttcgactcacgttag

SEQ ID NO: 20418 - DNA, 18 bp, Artificial Sequence
  Synthetic DNA
tgattcgtcacactatag

SEQ ID NO: 20419 - DNA, 18 bp, Artificial Sequence
  Synthetic DNA
tgttttgactcactatag

SEQ ID NO: 20420 - DNA, 18 bp, Artificial Sequence
  Synthetic DNA
ttatacgactcatttttg

SEQ ID NO: 20421 - DNA, 18 bp, Artificial Sequence
  Synthetic DNA
aaatactactatctatag

SEQ ID NO: 20422 - DNA, 18 bp, Artificial Sequence
  Synthetic DNA
aattacgactctctatgg

SEQ ID NO: 20423 - DNA, 18 bp, Artificial Sequence
  Synthetic DNA
taataagtctcacaaaag

SEQ ID NO: 20424 - DNA, 18 bp, Artificial Sequence
  Synthetic DNA
taatacaactctataaag

SEQ ID NO: 20425 - DNA, 18 bp, Artificial Sequence
  Synthetic DNA
taatacgactcaatcccg

SEQ ID NO: 20426 - DNA, 18 bp, Artificial Sequence
  Synthetic DNA
taatacgattctctcaag

SEQ ID NO: 20427 - DNA, 18 bp, Artificial Sequence
  Synthetic DNA
taatacgtcacaccagag

SEQ ID NO: 20428 - DNA, 18 bp, Artificial Sequence
  Synthetic DNA
taatacgtcttcctgtag

SEQ ID NO: 20429 - DNA, 18 bp, Artificial Sequence
  Synthetic DNA
tagtagaactcactaaag

SEQ ID NO: 20430 - DNA, 18 bp, Artificial Sequence
  Synthetic DNA
tattacgaatccctctag

SEQ ID NO: 20431 - DNA, 18 bp, Artificial Sequence
  Synthetic DNA
tattacgaccctctttag

SEQ ID NO: 20432 - DNA, 18 bp, Artificial Sequence
  Synthetic DNA
tattactatttactatag

SEQ ID NO: 20433 - DNA, 18 bp, Artificial Sequence
  Synthetic DNA
tcatacttctcactttag

SEQ ID NO: 20434 - DNA, 18 bp, Artificial Sequence
  Synthetic DNA
ttatacgacacaataaag

SEQ ID NO: 20435 - DNA, 18 bp, Artificial Sequence
  Synthetic DNA
ttatgagtctcactatag

SEQ ID NO: 20436 - DNA, 18 bp, Artificial Sequence
  Synthetic DNA
tttttggactcactatag

SEQ ID NO: 20437 - DNA, 18 bp, Artificial Sequence
  Synthetic DNA
ttataagtctcactattg

SEQ ID NO: 20438 - DNA, 18 bp, Artificial Sequence
  Synthetic DNA
aaattagactcactattg

SEQ ID NO: 20439 - DNA, 18 bp, Artificial Sequence
  Synthetic DNA
taattcggctcactaatg

SEQ ID NO: 20440 - DNA, 18 bp, Artificial Sequence
  Synthetic DNA
tagtacgactcgctagtg

SEQ ID NO: 20441 - DNA, 18 bp, Artificial Sequence
  Synthetic DNA
tattacgaatcgctattg

SEQ ID NO: 20442 - DNA, 18 bp, Artificial Sequence
  Synthetic DNA
tcattcgactcgctacag

SEQ ID NO: 20443 - DNA, 18 bp, Artificial Sequence
  Synthetic DNA
ttattcgactcgcaatag

SEQ ID NO: 20444 - DNA, 18 bp, Artificial Sequence
  Synthetic DNA
aaaatcgactccctatag

SEQ ID NO: 20445 - DNA, 18 bp, Artificial Sequence
  Synthetic DNA
aaatacgacttaatattg

SEQ ID NO: 20446 - DNA, 18 bp, Artificial Sequence
  Synthetic DNA
aaattccactcagtatag

SEQ ID NO: 20447 - DNA, 18 bp, Artificial Sequence
  Synthetic DNA
aaattcgactctctctag

SEQ ID NO: 20448 - DNA, 18 bp, Artificial Sequence
  Synthetic DNA
aataacgactcactattg

SEQ ID NO: 20449 - DNA, 18 bp, Artificial Sequence
  Synthetic DNA
aatttcgactcacgatag

SEQ ID NO: 20450 - DNA, 18 bp, Artificial Sequence
  Synthetic DNA
gatttcgactcattatag

SEQ ID NO: 20451 - DNA, 18 bp, Artificial Sequence
  Synthetic DNA
taaaacgactctctagtg

SEQ ID NO: 20452 - DNA, 18 bp, Artificial Sequence
  Synthetic DNA
taaatcgactcattctag

SEQ ID NO: 20453 - DNA, 18 bp, Artificial Sequence
  Synthetic DNA
taatacaactcaccatta

SEQ ID NO: 20454 - DNA, 18 bp, Artificial Sequence
  Synthetic DNA
taatacgaatacctattg

SEQ ID NO: 20455 - DNA, 18 bp, Artificial Sequence
  Synthetic DNA
taatacgacaagccatag

SEQ ID NO: 20456 - DNA, 18 bp, Artificial Sequence
  Synthetic DNA
taatacgacttattaatg

SEQ ID NO: 20457 - DNA, 18 bp, Artificial Sequence
  Synthetic DNA
taatacgagtaattattg

SEQ ID NO: 20458 - DNA, 18 bp, Artificial Sequence
  Synthetic DNA
taatactactcccaattg

SEQ ID NO: 20459 - DNA, 18 bp, Artificial Sequence
  Synthetic DNA
taatactatccactattg

SEQ ID NO: 20460 - DNA, 18 bp, Artificial Sequence
  Synthetic DNA
taatacttctcgcaatag

SEQ ID NO: 20461 - DNA, 18 bp, Artificial Sequence
  Synthetic DNA
taatatgcctcacttttg

SEQ ID NO: 20462 - DNA, 18 bp, Artificial Sequence
  Synthetic DNA
taatgcgactaaccattg

SEQ ID NO: 20463 - DNA, 18 bp, Artificial Sequence
  Synthetic DNA
taattagactctgtatag

SEQ ID NO: 20464 - DNA, 18 bp, Artificial Sequence
  Synthetic DNA
taattcgactcacatcag

SEQ ID NO: 20465 - DNA, 18 bp, Artificial Sequence
  Synthetic DNA
taattcgattctcgatag

SEQ ID NO: 20466 - DNA, 18 bp, Artificial Sequence
  Synthetic DNA
taattctacagactatag

SEQ ID NO: 20467 - DNA, 18 bp, Artificial Sequence
  Synthetic DNA
taattggagacactatag

SEQ ID NO: 20468 - DNA, 18 bp, Artificial Sequence
  Synthetic DNA
taatttcactcactaaag

SEQ ID NO: 20469 - DNA, 18 bp, Artificial Sequence
  Synthetic DNA
tattacgactcactcatg

SEQ ID NO: 20470 - DNA, 18 bp, Artificial Sequence
  Synthetic DNA
tatttcgactaactagag

SEQ ID NO: 20471 - DNA, 18 bp, Artificial Sequence
  Synthetic DNA
tcatacgactcgctaccg

SEQ ID NO: 20472 - DNA, 18 bp, Artificial Sequence
  Synthetic DNA
tgataccactcacaattg

SEQ ID NO: 20473 - DNA, 18 bp, Artificial Sequence
  Synthetic DNA
tggtactactcactattg

SEQ ID NO: 20474 - DNA, 18 bp, Artificial Sequence
  Synthetic DNA
ttataagaatcactattg

SEQ ID NO: 20475 - DNA, 18 bp, Artificial Sequence
  Synthetic DNA
ttatacgactagatatag

SEQ ID NO: 20476 - DNA, 18 bp, Artificial Sequence
  Synthetic DNA
ttatatgactcgctgtag

SEQ ID NO: 20477 - DNA, 18 bp, Artificial Sequence
  Synthetic DNA
ttatgcaactcgctatag

SEQ ID NO: 20478 - DNA, 18 bp, Artificial Sequence
  Synthetic DNA
ttattcgactcactaggg

SEQ ID NO: 20479 - DNA, 18 bp, Artificial Sequence
  Synthetic DNA
ttattcgactcattacag

SEQ ID NO: 20480 - DNA, 18 bp, Artificial Sequence
  Synthetic DNA
aaataagaatcactatgg

SEQ ID NO: 20481 - DNA, 18 bp, Artificial Sequence
  Synthetic DNA
aaatacaactcactcaag

SEQ ID NO: 20482 - DNA, 18 bp, Artificial Sequence
  Synthetic DNA
aaatacgactctctttcg

SEQ ID NO: 20483 - DNA, 18 bp, Artificial Sequence
  Synthetic DNA
aaatacgtcgcactaaag

SEQ ID NO: 20484 - DNA, 18 bp, Artificial Sequence
  Synthetic DNA
aagtacgactcacactag

SEQ ID NO: 20485 - DNA, 18 bp, Artificial Sequence
  Synthetic DNA
acatacaactccctatag

SEQ ID NO: 20486 - DNA, 18 bp, Artificial Sequence
  Synthetic DNA
acctacgactcactataa

SEQ ID NO: 20487 - DNA, 18 bp, Artificial Sequence
  Synthetic DNA
atagacggctcactatag

SEQ ID NO: 20488 - DNA, 18 bp, Artificial Sequence
  Synthetic DNA
atatacgactccttatag

SEQ ID NO: 20489 - DNA, 18 bp, Artificial Sequence
  Synthetic DNA
caatacgacaaacaatag

SEQ ID NO: 20490 - DNA, 18 bp, Artificial Sequence
  Synthetic DNA
caatactactcacattag

SEQ ID NO: 20491 - DNA, 18 bp, Artificial Sequence
  Synthetic DNA
ctatacgactctctaaag

SEQ ID NO: 20492 - DNA, 18 bp, Artificial Sequence
  Synthetic DNA
ctatatgacacactatag

SEQ ID NO: 20493 - DNA, 18 bp, Artificial Sequence
  Synthetic DNA
gaatacgactcaatgaag

SEQ ID NO: 20494 - DNA, 18 bp, Artificial Sequence
  Synthetic DNA
gactacaactcactttag

SEQ ID NO: 20495 - DNA, 18 bp, Artificial Sequence
  Synthetic DNA
gtaaacgactcactaaag

SEQ ID NO: 20496 - DNA, 18 bp, Artificial Sequence
  Synthetic DNA
taaaaagactaattatag

SEQ ID NO: 20497 - DNA, 18 bp, Artificial Sequence
  Synthetic DNA
taaaacaactcaatacag

SEQ ID NO: 20498 - DNA, 18 bp, Artificial Sequence
  Synthetic DNA
taaaacgatacattatag

SEQ ID NO: 20499 - DNA, 18 bp, Artificial Sequence
  Synthetic DNA
taaaatgcttcactatag

SEQ ID NO: 20500 - DNA, 18 bp, Artificial Sequence
  Synthetic DNA
taaagcgacacattatag

SEQ ID NO: 20501 - DNA, 18 bp, Artificial Sequence
  Synthetic DNA
taacatgactctttatag

SEQ ID NO: 20502 - DNA, 18 bp, Artificial Sequence
  Synthetic DNA
taagactattcactacag

SEQ ID NO: 20503 - DNA, 18 bp, Artificial Sequence
  Synthetic DNA
taataacattcactttag

SEQ ID NO: 20504 - DNA, 18 bp, Artificial Sequence
  Synthetic DNA
taataagacaatctatag

SEQ ID NO: 20505 - DNA, 18 bp, Artificial Sequence
  Synthetic DNA
taataagacacactgaag

SEQ ID NO: 20506 - DNA, 18 bp, Artificial Sequence
  Synthetic DNA
taataagagtcactcaag

SEQ ID NO: 20507 - DNA, 18 bp, Artificial Sequence
  Synthetic DNA
taataagattctctatgg

SEQ ID NO: 20508 - DNA, 18 bp, Artificial Sequence
  Synthetic DNA
taatacatcttattatag

SEQ ID NO: 20509 - DNA, 18 bp, Artificial Sequence
  Synthetic DNA
taatacgaatcaatagcg

SEQ ID NO: 20510 - DNA, 18 bp, Artificial Sequence
  Synthetic DNA
taatacgaatcaccgaag

SEQ ID NO: 20511 - DNA, 18 bp, Artificial Sequence
  Synthetic DNA
taatacgacaatctatgg

SEQ ID NO: 20512 - DNA, 18 bp, Artificial Sequence
  Synthetic DNA
taatacgactcatggaag

SEQ ID NO: 20513 - DNA, 18 bp, Artificial Sequence
  Synthetic DNA
taatacgactccgttaag

SEQ ID NO: 20514 - DNA, 18 bp, Artificial Sequence
  Synthetic DNA
taatacgatacacagtag

SEQ ID NO: 20515 - DNA, 18 bp, Artificial Sequence
  Synthetic DNA
taatacgccccaaaatag

SEQ ID NO: 20516 - DNA, 18 bp, Artificial Sequence
  Synthetic DNA
taatacgcctatctgtag

SEQ ID NO: 20517 - DNA, 18 bp, Artificial Sequence
  Synthetic DNA
taatacgtctaactcaag

SEQ ID NO: 20518 - DNA, 18 bp, Artificial Sequence
  Synthetic DNA
taatacgtctctctaccg

SEQ ID NO: 20519 - DNA, 18 bp, Artificial Sequence
  Synthetic DNA
taatacgtctctctggag

SEQ ID NO: 20520 - DNA, 18 bp, Artificial Sequence
  Synthetic DNA
taatactacctactctag

SEQ ID NO: 20521 - DNA, 18 bp, Artificial Sequence
  Synthetic DNA
taatatgactcataaaag

SEQ ID NO: 20522 - DNA, 18 bp, Artificial Sequence
  Synthetic DNA
taatatgatttaccatag

SEQ ID NO: 20523 - DNA, 18 bp, Artificial Sequence
  Synthetic DNA
taatattactcacaaaag

SEQ ID NO: 20524 - DNA, 18 bp, Artificial Sequence
  Synthetic DNA
taatcagaatcactttag

SEQ ID NO: 20525 - DNA, 18 bp, Artificial Sequence
  Synthetic DNA
taatccgtctcacactag

SEQ ID NO: 20526 - DNA, 18 bp, Artificial Sequence
  Synthetic DNA
taatgcgcctgaatatag

SEQ ID NO: 20527 - DNA, 18 bp, Artificial Sequence
  Synthetic DNA
tacaacgtctaactatag

SEQ ID NO: 20528 - DNA, 18 bp, Artificial Sequence
  Synthetic DNA
tactacaacactctatag

SEQ ID NO: 20529 - DNA, 18 bp, Artificial Sequence
  Synthetic DNA
tactgcgacccacaatag

SEQ ID NO: 20530 - DNA, 18 bp, Artificial Sequence
  Synthetic DNA
tactgcgactcaaaatag

SEQ ID NO: 20531 - DNA, 18 bp, Artificial Sequence
  Synthetic DNA
tagtccttctcactatag

SEQ ID NO: 20532 - DNA, 18 bp, Artificial Sequence
  Synthetic DNA
tataaagacttactatag

SEQ ID NO: 20533 - DNA, 18 bp, Artificial Sequence
  Synthetic DNA
tatcacgtctaactatag

SEQ ID NO: 20534 - DNA, 18 bp, Artificial Sequence
  Synthetic DNA
tatcactactcactttag

SEQ ID NO: 20535 - DNA, 18 bp, Artificial Sequence
  Synthetic DNA
tatgacacctcactatag

SEQ ID NO: 20536 - DNA, 18 bp, Artificial Sequence
  Synthetic DNA
tattacgtctcaatatcg

SEQ ID NO: 20537 - DNA, 18 bp, Artificial Sequence
  Synthetic DNA
tattgtgactcattatag

SEQ ID NO: 20538 - DNA, 18 bp, Artificial Sequence
  Synthetic DNA
tcaaactacacactatag

SEQ ID NO: 20539 - DNA, 18 bp, Artificial Sequence
  Synthetic DNA
tcatacgactaacttcag

SEQ ID NO: 20540 - DNA, 18 bp, Artificial Sequence
  Synthetic DNA
tcatatgactcattaaag

SEQ ID NO: 20541 - DNA, 18 bp, Artificial Sequence
  Synthetic DNA
tgaaacgactcagaatag

SEQ ID NO: 20542 - DNA, 18 bp, Artificial Sequence
  Synthetic DNA
ttaaacaactcactacag

SEQ ID NO: 20543 - DNA, 18 bp, Artificial Sequence
  Synthetic DNA
ttaaacgcctcactttag

SEQ ID NO: 20544 - DNA, 18 bp, Artificial Sequence
  Synthetic DNA
ttacacgactctctctag

SEQ ID NO: 20545 - DNA, 18 bp, Artificial Sequence
  Synthetic DNA
ttataagactctccatag

SEQ ID NO: 20546 - DNA, 18 bp, Artificial Sequence
  Synthetic DNA
ttatacaactctcgatag

SEQ ID NO: 20547 - DNA, 18 bp, Artificial Sequence
  Synthetic DNA
ttataccactcaccctag

SEQ ID NO: 20548 - DNA, 18 bp, Artificial Sequence
  Synthetic DNA
ttatacgactatctatgg

SEQ ID NO: 20549 - DNA, 18 bp, Artificial Sequence
  Synthetic DNA
ttatacgatacaatatag

SEQ ID NO: 20550 - DNA, 18 bp, Artificial Sequence
  Synthetic DNA
ttatacgtcccactacag

SEQ ID NO: 20551 - DNA, 18 bp, Artificial Sequence
  Synthetic DNA
ttatacgtcgcactaaag

SEQ ID NO: 20552 - DNA, 18 bp, Artificial Sequence
  Synthetic DNA
ttatacgtctccctaaag

SEQ ID NO: 20553 - DNA, 18 bp, Artificial Sequence
  Synthetic DNA
ttatactaattactatag

SEQ ID NO: 20554 - DNA, 18 bp, Artificial Sequence
  Synthetic DNA
ttatataactcaatatag

SEQ ID NO: 20555 - DNA, 18 bp, Artificial Sequence
  Synthetic DNA
ttatatgactaaccatag

SEQ ID NO: 20556 - DNA, 18 bp, Artificial Sequence
  Synthetic DNA
ttatattactcactctag

SEQ ID NO: 20557 - DNA, 18 bp, Artificial Sequence
  Synthetic DNA
ttctacaactcactttag

SEQ ID NO: 20558 - DNA, 18 bp, Artificial Sequence
  Synthetic DNA
ttttacgtctcactatcg

SEQ ID NO: 20559 - DNA, 18 bp, Artificial Sequence
  Synthetic DNA
ttatatgcatcactatag

SEQ ID NO: 20560 - DNA, 18 bp, Artificial Sequence
  Synthetic DNA
taaaacgtcacactaaag

SEQ ID NO: 20561 - DNA, 18 bp, Artificial Sequence
  Synthetic DNA
taaatcgatacactatag

SEQ ID NO: 20562 - DNA, 18 bp, Artificial Sequence
  Synthetic DNA
tactacgtctcactgttg

SEQ ID NO: 20563 - DNA, 18 bp, Artificial Sequence
  Synthetic DNA
tactatgactctctattg

SEQ ID NO: 20564 - DNA, 18 bp, Artificial Sequence
  Synthetic DNA
tcaatctactcactatag

SEQ ID NO: 20565 - DNA, 18 bp, Artificial Sequence
  Synthetic DNA
ttattcgacacactagag

SEQ ID NO: 20566 - DNA, 18 bp, Artificial Sequence
  Synthetic DNA
taaaacgactgacttcag

SEQ ID NO: 20567 - DNA, 18 bp, Artificial Sequence
  Synthetic DNA
taaaacgtcacattatag

SEQ ID NO: 20568 - DNA, 18 bp, Artificial Sequence
  Synthetic DNA
taataaaattcacaatag

SEQ ID NO: 20569 - DNA, 18 bp, Artificial Sequence
  Synthetic DNA
taataatactcacttaag

SEQ ID NO: 20570 - DNA, 18 bp, Artificial Sequence
  Synthetic DNA
taatacgattacctaaag

SEQ ID NO: 20571 - DNA, 18 bp, Artificial Sequence
  Synthetic DNA
taatacgccttataatag

SEQ ID NO: 20572 - DNA, 18 bp, Artificial Sequence
  Synthetic DNA
taatacgtcactctatcg

SEQ ID NO: 20573 - DNA, 18 bp, Artificial Sequence
  Synthetic DNA
taatccgacacacttaag

SEQ ID NO: 20574 - DNA, 18 bp, Artificial Sequence
  Synthetic DNA
tagtacgactctcgaaag

SEQ ID NO: 20575 - DNA, 18 bp, Artificial Sequence
  Synthetic DNA
tattacaaccctctatag

SEQ ID NO: 20576 - DNA, 18 bp, Artificial Sequence
  Synthetic DNA
tattacgtcacactacag

SEQ ID NO: 20577 - DNA, 18 bp, Artificial Sequence
  Synthetic DNA
tattactagtctctatag

SEQ ID NO: 20578 - DNA, 18 bp, Artificial Sequence
  Synthetic DNA
ttatacgactctttatgg

SEQ ID NO: 20579 - DNA, 18 bp, Artificial Sequence
  Synthetic DNA
ttatccgactcacttaag

SEQ ID NO: 20580 - DNA, 18 bp, Artificial Sequence
  Synthetic DNA
aaattagactcactaaag

SEQ ID NO: 20581 - DNA, 18 bp, Artificial Sequence
  Synthetic DNA
taataccattgactattg

SEQ ID NO: 20582 - DNA, 18 bp, Artificial Sequence
  Synthetic DNA
taatatgactttctattg

SEQ ID NO: 20583 - DNA, 18 bp, Artificial Sequence
  Synthetic DNA
taattcgcctcacattag

SEQ ID NO: 20584 - DNA, 18 bp, Artificial Sequence
  Synthetic DNA
aatcacgtctcactatag

SEQ ID NO: 20585 - DNA, 18 bp, Artificial Sequence
  Synthetic DNA
tatttcgactcactgttg

SEQ ID NO: 20586 - DNA, 18 bp, Artificial Sequence
  Synthetic DNA
atacactactcactatag

SEQ ID NO: 20587 - DNA, 18 bp, Artificial Sequence
  Synthetic DNA
taatgcttctcacaatag

SEQ ID NO: 20588 - DNA, 18 bp, Artificial Sequence
  Synthetic DNA
tataacaactctctatag

SEQ ID NO: 20589 - DNA, 18 bp, Artificial Sequence
  Synthetic DNA
tgattcgactcacttaag

SEQ ID NO: 20590 - DNA, 18 bp, Artificial Sequence
  Synthetic DNA
tattaaaacttactatag

SEQ ID NO: 20591 - DNA, 18 bp, Artificial Sequence
  Synthetic DNA
taattcgtctctctatcg

SEQ ID NO: 20592 - DNA, 18 bp, Artificial Sequence
  Synthetic DNA
aaatacaactcgctattg

SEQ ID NO: 20593 - DNA, 18 bp, Artificial Sequence
  Synthetic DNA
aaattcgactcactagtg

SEQ ID NO: 20594 - DNA, 18 bp, Artificial Sequence
  Synthetic DNA
caattcgaatcgctatag

SEQ ID NO: 20595 - DNA, 18 bp, Artificial Sequence
  Synthetic DNA
caattcgtctcactattg

SEQ ID NO: 20596 - DNA, 18 bp, Artificial Sequence
  Synthetic DNA
taaaacgactagctattg

SEQ ID NO: 20597 - DNA, 18 bp, Artificial Sequence
  Synthetic DNA
taactcgaatcgctatag

SEQ ID NO: 20598 - DNA, 18 bp, Artificial Sequence
  Synthetic DNA
taatacaactcgctcttg

SEQ ID NO: 20599 - DNA, 18 bp, Artificial Sequence
  Synthetic DNA
taataccactcgttattg

SEQ ID NO: 20600 - DNA, 18 bp, Artificial Sequence
  Synthetic DNA
taatacggctcgcaattg

SEQ ID NO: 20601 - DNA, 18 bp, Artificial Sequence
  Synthetic DNA
taatatgacttgctattg

SEQ ID NO: 20602 - DNA, 18 bp, Artificial Sequence
  Synthetic DNA
taattcatctcgctatag

SEQ ID NO: 20603 - DNA, 18 bp, Artificial Sequence
  Synthetic DNA
taattccactcactactg

SEQ ID NO: 20604 - DNA, 18 bp, Artificial Sequence
  Synthetic DNA
taattcgaatcaccattg

SEQ ID NO: 20605 - DNA, 18 bp, Artificial Sequence
  Synthetic DNA
taattcgactaactaatg

SEQ ID NO: 20606 - DNA, 18 bp, Artificial Sequence
  Synthetic DNA
taattcgactcacaactg

SEQ ID NO: 20607 - DNA, 18 bp, Artificial Sequence
  Synthetic DNA
taattcgactcacatttg

SEQ ID NO: 20608 - DNA, 18 bp, Artificial Sequence
  Synthetic DNA
taattcgactccatattg

SEQ ID NO: 20609 - DNA, 18 bp, Artificial Sequence
  Synthetic DNA
taattcgacttgatatag

SEQ ID NO: 20610 - DNA, 18 bp, Artificial Sequence
  Synthetic DNA
taattcgattcaccattg

SEQ ID NO: 20611 - DNA, 18 bp, Artificial Sequence
  Synthetic DNA
taattcgtatcgctatag

SEQ ID NO: 20612 - DNA, 18 bp, Artificial Sequence
  Synthetic DNA
taattcgtttcgctatag

SEQ ID NO: 20613 - DNA, 18 bp, Artificial Sequence
  Synthetic DNA
tactaagactcgctattg

SEQ ID NO: 20614 - DNA, 18 bp, Artificial Sequence
  Synthetic DNA
tacttcgcctcactattg

SEQ ID NO: 20615 - DNA, 18 bp, Artificial Sequence
  Synthetic DNA
tagttcgacccgctatag

SEQ ID NO: 20616 - DNA, 18 bp, Artificial Sequence
  Synthetic DNA
tagttcggctcactattg

SEQ ID NO: 20617 - DNA, 18 bp, Artificial Sequence
  Synthetic DNA
ttactcgactcgctatag

SEQ ID NO: 20618 - DNA, 18 bp, Artificial Sequence
  Synthetic DNA
aaaaacgactcacgattg

SEQ ID NO: 20619 - DNA, 18 bp, Artificial Sequence
  Synthetic DNA
aaatacgacacgcgatag

SEQ ID NO: 20620 - DNA, 18 bp, Artificial Sequence
  Synthetic DNA
aaatacgacccaccattg

SEQ ID NO: 20621 - DNA, 18 bp, Artificial Sequence
  Synthetic DNA
aaatacgactcgcgttag

SEQ ID NO: 20622 - DNA, 18 bp, Artificial Sequence
  Synthetic DNA
aaataggactcgctatcg

SEQ ID NO: 20623 - DNA, 18 bp, Artificial Sequence
  Synthetic DNA
aaattcgactaaatatag

SEQ ID NO: 20624 - DNA, 18 bp, Artificial Sequence
  Synthetic DNA
aaattcgactcaatacag

SEQ ID NO: 20625 - DNA, 18 bp, Artificial Sequence
  Synthetic DNA
aaattcgactcagtatcg

SEQ ID NO: 20626 - DNA, 18 bp, Artificial Sequence
  Synthetic DNA
aaattcgactcattctag

SEQ ID NO: 20627 - DNA, 18 bp, Artificial Sequence
  Synthetic DNA
aaattcgactgactagag

SEQ ID NO: 20628 - DNA, 18 bp, Artificial Sequence
  Synthetic DNA
aaattcgattcactatcg

SEQ ID NO: 20629 - DNA, 18 bp, Artificial Sequence
  Synthetic DNA
aaattcgtctcacgatag

SEQ ID NO: 20630 - DNA, 18 bp, Artificial Sequence
  Synthetic DNA
aattacgacgcactattg

SEQ ID NO: 20631 - DNA, 18 bp, Artificial Sequence
  Synthetic DNA
acatacgacccactattg

SEQ ID NO: 20632 - DNA, 18 bp, Artificial Sequence
  Synthetic DNA
acatacgactcattattg

SEQ ID NO: 20633 - DNA, 18 bp, Artificial Sequence
  Synthetic DNA
agatacgactccctattg

SEQ ID NO: 20634 - DNA, 18 bp, Artificial Sequence
  Synthetic DNA
caatacaattcactattg

SEQ ID NO: 20635 - DNA, 18 bp, Artificial Sequence
  Synthetic DNA
caatactactcaccattg

SEQ ID NO: 20636 - DNA, 18 bp, Artificial Sequence
  Synthetic DNA
caataggagtcactattg

SEQ ID NO: 20637 - DNA, 18 bp, Artificial Sequence
  Synthetic DNA
caatatgtctcgctatag

SEQ ID NO: 20638 - DNA, 18 bp, Artificial Sequence
  Synthetic DNA
caattagactcactatcg

SEQ ID NO: 20639 - DNA, 18 bp, Artificial Sequence
  Synthetic DNA
caattcgacacactagag

SEQ ID NO: 20640 - DNA, 18 bp, Artificial Sequence
  Synthetic DNA
caattcgaccgactatag

SEQ ID NO: 20641 - DNA, 18 bp, Artificial Sequence
  Synthetic DNA
caattcgactaactatcg

SEQ ID NO: 20642 - DNA, 18 bp, Artificial Sequence
  Synthetic DNA
caattcgactcaatgtag

SEQ ID NO: 20643 - DNA, 18 bp, Artificial Sequence
  Synthetic DNA
caattcgactcactaccg

SEQ ID NO: 20644 - DNA, 18 bp, Artificial Sequence
  Synthetic DNA
catttccactcactatag

SEQ ID NO: 20645 - DNA, 18 bp, Artificial Sequence
  Synthetic DNA
ctatacgactcaccattg

SEQ ID NO: 20646 - DNA, 18 bp, Artificial Sequence
  Synthetic DNA
ctatacgacttgctatag

SEQ ID NO: 20647 - DNA, 18 bp, Artificial Sequence
  Synthetic DNA
gaaatcgactcagtatag

SEQ ID NO: 20648 - DNA, 18 bp, Artificial Sequence
  Synthetic DNA
gaattccactcacaatag

SEQ ID NO: 20649 - DNA, 18 bp, Artificial Sequence
  Synthetic DNA
gaattcgtctcactgtag

SEQ ID NO: 20650 - DNA, 18 bp, Artificial Sequence
  Synthetic DNA
gaattggactcacgatag

SEQ ID NO: 20651 - DNA, 18 bp, Artificial Sequence
  Synthetic DNA
taaaaagattcactattg

SEQ ID NO: 20652 - DNA, 18 bp, Artificial Sequence
  Synthetic DNA
taaaacgaatcgatatag

SEQ ID NO: 20653 - DNA, 18 bp, Artificial Sequence
  Synthetic DNA
taaaacgattcactaatg

SEQ ID NO: 20654 - DNA, 18 bp, Artificial Sequence
  Synthetic DNA
taaaacggctcactactg

SEQ ID NO: 20655 - DNA, 18 bp, Artificial Sequence
  Synthetic DNA
taaaacggcttgctatag

SEQ ID NO: 20656 - DNA, 18 bp, Artificial Sequence
  Synthetic DNA
taaaacgtctcgctttag

SEQ ID NO: 20657 - DNA, 18 bp, Artificial Sequence
  Synthetic DNA
taaaactactcgctgtag

SEQ ID NO: 20658 - DNA, 18 bp, Artificial Sequence
  Synthetic DNA
taaaaggactccctattg

SEQ ID NO: 20659 - DNA, 18 bp, Artificial Sequence
  Synthetic DNA
taaaccgcctcactattg

SEQ ID NO: 20660 - DNA, 18 bp, Artificial Sequence
  Synthetic DNA
taaatcgaaacactatag

SEQ ID NO: 20661 - DNA, 18 bp, Artificial Sequence
  Synthetic DNA
taaatcgacttactctag

SEQ ID NO: 20662 - DNA, 18 bp, Artificial Sequence
  Synthetic DNA
taacacaactgactattg

SEQ ID NO: 20663 - DNA, 18 bp, Artificial Sequence
  Synthetic DNA
taacacgactcaacattg

SEQ ID NO: 20664 - DNA, 18 bp, Artificial Sequence
  Synthetic DNA
taacacgactctccattg

SEQ ID NO: 20665 - DNA, 18 bp, Artificial Sequence
  Synthetic DNA
taacacgtctcgctatcg

SEQ ID NO: 20666 - DNA, 18 bp, Artificial Sequence
  Synthetic DNA
taacactactcacaattg

SEQ ID NO: 20667 - DNA, 18 bp, Artificial Sequence
  Synthetic DNA
taactcgacacaatatag

SEQ ID NO: 20668 - DNA, 18 bp, Artificial Sequence
  Synthetic DNA
taactcgactaactagag

SEQ ID NO: 20669 - DNA, 18 bp, Artificial Sequence
  Synthetic DNA
taactcgattcaccatag

SEQ ID NO: 20670 - DNA, 18 bp, Artificial Sequence
  Synthetic DNA
taagacgactaggtatag

SEQ ID NO: 20671 - DNA, 18 bp, Artificial Sequence
  Synthetic DNA
taagtcaactcactaaag

SEQ ID NO: 20672 - DNA, 18 bp, Artificial Sequence
  Synthetic DNA
taagtctactcactatcg

SEQ ID NO: 20673 - DNA, 18 bp, Artificial Sequence
  Synthetic DNA
taagttgactcacaatag

SEQ ID NO: 20674 - DNA, 18 bp, Artificial Sequence
  Synthetic DNA
taataagaatcactgttg

SEQ ID NO: 20675 - DNA, 18 bp, Artificial Sequence
  Synthetic DNA
taataagacaaactattg

SEQ ID NO: 20676 - DNA, 18 bp, Artificial Sequence
  Synthetic DNA
taataagactcattgttg

SEQ ID NO: 20677 - DNA, 18 bp, Artificial Sequence
  Synthetic DNA
taataagactcgcaacag

SEQ ID NO: 20678 - DNA, 18 bp, Artificial Sequence
  Synthetic DNA
taataagactcgttgtag

SEQ ID NO: 20679 - DNA, 18 bp, Artificial Sequence
  Synthetic DNA
taataagcctcgctatcg

SEQ ID NO: 20680 - DNA, 18 bp, Artificial Sequence
  Synthetic DNA
taataaggctcacgattg

SEQ ID NO: 20681 - DNA, 18 bp, Artificial Sequence
  Synthetic DNA
taatacaacacactagtg

SEQ ID NO: 20682 - DNA, 18 bp, Artificial Sequence
  Synthetic DNA
taatacaactcaggattg

SEQ ID NO: 20683 - DNA, 18 bp, Artificial Sequence
  Synthetic DNA
taatacaactcgcattag

SEQ ID NO: 20684 - DNA, 18 bp, Artificial Sequence
  Synthetic DNA
taatacaagccactattg

SEQ ID NO: 20685 - DNA, 18 bp, Artificial Sequence
  Synthetic DNA
taatacatctcgctttag

SEQ ID NO: 20686 - DNA, 18 bp, Artificial Sequence
  Synthetic DNA
taatacctctcgatatag

SEQ ID NO: 20687 - DNA, 18 bp, Artificial Sequence
  Synthetic DNA
taatacgaatctctagtg

SEQ ID NO: 20688 - DNA, 18 bp, Artificial Sequence
  Synthetic DNA
taatacgaattacttttg

SEQ ID NO: 20689 - DNA, 18 bp, Artificial Sequence
  Synthetic DNA
taatacgaattgctgtag

SEQ ID NO: 20690 - DNA, 18 bp, Artificial Sequence
  Synthetic DNA
taatacgacacgttaaag

SEQ ID NO: 20691 - DNA, 18 bp, Artificial Sequence
  Synthetic DNA
taatacgacccacaaatg

SEQ ID NO: 20692 - DNA, 18 bp, Artificial Sequence
  Synthetic DNA
taatacgaccgactcttg

SEQ ID NO: 20693 - DNA, 18 bp, Artificial Sequence
  Synthetic DNA
taatacgacgtaccattg

SEQ ID NO: 20694 - DNA, 18 bp, Artificial Sequence
  Synthetic DNA
taatacgactcaactttg

SEQ ID NO: 20695 - DNA, 18 bp, Artificial Sequence
  Synthetic DNA
taatacgactctatatta

SEQ ID NO: 20696 - DNA, 18 bp, Artificial Sequence
  Synthetic DNA
taatacgactctcaagtg

SEQ ID NO: 20697 - DNA, 18 bp, Artificial Sequence
  Synthetic DNA
taatacgactgtctagtg

SEQ ID NO: 20698 - DNA, 18 bp, Artificial Sequence
  Synthetic DNA
taatacgactttctatta

SEQ ID NO: 20699 - DNA, 18 bp, Artificial Sequence
  Synthetic DNA
taatacgagtcggtttag

SEQ ID NO: 20700 - DNA, 18 bp, Artificial Sequence
  Synthetic DNA
taatacgagttcctattg

SEQ ID NO: 20701 - DNA, 18 bp, Artificial Sequence
  Synthetic DNA
taatacgatacgctatcg

SEQ ID NO: 20702 - DNA, 18 bp, Artificial Sequence
  Synthetic DNA
taatacggcccacaattg

SEQ ID NO: 20703 - DNA, 18 bp, Artificial Sequence
  Synthetic DNA
taatacggtacactattg

SEQ ID NO: 20704 - DNA, 18 bp, Artificial Sequence
  Synthetic DNA
taatacgtatcactgttg

SEQ ID NO: 20705 - DNA, 18 bp, Artificial Sequence
  Synthetic DNA
taatacgtcaggctatag

SEQ ID NO: 20706 - DNA, 18 bp, Artificial Sequence
  Synthetic DNA
taatactacccacaattg

SEQ ID NO: 20707 - DNA, 18 bp, Artificial Sequence
  Synthetic DNA
taatactactccttattg

SEQ ID NO: 20708 - DNA, 18 bp, Artificial Sequence
  Synthetic DNA
taatactactcgataaag

SEQ ID NO: 20709 - DNA, 18 bp, Artificial Sequence
  Synthetic DNA
taatagaactctctattg

SEQ ID NO: 20710 - DNA, 18 bp, Artificial Sequence
  Synthetic DNA
taataggacttattattg

SEQ ID NO: 20711 - DNA, 18 bp, Artificial Sequence
  Synthetic DNA
taataggatttactattg

SEQ ID NO: 20712 - DNA, 18 bp, Artificial Sequence
  Synthetic DNA
taataggcctcactaatg

SEQ ID NO: 20713 - DNA, 18 bp, Artificial Sequence
  Synthetic DNA
taatagggctcactgttg

SEQ ID NO: 20714 - DNA, 18 bp, Artificial Sequence
  Synthetic DNA
taataggtctcacaattg

SEQ ID NO: 20715 - DNA, 18 bp, Artificial Sequence
  Synthetic DNA
taatatgactcaatatta

SEQ ID NO: 20716 - DNA, 18 bp, Artificial Sequence
  Synthetic DNA
taatatgactcataattg

SEQ ID NO: 20717 - DNA, 18 bp, Artificial Sequence
  Synthetic DNA
taatatgacttgcaatag

SEQ ID NO: 20718 - DNA, 18 bp, Artificial Sequence
  Synthetic DNA
taatatgacttgcgatag

SEQ ID NO: 20719 - DNA, 18 bp, Artificial Sequence
  Synthetic DNA
taatatgagtcacttttg

SEQ ID NO: 20720 - DNA, 18 bp, Artificial Sequence
  Synthetic DNA
taatatgattcgctaaag

SEQ ID NO: 20721 - DNA, 18 bp, Artificial Sequence
  Synthetic DNA
taatattactcactgttg

SEQ ID NO: 20722 - DNA, 18 bp, Artificial Sequence
  Synthetic DNA
taatcaggctcactattg

SEQ ID NO: 20723 - DNA, 18 bp, Artificial Sequence
  Synthetic DNA
taatccgtctagctatag

SEQ ID NO: 20724 - DNA, 18 bp, Artificial Sequence
  Synthetic DNA
taatgcgactcccttttg

SEQ ID NO: 20725 - DNA, 18 bp, Artificial Sequence
  Synthetic DNA
taatggcactcactattg

SEQ ID NO: 20726 - DNA, 18 bp, Artificial Sequence
  Synthetic DNA
taattaaactaactatag

SEQ ID NO: 20727 - DNA, 18 bp, Artificial Sequence
  Synthetic DNA
taattcaactcaatctag

SEQ ID NO: 20728 - DNA, 18 bp, Artificial Sequence
  Synthetic DNA
taattcaactcaccatcg

SEQ ID NO: 20729 - DNA, 18 bp, Artificial Sequence
  Synthetic DNA
taattcaactcactgaag

SEQ ID NO: 20730 - DNA, 18 bp, Artificial Sequence
  Synthetic DNA
taattcaacttcctatag

SEQ ID NO: 20731 - DNA, 18 bp, Artificial Sequence
  Synthetic DNA
taattcagctcacaatag

SEQ ID NO: 20732 - DNA, 18 bp, Artificial Sequence
  Synthetic DNA
taattcagctcaccatag

SEQ ID NO: 20733 - DNA, 18 bp, Artificial Sequence
  Synthetic DNA
taattccactaattatag

SEQ ID NO: 20734 - DNA, 18 bp, Artificial Sequence
  Synthetic DNA
taattccaggcactatag

SEQ ID NO: 20735 - DNA, 18 bp, Artificial Sequence
  Synthetic DNA
taattcgaagccctatag

SEQ ID NO: 20736 - DNA, 18 bp, Artificial Sequence
  Synthetic DNA
taattcgaatctgtatag

SEQ ID NO: 20737 - DNA, 18 bp, Artificial Sequence
  Synthetic DNA
taattcgacaaactatcg

SEQ ID NO: 20738 - DNA, 18 bp, Artificial Sequence
  Synthetic DNA
taattcgacacacaagag

SEQ ID NO: 20739 - DNA, 18 bp, Artificial Sequence
  Synthetic DNA
taattcgacacacttcag

SEQ ID NO: 20740 - DNA, 18 bp, Artificial Sequence
  Synthetic DNA
taattcgacactctgtag

SEQ ID NO: 20741 - DNA, 18 bp, Artificial Sequence
  Synthetic DNA
taattcgactaaatgtag

SEQ ID NO: 20742 - DNA, 18 bp, Artificial Sequence
  Synthetic DNA
taattcgactacctaaag

SEQ ID NO: 20743 - DNA, 18 bp, Artificial Sequence
  Synthetic DNA
taattcgactcactgacg

SEQ ID NO: 20744 - DNA, 18 bp, Artificial Sequence
  Synthetic DNA
taattcgactcagaatcg

SEQ ID NO: 20745 - DNA, 18 bp, Artificial Sequence
  Synthetic DNA
taattcgactctcaatgg

SEQ ID NO: 20746 - DNA, 18 bp, Artificial Sequence
  Synthetic DNA
taattcgactctgtttag

SEQ ID NO: 20747 - DNA, 18 bp, Artificial Sequence
  Synthetic DNA
taattcgagtcattttag

SEQ ID NO: 20748 - DNA, 18 bp, Artificial Sequence
  Synthetic DNA
taattcgagttactttag

SEQ ID NO: 20749 - DNA, 18 bp, Artificial Sequence
  Synthetic DNA
taattcgcatcactttag

SEQ ID NO: 20750 - DNA, 18 bp, Artificial Sequence
  Synthetic DNA
taattcgccacactgtag

SEQ ID NO: 20751 - DNA, 18 bp, Artificial Sequence
  Synthetic DNA
taattcgccgctctatag

SEQ ID NO: 20752 - DNA, 18 bp, Artificial Sequence
  Synthetic DNA
taattcggcctactatag

SEQ ID NO: 20753 - DNA, 18 bp, Artificial Sequence
  Synthetic DNA
taattcgtcgcactacag

SEQ ID NO: 20754 - DNA, 18 bp, Artificial Sequence
  Synthetic DNA
taattcgtctcaatacag

SEQ ID NO: 20755 - DNA, 18 bp, Artificial Sequence
  Synthetic DNA
taattcgtctcaatagag

SEQ ID NO: 20756 - DNA, 18 bp, Artificial Sequence
  Synthetic DNA
taattcgtctcactctcg

SEQ ID NO: 20757 - DNA, 18 bp, Artificial Sequence
  Synthetic DNA
taattcgtctcacttgag

SEQ ID NO: 20758 - DNA, 18 bp, Artificial Sequence
  Synthetic DNA
taattcgtctcagcatag

SEQ ID NO: 20759 - DNA, 18 bp, Artificial Sequence
  Synthetic DNA
taattcgtcttactctag

SEQ ID NO: 20760 - DNA, 18 bp, Artificial Sequence
  Synthetic DNA
taattcgtttccctatag

SEQ ID NO: 20761 - DNA, 18 bp, Artificial Sequence
  Synthetic DNA
taattctactcaccctag

SEQ ID NO: 20762 - DNA, 18 bp, Artificial Sequence
  Synthetic DNA
taattctactcacggtag

SEQ ID NO: 20763 - DNA, 18 bp, Artificial Sequence
  Synthetic DNA
taattctactcactgcag

SEQ ID NO: 20764 - DNA, 18 bp, Artificial Sequence
  Synthetic DNA
taattctactcacttaag

SEQ ID NO: 20765 - DNA, 18 bp, Artificial Sequence
  Synthetic DNA
taattctagtcactttag

SEQ ID NO: 20766 - DNA, 18 bp, Artificial Sequence
  Synthetic DNA
taattctcctcactaaag

SEQ ID NO: 20767 - DNA, 18 bp, Artificial Sequence
  Synthetic DNA
taattcttctcactagag

SEQ ID NO: 20768 - DNA, 18 bp, Artificial Sequence
  Synthetic DNA
taattgaactctctatag

SEQ ID NO: 20769 - DNA, 18 bp, Artificial Sequence
  Synthetic DNA
taattgcactaactatag

SEQ ID NO: 20770 - DNA, 18 bp, Artificial Sequence
  Synthetic DNA
taattggactctccatag

SEQ ID NO: 20771 - DNA, 18 bp, Artificial Sequence
  Synthetic DNA
taattgtactcactctag

SEQ ID NO: 20772 - DNA, 18 bp, Artificial Sequence
  Synthetic DNA
taatttgacttactatgg

SEQ ID NO: 20773 - DNA, 18 bp, Artificial Sequence
  Synthetic DNA
tactacgacacaatattg

SEQ ID NO: 20774 - DNA, 18 bp, Artificial Sequence
  Synthetic DNA
tactacgactcagcattg

SEQ ID NO: 20775 - DNA, 18 bp, Artificial Sequence
  Synthetic DNA
tactacgactccccattg

SEQ ID NO: 20776 - DNA, 18 bp, Artificial Sequence
  Synthetic DNA
tactacgtctgactattg

SEQ ID NO: 20777 - DNA, 18 bp, Artificial Sequence
  Synthetic DNA
tactaggactcactcttg

SEQ ID NO: 20778 - DNA, 18 bp, Artificial Sequence
  Synthetic DNA
tactatgactcacttttg

SEQ ID NO: 20779 - DNA, 18 bp, Artificial Sequence
  Synthetic DNA
tactccgactctctattg

SEQ ID NO: 20780 - DNA, 18 bp, Artificial Sequence
  Synthetic DNA
tacttcgaatcactacag

SEQ ID NO: 20781 - DNA, 18 bp, Artificial Sequence
  Synthetic DNA
tacttcgaatcactatgg

SEQ ID NO: 20782 - DNA, 18 bp, Artificial Sequence
  Synthetic DNA
tacttcgactcaaaatag

SEQ ID NO: 20783 - DNA, 18 bp, Artificial Sequence
  Synthetic DNA
tacttcgcctcactatgg

SEQ ID NO: 20784 - DNA, 18 bp, Artificial Sequence
  Synthetic DNA
tactttgactccctatag

SEQ ID NO: 20785 - DNA, 18 bp, Artificial Sequence
  Synthetic DNA
tagatcgactcattatag

SEQ ID NO: 20786 - DNA, 18 bp, Artificial Sequence
  Synthetic DNA
tagtacaactcgttatag

SEQ ID NO: 20787 - DNA, 18 bp, Artificial Sequence
  Synthetic DNA
tagtacgactcaacattg

SEQ ID NO: 20788 - DNA, 18 bp, Artificial Sequence
  Synthetic DNA
tagttccactctctatag

SEQ ID NO: 20789 - DNA, 18 bp, Artificial Sequence
  Synthetic DNA
tagttcgcctcattatag

SEQ ID NO: 20790 - DNA, 18 bp, Artificial Sequence
  Synthetic DNA
tagttctactccctatag

SEQ ID NO: 20791 - DNA, 18 bp, Artificial Sequence
  Synthetic DNA
tatcacgacacactattg

SEQ ID NO: 20792 - DNA, 18 bp, Artificial Sequence
  Synthetic DNA
tattacaactcagtattg

SEQ ID NO: 20793 - DNA, 18 bp, Artificial Sequence
  Synthetic DNA
tattacgacacactgttg

SEQ ID NO: 20794 - DNA, 18 bp, Artificial Sequence
  Synthetic DNA
tattacgacacgctgtag

SEQ ID NO: 20795 - DNA, 18 bp, Artificial Sequence
  Synthetic DNA
tattacgacttgttatag

SEQ ID NO: 20796 - DNA, 18 bp, Artificial Sequence
  Synthetic DNA
tattaggacccactattg

SEQ ID NO: 20797 - DNA, 18 bp, Artificial Sequence
  Synthetic DNA
tatttcaactgactatag

SEQ ID NO: 20798 - DNA, 18 bp, Artificial Sequence
  Synthetic DNA
tatttcgactacctatag

SEQ ID NO: 20799 - DNA, 18 bp, Artificial Sequence
  Synthetic DNA
tatttcgactcacgacag

SEQ ID NO: 20800 - DNA, 18 bp, Artificial Sequence
  Synthetic DNA
tatttcgacttacgatag

SEQ ID NO: 20801 - DNA, 18 bp, Artificial Sequence
  Synthetic DNA
tcactcaactcactatag

SEQ ID NO: 20802 - DNA, 18 bp, Artificial Sequence
  Synthetic DNA
tcataccactcactagtg

SEQ ID NO: 20803 - DNA, 18 bp, Artificial Sequence
  Synthetic DNA
tcatacgtctcgctaaag

SEQ ID NO: 20804 - DNA, 18 bp, Artificial Sequence
  Synthetic DNA
tcatactactggctatag

SEQ ID NO: 20805 - DNA, 18 bp, Artificial Sequence
  Synthetic DNA
tcataggaatcactattg

SEQ ID NO: 20806 - DNA, 18 bp, Artificial Sequence
  Synthetic DNA
tcatatgactcggtatag

SEQ ID NO: 20807 - DNA, 18 bp, Artificial Sequence
  Synthetic DNA
tcattcaaatcactatag

SEQ ID NO: 20808 - DNA, 18 bp, Artificial Sequence
  Synthetic DNA
tcattcaagtcactatag

SEQ ID NO: 20809 - DNA, 18 bp, Artificial Sequence
  Synthetic DNA
tcattctactcactacag

SEQ ID NO: 20810 - DNA, 18 bp, Artificial Sequence
  Synthetic DNA
tcttacgacgcactattg

SEQ ID NO: 20811 - DNA, 18 bp, Artificial Sequence
  Synthetic DNA
tgaatggactcactatag

SEQ ID NO: 20812 - DNA, 18 bp, Artificial Sequence
  Synthetic DNA
tgacacgactcgctctag

SEQ ID NO: 20813 - DNA, 18 bp, Artificial Sequence
  Synthetic DNA
tgatacgaatcgctttag

SEQ ID NO: 20814 - DNA, 18 bp, Artificial Sequence
  Synthetic DNA
tgatacgactcacctttg

SEQ ID NO: 20815 - DNA, 18 bp, Artificial Sequence
  Synthetic DNA
tgatacgattcagtattg

SEQ ID NO: 20816 - DNA, 18 bp, Artificial Sequence
  Synthetic DNA
tgatgctactcgctatag

SEQ ID NO: 20817 - DNA, 18 bp, Artificial Sequence
  Synthetic DNA
tgattcgatttactatag

SEQ ID NO: 20818 - DNA, 18 bp, Artificial Sequence
  Synthetic DNA
tgttacgacccgctatag

SEQ ID NO: 20819 - DNA, 18 bp, Artificial Sequence
  Synthetic DNA
ttaaacgactcactgttg

SEQ ID NO: 20820 - DNA, 18 bp, Artificial Sequence
  Synthetic DNA
ttataccactcgctaaag

SEQ ID NO: 20821 - DNA, 18 bp, Artificial Sequence
  Synthetic DNA
ttatacgactgactactg

SEQ ID NO: 20822 - DNA, 18 bp, Artificial Sequence
  Synthetic DNA
ttatactactagctatag

SEQ ID NO: 20823 - DNA, 18 bp, Artificial Sequence
  Synthetic DNA
ttattcgtctcactatcg

SEQ ID NO: 20824 - DNA, 18 bp, Artificial Sequence
  Synthetic DNA
ttggacgactcgctatag

SEQ ID NO: 20825 - DNA, 18 bp, Artificial Sequence
  Synthetic DNA
aaaaacgactctctttag

SEQ ID NO: 20826 - DNA, 18 bp, Artificial Sequence
  Synthetic DNA
aaaaacgattcaccatag

SEQ ID NO: 20827 - DNA, 18 bp, Artificial Sequence
  Synthetic DNA
aaaaacggctccctatag

SEQ ID NO: 20828 - DNA, 18 bp, Artificial Sequence
  Synthetic DNA
aaaagcgactcaatatag

SEQ ID NO: 20829 - DNA, 18 bp, Artificial Sequence
  Synthetic DNA
aaacacaactcactctag

SEQ ID NO: 20830 - DNA, 18 bp, Artificial Sequence
  Synthetic DNA
aaacacgactcacttaag

SEQ ID NO: 20831 - DNA, 18 bp, Artificial Sequence
  Synthetic DNA
aaataacactcactgtag

SEQ ID NO: 20832 - DNA, 18 bp, Artificial Sequence
  Synthetic DNA
aaataagactcataatag

SEQ ID NO: 20833 - DNA, 18 bp, Artificial Sequence
  Synthetic DNA
aaatacaactcacaaaag

SEQ ID NO: 20834 - DNA, 18 bp, Artificial Sequence
  Synthetic DNA
aaatacaattcactttag

SEQ ID NO: 20835 - DNA, 18 bp, Artificial Sequence
  Synthetic DNA
aaataccactcatgatag

SEQ ID NO: 20836 - DNA, 18 bp, Artificial Sequence
  Synthetic DNA
aaatacgaatcacactag

SEQ ID NO: 20837 - DNA, 18 bp, Artificial Sequence
  Synthetic DNA
aaatacgaatcagtctag

SEQ ID NO: 20838 - DNA, 18 bp, Artificial Sequence
  Synthetic DNA
aaatacgaattaatatag

SEQ ID NO: 20839 - DNA, 18 bp, Artificial Sequence
  Synthetic DNA
aaatacgacacattatgg

SEQ ID NO: 20840 - DNA, 18 bp, Artificial Sequence
  Synthetic DNA
aaatacgacctactacag

SEQ ID NO: 20841 - DNA, 18 bp, Artificial Sequence
  Synthetic DNA
aaatacgacgcaatatcg

SEQ ID NO: 20842 - DNA, 18 bp, Artificial Sequence
  Synthetic DNA
aaatacgactaaccagag

SEQ ID NO: 20843 - DNA, 18 bp, Artificial Sequence
  Synthetic DNA
aaatacgactcaatttcg

SEQ ID NO: 20844 - DNA, 18 bp, Artificial Sequence
  Synthetic DNA
aaatacgactgacattag

SEQ ID NO: 20845 - DNA, 18 bp, Artificial Sequence
  Synthetic DNA
aaatacgacttatcatag

SEQ ID NO: 20846 - DNA, 18 bp, Artificial Sequence
  Synthetic DNA
aaatacgagttactttag

SEQ ID NO: 20847 - DNA, 18 bp, Artificial Sequence
  Synthetic DNA
aaatacgattcaccaaag

SEQ ID NO: 20848 - DNA, 18 bp, Artificial Sequence
  Synthetic DNA
aaatacggctcattacag

SEQ ID NO: 20849 - DNA, 18 bp, Artificial Sequence
  Synthetic DNA
aaatacggctgactttag

SEQ ID NO: 20850 - DNA, 18 bp, Artificial Sequence
  Synthetic DNA
aaatacggctgagtatag

SEQ ID NO: 20851 - DNA, 18 bp, Artificial Sequence
  Synthetic DNA
aaatacgtaacactatag

SEQ ID NO: 20852 - DNA, 18 bp, Artificial Sequence
  Synthetic DNA
aaatactactaactgtag

SEQ ID NO: 20853 - DNA, 18 bp, Artificial Sequence
  Synthetic DNA
aaatactactccctatcg

SEQ ID NO: 20854 - DNA, 18 bp, Artificial Sequence
  Synthetic DNA
aaatactacttactctag

SEQ ID NO: 20855 - DNA, 18 bp, Artificial Sequence
  Synthetic DNA
aaataggacacagtatag

SEQ ID NO: 20856 - DNA, 18 bp, Artificial Sequence
  Synthetic DNA
aaatatgaaacactatag

SEQ ID NO: 20857 - DNA, 18 bp, Artificial Sequence
  Synthetic DNA
aaatatgactcaacatag

SEQ ID NO: 20858 - DNA, 18 bp, Artificial Sequence
  Synthetic DNA
aaatatgactccctatcg

SEQ ID NO: 20859 - DNA, 18 bp, Artificial Sequence
  Synthetic DNA
aaatatgactctttatag

SEQ ID NO: 20860 - DNA, 18 bp, Artificial Sequence
  Synthetic DNA
aaatatgactgcctatag

SEQ ID NO: 20861 - DNA, 18 bp, Artificial Sequence
  Synthetic DNA
aaatattactcactgtag

SEQ ID NO: 20862 - DNA, 18 bp, Artificial Sequence
  Synthetic DNA
aaatattacttactatag

SEQ ID NO: 20863 - DNA, 18 bp, Artificial Sequence
  Synthetic DNA
aaatccgactcacactag

SEQ ID NO: 20864 - DNA, 18 bp, Artificial Sequence
  Synthetic DNA
aaatgagactcactatgg

SEQ ID NO: 20865 - DNA, 18 bp, Artificial Sequence
  Synthetic DNA
aaatgagtctcactatag

SEQ ID NO: 20866 - DNA, 18 bp, Artificial Sequence
  Synthetic DNA
aaatgcgactcacattag

SEQ ID NO: 20867 - DNA, 18 bp, Artificial Sequence
  Synthetic DNA
aaatgcgcctcacaatag

SEQ ID NO: 20868 - DNA, 18 bp, Artificial Sequence
  Synthetic DNA
aaatgtgacccactatag

SEQ ID NO: 20869 - DNA, 18 bp, Artificial Sequence
  Synthetic DNA
aactacgacccactttag

SEQ ID NO: 20870 - DNA, 18 bp, Artificial Sequence
  Synthetic DNA
aactacgactcaaaatag

SEQ ID NO: 20871 - DNA, 18 bp, Artificial Sequence
  Synthetic DNA
aactacgactcaccttag

SEQ ID NO: 20872 - DNA, 18 bp, Artificial Sequence
  Synthetic DNA
aactacgccttactatag

SEQ ID NO: 20873 - DNA, 18 bp, Artificial Sequence
  Synthetic DNA
aactccgacttactatag

SEQ ID NO: 20874 - DNA, 18 bp, Artificial Sequence
  Synthetic DNA
aagaacgactcactctag

SEQ ID NO: 20875 - DNA, 18 bp, Artificial Sequence
  Synthetic DNA
aagcacgactcaatatag

SEQ ID NO: 20876 - DNA, 18 bp, Artificial Sequence
  Synthetic DNA
aagtacgacgcactttag

SEQ ID NO: 20877 - DNA, 18 bp, Artificial Sequence
  Synthetic DNA
aagtactactccctatag

SEQ ID NO: 20878 - DNA, 18 bp, Artificial Sequence
  Synthetic DNA
aagtatgactaactatag

SEQ ID NO: 20879 - DNA, 18 bp, Artificial Sequence
  Synthetic DNA
aattacgacacactatcg

SEQ ID NO: 20880 - DNA, 18 bp, Artificial Sequence
  Synthetic DNA
aattacgacctactatag

SEQ ID NO: 20881 - DNA, 18 bp, Artificial Sequence
  Synthetic DNA
aattacgacttactacag

SEQ ID NO: 20882 - DNA, 18 bp, Artificial Sequence
  Synthetic DNA
aattacgagtcactagag

SEQ ID NO: 20883 - DNA, 18 bp, Artificial Sequence
  Synthetic DNA
aattacgtctcactagag

SEQ ID NO: 20884 - DNA, 18 bp, Artificial Sequence
  Synthetic DNA
aattgcgacacactatag

SEQ ID NO: 20885 - DNA, 18 bp, Artificial Sequence
  Synthetic DNA
acataagactctctatag

SEQ ID NO: 20886 - DNA, 18 bp, Artificial Sequence
  Synthetic DNA
acataccactccctatag

SEQ ID NO: 20887 - DNA, 18 bp, Artificial Sequence
  Synthetic DNA
acatacgaatcactgtag

SEQ ID NO: 20888 - DNA, 18 bp, Artificial Sequence
  Synthetic DNA
acatacgccttactatag

SEQ ID NO: 20889 - DNA, 18 bp, Artificial Sequence
  Synthetic DNA
acatacttctcactatag

SEQ ID NO: 20890 - DNA, 18 bp, Artificial Sequence
  Synthetic DNA
acataggacttactatag

SEQ ID NO: 20891 - DNA, 18 bp, Artificial Sequence
  Synthetic DNA
acgtacgactctctatag

SEQ ID NO: 20892 - DNA, 18 bp, Artificial Sequence
  Synthetic DNA
agaaacgactcacaatag

SEQ ID NO: 20893 - DNA, 18 bp, Artificial Sequence
  Synthetic DNA
agatacaactctctatag

SEQ ID NO: 20894 - DNA, 18 bp, Artificial Sequence
  Synthetic DNA
agatacgagtcaatatag

SEQ ID NO: 20895 - DNA, 18 bp, Artificial Sequence
  Synthetic DNA
agatacgtctcactatcg

SEQ ID NO: 20896 - DNA, 18 bp, Artificial Sequence
  Synthetic DNA
agatactactctctatag

SEQ ID NO: 20897 - DNA, 18 bp, Artificial Sequence
  Synthetic DNA
atataccacttactatag

SEQ ID NO: 20898 - DNA, 18 bp, Artificial Sequence
  Synthetic DNA
atatacgactcaccctag

SEQ ID NO: 20899 - DNA, 18 bp, Artificial Sequence
  Synthetic DNA
atatacgagacactatag

SEQ ID NO: 20900 - DNA, 18 bp, Artificial Sequence
  Synthetic DNA
atatacgagtcattatag

SEQ ID NO: 20901 - DNA, 18 bp, Artificial Sequence
  Synthetic DNA
atatactactcacgatag

SEQ ID NO: 20902 - DNA, 18 bp, Artificial Sequence
  Synthetic DNA
atatatgactcacaatag

SEQ ID NO: 20903 - DNA, 18 bp, Artificial Sequence
  Synthetic DNA
atatgcgactcactagag

SEQ ID NO: 20904 - DNA, 18 bp, Artificial Sequence
  Synthetic DNA
atgtaggactcactatag

SEQ ID NO: 20905 - DNA, 18 bp, Artificial Sequence
  Synthetic DNA
caaaaagtctcactatag

SEQ ID NO: 20906 - DNA, 18 bp, Artificial Sequence
  Synthetic DNA
caaaacgaatcactacag

SEQ ID NO: 20907 - DNA, 18 bp, Artificial Sequence
  Synthetic DNA
caaaacgactaactaaag

SEQ ID NO: 20908 - DNA, 18 bp, Artificial Sequence
  Synthetic DNA
caataagactctcaatag

SEQ ID NO: 20909 - DNA, 18 bp, Artificial Sequence
  Synthetic DNA
caataagacttcctatag

SEQ ID NO: 20910 - DNA, 18 bp, Artificial Sequence
  Synthetic DNA
caataagtctcaccatag

SEQ ID NO: 20911 - DNA, 18 bp, Artificial Sequence
  Synthetic DNA
caatacaaaacactatag

SEQ ID NO: 20912 - DNA, 18 bp, Artificial Sequence
  Synthetic DNA
caatacaactcaatgtag

SEQ ID NO: 20913 - DNA, 18 bp, Artificial Sequence
  Synthetic DNA
caatacaattcactagag

SEQ ID NO: 20914 - DNA, 18 bp, Artificial Sequence
  Synthetic DNA
caatacgaatccctaaag

SEQ ID NO: 20915 - DNA, 18 bp, Artificial Sequence
  Synthetic DNA
caatacgactcacctaag

SEQ ID NO: 20916 - DNA, 18 bp, Artificial Sequence
  Synthetic DNA
caatacgcctcaatagag

SEQ ID NO: 20917 - DNA, 18 bp, Artificial Sequence
  Synthetic DNA
caatacggcacactagag

SEQ ID NO: 20918 - DNA, 18 bp, Artificial Sequence
  Synthetic DNA
caatacggctctttatag

SEQ ID NO: 20919 - DNA, 18 bp, Artificial Sequence
  Synthetic DNA
caatacgtctcattaaag

SEQ ID NO: 20920 - DNA, 18 bp, Artificial Sequence
  Synthetic DNA
caatacgtcttacgatag

SEQ ID NO: 20921 - DNA, 18 bp, Artificial Sequence
  Synthetic DNA
caataggacacaatatag

SEQ ID NO: 20922 - DNA, 18 bp, Artificial Sequence
  Synthetic DNA
caataggacatactatag

SEQ ID NO: 20923 - DNA, 18 bp, Artificial Sequence
  Synthetic DNA
caatagggctcactttag

SEQ ID NO: 20924 - DNA, 18 bp, Artificial Sequence
  Synthetic DNA
caatatcactcattatag

SEQ ID NO: 20925 - DNA, 18 bp, Artificial Sequence
  Synthetic DNA
caatatgtctcaatatag

SEQ ID NO: 20926 - DNA, 18 bp, Artificial Sequence
  Synthetic DNA
caatcagactcactttag

SEQ ID NO: 20927 - DNA, 18 bp, Artificial Sequence
  Synthetic DNA
caatgcaacacactatag

SEQ ID NO: 20928 - DNA, 18 bp, Artificial Sequence
  Synthetic DNA
caatgcgacctactatag

SEQ ID NO: 20929 - DNA, 18 bp, Artificial Sequence
  Synthetic DNA
caatgggactcactgtag

SEQ ID NO: 20930 - DNA, 18 bp, Artificial Sequence
  Synthetic DNA
cactacgacacaatatag

SEQ ID NO: 20931 - DNA, 18 bp, Artificial Sequence
  Synthetic DNA
cagcacgacgcactatag

SEQ ID NO: 20932 - DNA, 18 bp, Artificial Sequence
  Synthetic DNA
cattacgactcaaaatag

SEQ ID NO: 20933 - DNA, 18 bp, Artificial Sequence
  Synthetic DNA
cattacgactcattgtag

SEQ ID NO: 20934 - DNA, 18 bp, Artificial Sequence
  Synthetic DNA
cattactactcactatcg

SEQ ID NO: 20935 - DNA, 18 bp, Artificial Sequence
  Synthetic DNA
ccatacgaataactatag

SEQ ID NO: 20936 - DNA, 18 bp, Artificial Sequence
  Synthetic DNA
ccatacgactcatgatag

SEQ ID NO: 20937 - DNA, 18 bp, Artificial Sequence
  Synthetic DNA
ccttacgactcactctag

SEQ ID NO: 20938 - DNA, 18 bp, Artificial Sequence
  Synthetic DNA
cgatacgactcaataaag

SEQ ID NO: 20939 - DNA, 18 bp, Artificial Sequence
  Synthetic DNA
ctatacaactcacaatag

SEQ ID NO: 20940 - DNA, 18 bp, Artificial Sequence
  Synthetic DNA
ctatacgactcaaaatag

SEQ ID NO: 20941 - DNA, 18 bp, Artificial Sequence
  Synthetic DNA
ctatacgattccctatag

SEQ ID NO: 20942 - DNA, 18 bp, Artificial Sequence
  Synthetic DNA
ctatacggctcactacag

SEQ ID NO: 20943 - DNA, 18 bp, Artificial Sequence
  Synthetic DNA
ctatgcgactcagtatag

SEQ ID NO: 20944 - DNA, 18 bp, Artificial Sequence
  Synthetic DNA
gaaaacgacacactatcg

SEQ ID NO: 20945 - DNA, 18 bp, Artificial Sequence
  Synthetic DNA
gaaaactactcactaaag

SEQ ID NO: 20946 - DNA, 18 bp, Artificial Sequence
  Synthetic DNA
gaataagtctcactatgg

SEQ ID NO: 20947 - DNA, 18 bp, Artificial Sequence
  Synthetic DNA
gaatacgaatcattttag

SEQ ID NO: 20948 - DNA, 18 bp, Artificial Sequence
  Synthetic DNA
gaatacgactcacacaag

SEQ ID NO: 20949 - DNA, 18 bp, Artificial Sequence
  Synthetic DNA
gaatacgtctaactctag

SEQ ID NO: 20950 - DNA, 18 bp, Artificial Sequence
  Synthetic DNA
gaatacgtcttactttag

SEQ ID NO: 20951 - DNA, 18 bp, Artificial Sequence
  Synthetic DNA
gaatacgtcttattatag

SEQ ID NO: 20952 - DNA, 18 bp, Artificial Sequence
  Synthetic DNA
gaatccgagtcacgatag

SEQ ID NO: 20953 - DNA, 18 bp, Artificial Sequence
  Synthetic DNA
gagtacgagtgactatag

SEQ ID NO: 20954 - DNA, 18 bp, Artificial Sequence
  Synthetic DNA
gattaccactcactttag

SEQ ID NO: 20955 - DNA, 18 bp, Artificial Sequence
  Synthetic DNA
gattacgaatcactgtag

SEQ ID NO: 20956 - DNA, 18 bp, Artificial Sequence
  Synthetic DNA
gattacgactaactctag

SEQ ID NO: 20957 - DNA, 18 bp, Artificial Sequence
  Synthetic DNA
gattacgattcacaatag

SEQ ID NO: 20958 - DNA, 18 bp, Artificial Sequence
  Synthetic DNA
gattacgattcactctag

SEQ ID NO: 20959 - DNA, 18 bp, Artificial Sequence
  Synthetic DNA
gcatacgacacaatatag

SEQ ID NO: 20960 - DNA, 18 bp, Artificial Sequence
  Synthetic DNA
gcatacgactctctttag

SEQ ID NO: 20961 - DNA, 18 bp, Artificial Sequence
  Synthetic DNA
gcatacgacttaccatag

SEQ ID NO: 20962 - DNA, 18 bp, Artificial Sequence
  Synthetic DNA
ggataaggctcactatag

SEQ ID NO: 20963 - DNA, 18 bp, Artificial Sequence
  Synthetic DNA
ggataggacttactatag

SEQ ID NO: 20964 - DNA, 18 bp, Artificial Sequence
  Synthetic DNA
gtaaacgactaactatag

SEQ ID NO: 20965 - DNA, 18 bp, Artificial Sequence
  Synthetic DNA
gttaacgactcactatag

SEQ ID NO: 20966 - DNA, 18 bp, Artificial Sequence
  Synthetic DNA
taaaaagtctccctatag

SEQ ID NO: 20967 - DNA, 18 bp, Artificial Sequence
  Synthetic DNA
taaaacaactgacaatag

SEQ ID NO: 20968 - DNA, 18 bp, Artificial Sequence
  Synthetic DNA
taaaaccacacaatatag

SEQ ID NO: 20969 - DNA, 18 bp, Artificial Sequence
  Synthetic DNA
taaaaccactcagtttag

SEQ ID NO: 20970 - DNA, 18 bp, Artificial Sequence
  Synthetic DNA
taaaacgaatcaccagag

SEQ ID NO: 20971 - DNA, 18 bp, Artificial Sequence
  Synthetic DNA
taaaacgaatctttatag

SEQ ID NO: 20972 - DNA, 18 bp, Artificial Sequence
  Synthetic DNA
taaaacgactcagttcag

SEQ ID NO: 20973 - DNA, 18 bp, Artificial Sequence
  Synthetic DNA
taaaacgactcccactag

SEQ ID NO: 20974 - DNA, 18 bp, Artificial Sequence
  Synthetic DNA
taaaacgactccctgtcg

SEQ ID NO: 20975 - DNA, 18 bp, Artificial Sequence
  Synthetic DNA
taaaacgacttaatagag

SEQ ID NO: 20976 - DNA, 18 bp, Artificial Sequence
  Synthetic DNA
taaaacgagttactatcg

SEQ ID NO: 20977 - DNA, 18 bp, Artificial Sequence
  Synthetic DNA
taaaacgattcactttgg

SEQ ID NO: 20978 - DNA, 18 bp, Artificial Sequence
  Synthetic DNA
taaaacgatttacaatag

SEQ ID NO: 20979 - DNA, 18 bp, Artificial Sequence
  Synthetic DNA
taaaacgcctcagcatag

SEQ ID NO: 20980 - DNA, 18 bp, Artificial Sequence
  Synthetic DNA
taaaacgccttaccatag

SEQ ID NO: 20981 - DNA, 18 bp, Artificial Sequence
  Synthetic DNA
taaaacggctcacaatcg

SEQ ID NO: 20982 - DNA, 18 bp, Artificial Sequence
  Synthetic DNA
taaaacggctcacactag

SEQ ID NO: 20983 - DNA, 18 bp, Artificial Sequence
  Synthetic DNA
taaaacggctcattatgg

SEQ ID NO: 20984 - DNA, 18 bp, Artificial Sequence
  Synthetic DNA
taaaacggttcattatag

SEQ ID NO: 20985 - DNA, 18 bp, Artificial Sequence
  Synthetic DNA
taaaacgtctctctatcg

SEQ ID NO: 20986 - DNA, 18 bp, Artificial Sequence
  Synthetic DNA
taaaactagttactatag

SEQ ID NO: 20987 - DNA, 18 bp, Artificial Sequence
  Synthetic DNA
taaaactgctcactaaag

SEQ ID NO: 20988 - DNA, 18 bp, Artificial Sequence
  Synthetic DNA
taaaacttctcactatgg

SEQ ID NO: 20989 - DNA, 18 bp, Artificial Sequence
  Synthetic DNA
taaaaggactaattatag

SEQ ID NO: 20990 - DNA, 18 bp, Artificial Sequence
  Synthetic DNA
taaaaggacttcctatag

SEQ ID NO: 20991 - DNA, 18 bp, Artificial Sequence
  Synthetic DNA
taaaatatctcactatag

SEQ ID NO: 20992 - DNA, 18 bp, Artificial Sequence
  Synthetic DNA
taaaatgactaactttag

SEQ ID NO: 20993 - DNA, 18 bp, Artificial Sequence
  Synthetic DNA
taaaatgactgactttag

SEQ ID NO: 20994 - DNA, 18 bp, Artificial Sequence
  Synthetic DNA
taaaatggcccactatag

SEQ ID NO: 20995 - DNA, 18 bp, Artificial Sequence
  Synthetic DNA
taaacaggctcactatag

SEQ ID NO: 20996 - DNA, 18 bp, Artificial Sequence
  Synthetic DNA
taaaccacctcactatag

SEQ ID NO: 20997 - DNA, 18 bp, Artificial Sequence
  Synthetic DNA
taaaccgtctcattatag

SEQ ID NO: 20998 - DNA, 18 bp, Artificial Sequence
  Synthetic DNA
taaacctacgcactatag

SEQ ID NO: 20999 - DNA, 18 bp, Artificial Sequence
  Synthetic DNA
taaagagactcaatatag

SEQ ID NO: 21000 - DNA, 18 bp, Artificial Sequence
  Synthetic DNA
taaagcgacaaactatag

SEQ ID NO: 21001 - DNA, 18 bp, Artificial Sequence
  Synthetic DNA
taacaagacacaatatag

SEQ ID NO: 21002 - DNA, 18 bp, Artificial Sequence
  Synthetic DNA
taacaagcctcactatcg

SEQ ID NO: 21003 - DNA, 18 bp, Artificial Sequence
  Synthetic DNA
taacaccacacacaatag

SEQ ID NO: 21004 - DNA, 18 bp, Artificial Sequence
  Synthetic DNA
taacacgacgcaccctag

SEQ ID NO: 21005 - DNA, 18 bp, Artificial Sequence
  Synthetic DNA
taacacgactcaacaaag

SEQ ID NO: 21006 - DNA, 18 bp, Artificial Sequence
  Synthetic DNA
taacacgactctttaaag

SEQ ID NO: 21007 - DNA, 18 bp, Artificial Sequence
  Synthetic DNA
taacacgactgattttag

SEQ ID NO: 21008 - DNA, 18 bp, Artificial Sequence
  Synthetic DNA
taacacgccgctctatag

SEQ ID NO: 21009 - DNA, 18 bp, Artificial Sequence
  Synthetic DNA
taacacgcctcacaaaag

SEQ ID NO: 21010 - DNA, 18 bp, Artificial Sequence
  Synthetic DNA
taacacgtctctatatag

SEQ ID NO: 21011 - DNA, 18 bp, Artificial Sequence
  Synthetic DNA
taacactactgaccatag

SEQ ID NO: 21012 - DNA, 18 bp, Artificial Sequence
  Synthetic DNA
taacaggaatccctatag

SEQ ID NO: 21013 - DNA, 18 bp, Artificial Sequence
  Synthetic DNA
taacatgaatcactacag

SEQ ID NO: 21014 - DNA, 18 bp, Artificial Sequence
  Synthetic DNA
taacatgaccaactatag

SEQ ID NO: 21015 - DNA, 18 bp, Artificial Sequence
  Synthetic DNA
taaccagattcactatag

SEQ ID NO: 21016 - DNA, 18 bp, Artificial Sequence
  Synthetic DNA
taacccgacctactatag

SEQ ID NO: 21017 - DNA, 18 bp, Artificial Sequence
  Synthetic DNA
taacccgacgcactctag

SEQ ID NO: 21018 - DNA, 18 bp, Artificial Sequence
  Synthetic DNA
taacccgactaactaaag

SEQ ID NO: 21019 - DNA, 18 bp, Artificial Sequence
  Synthetic DNA
taacccgactcattttag

SEQ ID NO: 21020 - DNA, 18 bp, Artificial Sequence
  Synthetic DNA
taacctgactcactatcg

SEQ ID NO: 21021 - DNA, 18 bp, Artificial Sequence
  Synthetic DNA
taacctgactcattatag

SEQ ID NO: 21022 - DNA, 18 bp, Artificial Sequence
  Synthetic DNA
taacgcgactctctaaag

SEQ ID NO: 21023 - DNA, 18 bp, Artificial Sequence
  Synthetic DNA
taagaagactcacttaag

SEQ ID NO: 21024 - DNA, 18 bp, Artificial Sequence
  Synthetic DNA
taagaagattcactatcg

SEQ ID NO: 21025 - DNA, 18 bp, Artificial Sequence
  Synthetic DNA
taagacgaatgaatatag

SEQ ID NO: 21026 - DNA, 18 bp, Artificial Sequence
  Synthetic DNA
taagacgacacattagag

SEQ ID NO: 21027 - DNA, 18 bp, Artificial Sequence
  Synthetic DNA
taagacgaccctgtatag

SEQ ID NO: 21028 - DNA, 18 bp, Artificial Sequence
  Synthetic DNA
taagacgactccttaaag

SEQ ID NO: 21029 - DNA, 18 bp, Artificial Sequence
  Synthetic DNA
taagacgactctcaatcg

SEQ ID NO: 21030 - DNA, 18 bp, Artificial Sequence
  Synthetic DNA
taagacgcctctctatcg

SEQ ID NO: 21031 - DNA, 18 bp, Artificial Sequence
  Synthetic DNA
taagactagtcacgatag

SEQ ID NO: 21032 - DNA, 18 bp, Artificial Sequence
  Synthetic DNA
taagatgaatctctatag

SEQ ID NO: 21033 - DNA, 18 bp, Artificial Sequence
  Synthetic DNA
taagatgacacaatatag

SEQ ID NO: 21034 - DNA, 18 bp, Artificial Sequence
  Synthetic DNA
taagccgacttattatag

SEQ ID NO: 21035 - DNA, 18 bp, Artificial Sequence
  Synthetic DNA
taaggcgactcattttag

SEQ ID NO: 21036 - DNA, 18 bp, Artificial Sequence
  Synthetic DNA
taaggctacccactatag

SEQ ID NO: 21037 - DNA, 18 bp, Artificial Sequence
  Synthetic DNA
taataaaactatctatag

SEQ ID NO: 21038 - DNA, 18 bp, Artificial Sequence
  Synthetic DNA
taataaacctcactctag

SEQ ID NO: 21039 - DNA, 18 bp, Artificial Sequence
  Synthetic DNA
taataagactcacccaag

SEQ ID NO: 21040 - DNA, 18 bp, Artificial Sequence
  Synthetic DNA
taataagactccctacgg

SEQ ID NO: 21041 - DNA, 18 bp, Artificial Sequence
  Synthetic DNA
taataagacttacttcag

SEQ ID NO: 21042 - DNA, 18 bp, Artificial Sequence
  Synthetic DNA
taataagacttcatatag

SEQ ID NO: 21043 - DNA, 18 bp, Artificial Sequence
  Synthetic DNA
taataagagtcacaatcg

SEQ ID NO: 21044 - DNA, 18 bp, Artificial Sequence
  Synthetic DNA
taataagcctaactgtag

SEQ ID NO: 21045 - DNA, 18 bp, Artificial Sequence
  Synthetic DNA
taataaggatcacaatag

SEQ ID NO: 21046 - DNA, 18 bp, Artificial Sequence
  Synthetic DNA
taataagtctaaatatag

SEQ ID NO: 21047 - DNA, 18 bp, Artificial Sequence
  Synthetic DNA
taataagtctcattacag

SEQ ID NO: 21048 - DNA, 18 bp, Artificial Sequence
  Synthetic DNA
taataatactcacttcag

SEQ ID NO: 21049 - DNA, 18 bp, Artificial Sequence
  Synthetic DNA
taataatacttacaatag

SEQ ID NO: 21050 - DNA, 18 bp, Artificial Sequence
  Synthetic DNA
taatacaaagcactaaag

SEQ ID NO: 21051 - DNA, 18 bp, Artificial Sequence
  Synthetic DNA
taatacaaatccctgtag

SEQ ID NO: 21052 - DNA, 18 bp, Artificial Sequence
  Synthetic DNA
taatacaacaccctaaag

SEQ ID NO: 21053 - DNA, 18 bp, Artificial Sequence
  Synthetic DNA
taatacaactcaccttcg

SEQ ID NO: 21054 - DNA, 18 bp, Artificial Sequence
  Synthetic DNA
taatacaactctcaagag

SEQ ID NO: 21055 - DNA, 18 bp, Artificial Sequence
  Synthetic DNA
taatacaacttactaacg

SEQ ID NO: 21056 - DNA, 18 bp, Artificial Sequence
  Synthetic DNA
taatacaactttgtatag

SEQ ID NO: 21057 - DNA, 18 bp, Artificial Sequence
  Synthetic DNA
taatacaagttaccatag

SEQ ID NO: 21058 - DNA, 18 bp, Artificial Sequence
  Synthetic DNA
taatacaattcactaacg

SEQ ID NO: 21059 - DNA, 18 bp, Artificial Sequence
  Synthetic DNA
taatacacctcataatag

SEQ ID NO: 21060 - DNA, 18 bp, Artificial Sequence
  Synthetic DNA
taatacagcacactctag

SEQ ID NO: 21061 - DNA, 18 bp, Artificial Sequence
  Synthetic DNA
taatacatccaactatag

SEQ ID NO: 21062 - DNA, 18 bp, Artificial Sequence
  Synthetic DNA
taatacatctctctatcg

SEQ ID NO: 21063 - DNA, 18 bp, Artificial Sequence
  Synthetic DNA
taatacatctctctgtag

SEQ ID NO: 21064 - DNA, 18 bp, Artificial Sequence
  Synthetic DNA
taatacatctgactaaag

SEQ ID NO: 21065 - DNA, 18 bp, Artificial Sequence
  Synthetic DNA
taatacatcttagtatag

SEQ ID NO: 21066 - DNA, 18 bp, Artificial Sequence
  Synthetic DNA
taataccaaacaccatag

SEQ ID NO: 21067 - DNA, 18 bp, Artificial Sequence
  Synthetic DNA
taataccactaattctag

SEQ ID NO: 21068 - DNA, 18 bp, Artificial Sequence
  Synthetic DNA
taataccactctacatag

SEQ ID NO: 21069 - DNA, 18 bp, Artificial Sequence
  Synthetic DNA
taataccactgagcatag

SEQ ID NO: 21070 - DNA, 18 bp, Artificial Sequence
  Synthetic DNA
taatacccctccctttag

SEQ ID NO: 21071 - DNA, 18 bp, Artificial Sequence
  Synthetic DNA
taataccgctctccatag

SEQ ID NO: 21072 - DNA, 18 bp, Artificial Sequence
  Synthetic DNA
taatacctctcacggtag

SEQ ID NO: 21073 - DNA, 18 bp, Artificial Sequence
  Synthetic DNA
taatacctcttactgtag

SEQ ID NO: 21074 - DNA, 18 bp, Artificial Sequence
  Synthetic DNA
taatacgaataattctag

SEQ ID NO: 21075 - DNA, 18 bp, Artificial Sequence
  Synthetic DNA
taatacgaatcaatcaag

SEQ ID NO: 21076 - DNA, 18 bp, Artificial Sequence
  Synthetic DNA
taatacgaatcaattcag

SEQ ID NO: 21077 - DNA, 18 bp, Artificial Sequence
  Synthetic DNA
taatacgaatcacgttcg

SEQ ID NO: 21078 - DNA, 18 bp, Artificial Sequence
  Synthetic DNA
taatacgaatcagtttgg

SEQ ID NO: 21079 - DNA, 18 bp, Artificial Sequence
  Synthetic DNA
taatacgaatcccgacag

SEQ ID NO: 21080 - DNA, 18 bp, Artificial Sequence
  Synthetic DNA
taatacgaatctatacag

SEQ ID NO: 21081 - DNA, 18 bp, Artificial Sequence
  Synthetic DNA
taatacgaatgtctatcg

SEQ ID NO: 21082 - DNA, 18 bp, Artificial Sequence
  Synthetic DNA
taatacgacacagaatgg

SEQ ID NO: 21083 - DNA, 18 bp, Artificial Sequence
  Synthetic DNA
taatacgacactttatgg

SEQ ID NO: 21084 - DNA, 18 bp, Artificial Sequence
  Synthetic DNA
taatacgacatattagag

SEQ ID NO: 21085 - DNA, 18 bp, Artificial Sequence
  Synthetic DNA
taatacgaccaattttag

SEQ ID NO: 21086 - DNA, 18 bp, Artificial Sequence
  Synthetic DNA
taatacgactatatataa

SEQ ID NO: 21087 - DNA, 18 bp, Artificial Sequence
  Synthetic DNA
taatacgactatatctag

SEQ ID NO: 21088 - DNA, 18 bp, Artificial Sequence
  Synthetic DNA
taatacgactatccacag

SEQ ID NO: 21089 - DNA, 18 bp, Artificial Sequence
  Synthetic DNA
taatacgactcacagagg

SEQ ID NO: 21090 - DNA, 18 bp, Artificial Sequence
  Synthetic DNA
taatacgactcaggtaag

SEQ ID NO: 21091 - DNA, 18 bp, Artificial Sequence
  Synthetic DNA
taatacgactcattcacg

SEQ ID NO: 21092 - DNA, 18 bp, Artificial Sequence
  Synthetic DNA
taatacgactccccaacg

SEQ ID NO: 21093 - DNA, 18 bp, Artificial Sequence
  Synthetic DNA
taatacgactcttcaaag

SEQ ID NO: 21094 - DNA, 18 bp, Artificial Sequence
  Synthetic DNA
taatacgactgataaaag

SEQ ID NO: 21095 - DNA, 18 bp, Artificial Sequence
  Synthetic DNA
taatacgacttagttgag

SEQ ID NO: 21096 - DNA, 18 bp, Artificial Sequence
  Synthetic DNA
taatacgacttagtttcg

SEQ ID NO: 21097 - DNA, 18 bp, Artificial Sequence
  Synthetic DNA
taatacgagacactcaag

SEQ ID NO: 21098 - DNA, 18 bp, Artificial Sequence
  Synthetic DNA
taatacgagtaaatatgg

SEQ ID NO: 21099 - DNA, 18 bp, Artificial Sequence
  Synthetic DNA
taatacgagtaatcatag

SEQ ID NO: 21100 - DNA, 18 bp, Artificial Sequence
  Synthetic DNA
taatacgatacaataaag

SEQ ID NO: 21101 - DNA, 18 bp, Artificial Sequence
  Synthetic DNA
taatacgatccactaagg

SEQ ID NO: 21102 - DNA, 18 bp, Artificial Sequence
  Synthetic DNA
taatacgatgctccatag

SEQ ID NO: 21103 - DNA, 18 bp, Artificial Sequence
  Synthetic DNA
taatacgatttaatatgg

SEQ ID NO: 21104 - DNA, 18 bp, Artificial Sequence
  Synthetic DNA
taatacgcatcactaacg

SEQ ID NO: 21105 - DNA, 18 bp, Artificial Sequence
  Synthetic DNA
taatacgccgaactttag

SEQ ID NO: 21106 - DNA, 18 bp, Artificial Sequence
  Synthetic DNA
taatacgcctccccaaag

SEQ ID NO: 21107 - DNA, 18 bp, Artificial Sequence
  Synthetic DNA
taatacgcttcactcaag

SEQ ID NO: 21108 - DNA, 18 bp, Artificial Sequence
  Synthetic DNA
taatacggcagactaaag

SEQ ID NO: 21109 - DNA, 18 bp, Artificial Sequence
  Synthetic DNA
taatacggcgcacttaag

SEQ ID NO: 21110 - DNA, 18 bp, Artificial Sequence
  Synthetic DNA
taatacggctctatagag

SEQ ID NO: 21111 - DNA, 18 bp, Artificial Sequence
  Synthetic DNA
taatacggctctcaagag

SEQ ID NO: 21112 - DNA, 18 bp, Artificial Sequence
  Synthetic DNA
taatacggctctctgaag

SEQ ID NO: 21113 - DNA, 18 bp, Artificial Sequence
  Synthetic DNA
taatacggctctctgcag

SEQ ID NO: 21114 - DNA, 18 bp, Artificial Sequence
  Synthetic DNA
taatacgtaccagtatag

SEQ ID NO: 21115 - DNA, 18 bp, Artificial Sequence
  Synthetic DNA
taatacgtatccctttag

SEQ ID NO: 21116 - DNA, 18 bp, Artificial Sequence
  Synthetic DNA
taatacgtcccacaacag

SEQ ID NO: 21117 - DNA, 18 bp, Artificial Sequence
  Synthetic DNA
taatacgtcgatctatag

SEQ ID NO: 21118 - DNA, 18 bp, Artificial Sequence
  Synthetic DNA
taatacgtctcaccaccg

SEQ ID NO: 21119 - DNA, 18 bp, Artificial Sequence
  Synthetic DNA
taatacgtctccgcatag

SEQ ID NO: 21120 - DNA, 18 bp, Artificial Sequence
  Synthetic DNA
taatacgtgtccccatag

SEQ ID NO: 21121 - DNA, 18 bp, Artificial Sequence
  Synthetic DNA
taatacgttacattatag

SEQ ID NO: 21122 - DNA, 18 bp, Artificial Sequence
  Synthetic DNA
taatacgtttcacaatcg

SEQ ID NO: 21123 - DNA, 18 bp, Artificial Sequence
  Synthetic DNA
taatacgtttcactaggg

SEQ ID NO: 21124 - DNA, 18 bp, Artificial Sequence
  Synthetic DNA
taatactaataactatcg

SEQ ID NO: 21125 - DNA, 18 bp, Artificial Sequence
  Synthetic DNA
taatactacccaatacag

SEQ ID NO: 21126 - DNA, 18 bp, Artificial Sequence
  Synthetic DNA
taatactacccactcaag

SEQ ID NO: 21127 - DNA, 18 bp, Artificial Sequence
  Synthetic DNA
taatactactcattttcg

SEQ ID NO: 21128 - DNA, 18 bp, Artificial Sequence
  Synthetic DNA
taatactacttaatttag

SEQ ID NO: 21129 - DNA, 18 bp, Artificial Sequence
  Synthetic DNA
taatactagccacaatag

SEQ ID NO: 21130 - DNA, 18 bp, Artificial Sequence
  Synthetic DNA
taatactagtccctaaag

SEQ ID NO: 21131 - DNA, 18 bp, Artificial Sequence
  Synthetic DNA
taatactagtgaatatag

SEQ ID NO: 21132 - DNA, 18 bp, Artificial Sequence
  Synthetic DNA
taatactatcccctatag

SEQ ID NO: 21133 - DNA, 18 bp, Artificial Sequence
  Synthetic DNA
taatactattctctagag

SEQ ID NO: 21134 - DNA, 18 bp, Artificial Sequence
  Synthetic DNA
taatactcctcagtttag

SEQ ID NO: 21135 - DNA, 18 bp, Artificial Sequence
  Synthetic DNA
taatactcctctcgatag

SEQ ID NO: 21136 - DNA, 18 bp, Artificial Sequence
  Synthetic DNA
taatactcctctctaaag

SEQ ID NO: 21137 - DNA, 18 bp, Artificial Sequence
  Synthetic DNA
taatactcgtcaccatag

SEQ ID NO: 21138 - DNA, 18 bp, Artificial Sequence
  Synthetic DNA
taatactgcactctatag

SEQ ID NO: 21139 - DNA, 18 bp, Artificial Sequence
  Synthetic DNA
taatacttcccactgtag

SEQ ID NO: 21140 - DNA, 18 bp, Artificial Sequence
  Synthetic DNA
taatagaacttactatcg

SEQ ID NO: 21141 - DNA, 18 bp, Artificial Sequence
  Synthetic DNA
taatagaacttactgtag

SEQ ID NO: 21142 - DNA, 18 bp, Artificial Sequence
  Synthetic DNA
taataggaatcaatacag

SEQ ID NO: 21143 - DNA, 18 bp, Artificial Sequence
  Synthetic DNA
taataggaatcaatctag

SEQ ID NO: 21144 - DNA, 18 bp, Artificial Sequence
  Synthetic DNA
taataggaatcagtctag

SEQ ID NO: 21145 - DNA, 18 bp, Artificial Sequence
  Synthetic DNA
taataggactcaccaacg

SEQ ID NO: 21146 - DNA, 18 bp, Artificial Sequence
  Synthetic DNA
taataggattaactaaag

SEQ ID NO: 21147 - DNA, 18 bp, Artificial Sequence
  Synthetic DNA
taataggcctctctgtag

SEQ ID NO: 21148 - DNA, 18 bp, Artificial Sequence
  Synthetic DNA
taataggtcacactacag

SEQ ID NO: 21149 - DNA, 18 bp, Artificial Sequence
  Synthetic DNA
taataggtctctccatag

SEQ ID NO: 21150 - DNA, 18 bp, Artificial Sequence
  Synthetic DNA
taataggtctctctatgg

SEQ ID NO: 21151 - DNA, 18 bp, Artificial Sequence
  Synthetic DNA
taatataactaactatcg

SEQ ID NO: 21152 - DNA, 18 bp, Artificial Sequence
  Synthetic DNA
taatataactaactctag

SEQ ID NO: 21153 - DNA, 18 bp, Artificial Sequence
  Synthetic DNA
taatataactccttatag

SEQ ID NO: 21154 - DNA, 18 bp, Artificial Sequence
  Synthetic DNA
taatatatctaactatag

SEQ ID NO: 21155 - DNA, 18 bp, Artificial Sequence
  Synthetic DNA
taatatcacactctatag

SEQ ID NO: 21156 - DNA, 18 bp, Artificial Sequence
  Synthetic DNA
taatatcatacactatag

SEQ ID NO: 21157 - DNA, 18 bp, Artificial Sequence
  Synthetic DNA
taatatgaaatactatag

SEQ ID NO: 21158 - DNA, 18 bp, Artificial Sequence
  Synthetic DNA
taatatgaataactaaag

SEQ ID NO: 21159 - DNA, 18 bp, Artificial Sequence
  Synthetic DNA
taatatgaataattatag

SEQ ID NO: 21160 - DNA, 18 bp, Artificial Sequence
  Synthetic DNA
taatatgaatgactatgg

SEQ ID NO: 21161 - DNA, 18 bp, Artificial Sequence
  Synthetic DNA
taatatgacagacaatag

SEQ ID NO: 21162 - DNA, 18 bp, Artificial Sequence
  Synthetic DNA
taatatgactcataacag

SEQ ID NO: 21163 - DNA, 18 bp, Artificial Sequence
  Synthetic DNA
taatatgactccctaagg

SEQ ID NO: 21164 - DNA, 18 bp, Artificial Sequence
  Synthetic DNA
taatatgactctataaag

SEQ ID NO: 21165 - DNA, 18 bp, Artificial Sequence
  Synthetic DNA
taatatgactgatgatag

SEQ ID NO: 21166 - DNA, 18 bp, Artificial Sequence
  Synthetic DNA
taatatgagtaactctag

SEQ ID NO: 21167 - DNA, 18 bp, Artificial Sequence
  Synthetic DNA
taatatgatccactatgg

SEQ ID NO: 21168 - DNA, 18 bp, Artificial Sequence
  Synthetic DNA
taatatgcctgattatag

SEQ ID NO: 21169 - DNA, 18 bp, Artificial Sequence
  Synthetic DNA
taatatgcgtcaatatag

SEQ ID NO: 21170 - DNA, 18 bp, Artificial Sequence
  Synthetic DNA
taatatggatcacaatag

SEQ ID NO: 21171 - DNA, 18 bp, Artificial Sequence
  Synthetic DNA
taatatgtctccctctag

SEQ ID NO: 21172 - DNA, 18 bp, Artificial Sequence
  Synthetic DNA
taatatgtttcactctag

SEQ ID NO: 21173 - DNA, 18 bp, Artificial Sequence
  Synthetic DNA
taatattaatcactttag

SEQ ID NO: 21174 - DNA, 18 bp, Artificial Sequence
  Synthetic DNA
taatattactcactgtcg

SEQ ID NO: 21175 - DNA, 18 bp, Artificial Sequence
  Synthetic DNA
taatattactctttatag

SEQ ID NO: 21176 - DNA, 18 bp, Artificial Sequence
  Synthetic DNA
taatattgctcactttag

SEQ ID NO: 21177 - DNA, 18 bp, Artificial Sequence
  Synthetic DNA
taatatttctcactacag

SEQ ID NO: 21178 - DNA, 18 bp, Artificial Sequence
  Synthetic DNA
taatcagactcacagtag

SEQ ID NO: 21179 - DNA, 18 bp, Artificial Sequence
  Synthetic DNA
taatccaatgcactatag

SEQ ID NO: 21180 - DNA, 18 bp, Artificial Sequence
  Synthetic DNA
taatccatctaactatag

SEQ ID NO: 21181 - DNA, 18 bp, Artificial Sequence
  Synthetic DNA
taatcccactcacaacag

SEQ ID NO: 21182 - DNA, 18 bp, Artificial Sequence
  Synthetic DNA
taatcccactcacattag

SEQ ID NO: 21183 - DNA, 18 bp, Artificial Sequence
  Synthetic DNA
taatcccacttactacag

SEQ ID NO: 21184 - DNA, 18 bp, Artificial Sequence
  Synthetic DNA
taatccgaatcattaaag

SEQ ID NO: 21185 - DNA, 18 bp, Artificial Sequence
  Synthetic DNA
taatccgacactctacag

SEQ ID NO: 21186 - DNA, 18 bp, Artificial Sequence
  Synthetic DNA
taatccgacccacaacag

SEQ ID NO: 21187 - DNA, 18 bp, Artificial Sequence
  Synthetic DNA
taatccgactaactttgg

SEQ ID NO: 21188 - DNA, 18 bp, Artificial Sequence
  Synthetic DNA
taatccgacttaataaag

SEQ ID NO: 21189 - DNA, 18 bp, Artificial Sequence
  Synthetic DNA
taatccgacttacaaaag

SEQ ID NO: 21190 - DNA, 18 bp, Artificial Sequence
  Synthetic DNA
taatccgatccactctag

SEQ ID NO: 21191 - DNA, 18 bp, Artificial Sequence
  Synthetic DNA
taatccgattcacaatcg

SEQ ID NO: 21192 - DNA, 18 bp, Artificial Sequence
  Synthetic DNA
taatccggctcacttgag

SEQ ID NO: 21193 - DNA, 18 bp, Artificial Sequence
  Synthetic DNA
taatccgtcacattatag

SEQ ID NO: 21194 - DNA, 18 bp, Artificial Sequence
  Synthetic DNA
taatccgtctcactaagg

SEQ ID NO: 21195 - DNA, 18 bp, Artificial Sequence
  Synthetic DNA
taatccgtctcattacag

SEQ ID NO: 21196 - DNA, 18 bp, Artificial Sequence
  Synthetic DNA
taatccgtctccctttag

SEQ ID NO: 21197 - DNA, 18 bp, Artificial Sequence
  Synthetic DNA
taatccgtcttaatatag

SEQ ID NO: 21198 - DNA, 18 bp, Artificial Sequence
  Synthetic DNA
taatcctactcacaatgg

SEQ ID NO: 21199 - DNA, 18 bp, Artificial Sequence
  Synthetic DNA
taatcctccacactatag

SEQ ID NO: 21200 - DNA, 18 bp, Artificial Sequence
  Synthetic DNA
taatcgatctcactatag

SEQ ID NO: 21201 - DNA, 18 bp, Artificial Sequence
  Synthetic DNA
taatcggactctctgtag

SEQ ID NO: 21202 - DNA, 18 bp, Artificial Sequence
  Synthetic DNA
taatctgaatcactttag

SEQ ID NO: 21203 - DNA, 18 bp, Artificial Sequence
  Synthetic DNA
taatgagccttactatag

SEQ ID NO: 21204 - DNA, 18 bp, Artificial Sequence
  Synthetic DNA
taatgagtgtcactatag

SEQ ID NO: 21205 - DNA, 18 bp, Artificial Sequence
  Synthetic DNA
taatgcaaatcaccatag

SEQ ID NO: 21206 - DNA, 18 bp, Artificial Sequence
  Synthetic DNA
taatgcaactcaatatgg

SEQ ID NO: 21207 - DNA, 18 bp, Artificial Sequence
  Synthetic DNA
taatgcaactcacaagag

SEQ ID NO: 21208 - DNA, 18 bp, Artificial Sequence
  Synthetic DNA
taatgcgaatctctgtag

SEQ ID NO: 21209 - DNA, 18 bp, Artificial Sequence
  Synthetic DNA
taatgcgacacacttgag

SEQ ID NO: 21210 - DNA, 18 bp, Artificial Sequence
  Synthetic DNA
taatgcgacacagtttag

SEQ ID NO: 21211 - DNA, 18 bp, Artificial Sequence
  Synthetic DNA
taatgcgactcaccaacg

SEQ ID NO: 21212 - DNA, 18 bp, Artificial Sequence
  Synthetic DNA
taatgcgactcagaataa

SEQ ID NO: 21213 - DNA, 18 bp, Artificial Sequence
  Synthetic DNA
taatgcgactcagtcaag

SEQ ID NO: 21214 - DNA, 18 bp, Artificial Sequence
  Synthetic DNA
taatgcgactcagttaag

SEQ ID NO: 21215 - DNA, 18 bp, Artificial Sequence
  Synthetic DNA
taatgcgactctcttgag

SEQ ID NO: 21216 - DNA, 18 bp, Artificial Sequence
  Synthetic DNA
taatgcgacttactaacg

SEQ ID NO: 21217 - DNA, 18 bp, Artificial Sequence
  Synthetic DNA
taatgcgacttacttaag

SEQ ID NO: 21218 - DNA, 18 bp, Artificial Sequence
  Synthetic DNA
taatgcgattcaataaag

SEQ ID NO: 21219 - DNA, 18 bp, Artificial Sequence
  Synthetic DNA
taatgcgattcacattag

SEQ ID NO: 21220 - DNA, 18 bp, Artificial Sequence
  Synthetic DNA
taatgcgcctcaatttag

SEQ ID NO: 21221 - DNA, 18 bp, Artificial Sequence
  Synthetic DNA
taatgcggttcactttag

SEQ ID NO: 21222 - DNA, 18 bp, Artificial Sequence
  Synthetic DNA
taatgcgtcacacgatag

SEQ ID NO: 21223 - DNA, 18 bp, Artificial Sequence
  Synthetic DNA
taatgcgtcaccctatag

SEQ ID NO: 21224 - DNA, 18 bp, Artificial Sequence
  Synthetic DNA
taatgcgtctcacactag

SEQ ID NO: 21225 - DNA, 18 bp, Artificial Sequence
  Synthetic DNA
taatgcgtctccctaaag

SEQ ID NO: 21226 - DNA, 18 bp, Artificial Sequence
  Synthetic DNA
taatgctactaaccatag

SEQ ID NO: 21227 - DNA, 18 bp, Artificial Sequence
  Synthetic DNA
taatgctactcaccatgg

SEQ ID NO: 21228 - DNA, 18 bp, Artificial Sequence
  Synthetic DNA
taatgctactcactaccg

SEQ ID NO: 21229 - DNA, 18 bp, Artificial Sequence
  Synthetic DNA
taatgtgaataactatag

SEQ ID NO: 21230 - DNA, 18 bp, Artificial Sequence
  Synthetic DNA
taatgtgtctcactatcg

SEQ ID NO: 21231 - DNA, 18 bp, Artificial Sequence
  Synthetic DNA
tacaacaacccactatag

SEQ ID NO: 21232 - DNA, 18 bp, Artificial Sequence
  Synthetic DNA
tacaacgtgtcactatag

SEQ ID NO: 21233 - DNA, 18 bp, Artificial Sequence
  Synthetic DNA
tacaagtactcactatag

SEQ ID NO: 21234 - DNA, 18 bp, Artificial Sequence
  Synthetic DNA
tacaccgactcaatatag

SEQ ID NO: 21235 - DNA, 18 bp, Artificial Sequence
  Synthetic DNA
taccacgattcactaaag

SEQ ID NO: 21236 - DNA, 18 bp, Artificial Sequence
  Synthetic DNA
taccactaatcactatag

SEQ ID NO: 21237 - DNA, 18 bp, Artificial Sequence
  Synthetic DNA
tacgacaactcactttag

SEQ ID NO: 21238 - DNA, 18 bp, Artificial Sequence
  Synthetic DNA
tactaaaacacactatag

SEQ ID NO: 21239 - DNA, 18 bp, Artificial Sequence
  Synthetic DNA
tactacgaacccctatag

SEQ ID NO: 21240 - DNA, 18 bp, Artificial Sequence
  Synthetic DNA
tactacgacacaataaag

SEQ ID NO: 21241 - DNA, 18 bp, Artificial Sequence
  Synthetic DNA
tactacgacacacttcag

SEQ ID NO: 21242 - DNA, 18 bp, Artificial Sequence
  Synthetic DNA
tactacgacgatctatag

SEQ ID NO: 21243 - DNA, 18 bp, Artificial Sequence
  Synthetic DNA
tactacgactcatcttag

SEQ ID NO: 21244 - DNA, 18 bp, Artificial Sequence
  Synthetic DNA
tactacgactctctaacg

SEQ ID NO: 21245 - DNA, 18 bp, Artificial Sequence
  Synthetic DNA
tactacgactgacaatcg

SEQ ID NO: 21246 - DNA, 18 bp, Artificial Sequence
  Synthetic DNA
tactacgacttacttaag

SEQ ID NO: 21247 - DNA, 18 bp, Artificial Sequence
  Synthetic DNA
tactacgcatcacaatag

SEQ ID NO: 21248 - DNA, 18 bp, Artificial Sequence
  Synthetic DNA
tactacgccttactttag

SEQ ID NO: 21249 - DNA, 18 bp, Artificial Sequence
  Synthetic DNA
tactacggctctccatag

SEQ ID NO: 21250 - DNA, 18 bp, Artificial Sequence
  Synthetic DNA
tactacggctgtctatag

SEQ ID NO: 21251 - DNA, 18 bp, Artificial Sequence
  Synthetic DNA
tactacggcttactatgg

SEQ ID NO: 21252 - DNA, 18 bp, Artificial Sequence
  Synthetic DNA
tactacgtcgcacaatag

SEQ ID NO: 21253 - DNA, 18 bp, Artificial Sequence
  Synthetic DNA
tactacgtctcacactag

SEQ ID NO: 21254 - DNA, 18 bp, Artificial Sequence
  Synthetic DNA
tactacgtctccctctag

SEQ ID NO: 21255 - DNA, 18 bp, Artificial Sequence
  Synthetic DNA
tactacgttttactatag

SEQ ID NO: 21256 - DNA, 18 bp, Artificial Sequence
  Synthetic DNA
tactactacaaactatag

SEQ ID NO: 21257 - DNA, 18 bp, Artificial Sequence
  Synthetic DNA
tactactacactctatag

SEQ ID NO: 21258 - DNA, 18 bp, Artificial Sequence
  Synthetic DNA
tactactcttcactatag

SEQ ID NO: 21259 - DNA, 18 bp, Artificial Sequence
  Synthetic DNA
tactatgacactctatag

SEQ ID NO: 21260 - DNA, 18 bp, Artificial Sequence
  Synthetic DNA
tactatgactcagaatag

SEQ ID NO: 21261 - DNA, 18 bp, Artificial Sequence
  Synthetic DNA
tactatgtcttactatag

SEQ ID NO: 21262 - DNA, 18 bp, Artificial Sequence
  Synthetic DNA
tagaactactcactatgg

SEQ ID NO: 21263 - DNA, 18 bp, Artificial Sequence
  Synthetic DNA
tagaaggactgactatag

SEQ ID NO: 21264 - DNA, 18 bp, Artificial Sequence
  Synthetic DNA
tagcacgactaaccatag

SEQ ID NO: 21265 - DNA, 18 bp, Artificial Sequence
  Synthetic DNA
tagcacgactcacttcag

SEQ ID NO: 21266 - DNA, 18 bp, Artificial Sequence
  Synthetic DNA
tagcacgactttctatag

SEQ ID NO: 21267 - DNA, 18 bp, Artificial Sequence
  Synthetic DNA
tagtaagaatcaccatag

SEQ ID NO: 21268 - DNA, 18 bp, Artificial Sequence
  Synthetic DNA
tagtaagactcaccatcg

SEQ ID NO: 21269 - DNA, 18 bp, Artificial Sequence
  Synthetic DNA
tagtaagactctccatag

SEQ ID NO: 21270 - DNA, 18 bp, Artificial Sequence
  Synthetic DNA
tagtaagactctctgtag

SEQ ID NO: 21271 - DNA, 18 bp, Artificial Sequence
  Synthetic DNA
tagtacaactgtctatag

SEQ ID NO: 21272 - DNA, 18 bp, Artificial Sequence
  Synthetic DNA
tagtacgacttactttgg

SEQ ID NO: 21273 - DNA, 18 bp, Artificial Sequence
  Synthetic DNA
tagtacgacttattaaag

SEQ ID NO: 21274 - DNA, 18 bp, Artificial Sequence
  Synthetic DNA
tagtacgagttacaatag

SEQ ID NO: 21275 - DNA, 18 bp, Artificial Sequence
  Synthetic DNA
tagtacgcctcaccatgg

SEQ ID NO: 21276 - DNA, 18 bp, Artificial Sequence
  Synthetic DNA
tagtactcctcactaaag

SEQ ID NO: 21277 - DNA, 18 bp, Artificial Sequence
  Synthetic DNA
tagtacttctgactatag

SEQ ID NO: 21278 - DNA, 18 bp, Artificial Sequence
  Synthetic DNA
tagtacttttcactatag

SEQ ID NO: 21279 - DNA, 18 bp, Artificial Sequence
  Synthetic DNA
tagtattactcactaaag

SEQ ID NO: 21280 - DNA, 18 bp, Artificial Sequence
  Synthetic DNA
tagtccaattcactatag

SEQ ID NO: 21281 - DNA, 18 bp, Artificial Sequence
  Synthetic DNA
tagtcccactcactttag

SEQ ID NO: 21282 - DNA, 18 bp, Artificial Sequence
  Synthetic DNA
tagtccgacactctatag

SEQ ID NO: 21283 - DNA, 18 bp, Artificial Sequence
  Synthetic DNA
tagtccgaggcactatag

SEQ ID NO: 21284 - DNA, 18 bp, Artificial Sequence
  Synthetic DNA
tagtgcgattctctatag

SEQ ID NO: 21285 - DNA, 18 bp, Artificial Sequence
  Synthetic DNA
tataaagactcactacag

SEQ ID NO: 21286 - DNA, 18 bp, Artificial Sequence
  Synthetic DNA
tataacgacgcactaaag

SEQ ID NO: 21287 - DNA, 18 bp, Artificial Sequence
  Synthetic DNA
tataacgcctcacaatag

SEQ ID NO: 21288 - DNA, 18 bp, Artificial Sequence
  Synthetic DNA
tataacgtctcactacag

SEQ ID NO: 21289 - DNA, 18 bp, Artificial Sequence
  Synthetic DNA
tataacgtgtcactatag

SEQ ID NO: 21290 - DNA, 18 bp, Artificial Sequence
  Synthetic DNA
tataactactaactatag

SEQ ID NO: 21291 - DNA, 18 bp, Artificial Sequence
  Synthetic DNA
tataactactcacgatag

SEQ ID NO: 21292 - DNA, 18 bp, Artificial Sequence
  Synthetic DNA
tataaggactcactatcg

SEQ ID NO: 21293 - DNA, 18 bp, Artificial Sequence
  Synthetic DNA
tatcaagactcactgtag

SEQ ID NO: 21294 - DNA, 18 bp, Artificial Sequence
  Synthetic DNA
tatcacgaatcattatag

SEQ ID NO: 21295 - DNA, 18 bp, Artificial Sequence
  Synthetic DNA
tatcacgacaaactatag

SEQ ID NO: 21296 - DNA, 18 bp, Artificial Sequence
  Synthetic DNA
tatcacgactacctatag

SEQ ID NO: 21297 - DNA, 18 bp, Artificial Sequence
  Synthetic DNA
tatcacgactccccatag

SEQ ID NO: 21298 - DNA, 18 bp, Artificial Sequence
  Synthetic DNA
tatcacgactgactaaag

SEQ ID NO: 21299 - DNA, 18 bp, Artificial Sequence
  Synthetic DNA
tatcccgtctcactatag

SEQ ID NO: 21300 - DNA, 18 bp, Artificial Sequence
  Synthetic DNA
tattaagactaaatatag

SEQ ID NO: 21301 - DNA, 18 bp, Artificial Sequence
  Synthetic DNA
tattaagactcaatatgg

SEQ ID NO: 21302 - DNA, 18 bp, Artificial Sequence
  Synthetic DNA
tattaagactcagcatag

SEQ ID NO: 21303 - DNA, 18 bp, Artificial Sequence
  Synthetic DNA
tattaagactcagtgtag

SEQ ID NO: 21304 - DNA, 18 bp, Artificial Sequence
  Synthetic DNA
tattaagcgtcactatag

SEQ ID NO: 21305 - DNA, 18 bp, Artificial Sequence
  Synthetic DNA
tattacaacccaccatag

SEQ ID NO: 21306 - DNA, 18 bp, Artificial Sequence
  Synthetic DNA
tattacaacccactacag

SEQ ID NO: 21307 - DNA, 18 bp, Artificial Sequence
  Synthetic DNA
tattaccactcacattag

SEQ ID NO: 21308 - DNA, 18 bp, Artificial Sequence
  Synthetic DNA
tattaccactccccatag

SEQ ID NO: 21309 - DNA, 18 bp, Artificial Sequence
  Synthetic DNA
tattaccatccactatag

SEQ ID NO: 21310 - DNA, 18 bp, Artificial Sequence
  Synthetic DNA
tattaccattcaccatag

SEQ ID NO: 21311 - DNA, 18 bp, Artificial Sequence
  Synthetic DNA
tattacgaatcattatgg

SEQ ID NO: 21312 - DNA, 18 bp, Artificial Sequence
  Synthetic DNA
tattacgaatgattatag

SEQ ID NO: 21313 - DNA, 18 bp, Artificial Sequence
  Synthetic DNA
tattacgacacacagtag

SEQ ID NO: 21314 - DNA, 18 bp, Artificial Sequence
  Synthetic DNA
tattacgacacactagcg

SEQ ID NO: 21315 - DNA, 18 bp, Artificial Sequence
  Synthetic DNA
tattacgacacacttcag

SEQ ID NO: 21316 - DNA, 18 bp, Artificial Sequence
  Synthetic DNA
tattacgacccaatgtag

SEQ ID NO: 21317 - DNA, 18 bp, Artificial Sequence
  Synthetic DNA
tattacgacctattatag

SEQ ID NO: 21318 - DNA, 18 bp, Artificial Sequence
  Synthetic DNA
tattacgacgcataatag

SEQ ID NO: 21319 - DNA, 18 bp, Artificial Sequence
  Synthetic DNA
tattacgactaacactag

SEQ ID NO: 21320 - DNA, 18 bp, Artificial Sequence
  Synthetic DNA
tattacgactcactgacg

SEQ ID NO: 21321 - DNA, 18 bp, Artificial Sequence
  Synthetic DNA
tattacgactcatcatgg

SEQ ID NO: 21322 - DNA, 18 bp, Artificial Sequence
  Synthetic DNA
tattacgactccctcgag

SEQ ID NO: 21323 - DNA, 18 bp, Artificial Sequence
  Synthetic DNA
tattacgactctgcatag

SEQ ID NO: 21324 - DNA, 18 bp, Artificial Sequence
  Synthetic DNA
tattacgattctctatcg

SEQ ID NO: 21325 - DNA, 18 bp, Artificial Sequence
  Synthetic DNA
tattacgccttcctatag

SEQ ID NO: 21326 - DNA, 18 bp, Artificial Sequence
  Synthetic DNA
tattacgcttcaatatag

SEQ ID NO: 21327 - DNA, 18 bp, Artificial Sequence
  Synthetic DNA
tattacgcttcacaatag

SEQ ID NO: 21328 - DNA, 18 bp, Artificial Sequence
  Synthetic DNA
tattacggctctctttag

SEQ ID NO: 21329 - DNA, 18 bp, Artificial Sequence
  Synthetic DNA
tattacggctgattatag

SEQ ID NO: 21330 - DNA, 18 bp, Artificial Sequence
  Synthetic DNA
tattacgtcccacaatag

SEQ ID NO: 21331 - DNA, 18 bp, Artificial Sequence
  Synthetic DNA
tattacgtgtcactacag

SEQ ID NO: 21332 - DNA, 18 bp, Artificial Sequence
  Synthetic DNA
tattacttatcactatag

SEQ ID NO: 21333 - DNA, 18 bp, Artificial Sequence
  Synthetic DNA
tattagatctcactatag

SEQ ID NO: 21334 - DNA, 18 bp, Artificial Sequence
  Synthetic DNA
tattaggagtcactttag

SEQ ID NO: 21335 - DNA, 18 bp, Artificial Sequence
  Synthetic DNA
tattaggatttactatag

SEQ ID NO: 21336 - DNA, 18 bp, Artificial Sequence
  Synthetic DNA
tattaggcctcaatatag

SEQ ID NO: 21337 - DNA, 18 bp, Artificial Sequence
  Synthetic DNA
tattagtactcattatag

SEQ ID NO: 21338 - DNA, 18 bp, Artificial Sequence
  Synthetic DNA
tattattaatcactatag

SEQ ID NO: 21339 - DNA, 18 bp, Artificial Sequence
  Synthetic DNA
tattcagactcactagag

SEQ ID NO: 21340 - DNA, 18 bp, Artificial Sequence
  Synthetic DNA
tattcatactcactatag

SEQ ID NO: 21341 - DNA, 18 bp, Artificial Sequence
  Synthetic DNA
tattccgactaacaatag

SEQ ID NO: 21342 - DNA, 18 bp, Artificial Sequence
  Synthetic DNA
tattccgactctgtatag

SEQ ID NO: 21343 - DNA, 18 bp, Artificial Sequence
  Synthetic DNA
tattgcgacacactacag

SEQ ID NO: 21344 - DNA, 18 bp, Artificial Sequence
  Synthetic DNA
tattgcgtgtcactatag

SEQ ID NO: 21345 - DNA, 18 bp, Artificial Sequence
  Synthetic DNA
tattgggactctctatag

SEQ ID NO: 21346 - DNA, 18 bp, Artificial Sequence
  Synthetic DNA
tcaaacgtctaactatag

SEQ ID NO: 21347 - DNA, 18 bp, Artificial Sequence
  Synthetic DNA
tcacacgactctctatgg

SEQ ID NO: 21348 - DNA, 18 bp, Artificial Sequence
  Synthetic DNA
tcacacgattctctatag

SEQ ID NO: 21349 - DNA, 18 bp, Artificial Sequence
  Synthetic DNA
tcacacgtctcactttag

SEQ ID NO: 21350 - DNA, 18 bp, Artificial Sequence
  Synthetic DNA
tcacactactcactgtag

SEQ ID NO: 21351 - DNA, 18 bp, Artificial Sequence
  Synthetic DNA
tcagaagattcactatag

SEQ ID NO: 21352 - DNA, 18 bp, Artificial Sequence
  Synthetic DNA
tcagaagtctcactatag

SEQ ID NO: 21353 - DNA, 18 bp, Artificial Sequence
  Synthetic DNA
tcagacgacacattatag

SEQ ID NO: 21354 - DNA, 18 bp, Artificial Sequence
  Synthetic DNA
tcagatgactgactatag

SEQ ID NO: 21355 - DNA, 18 bp, Artificial Sequence
  Synthetic DNA
tcataagacacactaaag

SEQ ID NO: 21356 - DNA, 18 bp, Artificial Sequence
  Synthetic DNA
tcataagagtcactctag

SEQ ID NO: 21357 - DNA, 18 bp, Artificial Sequence
  Synthetic DNA
tcatacaacccagtatag

SEQ ID NO: 21358 - DNA, 18 bp, Artificial Sequence
  Synthetic DNA
tcatacgacacacattag

SEQ ID NO: 21359 - DNA, 18 bp, Artificial Sequence
  Synthetic DNA
tcatacgacataatatag

SEQ ID NO: 21360 - DNA, 18 bp, Artificial Sequence
  Synthetic DNA
tcatacgacatattatag

SEQ ID NO: 21361 - DNA, 18 bp, Artificial Sequence
  Synthetic DNA
tcatacgaccctatatag

SEQ ID NO: 21362 - DNA, 18 bp, Artificial Sequence
  Synthetic DNA
tcatacgactaacttaag

SEQ ID NO: 21363 - DNA, 18 bp, Artificial Sequence
  Synthetic DNA
tcatacgactacctttag

SEQ ID NO: 21364 - DNA, 18 bp, Artificial Sequence
  Synthetic DNA
tcatacgactctctcgag

SEQ ID NO: 21365 - DNA, 18 bp, Artificial Sequence
  Synthetic DNA
tcatacgagaaactatag

SEQ ID NO: 21366 - DNA, 18 bp, Artificial Sequence
  Synthetic DNA
tcatacgatttactatgg

SEQ ID NO: 21367 - DNA, 18 bp, Artificial Sequence
  Synthetic DNA
tcatacgcatcactatgg

SEQ ID NO: 21368 - DNA, 18 bp, Artificial Sequence
  Synthetic DNA
tcatacgccgtactatag

SEQ ID NO: 21369 - DNA, 18 bp, Artificial Sequence
  Synthetic DNA
tcatacgcctcagtttag

SEQ ID NO: 21370 - DNA, 18 bp, Artificial Sequence
  Synthetic DNA
tcatacgccttactctag

SEQ ID NO: 21371 - DNA, 18 bp, Artificial Sequence
  Synthetic DNA
tcatacgtcttactgtag

SEQ ID NO: 21372 - DNA, 18 bp, Artificial Sequence
  Synthetic DNA
tcataggactcagtacag

SEQ ID NO: 21373 - DNA, 18 bp, Artificial Sequence
  Synthetic DNA
tcataggcctcactatgg

SEQ ID NO: 21374 - DNA, 18 bp, Artificial Sequence
  Synthetic DNA
tcatatgacacactatcg

SEQ ID NO: 21375 - DNA, 18 bp, Artificial Sequence
  Synthetic DNA
tcatcagactcactttag

SEQ ID NO: 21376 - DNA, 18 bp, Artificial Sequence
  Synthetic DNA
tcatccgcctcactatgg

SEQ ID NO: 21377 - DNA, 18 bp, Artificial Sequence
  Synthetic DNA
tcatgcgacacactttag

SEQ ID NO: 21378 - DNA, 18 bp, Artificial Sequence
  Synthetic DNA
tcctacgacactctatag

SEQ ID NO: 21379 - DNA, 18 bp, Artificial Sequence
  Synthetic DNA
tcctacgactgtctatag

SEQ ID NO: 21380 - DNA, 18 bp, Artificial Sequence
  Synthetic DNA
tcctacgtctcagtatag

SEQ ID NO: 21381 - DNA, 18 bp, Artificial Sequence
  Synthetic DNA
tcctacttctcactatag

SEQ ID NO: 21382 - DNA, 18 bp, Artificial Sequence
  Synthetic DNA
tcgtaagactaactatag

SEQ ID NO: 21383 - DNA, 18 bp, Artificial Sequence
  Synthetic DNA
tcttacgactcactccag

SEQ ID NO: 21384 - DNA, 18 bp, Artificial Sequence
  Synthetic DNA
tcttacgactcattaaag

SEQ ID NO: 21385 - DNA, 18 bp, Artificial Sequence
  Synthetic DNA
tcttacgacttactgtag

SEQ ID NO: 21386 - DNA, 18 bp, Artificial Sequence
  Synthetic DNA
tcttacgagtaactatag

SEQ ID NO: 21387 - DNA, 18 bp, Artificial Sequence
  Synthetic DNA
tcttacgattcagtatag

SEQ ID NO: 21388 - DNA, 18 bp, Artificial Sequence
  Synthetic DNA
tcttacgtctcactaaag

SEQ ID NO: 21389 - DNA, 18 bp, Artificial Sequence
  Synthetic DNA
tgaaacgactcaccatgg

SEQ ID NO: 21390 - DNA, 18 bp, Artificial Sequence
  Synthetic DNA
tgacacgacttaccatag

SEQ ID NO: 21391 - DNA, 18 bp, Artificial Sequence
  Synthetic DNA
tgacccgactaactatag

SEQ ID NO: 21392 - DNA, 18 bp, Artificial Sequence
  Synthetic DNA
tgagacgtctcactatcg

SEQ ID NO: 21393 - DNA, 18 bp, Artificial Sequence
  Synthetic DNA
tgataagactcacaatgg

SEQ ID NO: 21394 - DNA, 18 bp, Artificial Sequence
  Synthetic DNA
tgataccactcactccag

SEQ ID NO: 21395 - DNA, 18 bp, Artificial Sequence
  Synthetic DNA
tgatacgacaaactaaag

SEQ ID NO: 21396 - DNA, 18 bp, Artificial Sequence
  Synthetic DNA
tgatacgacacaccttag

SEQ ID NO: 21397 - DNA, 18 bp, Artificial Sequence
  Synthetic DNA
tgatacgactcaccctcg

SEQ ID NO: 21398 - DNA, 18 bp, Artificial Sequence
  Synthetic DNA
tgatacgactcccagtag

SEQ ID NO: 21399 - DNA, 18 bp, Artificial Sequence
  Synthetic DNA
tgatacgtctaactacag

SEQ ID NO: 21400 - DNA, 18 bp, Artificial Sequence
  Synthetic DNA
tgatacgtctcactacgg

SEQ ID NO: 21401 - DNA, 18 bp, Artificial Sequence
  Synthetic DNA
tgatactacactctatag

SEQ ID NO: 21402 - DNA, 18 bp, Artificial Sequence
  Synthetic DNA
tgatactactcattttag

SEQ ID NO: 21403 - DNA, 18 bp, Artificial Sequence
  Synthetic DNA
tgatagttctcactatag

SEQ ID NO: 21404 - DNA, 18 bp, Artificial Sequence
  Synthetic DNA
tgatataacacactatag

SEQ ID NO: 21405 - DNA, 18 bp, Artificial Sequence
  Synthetic DNA
tgatatgactgactaaag

SEQ ID NO: 21406 - DNA, 18 bp, Artificial Sequence
  Synthetic DNA
tgatccgaatcactttag

SEQ ID NO: 21407 - DNA, 18 bp, Artificial Sequence
  Synthetic DNA
tgatccgactctccatag

SEQ ID NO: 21408 - DNA, 18 bp, Artificial Sequence
  Synthetic DNA
tgatgcgactcccaatag

SEQ ID NO: 21409 - DNA, 18 bp, Artificial Sequence
  Synthetic DNA
tgccacgactcactagag

SEQ ID NO: 21410 - DNA, 18 bp, Artificial Sequence
  Synthetic DNA
tggtacgactcagaatag

SEQ ID NO: 21411 - DNA, 18 bp, Artificial Sequence
  Synthetic DNA
tggtacgactccctatcg

SEQ ID NO: 21412 - DNA, 18 bp, Artificial Sequence
  Synthetic DNA
tgttacctctcactatag

SEQ ID NO: 21413 - DNA, 18 bp, Artificial Sequence
  Synthetic DNA
tgttacgaatcagtatag

SEQ ID NO: 21414 - DNA, 18 bp, Artificial Sequence
  Synthetic DNA
tgttacgacacactacag

SEQ ID NO: 21415 - DNA, 18 bp, Artificial Sequence
  Synthetic DNA
ttaaaagactcagtatag

SEQ ID NO: 21416 - DNA, 18 bp, Artificial Sequence
  Synthetic DNA
ttaaacgaattactatag

SEQ ID NO: 21417 - DNA, 18 bp, Artificial Sequence
  Synthetic DNA
ttaaacgactcaccttag

SEQ ID NO: 21418 - DNA, 18 bp, Artificial Sequence
  Synthetic DNA
ttacacaacttactatag

SEQ ID NO: 21419 - DNA, 18 bp, Artificial Sequence
  Synthetic DNA
ttacacgactctcaatag

SEQ ID NO: 21420 - DNA, 18 bp, Artificial Sequence
  Synthetic DNA
ttacacgattcactacag

SEQ ID NO: 21421 - DNA, 18 bp, Artificial Sequence
  Synthetic DNA
ttacacgattcactagag

SEQ ID NO: 21422 - DNA, 18 bp, Artificial Sequence
  Synthetic DNA
ttacacgtctctctatag

SEQ ID NO: 21423 - DNA, 18 bp, Artificial Sequence
  Synthetic DNA
ttacgcgtctcactatag

SEQ ID NO: 21424 - DNA, 18 bp, Artificial Sequence
  Synthetic DNA
ttagaagactaactatag

SEQ ID NO: 21425 - DNA, 18 bp, Artificial Sequence
  Synthetic DNA
ttagacgtgtcactatag

SEQ ID NO: 21426 - DNA, 18 bp, Artificial Sequence
  Synthetic DNA
ttataacacgcactatag

SEQ ID NO: 21427 - DNA, 18 bp, Artificial Sequence
  Synthetic DNA
ttataagagtcactagag

SEQ ID NO: 21428 - DNA, 18 bp, Artificial Sequence
  Synthetic DNA
ttatacaactctctatgg

SEQ ID NO: 21429 - DNA, 18 bp, Artificial Sequence
  Synthetic DNA
ttataccattcaccatag

SEQ ID NO: 21430 - DNA, 18 bp, Artificial Sequence
  Synthetic DNA
ttatacgacacaacatag

SEQ ID NO: 21431 - DNA, 18 bp, Artificial Sequence
  Synthetic DNA
ttatacgacccaacatag

SEQ ID NO: 21432 - DNA, 18 bp, Artificial Sequence
  Synthetic DNA
ttatacgactcaatcaag

SEQ ID NO: 21433 - DNA, 18 bp, Artificial Sequence
  Synthetic DNA
ttatacgactcactacct

SEQ ID NO: 21434 - DNA, 18 bp, Artificial Sequence
  Synthetic DNA
ttatacgactcataatcg

SEQ ID NO: 21435 - DNA, 18 bp, Artificial Sequence
  Synthetic DNA
ttatacgactctgtaaag

SEQ ID NO: 21436 - DNA, 18 bp, Artificial Sequence
  Synthetic DNA
ttatacgaggcactttag

SEQ ID NO: 21437 - DNA, 18 bp, Artificial Sequence
  Synthetic DNA
ttatacgcctcactgcag

SEQ ID NO: 21438 - DNA, 18 bp, Artificial Sequence
  Synthetic DNA
ttatacggcacacaatag

SEQ ID NO: 21439 - DNA, 18 bp, Artificial Sequence
  Synthetic DNA
ttatacggttcactgtag

SEQ ID NO: 21440 - DNA, 18 bp, Artificial Sequence
  Synthetic DNA
ttatacgtctcactctgg

SEQ ID NO: 21441 - DNA, 18 bp, Artificial Sequence
  Synthetic DNA
ttatacgtctcattacag

SEQ ID NO: 21442 - DNA, 18 bp, Artificial Sequence
  Synthetic DNA
ttatacgtctcattatcg

SEQ ID NO: 21443 - DNA, 18 bp, Artificial Sequence
  Synthetic DNA
ttatactactcccgatag

SEQ ID NO: 21444 - DNA, 18 bp, Artificial Sequence
  Synthetic DNA
ttatactactctcgatag

SEQ ID NO: 21445 - DNA, 18 bp, Artificial Sequence
  Synthetic DNA
ttataggactaactacag

SEQ ID NO: 21446 - DNA, 18 bp, Artificial Sequence
  Synthetic DNA
ttatatcactcaccatag

SEQ ID NO: 21447 - DNA, 18 bp, Artificial Sequence
  Synthetic DNA
ttatccgacaaactatag

SEQ ID NO: 21448 - DNA, 18 bp, Artificial Sequence
  Synthetic DNA
ttatctgactctctatag

SEQ ID NO: 21449 - DNA, 18 bp, Artificial Sequence
  Synthetic DNA
ttatctgactgactatag

SEQ ID NO: 21450 - DNA, 18 bp, Artificial Sequence
  Synthetic DNA
ttatgcaacttactatag

SEQ ID NO: 21451 - DNA, 18 bp, Artificial Sequence
  Synthetic DNA
ttatgcgactcacattag

SEQ ID NO: 21452 - DNA, 18 bp, Artificial Sequence
  Synthetic DNA
ttatgcgagtcaatatag

SEQ ID NO: 21453 - DNA, 18 bp, Artificial Sequence
  Synthetic DNA
ttatgcgatccactatag

SEQ ID NO: 21454 - DNA, 18 bp, Artificial Sequence
  Synthetic DNA
ttatgcgtctcaatatag

SEQ ID NO: 21455 - DNA, 18 bp, Artificial Sequence
  Synthetic DNA
ttctaccactcactttag

SEQ ID NO: 21456 - DNA, 18 bp, Artificial Sequence
  Synthetic DNA
ttctacgaatcactatgg

SEQ ID NO: 21457 - DNA, 18 bp, Artificial Sequence
  Synthetic DNA
ttctacgacacactaaag

SEQ ID NO: 21458 - DNA, 18 bp, Artificial Sequence
  Synthetic DNA
ttctacgactcaccaaag

SEQ ID NO: 21459 - DNA, 18 bp, Artificial Sequence
  Synthetic DNA
ttctacgactcactaagg

SEQ ID NO: 21460 - DNA, 18 bp, Artificial Sequence
  Synthetic DNA
ttctacgagtcactatcg

SEQ ID NO: 21461 - DNA, 18 bp, Artificial Sequence
  Synthetic DNA
ttctattactcactatag

SEQ ID NO: 21462 - DNA, 18 bp, Artificial Sequence
  Synthetic DNA
ttgaacgaatcactatag

SEQ ID NO: 21463 - DNA, 18 bp, Artificial Sequence
  Synthetic DNA
ttgtacaagtcactatag

SEQ ID NO: 21464 - DNA, 18 bp, Artificial Sequence
  Synthetic DNA
ttgtatgactcactttag

SEQ ID NO: 21465 - DNA, 18 bp, Artificial Sequence
  Synthetic DNA
ttttacgactccccatag

SEQ ID NO: 21466 - DNA, 18 bp, Artificial Sequence
  Synthetic DNA
ttttacgcctcactctag

SEQ ID NO: 21467 - DNA, 18 bp, Artificial Sequence
  Synthetic DNA
ttttacgtctcactaaag

SEQ ID NO: 21468 - DNA, 18 bp, Artificial Sequence
  Synthetic DNA
ttttaggaatcactatag

SEQ ID NO: 21469 - DNA, 18 bp, Artificial Sequence
  Synthetic DNA
ttttccgactaactatag

SEQ ID NO: 21470 - DNA, 18 bp, Artificial Sequence
  Synthetic DNA
tatatcaactcactatag

SEQ ID NO: 21471 - DNA, 18 bp, Artificial Sequence
  Synthetic DNA
taatccgtctcacttaag

SEQ ID NO: 21472 - DNA, 18 bp, Artificial Sequence
  Synthetic DNA
taacactacacacaatag

SEQ ID NO: 21473 - DNA, 18 bp, Artificial Sequence
  Synthetic DNA
tattacgactcaatcaag

SEQ ID NO: 21474 - DNA, 18 bp, Artificial Sequence
  Synthetic DNA
taattagtctcactattg

SEQ ID NO: 21475 - DNA, 18 bp, Artificial Sequence
  Synthetic DNA
ttattcgactcactaatg

SEQ ID NO: 21476 - DNA, 18 bp, Artificial Sequence
  Synthetic DNA
aaatacgcttcactattg

SEQ ID NO: 21477 - DNA, 18 bp, Artificial Sequence
  Synthetic DNA
atattcgagtcactatag

SEQ ID NO: 21478 - DNA, 18 bp, Artificial Sequence
  Synthetic DNA
taaaacgtctcagtattg

SEQ ID NO: 21479 - DNA, 18 bp, Artificial Sequence
  Synthetic DNA
taacatgactctctattg

SEQ ID NO: 21480 - DNA, 18 bp, Artificial Sequence
  Synthetic DNA
taattcaactcacagtag

SEQ ID NO: 21481 - DNA, 18 bp, Artificial Sequence
  Synthetic DNA
taattcgaatcactaacg

SEQ ID NO: 21482 - DNA, 18 bp, Artificial Sequence
  Synthetic DNA
taatttgactcacttgag

SEQ ID NO: 21483 - DNA, 18 bp, Artificial Sequence
  Synthetic DNA
tctttcgactcactatcg

SEQ ID NO: 21484 - DNA, 18 bp, Artificial Sequence
  Synthetic DNA
ttatacgactcaatcttg

SEQ ID NO: 21485 - DNA, 18 bp, Artificial Sequence
  Synthetic DNA
aaataggactcacaaaag

SEQ ID NO: 21486 - DNA, 18 bp, Artificial Sequence
  Synthetic DNA
atatacgtctcactagag

SEQ ID NO: 21487 - DNA, 18 bp, Artificial Sequence
  Synthetic DNA
caatacgactctcaaaag

SEQ ID NO: 21488 - DNA, 18 bp, Artificial Sequence
  Synthetic DNA
taagacgattctttatag

SEQ ID NO: 21489 - DNA, 18 bp, Artificial Sequence
  Synthetic DNA
taatactatacacaatag

SEQ ID NO: 21490 - DNA, 18 bp, Artificial Sequence
  Synthetic DNA
taatatgaatctctaaag

SEQ ID NO: 21491 - DNA, 18 bp, Artificial Sequence
  Synthetic DNA
taatatgtctatctatag

SEQ ID NO: 21492 - DNA, 18 bp, Artificial Sequence
  Synthetic DNA
tataacgcctcattatag

SEQ ID NO: 21493 - DNA, 18 bp, Artificial Sequence
  Synthetic DNA
tatcacgaatcactttag

SEQ ID NO: 21494 - DNA, 18 bp, Artificial Sequence
  Synthetic DNA
tattaaggctctctatag

SEQ ID NO: 21495 - DNA, 18 bp, Artificial Sequence
  Synthetic DNA
tattaccacacacaatag

SEQ ID NO: 21496 - DNA, 18 bp, Artificial Sequence
  Synthetic DNA
tcatatgaatctctatag

SEQ ID NO: 21497 - DNA, 18 bp, Artificial Sequence
  Synthetic DNA
ttaaacgcctcactaaag

SEQ ID NO: 21498 - DNA, 18 bp, Artificial Sequence
  Synthetic DNA
ttatccaactcattatag

SEQ ID NO: 21499 - DNA, 18 bp, Artificial Sequence
  Synthetic DNA
ttatccgcctcactaaag

SEQ ID NO: 21500 - DNA, 18 bp, Artificial Sequence
  Synthetic DNA
ttctaagacccactatag

SEQ ID NO: 21501 - DNA, 18 bp, Artificial Sequence
  Synthetic DNA
taaaacgtttcactattg

SEQ ID NO: 21502 - DNA, 18 bp, Artificial Sequence
  Synthetic DNA
ttaaatgactcactaaag

SEQ ID NO: 21503 - DNA, 18 bp, Artificial Sequence
  Synthetic DNA
taattcgacacgctattg

SEQ ID NO: 21504 - DNA, 18 bp, Artificial Sequence
  Synthetic DNA
taatccgattcgctattg

SEQ ID NO: 21505 - DNA, 18 bp, Artificial Sequence
  Synthetic DNA
taattccacttgctatag

SEQ ID NO: 21506 - DNA, 18 bp, Artificial Sequence
  Synthetic DNA
aaacacgattcactattg

SEQ ID NO: 21507 - DNA, 18 bp, Artificial Sequence
  Synthetic DNA
aaataagactaactattg

SEQ ID NO: 21508 - DNA, 18 bp, Artificial Sequence
  Synthetic DNA
aaatacgattcactcttg

SEQ ID NO: 21509 - DNA, 18 bp, Artificial Sequence
  Synthetic DNA
aaattccactcactatgg

SEQ ID NO: 21510 - DNA, 18 bp, Artificial Sequence
  Synthetic DNA
aaattcgactcactttgg

SEQ ID NO: 21511 - DNA, 18 bp, Artificial Sequence
  Synthetic DNA
aacaacgactcactattg

SEQ ID NO: 21512 - DNA, 18 bp, Artificial Sequence
  Synthetic DNA
caatgcgactcactaatg

SEQ ID NO: 21513 - DNA, 18 bp, Artificial Sequence
  Synthetic DNA
taaaacgagtcacttttg

SEQ ID NO: 21514 - DNA, 18 bp, Artificial Sequence
  Synthetic DNA
taaaccgactgactattg

SEQ ID NO: 21515 - DNA, 18 bp, Artificial Sequence
  Synthetic DNA
taactcgattcacaatag

SEQ ID NO: 21516 - DNA, 18 bp, Artificial Sequence
  Synthetic DNA
taagacaactcactaatg

SEQ ID NO: 21517 - DNA, 18 bp, Artificial Sequence
  Synthetic DNA
taatacaactctctagtg

SEQ ID NO: 21518 - DNA, 18 bp, Artificial Sequence
  Synthetic DNA
taatacgaccaactactg

SEQ ID NO: 21519 - DNA, 18 bp, Artificial Sequence
  Synthetic DNA
taatacgcttcgctctag

SEQ ID NO: 21520 - DNA, 18 bp, Artificial Sequence
  Synthetic DNA
taatacggttctctattg

SEQ ID NO: 21521 - DNA, 18 bp, Artificial Sequence
  Synthetic DNA
taatgcgattcactaatg

SEQ ID NO: 21522 - DNA, 18 bp, Artificial Sequence
  Synthetic DNA
taattagagttactatag

SEQ ID NO: 21523 - DNA, 18 bp, Artificial Sequence
  Synthetic DNA
taattagtctccctatag

SEQ ID NO: 21524 - DNA, 18 bp, Artificial Sequence
  Synthetic DNA
taattcaactcacaatcg

SEQ ID NO: 21525 - DNA, 18 bp, Artificial Sequence
  Synthetic DNA
taattcacctcactaaag

SEQ ID NO: 21526 - DNA, 18 bp, Artificial Sequence
  Synthetic DNA
taattccacacactacag

SEQ ID NO: 21527 - DNA, 18 bp, Artificial Sequence
  Synthetic DNA
taattccactccctttag

SEQ ID NO: 21528 - DNA, 18 bp, Artificial Sequence
  Synthetic DNA
taattcgaatcagtatcg

SEQ ID NO: 21529 - DNA, 18 bp, Artificial Sequence
  Synthetic DNA
taattcgactcccaatgg

SEQ ID NO: 21530 - DNA, 18 bp, Artificial Sequence
  Synthetic DNA
taattcgactgacttaag

SEQ ID NO: 21531 - DNA, 18 bp, Artificial Sequence
  Synthetic DNA
taattcgagacactttag

SEQ ID NO: 21532 - DNA, 18 bp, Artificial Sequence
  Synthetic DNA
taattcgcctcaccttag

SEQ ID NO: 21533 - DNA, 18 bp, Artificial Sequence
  Synthetic DNA
taattcggctcactaacg

SEQ ID NO: 21534 - DNA, 18 bp, Artificial Sequence
  Synthetic DNA
taattcgtctcactgaag

SEQ ID NO: 21535 - DNA, 18 bp, Artificial Sequence
  Synthetic DNA
taattcgtctctctgtag

SEQ ID NO: 21536 - DNA, 18 bp, Artificial Sequence
  Synthetic DNA
taattcgtttcattatag

SEQ ID NO: 21537 - DNA, 18 bp, Artificial Sequence
  Synthetic DNA
taccacgactcacaattg

SEQ ID NO: 21538 - DNA, 18 bp, Artificial Sequence
  Synthetic DNA
tattacaactcactcttg

SEQ ID NO: 21539 - DNA, 18 bp, Artificial Sequence
  Synthetic DNA
tattacgacacgcaatag

SEQ ID NO: 21540 - DNA, 18 bp, Artificial Sequence
  Synthetic DNA
tattacgacagactattg

SEQ ID NO: 21541 - DNA, 18 bp, Artificial Sequence
  Synthetic DNA
tatttcgacgcattatag

SEQ ID NO: 21542 - DNA, 18 bp, Artificial Sequence
  Synthetic DNA
tgccacgactcactattg

SEQ ID NO: 21543 - DNA, 18 bp, Artificial Sequence
  Synthetic DNA
ttacaggactcgctatag

SEQ ID NO: 21544 - DNA, 18 bp, Artificial Sequence
  Synthetic DNA
ttatactactcgatatag

SEQ ID NO: 21545 - DNA, 18 bp, Artificial Sequence
  Synthetic DNA
aaaaacaactcaccatag

SEQ ID NO: 21546 - DNA, 18 bp, Artificial Sequence
  Synthetic DNA
aaataccactcacttaag

SEQ ID NO: 21547 - DNA, 18 bp, Artificial Sequence
  Synthetic DNA
aaatacgactcataacag

SEQ ID NO: 21548 - DNA, 18 bp, Artificial Sequence
  Synthetic DNA
aaatacgtctaactttag

SEQ ID NO: 21549 - DNA, 18 bp, Artificial Sequence
  Synthetic DNA
aattacggcacactatag

SEQ ID NO: 21550 - DNA, 18 bp, Artificial Sequence
  Synthetic DNA
aattccgacacactatag

SEQ ID NO: 21551 - DNA, 18 bp, Artificial Sequence
  Synthetic DNA
acacacgactcactaaag

SEQ ID NO: 21552 - DNA, 18 bp, Artificial Sequence
  Synthetic DNA
agataccacacactatag

SEQ ID NO: 21553 - DNA, 18 bp, Artificial Sequence
  Synthetic DNA
atataaaactcactatag

SEQ ID NO: 21554 - DNA, 18 bp, Artificial Sequence
  Synthetic DNA
atatacgaccctctatag

SEQ ID NO: 21555 - DNA, 18 bp, Artificial Sequence
  Synthetic DNA
atatacgacgcactttag

SEQ ID NO: 21556 - DNA, 18 bp, Artificial Sequence
  Synthetic DNA
caataccagtgactatag

SEQ ID NO: 21557 - DNA, 18 bp, Artificial Sequence
  Synthetic DNA
caatacgacatactttag

SEQ ID NO: 21558 - DNA, 18 bp, Artificial Sequence
  Synthetic DNA
caatacgattccctttag

SEQ ID NO: 21559 - DNA, 18 bp, Artificial Sequence
  Synthetic DNA
ctttacgactcactctag

SEQ ID NO: 21560 - DNA, 18 bp, Artificial Sequence
  Synthetic DNA
gattacgtctcacaatag

SEQ ID NO: 21561 - DNA, 18 bp, Artificial Sequence
  Synthetic DNA
gtatacaactcactttag

SEQ ID NO: 21562 - DNA, 18 bp, Artificial Sequence
  Synthetic DNA
taaaaagacagactatag

SEQ ID NO: 21563 - DNA, 18 bp, Artificial Sequence
  Synthetic DNA
taaaaccagtcactaaag

SEQ ID NO: 21564 - DNA, 18 bp, Artificial Sequence
  Synthetic DNA
taaaacgactccctgaag

SEQ ID NO: 21565 - DNA, 18 bp, Artificial Sequence
  Synthetic DNA
taaaacgagtaattatag

SEQ ID NO: 21566 - DNA, 18 bp, Artificial Sequence
  Synthetic DNA
taaaactactcataatag

SEQ ID NO: 21567 - DNA, 18 bp, Artificial Sequence
  Synthetic DNA
taacaagactcacaacag

SEQ ID NO: 21568 - DNA, 18 bp, Artificial Sequence
  Synthetic DNA
taataaaactcattttag

SEQ ID NO: 21569 - DNA, 18 bp, Artificial Sequence
  Synthetic DNA
taataatgctcattatag

SEQ ID NO: 21570 - DNA, 18 bp, Artificial Sequence
  Synthetic DNA
taatacatataactatag

SEQ ID NO: 21571 - DNA, 18 bp, Artificial Sequence
  Synthetic DNA
taatacgactcttactag

SEQ ID NO: 21572 - DNA, 18 bp, Artificial Sequence
  Synthetic DNA
taatacgactcttcatcg

SEQ ID NO: 21573 - DNA, 18 bp, Artificial Sequence
  Synthetic DNA
taatacgatactctatcg

SEQ ID NO: 21574 - DNA, 18 bp, Artificial Sequence
  Synthetic DNA
taatacgattcctaatag

SEQ ID NO: 21575 - DNA, 18 bp, Artificial Sequence
  Synthetic DNA
taatacgattgtcgatag

SEQ ID NO: 21576 - DNA, 18 bp, Artificial Sequence
  Synthetic DNA
taatacgttaaactatag

SEQ ID NO: 21577 - DNA, 18 bp, Artificial Sequence
  Synthetic DNA
taatacgtttcattttag

SEQ ID NO: 21578 - DNA, 18 bp, Artificial Sequence
  Synthetic DNA
taatactacaccctttag

SEQ ID NO: 21579 - DNA, 18 bp, Artificial Sequence
  Synthetic DNA
taatactcctcacaaaag

SEQ ID NO: 21580 - DNA, 18 bp, Artificial Sequence
  Synthetic DNA
taatacttctcactttcg

SEQ ID NO: 21581 - DNA, 18 bp, Artificial Sequence
  Synthetic DNA
taatatgattccctaaag

SEQ ID NO: 21582 - DNA, 18 bp, Artificial Sequence
  Synthetic DNA
taatatgtctcacttcag

SEQ ID NO: 21583 - DNA, 18 bp, Artificial Sequence
  Synthetic DNA
taatgcgattcacttaag

SEQ ID NO: 21584 - DNA, 18 bp, Artificial Sequence
  Synthetic DNA
taatgcgcttcactttag

SEQ ID NO: 21585 - DNA, 18 bp, Artificial Sequence
  Synthetic DNA
taatgcgtctccctttag

SEQ ID NO: 21586 - DNA, 18 bp, Artificial Sequence
  Synthetic DNA
taatgcgtgtcattatag

SEQ ID NO: 21587 - DNA, 18 bp, Artificial Sequence
  Synthetic DNA
tactacgactcagaaaag

SEQ ID NO: 21588 - DNA, 18 bp, Artificial Sequence
  Synthetic DNA
tactacgattcaataaag

SEQ ID NO: 21589 - DNA, 18 bp, Artificial Sequence
  Synthetic DNA
tagtacgtctcccaatag

SEQ ID NO: 21590 - DNA, 18 bp, Artificial Sequence
  Synthetic DNA
tagtactactaattatag

SEQ ID NO: 21591 - DNA, 18 bp, Artificial Sequence
  Synthetic DNA
tagtgctactccctatag

SEQ ID NO: 21592 - DNA, 18 bp, Artificial Sequence
  Synthetic DNA
tataatgactcactacag

SEQ ID NO: 21593 - DNA, 18 bp, Artificial Sequence
  Synthetic DNA
tatcaccactcattatag

SEQ ID NO: 21594 - DNA, 18 bp, Artificial Sequence
  Synthetic DNA
tattaagactctcaatag

SEQ ID NO: 21595 - DNA, 18 bp, Artificial Sequence
  Synthetic DNA
tattaccactcactggag

SEQ ID NO: 21596 - DNA, 18 bp, Artificial Sequence
  Synthetic DNA
tattacgaaatactatag

SEQ ID NO: 21597 - DNA, 18 bp, Artificial Sequence
  Synthetic DNA
tattacgactgtctttag

SEQ ID NO: 21598 - DNA, 18 bp, Artificial Sequence
  Synthetic DNA
tattactatccactatag

SEQ ID NO: 21599 - DNA, 18 bp, Artificial Sequence
  Synthetic DNA
tattatgacacacaatag

SEQ ID NO: 21600 - DNA, 18 bp, Artificial Sequence
  Synthetic DNA
tcacgtgactcactatag

SEQ ID NO: 21601 - DNA, 18 bp, Artificial Sequence
  Synthetic DNA
tcataagtctccctatag

SEQ ID NO: 21602 - DNA, 18 bp, Artificial Sequence
  Synthetic DNA
tcatacgtcttactaaag

SEQ ID NO: 21603 - DNA, 18 bp, Artificial Sequence
  Synthetic DNA
tcttacgtctctctatag

SEQ ID NO: 21604 - DNA, 18 bp, Artificial Sequence
  Synthetic DNA
tcttgcgactcactatcg

SEQ ID NO: 21605 - DNA, 18 bp, Artificial Sequence
  Synthetic DNA
tgatacatctcactatgg

SEQ ID NO: 21606 - DNA, 18 bp, Artificial Sequence
  Synthetic DNA
tgatacgactcatcatgg

SEQ ID NO: 21607 - DNA, 18 bp, Artificial Sequence
  Synthetic DNA
tgatcctactcacaatag

SEQ ID NO: 21608 - DNA, 18 bp, Artificial Sequence
  Synthetic DNA
tgatgcaactcaatatag

SEQ ID NO: 21609 - DNA, 18 bp, Artificial Sequence
  Synthetic DNA
tgttacgcctctctatag

SEQ ID NO: 21610 - DNA, 18 bp, Artificial Sequence
  Synthetic DNA
ttaaacgactcaaaatag

SEQ ID NO: 21611 - DNA, 18 bp, Artificial Sequence
  Synthetic DNA
ttaaacgactcaccctag

SEQ ID NO: 21612 - DNA, 18 bp, Artificial Sequence
  Synthetic DNA
ttacacgcctcactatgg

SEQ ID NO: 21613 - DNA, 18 bp, Artificial Sequence
  Synthetic DNA
ttataaggctcaccatag

SEQ ID NO: 21614 - DNA, 18 bp, Artificial Sequence
  Synthetic DNA
ttatacgaatcacactag

SEQ ID NO: 21615 - DNA, 18 bp, Artificial Sequence
  Synthetic DNA
ttatacgactgagtaaag

SEQ ID NO: 21616 - DNA, 18 bp, Artificial Sequence
  Synthetic DNA
ttatacgtctcaccgtag

SEQ ID NO: 21617 - DNA, 18 bp, Artificial Sequence
  Synthetic DNA
ttatactacaaactatag

SEQ ID NO: 21618 - DNA, 18 bp, Artificial Sequence
  Synthetic DNA
ttatactcctcactttag

SEQ ID NO: 21619 - DNA, 18 bp, Artificial Sequence
  Synthetic DNA
ttataggtctctctatag

SEQ ID NO: 21620 - DNA, 18 bp, Artificial Sequence
  Synthetic DNA
ttatatgtgtcactatag

SEQ ID NO: 21621 - DNA, 18 bp, Artificial Sequence
  Synthetic DNA
ttgtacgactcacaaaag

SEQ ID NO: 21622 - DNA, 18 bp, Artificial Sequence
  Synthetic DNA
aaattcgtctcactattg

SEQ ID NO: 21623 - DNA, 18 bp, Artificial Sequence
  Synthetic DNA
ttattcgactcacaatcg

SEQ ID NO: 21624 - DNA, 18 bp, Artificial Sequence
  Synthetic DNA
tagttcgaatcgctatag

SEQ ID NO: 21625 - DNA, 18 bp, Artificial Sequence
  Synthetic DNA
atatacgcctcactattg

SEQ ID NO: 21626 - DNA, 18 bp, Artificial Sequence
  Synthetic DNA
caaatcgactcacaatag

SEQ ID NO: 21627 - DNA, 18 bp, Artificial Sequence
  Synthetic DNA
taatgcgactctcttttg

SEQ ID NO: 21628 - DNA, 18 bp, Artificial Sequence
  Synthetic DNA
taattcgactttctatcg

SEQ ID NO: 21629 - DNA, 18 bp, Artificial Sequence
  Synthetic DNA
tatttcaactcactaaag

SEQ ID NO: 21630 - DNA, 18 bp, Artificial Sequence
  Synthetic DNA
tatttcgcctcactttag

SEQ ID NO: 21631 - DNA, 18 bp, Artificial Sequence
  Synthetic DNA
ttatatgactctctattg

SEQ ID NO: 21632 - DNA, 18 bp, Artificial Sequence
  Synthetic DNA
ttattcgactctctacag

SEQ ID NO: 21633 - DNA, 18 bp, Artificial Sequence
  Synthetic DNA
aaataagtcgcactatag

SEQ ID NO: 21634 - DNA, 18 bp, Artificial Sequence
  Synthetic DNA
aaatacatctcactctag

SEQ ID NO: 21635 - DNA, 18 bp, Artificial Sequence
  Synthetic DNA
aaatacgactgccaatag

SEQ ID NO: 21636 - DNA, 18 bp, Artificial Sequence
  Synthetic DNA
acaaacgaatcactatag

SEQ ID NO: 21637 - DNA, 18 bp, Artificial Sequence
  Synthetic DNA
caaaaagactcactttag

SEQ ID NO: 21638 - DNA, 18 bp, Artificial Sequence
  Synthetic DNA
taaaacgactctatgtag

SEQ ID NO: 21639 - DNA, 18 bp, Artificial Sequence
  Synthetic DNA
taagacttctctctatag

SEQ ID NO: 21640 - DNA, 18 bp, Artificial Sequence
  Synthetic DNA
taataagaatttctatag

SEQ ID NO: 21641 - DNA, 18 bp, Artificial Sequence
  Synthetic DNA
taatacaactcaaattag

SEQ ID NO: 21642 - DNA, 18 bp, Artificial Sequence
  Synthetic DNA
taatacgtctctcaatcg

SEQ ID NO: 21643 - DNA, 18 bp, Artificial Sequence
  Synthetic DNA
taatacgtctctctaacg

SEQ ID NO: 21644 - DNA, 18 bp, Artificial Sequence
  Synthetic DNA
tattacgactcaaaaaag

SEQ ID NO: 21645 - DNA, 18 bp, Artificial Sequence
  Synthetic DNA
tgatacgactaacaaaag

SEQ ID NO: 21646 - DNA, 18 bp, Artificial Sequence
  Synthetic DNA
ttacacgactcaccacag

SEQ ID NO: 21647 - DNA, 18 bp, Artificial Sequence
  Synthetic DNA
ttataccaatcacaatag

SEQ ID NO: 21648 - DNA, 18 bp, Artificial Sequence
  Synthetic DNA
taattcgactctccattg

SEQ ID NO: 21649 - DNA, 18 bp, Artificial Sequence
  Synthetic DNA
taaaaagactcaccattg

SEQ ID NO: 21650 - DNA, 18 bp, Artificial Sequence
  Synthetic DNA
taaaacgtctcacttttg

SEQ ID NO: 21651 - DNA, 18 bp, Artificial Sequence
  Synthetic DNA
taatacgtatcactaatg

SEQ ID NO: 21652 - DNA, 18 bp, Artificial Sequence
  Synthetic DNA
tattactaatcactattg

SEQ ID NO: 21653 - DNA, 18 bp, Artificial Sequence
  Synthetic DNA
tatttcgtcgcactatag

SEQ ID NO: 21654 - DNA, 18 bp, Artificial Sequence
  Synthetic DNA
tcttacgacttactaaag

SEQ ID NO: 21655 - DNA, 18 bp, Artificial Sequence
  Synthetic DNA
ttttacgactcacaatgg

SEQ ID NO: 21656 - DNA, 18 bp, Artificial Sequence
  Synthetic DNA
taattagactcacttttg

SEQ ID NO: 21657 - DNA, 18 bp, Artificial Sequence
  Synthetic DNA
taaatcgactcactttcg

SEQ ID NO: 21658 - DNA, 18 bp, Artificial Sequence
  Synthetic DNA
taatacgtctcacaactg

SEQ ID NO: 21659 - DNA, 18 bp, Artificial Sequence
  Synthetic DNA
tataacgactcactactg

SEQ ID NO: 21660 - DNA, 18 bp, Artificial Sequence
  Synthetic DNA
ttatacgagtctctttag

SEQ ID NO: 21661 - DNA, 18 bp, Artificial Sequence
  Synthetic DNA
ttttacaactaactatag

SEQ ID NO: 21662 - DNA, 18 bp, Artificial Sequence
  Synthetic DNA
ttaatcgactcactattg

SEQ ID NO: 21663 - DNA, 18 bp, Artificial Sequence
  Synthetic DNA
tataaagcctcactatag

SEQ ID NO: 21664 - DNA, 18 bp, Artificial Sequence
  Synthetic DNA
tataacaactcactaaag

SEQ ID NO: 21665 - DNA, 18 bp, Artificial Sequence
  Synthetic DNA
tatctcgtctcactatag

SEQ ID NO: 21666 - DNA, 18 bp, Artificial Sequence
  Synthetic DNA
aaattcgactcaatattg

SEQ ID NO: 21667 - DNA, 18 bp, Artificial Sequence
  Synthetic DNA
aaattcggctcactattg

SEQ ID NO: 21668 - DNA, 18 bp, Artificial Sequence
  Synthetic DNA
gaatatgactcgctattg

SEQ ID NO: 21669 - DNA, 18 bp, Artificial Sequence
  Synthetic DNA
gagttcgactcactattg

SEQ ID NO: 21670 - DNA, 18 bp, Artificial Sequence
  Synthetic DNA
taaaacgaatcgctattg

SEQ ID NO: 21671 - DNA, 18 bp, Artificial Sequence
  Synthetic DNA
taaaacgactcgcgattg

SEQ ID NO: 21672 - DNA, 18 bp, Artificial Sequence
  Synthetic DNA
taatacgatttgctattg

SEQ ID NO: 21673 - DNA, 18 bp, Artificial Sequence
  Synthetic DNA
taatacgtctcgctgttg

SEQ ID NO: 21674 - DNA, 18 bp, Artificial Sequence
  Synthetic DNA
taatgcgactcgttattg

SEQ ID NO: 21675 - DNA, 18 bp, Artificial Sequence
  Synthetic DNA
taatgctactcgctattg

SEQ ID NO: 21676 - DNA, 18 bp, Artificial Sequence
  Synthetic DNA
taattccactcgttatag

SEQ ID NO: 21677 - DNA, 18 bp, Artificial Sequence
  Synthetic DNA
taattcgacgtactattg

SEQ ID NO: 21678 - DNA, 18 bp, Artificial Sequence
  Synthetic DNA
taattcgcctcacttttg

SEQ ID NO: 21679 - DNA, 18 bp, Artificial Sequence
  Synthetic DNA
taattctcctcgctatag

SEQ ID NO: 21680 - DNA, 18 bp, Artificial Sequence
  Synthetic DNA
taattggactagctatag

SEQ ID NO: 21681 - DNA, 18 bp, Artificial Sequence
  Synthetic DNA
taatttgcctcactattg

SEQ ID NO: 21682 - DNA, 18 bp, Artificial Sequence
  Synthetic DNA
tatttcggctcgctatag

SEQ ID NO: 21683 - DNA, 18 bp, Artificial Sequence
  Synthetic DNA
tcatacgaatcgctattg

SEQ ID NO: 21684 - DNA, 18 bp, Artificial Sequence
  Synthetic DNA
tgatacgactagctattg

SEQ ID NO: 21685 - DNA, 18 bp, Artificial Sequence
  Synthetic DNA
aaataagactcaccattg

SEQ ID NO: 21686 - DNA, 18 bp, Artificial Sequence
  Synthetic DNA
aaatacgacaagctatag

SEQ ID NO: 21687 - DNA, 18 bp, Artificial Sequence
  Synthetic DNA
aaatacgacctactattg

SEQ ID NO: 21688 - DNA, 18 bp, Artificial Sequence
  Synthetic DNA
aaatacgactgactaatg

SEQ ID NO: 21689 - DNA, 18 bp, Artificial Sequence
  Synthetic DNA
aaataggactaactattg

SEQ ID NO: 21690 - DNA, 18 bp, Artificial Sequence
  Synthetic DNA
aaatatgattcactattg

SEQ ID NO: 21691 - DNA, 18 bp, Artificial Sequence
  Synthetic DNA
aaatccgtctcactattg

SEQ ID NO: 21692 - DNA, 18 bp, Artificial Sequence
  Synthetic DNA
aaattccactcactctag

SEQ ID NO: 21693 - DNA, 18 bp, Artificial Sequence
  Synthetic DNA
aaattccgctcactatag

SEQ ID NO: 21694 - DNA, 18 bp, Artificial Sequence
  Synthetic DNA
aactacgactctctattg

SEQ ID NO: 21695 - DNA, 18 bp, Artificial Sequence
  Synthetic DNA
aattacgacccactattg

SEQ ID NO: 21696 - DNA, 18 bp, Artificial Sequence
  Synthetic DNA
aattacgtctcgctatag

SEQ ID NO: 21697 - DNA, 18 bp, Artificial Sequence
  Synthetic DNA
acattcgactcactacag

SEQ ID NO: 21698 - DNA, 18 bp, Artificial Sequence
  Synthetic DNA
acattcgactcattatag

SEQ ID NO: 21699 - DNA, 18 bp, Artificial Sequence
  Synthetic DNA
agatacgaatcactattg

SEQ ID NO: 21700 - DNA, 18 bp, Artificial Sequence
  Synthetic DNA
agatacgactcactcttg

SEQ ID NO: 21701 - DNA, 18 bp, Artificial Sequence
  Synthetic DNA
caaaacgactcacaattg

SEQ ID NO: 21702 - DNA, 18 bp, Artificial Sequence
  Synthetic DNA
caaaacgactcattattg

SEQ ID NO: 21703 - DNA, 18 bp, Artificial Sequence
  Synthetic DNA
caacacgactcacaattg

SEQ ID NO: 21704 - DNA, 18 bp, Artificial Sequence
  Synthetic DNA
caagaccactcactattg

SEQ ID NO: 21705 - DNA, 18 bp, Artificial Sequence
  Synthetic DNA
caatacgacttactagtg

SEQ ID NO: 21706 - DNA, 18 bp, Artificial Sequence
  Synthetic DNA
caatacgattcactgttg

SEQ ID NO: 21707 - DNA, 18 bp, Artificial Sequence
  Synthetic DNA
caatacgtctcactactg

SEQ ID NO: 21708 - DNA, 18 bp, Artificial Sequence
  Synthetic DNA
caattcgaatcactctag

SEQ ID NO: 21709 - DNA, 18 bp, Artificial Sequence
  Synthetic DNA
ctatacgactcactatta

SEQ ID NO: 21710 - DNA, 18 bp, Artificial Sequence
  Synthetic DNA
ctatacggctcactattg

SEQ ID NO: 21711 - DNA, 18 bp, Artificial Sequence
  Synthetic DNA
ctctacgactcactattg

SEQ ID NO: 21712 - DNA, 18 bp, Artificial Sequence
  Synthetic DNA
ctttacgactcactattg

SEQ ID NO: 21713 - DNA, 18 bp, Artificial Sequence
  Synthetic DNA
gaaaacgtctcactattg

SEQ ID NO: 21714 - DNA, 18 bp, Artificial Sequence
  Synthetic DNA
gaatacgtctcactcttg

SEQ ID NO: 21715 - DNA, 18 bp, Artificial Sequence
  Synthetic DNA
gaatactactcgctttag

SEQ ID NO: 21716 - DNA, 18 bp, Artificial Sequence
  Synthetic DNA
gaatgcgtctcgctatag

SEQ ID NO: 21717 - DNA, 18 bp, Artificial Sequence
  Synthetic DNA
gaattcgactcacactag

SEQ ID NO: 21718 - DNA, 18 bp, Artificial Sequence
  Synthetic DNA
gaattcgattcactttag

SEQ ID NO: 21719 - DNA, 18 bp, Artificial Sequence
  Synthetic DNA
gattacgactcactcttg

SEQ ID NO: 21720 - DNA, 18 bp, Artificial Sequence
  Synthetic DNA
gtatacgacttgctatag

SEQ ID NO: 21721 - DNA, 18 bp, Artificial Sequence
  Synthetic DNA
taaaacgactccccattg

SEQ ID NO: 21722 - DNA, 18 bp, Artificial Sequence
  Synthetic DNA
taaaacgactcgctaacg

SEQ ID NO: 21723 - DNA, 18 bp, Artificial Sequence
  Synthetic DNA
taaaacgagccactattg

SEQ ID NO: 21724 - DNA, 18 bp, Artificial Sequence
  Synthetic DNA
taaagcgacccactattg

SEQ ID NO: 21725 - DNA, 18 bp, Artificial Sequence
  Synthetic DNA
taaatcgactcactaccg

SEQ ID NO: 21726 - DNA, 18 bp, Artificial Sequence
  Synthetic DNA
taaatcgcctcacaatag

SEQ ID NO: 21727 - DNA, 18 bp, Artificial Sequence
  Synthetic DNA
taaattgactcactaaag

SEQ ID NO: 21728 - DNA, 18 bp, Artificial Sequence
  Synthetic DNA
taacacgacacgctatcg

SEQ ID NO: 21729 - DNA, 18 bp, Artificial Sequence
  Synthetic DNA
taacacgacacgctgtag

SEQ ID NO: 21730 - DNA, 18 bp, Artificial Sequence
  Synthetic DNA
taacacgacccattattg

SEQ ID NO: 21731 - DNA, 18 bp, Artificial Sequence
  Synthetic DNA
taacaggactcattattg

SEQ ID NO: 21732 - DNA, 18 bp, Artificial Sequence
  Synthetic DNA
taacatgcctcactattg

SEQ ID NO: 21733 - DNA, 18 bp, Artificial Sequence
  Synthetic DNA
taacccgactctctattg

SEQ ID NO: 21734 - DNA, 18 bp, Artificial Sequence
  Synthetic DNA
taactcgaccaactatag

SEQ ID NO: 21735 - DNA, 18 bp, Artificial Sequence
  Synthetic DNA
taactcgactcaccttag

SEQ ID NO: 21736 - DNA, 18 bp, Artificial Sequence
  Synthetic DNA
taagaccactctctattg

SEQ ID NO: 21737 - DNA, 18 bp, Artificial Sequence
  Synthetic DNA
taagacgacccacttttg

SEQ ID NO: 21738 - DNA, 18 bp, Artificial Sequence
  Synthetic DNA
taagagaactcactattg

SEQ ID NO: 21739 - DNA, 18 bp, Artificial Sequence
  Synthetic DNA
taataagaatggctatag

SEQ ID NO: 21740 - DNA, 18 bp, Artificial Sequence
  Synthetic DNA
taataagccacgctatag

SEQ ID NO: 21741 - DNA, 18 bp, Artificial Sequence
  Synthetic DNA
taataagcctcactgttg

SEQ ID NO: 21742 - DNA, 18 bp, Artificial Sequence
  Synthetic DNA
taatacaacacaccattg

SEQ ID NO: 21743 - DNA, 18 bp, Artificial Sequence
  Synthetic DNA
taatacaactagatatag

SEQ ID NO: 21744 - DNA, 18 bp, Artificial Sequence
  Synthetic DNA
taatacaactcagttttg

SEQ ID NO: 21745 - DNA, 18 bp, Artificial Sequence
  Synthetic DNA
taatacaactcgttacag

SEQ ID NO: 21746 - DNA, 18 bp, Artificial Sequence
  Synthetic DNA
taatacaattcgctatgg

SEQ ID NO: 21747 - DNA, 18 bp, Artificial Sequence
  Synthetic DNA
taatacaattgactattg

SEQ ID NO: 21748 - DNA, 18 bp, Artificial Sequence
  Synthetic DNA
taataccactcaatcttg

SEQ ID NO: 21749 - DNA, 18 bp, Artificial Sequence
  Synthetic DNA
taataccactcacgactg

SEQ ID NO: 21750 - DNA, 18 bp, Artificial Sequence
  Synthetic DNA
taatacgaatcaatactg

SEQ ID NO: 21751 - DNA, 18 bp, Artificial Sequence
  Synthetic DNA
taatacgacacacagttg

SEQ ID NO: 21752 - DNA, 18 bp, Artificial Sequence
  Synthetic DNA
taatacgacagattattg

SEQ ID NO: 21753 - DNA, 18 bp, Artificial Sequence
  Synthetic DNA
taatacgacctgcgatag

SEQ ID NO: 21754 - DNA, 18 bp, Artificial Sequence
  Synthetic DNA
taatacgactaaatagtg

SEQ ID NO: 21755 - DNA, 18 bp, Artificial Sequence
  Synthetic DNA
taatacgactcagttatg

SEQ ID NO: 21756 - DNA, 18 bp, Artificial Sequence
  Synthetic DNA
taatacgactccatactg

SEQ ID NO: 21757 - DNA, 18 bp, Artificial Sequence
  Synthetic DNA
taatacgactctcctttg

SEQ ID NO: 21758 - DNA, 18 bp, Artificial Sequence
  Synthetic DNA
taatacgacttgcaaaag

SEQ ID NO: 21759 - DNA, 18 bp, Artificial Sequence
  Synthetic DNA
taatacgagtcccaattg

SEQ ID NO: 21760 - DNA, 18 bp, Artificial Sequence
  Synthetic DNA
taatacgagtcgatagag

SEQ ID NO: 21761 - DNA, 18 bp, Artificial Sequence
  Synthetic DNA
taatacgatccgcaatag

SEQ ID NO: 21762 - DNA, 18 bp, Artificial Sequence
  Synthetic DNA
taatacgattctcgattg

SEQ ID NO: 21763 - DNA, 18 bp, Artificial Sequence
  Synthetic DNA
taatacgcatcgctagag

SEQ ID NO: 21764 - DNA, 18 bp, Artificial Sequence
  Synthetic DNA
taatacgccacactgttg

SEQ ID NO: 21765 - DNA, 18 bp, Artificial Sequence
  Synthetic DNA
taatacgccccactagtg

SEQ ID NO: 21766 - DNA, 18 bp, Artificial Sequence
  Synthetic DNA
taatacgcctaacgattg

SEQ ID NO: 21767 - DNA, 18 bp, Artificial Sequence
  Synthetic DNA
taatacgcctccctaatg

SEQ ID NO: 21768 - DNA, 18 bp, Artificial Sequence
  Synthetic DNA
taatacgcctcgcattag

SEQ ID NO: 21769 - DNA, 18 bp, Artificial Sequence
  Synthetic DNA
taatacggatctctattg

SEQ ID NO: 21770 - DNA, 18 bp, Artificial Sequence
  Synthetic DNA
taatacggcttactcttg

SEQ ID NO: 21771 - DNA, 18 bp, Artificial Sequence
  Synthetic DNA
taatacgtctaactagtg

SEQ ID NO: 21772 - DNA, 18 bp, Artificial Sequence
  Synthetic DNA
taatacgtctcattcttg

SEQ ID NO: 21773 - DNA, 18 bp, Artificial Sequence
  Synthetic DNA
taatacgtcttggtatag

SEQ ID NO: 21774 - DNA, 18 bp, Artificial Sequence
  Synthetic DNA
taatacgtgtcactactg

SEQ ID NO: 21775 - DNA, 18 bp, Artificial Sequence
  Synthetic DNA
taatactacacactcttg

SEQ ID NO: 21776 - DNA, 18 bp, Artificial Sequence
  Synthetic DNA
taatactactcaccactg

SEQ ID NO: 21777 - DNA, 18 bp, Artificial Sequence
  Synthetic DNA
taatactactccctactg

SEQ ID NO: 21778 - DNA, 18 bp, Artificial Sequence
  Synthetic DNA
taatactactggctgtag

SEQ ID NO: 21779 - DNA, 18 bp, Artificial Sequence
  Synthetic DNA
taatagcactcacttttg

SEQ ID NO: 21780 - DNA, 18 bp, Artificial Sequence
  Synthetic DNA
taataggaatcgccatag

SEQ ID NO: 21781 - DNA, 18 bp, Artificial Sequence
  Synthetic DNA
taataggactctcaattg

SEQ ID NO: 21782 - DNA, 18 bp, Artificial Sequence
  Synthetic DNA
taatagtactaactattg

SEQ ID NO: 21783 - DNA, 18 bp, Artificial Sequence
  Synthetic DNA
taatatcactcgctaaag

SEQ ID NO: 21784 - DNA, 18 bp, Artificial Sequence
  Synthetic DNA
taatattactcgatatag

SEQ ID NO: 21785 - DNA, 18 bp, Artificial Sequence
  Synthetic DNA
taatcagactaactattg

SEQ ID NO: 21786 - DNA, 18 bp, Artificial Sequence
  Synthetic DNA
taatccgacttactgttg

SEQ ID NO: 21787 - DNA, 18 bp, Artificial Sequence
  Synthetic DNA
taatccgcctcacttttg

SEQ ID NO: 21788 - DNA, 18 bp, Artificial Sequence
  Synthetic DNA
taatgccactcactgttg

SEQ ID NO: 21789 - DNA, 18 bp, Artificial Sequence
  Synthetic DNA
taatgcgagtcactagtg

SEQ ID NO: 21790 - DNA, 18 bp, Artificial Sequence
  Synthetic DNA
taatgcgtctcaccattg

SEQ ID NO: 21791 - DNA, 18 bp, Artificial Sequence
  Synthetic DNA
taatgctactcgctacag

SEQ ID NO: 21792 - DNA, 18 bp, Artificial Sequence
  Synthetic DNA
taatgctactgactattg

SEQ ID NO: 21793 - DNA, 18 bp, Artificial Sequence
  Synthetic DNA
taattagaatcactacag

SEQ ID NO: 21794 - DNA, 18 bp, Artificial Sequence
  Synthetic DNA
taattagacacactagag

SEQ ID NO: 21795 - DNA, 18 bp, Artificial Sequence
  Synthetic DNA
taattagactcacaatgg

SEQ ID NO: 21796 - DNA, 18 bp, Artificial Sequence
  Synthetic DNA
taattagactccatatag

SEQ ID NO: 21797 - DNA, 18 bp, Artificial Sequence
  Synthetic DNA
taattagacttacgatag

SEQ ID NO: 21798 - DNA, 18 bp, Artificial Sequence
  Synthetic DNA
taattagtctcactctag

SEQ ID NO: 21799 - DNA, 18 bp, Artificial Sequence
  Synthetic DNA
taattcaacacagtatag

SEQ ID NO: 21800 - DNA, 18 bp, Artificial Sequence
  Synthetic DNA
taattccactcacaacag

SEQ ID NO: 21801 - DNA, 18 bp, Artificial Sequence
  Synthetic DNA
taattccactgattatag

SEQ ID NO: 21802 - DNA, 18 bp, Artificial Sequence
  Synthetic DNA
taattcgaatcattatgg

SEQ ID NO: 21803 - DNA, 18 bp, Artificial Sequence
  Synthetic DNA
taattcgacagactaaag

SEQ ID NO: 21804 - DNA, 18 bp, Artificial Sequence
  Synthetic DNA
taattcgacatacaatag

SEQ ID NO: 21805 - DNA, 18 bp, Artificial Sequence
  Synthetic DNA
taattcgactaacaatgg

SEQ ID NO: 21806 - DNA, 18 bp, Artificial Sequence
  Synthetic DNA
taattcgactctaaatag

SEQ ID NO: 21807 - DNA, 18 bp, Artificial Sequence
  Synthetic DNA
taattcgatgaactatag

SEQ ID NO: 21808 - DNA, 18 bp, Artificial Sequence
  Synthetic DNA
taattcgcataactatag

SEQ ID NO: 21809 - DNA, 18 bp, Artificial Sequence
  Synthetic DNA
taattcgccacactctag

SEQ ID NO: 21810 - DNA, 18 bp, Artificial Sequence
  Synthetic DNA
taattcgtctgcctatag

SEQ ID NO: 21811 - DNA, 18 bp, Artificial Sequence
  Synthetic DNA
taattctaatcactacag

SEQ ID NO: 21812 - DNA, 18 bp, Artificial Sequence
  Synthetic DNA
taattctactcattttag

SEQ ID NO: 21813 - DNA, 18 bp, Artificial Sequence
  Synthetic DNA
taattctactctccatag

SEQ ID NO: 21814 - DNA, 18 bp, Artificial Sequence
  Synthetic DNA
taattctattcactatcg

SEQ ID NO: 21815 - DNA, 18 bp, Artificial Sequence
  Synthetic DNA
taattggactcacttgag

SEQ ID NO: 21816 - DNA, 18 bp, Artificial Sequence
  Synthetic DNA
taattggtctaactatag

SEQ ID NO: 21817 - DNA, 18 bp, Artificial Sequence
  Synthetic DNA
taatttgactaaatatag

SEQ ID NO: 21818 - DNA, 18 bp, Artificial Sequence
  Synthetic DNA
taatttgactcattacag

SEQ ID NO: 21819 - DNA, 18 bp, Artificial Sequence
  Synthetic DNA
taatttgactctctatcg

SEQ ID NO: 21820 - DNA, 18 bp, Artificial Sequence
  Synthetic DNA
taatttgactgattatag

SEQ ID NO: 21821 - DNA, 18 bp, Artificial Sequence
  Synthetic DNA
taatttgattcactgtag

SEQ ID NO: 21822 - DNA, 18 bp, Artificial Sequence
  Synthetic DNA
taatttgcctcaatatag

SEQ ID NO: 21823 - DNA, 18 bp, Artificial Sequence
  Synthetic DNA
taattttactcactgtag

SEQ ID NO: 21824 - DNA, 18 bp, Artificial Sequence
  Synthetic DNA
tacatcgactcaccatag

SEQ ID NO: 21825 - DNA, 18 bp, Artificial Sequence
  Synthetic DNA
tactacgactagctaaag

SEQ ID NO: 21826 - DNA, 18 bp, Artificial Sequence
  Synthetic DNA
tactacgactcaccaatg

SEQ ID NO: 21827 - DNA, 18 bp, Artificial Sequence
  Synthetic DNA
tactacgactcgcaaaag

SEQ ID NO: 21828 - DNA, 18 bp, Artificial Sequence
  Synthetic DNA
tactacgactcggaatag

SEQ ID NO: 21829 - DNA, 18 bp, Artificial Sequence
  Synthetic DNA
tactacgtctcagtattg

SEQ ID NO: 21830 - DNA, 18 bp, Artificial Sequence
  Synthetic DNA
tacttcgaatcattatag

SEQ ID NO: 21831 - DNA, 18 bp, Artificial Sequence
  Synthetic DNA
tacttcgactaactatcg

SEQ ID NO: 21832 - DNA, 18 bp, Artificial Sequence
  Synthetic DNA
tacttcgatacactatag

SEQ ID NO: 21833 - DNA, 18 bp, Artificial Sequence
  Synthetic DNA
tacttggactcaatatag

SEQ ID NO: 21834 - DNA, 18 bp, Artificial Sequence
  Synthetic DNA
tagtacgactaaatattg

SEQ ID NO: 21835 - DNA, 18 bp, Artificial Sequence
  Synthetic DNA
tagtacgattctctattg

SEQ ID NO: 21836 - DNA, 18 bp, Artificial Sequence
  Synthetic DNA
tagtaggactgactattg

SEQ ID NO: 21837 - DNA, 18 bp, Artificial Sequence
  Synthetic DNA
tagttcgacgcacaatag

SEQ ID NO: 21838 - DNA, 18 bp, Artificial Sequence
  Synthetic DNA
tatcaccactcactattg

SEQ ID NO: 21839 - DNA, 18 bp, Artificial Sequence
  Synthetic DNA
tatgacgactcaccattg

SEQ ID NO: 21840 - DNA, 18 bp, Artificial Sequence
  Synthetic DNA
tattacgactcaatcttg

SEQ ID NO: 21841 - DNA, 18 bp, Artificial Sequence
  Synthetic DNA
tattacgattcagtattg

SEQ ID NO: 21842 - DNA, 18 bp, Artificial Sequence
  Synthetic DNA
tattaggactcactactg

SEQ ID NO: 21843 - DNA, 18 bp, Artificial Sequence
  Synthetic DNA
tatttagactcactctag

SEQ ID NO: 21844 - DNA, 18 bp, Artificial Sequence
  Synthetic DNA
tatttagactctctatag

SEQ ID NO: 21845 - DNA, 18 bp, Artificial Sequence
  Synthetic DNA
tatttcgactcagcatag

SEQ ID NO: 21846 - DNA, 18 bp, Artificial Sequence
  Synthetic DNA
tatttcgactcattacag

SEQ ID NO: 21847 - DNA, 18 bp, Artificial Sequence
  Synthetic DNA
tatttcgattcactctag

SEQ ID NO: 21848 - DNA, 18 bp, Artificial Sequence
  Synthetic DNA
tatttcgattcattatag

SEQ ID NO: 21849 - DNA, 18 bp, Artificial Sequence
  Synthetic DNA
tatttctacgcactatag

SEQ ID NO: 21850 - DNA, 18 bp, Artificial Sequence
  Synthetic DNA
tatttctactcactatcg

SEQ ID NO: 21851 - DNA, 18 bp, Artificial Sequence
  Synthetic DNA
tatttggactcacaatag

SEQ ID NO: 21852 - DNA, 18 bp, Artificial Sequence
  Synthetic DNA
tatttgggctcactatag

SEQ ID NO: 21853 - DNA, 18 bp, Artificial Sequence
  Synthetic DNA
tattttgattcactatag

SEQ ID NO: 21854 - DNA, 18 bp, Artificial Sequence
  Synthetic DNA
tcacacaactcactattg

SEQ ID NO: 21855 - DNA, 18 bp, Artificial Sequence
  Synthetic DNA
tcatacgactcactggtg

SEQ ID NO: 21856 - DNA, 18 bp, Artificial Sequence
  Synthetic DNA
tcatacgactcataattg

SEQ ID NO: 21857 - DNA, 18 bp, Artificial Sequence
  Synthetic DNA
tcatactacttactattg

SEQ ID NO: 21858 - DNA, 18 bp, Artificial Sequence
  Synthetic DNA
tcatgcgactcacaattg

SEQ ID NO: 21859 - DNA, 18 bp, Artificial Sequence
  Synthetic DNA
tcattagactcactgtag

SEQ ID NO: 21860 - DNA, 18 bp, Artificial Sequence
  Synthetic DNA
tcattcgactctctaaag

SEQ ID NO: 21861 - DNA, 18 bp, Artificial Sequence
  Synthetic DNA
tcattcgcctcattatag

SEQ ID NO: 21862 - DNA, 18 bp, Artificial Sequence
  Synthetic DNA
tcatttgactctctatag

SEQ ID NO: 21863 - DNA, 18 bp, Artificial Sequence
  Synthetic DNA
tcccacgactcactattg

SEQ ID NO: 21864 - DNA, 18 bp, Artificial Sequence
  Synthetic DNA
tgaaacgacgcactattg

SEQ ID NO: 21865 - DNA, 18 bp, Artificial Sequence
  Synthetic DNA
tgacacgacacactattg

SEQ ID NO: 21866 - DNA, 18 bp, Artificial Sequence
  Synthetic DNA
tgataagactaactattg

SEQ ID NO: 21867 - DNA, 18 bp, Artificial Sequence
  Synthetic DNA
tgatacctctcgctatag

SEQ ID NO: 21868 - DNA, 18 bp, Artificial Sequence
  Synthetic DNA
tgatacgacacagtattg

SEQ ID NO: 21869 - DNA, 18 bp, Artificial Sequence
  Synthetic DNA
tgatacgacacgcaatag

SEQ ID NO: 21870 - DNA, 18 bp, Artificial Sequence
  Synthetic DNA
tgatacgacacgctacag

SEQ ID NO: 21871 - DNA, 18 bp, Artificial Sequence
  Synthetic DNA
tgatacgacccacaattg

SEQ ID NO: 21872 - DNA, 18 bp, Artificial Sequence
  Synthetic DNA
tgatacgacttacttttg

SEQ ID NO: 21873 - DNA, 18 bp, Artificial Sequence
  Synthetic DNA
tgatacgtctcgctatcg

SEQ ID NO: 21874 - DNA, 18 bp, Artificial Sequence
  Synthetic DNA
tgatatgactcacttttg

SEQ ID NO: 21875 - DNA, 18 bp, Artificial Sequence
  Synthetic DNA
tgatatgacttactattg

SEQ ID NO: 21876 - DNA, 18 bp, Artificial Sequence
  Synthetic DNA
tgatgcgactcactactg

SEQ ID NO: 21877 - DNA, 18 bp, Artificial Sequence
  Synthetic DNA
tgattcgacccactaaag

SEQ ID NO: 21878 - DNA, 18 bp, Artificial Sequence
  Synthetic DNA
tgattcgactcaataaag

SEQ ID NO: 21879 - DNA, 18 bp, Artificial Sequence
  Synthetic DNA
tgattggactcactatcg

SEQ ID NO: 21880 - DNA, 18 bp, Artificial Sequence
  Synthetic DNA
tgatttgacacactatag

SEQ ID NO: 21881 - DNA, 18 bp, Artificial Sequence
  Synthetic DNA
tgtttcgagtcactatag

SEQ ID NO: 21882 - DNA, 18 bp, Artificial Sequence
  Synthetic DNA
ttacacgactcactaatg

SEQ ID NO: 21883 - DNA, 18 bp, Artificial Sequence
  Synthetic DNA
ttacacgactccctattg

SEQ ID NO: 21884 - DNA, 18 bp, Artificial Sequence
  Synthetic DNA
ttacacgactcgcaatag

SEQ ID NO: 21885 - DNA, 18 bp, Artificial Sequence
  Synthetic DNA
ttataagacgcactattg

SEQ ID NO: 21886 - DNA, 18 bp, Artificial Sequence
  Synthetic DNA
ttataagactcaccattg

SEQ ID NO: 21887 - DNA, 18 bp, Artificial Sequence
  Synthetic DNA
ttataagactcgctttag

SEQ ID NO: 21888 - DNA, 18 bp, Artificial Sequence
  Synthetic DNA
ttataccactagctatag

SEQ ID NO: 21889 - DNA, 18 bp, Artificial Sequence
  Synthetic DNA
ttataccactcgctacag

SEQ ID NO: 21890 - DNA, 18 bp, Artificial Sequence
  Synthetic DNA
ttatacgactaactcttg

SEQ ID NO: 21891 - DNA, 18 bp, Artificial Sequence
  Synthetic DNA
ttatacgactcagtcttg

SEQ ID NO: 21892 - DNA, 18 bp, Artificial Sequence
  Synthetic DNA
ttatacgactcgctcaag

SEQ ID NO: 21893 - DNA, 18 bp, Artificial Sequence
  Synthetic DNA
ttatacgattcgctatcg

SEQ ID NO: 21894 - DNA, 18 bp, Artificial Sequence
  Synthetic DNA
ttatacgcttcgctatag

SEQ ID NO: 21895 - DNA, 18 bp, Artificial Sequence
  Synthetic DNA
ttatacggatcgctatag

SEQ ID NO: 21896 - DNA, 18 bp, Artificial Sequence
  Synthetic DNA
ttatacggctcacaattg

SEQ ID NO: 21897 - DNA, 18 bp, Artificial Sequence
  Synthetic DNA
ttataggactcaatattg

SEQ ID NO: 21898 - DNA, 18 bp, Artificial Sequence
  Synthetic DNA
ttatccgacttactattg

SEQ ID NO: 21899 - DNA, 18 bp, Artificial Sequence
  Synthetic DNA
ttattcgactcacgaaag

SEQ ID NO: 21900 - DNA, 18 bp, Artificial Sequence
  Synthetic DNA
ttattcgactcactctgg

SEQ ID NO: 21901 - DNA, 18 bp, Artificial Sequence
  Synthetic DNA
ttattcgactcattgtag

SEQ ID NO: 21902 - DNA, 18 bp, Artificial Sequence
  Synthetic DNA
ttattcgactctctagag

SEQ ID NO: 21903 - DNA, 18 bp, Artificial Sequence
  Synthetic DNA
ttattcgagtcactatgg

SEQ ID NO: 21904 - DNA, 18 bp, Artificial Sequence
  Synthetic DNA
ttattcgattcactctag

SEQ ID NO: 21905 - DNA, 18 bp, Artificial Sequence
  Synthetic DNA
ttattcgcctcattatag

SEQ ID NO: 21906 - DNA, 18 bp, Artificial Sequence
  Synthetic DNA
ttattcgtcgcactatag

SEQ ID NO: 21907 - DNA, 18 bp, Artificial Sequence
  Synthetic DNA
tttttcgacttactatag

SEQ ID NO: 21908 - DNA, 18 bp, Artificial Sequence
  Synthetic DNA
aaaaacgcctcactatgg

SEQ ID NO: 21909 - DNA, 18 bp, Artificial Sequence
  Synthetic DNA
aaaaacgtctaactatag

SEQ ID NO: 21910 - DNA, 18 bp, Artificial Sequence
  Synthetic DNA
aaaaacgtctcactagag

SEQ ID NO: 21911 - DNA, 18 bp, Artificial Sequence
  Synthetic DNA
aaaaactattcactatag

SEQ ID NO: 21912 - DNA, 18 bp, Artificial Sequence
  Synthetic DNA
aaacaagactcattatag

SEQ ID NO: 21913 - DNA, 18 bp, Artificial Sequence
  Synthetic DNA
aaacacgtctcactgtag

SEQ ID NO: 21914 - DNA, 18 bp, Artificial Sequence
  Synthetic DNA
aaacacgtctcattatag

SEQ ID NO: 21915 - DNA, 18 bp, Artificial Sequence
  Synthetic DNA
aaacactactgactatag

SEQ ID NO: 21916 - DNA, 18 bp, Artificial Sequence
  Synthetic DNA
aaagacgtctcactttag

SEQ ID NO: 21917 - DNA, 18 bp, Artificial Sequence
  Synthetic DNA
aaataagactcaatacag

SEQ ID NO: 21918 - DNA, 18 bp, Artificial Sequence
  Synthetic DNA
aaataaggctcattatag

SEQ ID NO: 21919 - DNA, 18 bp, Artificial Sequence
  Synthetic DNA
aaatacaaatcattatag

SEQ ID NO: 21920 - DNA, 18 bp, Artificial Sequence
  Synthetic DNA
aaatacaacaaactatag

SEQ ID NO: 21921 - DNA, 18 bp, Artificial Sequence
  Synthetic DNA
aaatacaactcacaacag

SEQ ID NO: 21922 - DNA, 18 bp, Artificial Sequence
  Synthetic DNA
aaatacaattcactatgg

SEQ ID NO: 21923 - DNA, 18 bp, Artificial Sequence
  Synthetic DNA
aaataccactcagtctag

SEQ ID NO: 21924 - DNA, 18 bp, Artificial Sequence
  Synthetic DNA
aaataccatttactatag

SEQ ID NO: 21925 - DNA, 18 bp, Artificial Sequence
  Synthetic DNA
aaatacgaatcactcaag

SEQ ID NO: 21926 - DNA, 18 bp, Artificial Sequence
  Synthetic DNA
aaatacgacccaatatcg

SEQ ID NO: 21927 - DNA, 18 bp, Artificial Sequence
  Synthetic DNA
aaatacgacccatcatag

SEQ ID NO: 21928 - DNA, 18 bp, Artificial Sequence
  Synthetic DNA
aaatacgactctctctcg

SEQ ID NO: 21929 - DNA, 18 bp, Artificial Sequence
  Synthetic DNA
aaatacgattcaaaatag

SEQ ID NO: 21930 - DNA, 18 bp, Artificial Sequence
  Synthetic DNA
aaatacgattcaccatcg

SEQ ID NO: 21931 - DNA, 18 bp, Artificial Sequence
  Synthetic DNA
aaatacgattcccaatag

SEQ ID NO: 21932 - DNA, 18 bp, Artificial Sequence
  Synthetic DNA
aaatacgcctcaccaaag

SEQ ID NO: 21933 - DNA, 18 bp, Artificial Sequence
  Synthetic DNA
aaatacggctcattctag

SEQ ID NO: 21934 - DNA, 18 bp, Artificial Sequence
  Synthetic DNA
aaatacgtctctctgtag

SEQ ID NO: 21935 - DNA, 18 bp, Artificial Sequence
  Synthetic DNA
aaatactactcactaagg

SEQ ID NO: 21936 - DNA, 18 bp, Artificial Sequence
  Synthetic DNA
aaatactagtcactaaag

SEQ ID NO: 21937 - DNA, 18 bp, Artificial Sequence
  Synthetic DNA
aaatactgctcagtatag

SEQ ID NO: 21938 - DNA, 18 bp, Artificial Sequence
  Synthetic DNA
aaatagaaatcactatag

SEQ ID NO: 21939 - DNA, 18 bp, Artificial Sequence
  Synthetic DNA
aaataggactcactgaag

SEQ ID NO: 21940 - DNA, 18 bp, Artificial Sequence
  Synthetic DNA
aaataggactctctgtag

SEQ ID NO: 21941 - DNA, 18 bp, Artificial Sequence
  Synthetic DNA
aaatatgactaactttag

SEQ ID NO: 21942 - DNA, 18 bp, Artificial Sequence
  Synthetic DNA
aaatatgattcactttag

SEQ ID NO: 21943 - DNA, 18 bp, Artificial Sequence
  Synthetic DNA
aaatatgcctcacaatag

SEQ ID NO: 21944 - DNA, 18 bp, Artificial Sequence
  Synthetic DNA
aaatcatactcactatag

SEQ ID NO: 21945 - DNA, 18 bp, Artificial Sequence
  Synthetic DNA
aaatcctactctctatag

SEQ ID NO: 21946 - DNA, 18 bp, Artificial Sequence
  Synthetic DNA
aaatgcgaatcaccatag

SEQ ID NO: 21947 - DNA, 18 bp, Artificial Sequence
  Synthetic DNA
aaatgcgacttactatcg

SEQ ID NO: 21948 - DNA, 18 bp, Artificial Sequence
  Synthetic DNA
aaatgtgactcactttag

SEQ ID NO: 21949 - DNA, 18 bp, Artificial Sequence
  Synthetic DNA
aactacgaatcaccatag

SEQ ID NO: 21950 - DNA, 18 bp, Artificial Sequence
  Synthetic DNA
aactacgacgtactatag

SEQ ID NO: 21951 - DNA, 18 bp, Artificial Sequence
  Synthetic DNA
aactacgtctcaatatag

SEQ ID NO: 21952 - DNA, 18 bp, Artificial Sequence
  Synthetic DNA
aactccgacccactatag

SEQ ID NO: 21953 - DNA, 18 bp, Artificial Sequence
  Synthetic DNA
aagaacgactcattatag

SEQ ID NO: 21954 - DNA, 18 bp, Artificial Sequence
  Synthetic DNA
aagtaagactcaatatag

SEQ ID NO: 21955 - DNA, 18 bp, Artificial Sequence
  Synthetic DNA
aagtacgacacacaatag

SEQ ID NO: 21956 - DNA, 18 bp, Artificial Sequence
  Synthetic DNA
aattaagactcactgtag

SEQ ID NO: 21957 - DNA, 18 bp, Artificial Sequence
  Synthetic DNA
aattacgactcatcatag

SEQ ID NO: 21958 - DNA, 18 bp, Artificial Sequence
  Synthetic DNA
aattacgacttactaaag

SEQ ID NO: 21959 - DNA, 18 bp, Artificial Sequence
  Synthetic DNA
aattccaactcactatag

SEQ ID NO: 21960 - DNA, 18 bp, Artificial Sequence
  Synthetic DNA
aattgccactcactatag

SEQ ID NO: 21961 - DNA, 18 bp, Artificial Sequence
  Synthetic DNA
acaaacgacccactatag

SEQ ID NO: 21962 - DNA, 18 bp, Artificial Sequence
  Synthetic DNA
acatacgactccctctag

SEQ ID NO: 21963 - DNA, 18 bp, Artificial Sequence
  Synthetic DNA
acctacgactcacaatag

SEQ ID NO: 21964 - DNA, 18 bp, Artificial Sequence
  Synthetic DNA
agatacaactcacgatag

SEQ ID NO: 21965 - DNA, 18 bp, Artificial Sequence
  Synthetic DNA
agataccactctctatag

SEQ ID NO: 21966 - DNA, 18 bp, Artificial Sequence
  Synthetic DNA
agatatgactcactctag

SEQ ID NO: 21967 - DNA, 18 bp, Artificial Sequence
  Synthetic DNA
agttacgaatcactatag

SEQ ID NO: 21968 - DNA, 18 bp, Artificial Sequence
  Synthetic DNA
atatacgaatcaccatag

SEQ ID NO: 21969 - DNA, 18 bp, Artificial Sequence
  Synthetic DNA
atatacgactaattatag

SEQ ID NO: 21970 - DNA, 18 bp, Artificial Sequence
  Synthetic DNA
atatacgactccatatag

SEQ ID NO: 21971 - DNA, 18 bp, Artificial Sequence
  Synthetic DNA
atatacgtctcactatgg

SEQ ID NO: 21972 - DNA, 18 bp, Artificial Sequence
  Synthetic DNA
atgtatgactcactatag

SEQ ID NO: 21973 - DNA, 18 bp, Artificial Sequence
  Synthetic DNA
caaaacaattcactatag

SEQ ID NO: 21974 - DNA, 18 bp, Artificial Sequence
  Synthetic DNA
caacacaactcacaatag

SEQ ID NO: 21975 - DNA, 18 bp, Artificial Sequence
  Synthetic DNA
caacacgaaccactatag

SEQ ID NO: 21976 - DNA, 18 bp, Artificial Sequence
  Synthetic DNA
caacacgtctcattatag

SEQ ID NO: 21977 - DNA, 18 bp, Artificial Sequence
  Synthetic DNA
caacatgtctcactatag

SEQ ID NO: 21978 - DNA, 18 bp, Artificial Sequence
  Synthetic DNA
caagacggatcactatag

SEQ ID NO: 21979 - DNA, 18 bp, Artificial Sequence
  Synthetic DNA
caataagacgcactttag

SEQ ID NO: 21980 - DNA, 18 bp, Artificial Sequence
  Synthetic DNA
caataagtctcattatag

SEQ ID NO: 21981 - DNA, 18 bp, Artificial Sequence
  Synthetic DNA
caatacaactccctaaag

SEQ ID NO: 21982 - DNA, 18 bp, Artificial Sequence
  Synthetic DNA
caatacgaatcactaacg

SEQ ID NO: 21983 - DNA, 18 bp, Artificial Sequence
  Synthetic DNA
caatacgaatcattaaag

SEQ ID NO: 21984 - DNA, 18 bp, Artificial Sequence
  Synthetic DNA
caatacgaatctttatag

SEQ ID NO: 21985 - DNA, 18 bp, Artificial Sequence
  Synthetic DNA
caatacgacaccatatag

SEQ ID NO: 21986 - DNA, 18 bp, Artificial Sequence
  Synthetic DNA
caatacgacaccctaaag

SEQ ID NO: 21987 - DNA, 18 bp, Artificial Sequence
  Synthetic DNA
caatacgactaattaaag

SEQ ID NO: 21988 - DNA, 18 bp, Artificial Sequence
  Synthetic DNA
caatacgattacctatag

SEQ ID NO: 21989 - DNA, 18 bp, Artificial Sequence
  Synthetic DNA
caatacgattcactcaag

SEQ ID NO: 21990 - DNA, 18 bp, Artificial Sequence
  Synthetic DNA
caatacgattctatatag

SEQ ID NO: 21991 - DNA, 18 bp, Artificial Sequence
  Synthetic DNA
caatactgctcactatgg

SEQ ID NO: 21992 - DNA, 18 bp, Artificial Sequence
  Synthetic DNA
caataggactctttatag

SEQ ID NO: 21993 - DNA, 18 bp, Artificial Sequence
  Synthetic DNA
caatatgcctaactatag

SEQ ID NO: 21994 - DNA, 18 bp, Artificial Sequence
  Synthetic DNA
caatgcgaatcactaaag

SEQ ID NO: 21995 - DNA, 18 bp, Artificial Sequence
  Synthetic DNA
cataacgagtcactatag

SEQ ID NO: 21996 - DNA, 18 bp, Artificial Sequence
  Synthetic DNA
cattacaactcactacag

SEQ ID NO: 21997 - DNA, 18 bp, Artificial Sequence
  Synthetic DNA
cattactcctcactatag

SEQ ID NO: 21998 - DNA, 18 bp, Artificial Sequence
  Synthetic DNA
cattatgactcactacag

SEQ ID NO: 21999 - DNA, 18 bp, Artificial Sequence
  Synthetic DNA
cattgcgacttactatag

SEQ ID NO: 22000 - DNA, 18 bp, Artificial Sequence
  Synthetic DNA
ccatacgacttaccatag

SEQ ID NO: 22001 - DNA, 18 bp, Artificial Sequence
  Synthetic DNA
cgatacgcctcactttag

SEQ ID NO: 22002 - DNA, 18 bp, Artificial Sequence
  Synthetic DNA
cgtaacgactcactatag

SEQ ID NO: 22003 - DNA, 18 bp, Artificial Sequence
  Synthetic DNA
ctacacgactcacaatag

SEQ ID NO: 22004 - DNA, 18 bp, Artificial Sequence
  Synthetic DNA
ctacgcgactcactatag

SEQ ID NO: 22005 - DNA, 18 bp, Artificial Sequence
  Synthetic DNA
ctataagactccctatag

SEQ ID NO: 22006 - DNA, 18 bp, Artificial Sequence
  Synthetic DNA
ctatacgaatcactaaag

SEQ ID NO: 22007 - DNA, 18 bp, Artificial Sequence
  Synthetic DNA
ctatacgactcacattag

SEQ ID NO: 22008 - DNA, 18 bp, Artificial Sequence
  Synthetic DNA
ctatacgcctcactacag

SEQ ID NO: 22009 - DNA, 18 bp, Artificial Sequence
  Synthetic DNA
ctatactactcactttag

SEQ ID NO: 22010 - DNA, 18 bp, Artificial Sequence
  Synthetic DNA
ctatgcgactaactatag

SEQ ID NO: 22011 - DNA, 18 bp, Artificial Sequence
  Synthetic DNA
ctatgcggctcactatag

SEQ ID NO: 22012 - DNA, 18 bp, Artificial Sequence
  Synthetic DNA
ctctccgactcactatag

SEQ ID NO: 22013 - DNA, 18 bp, Artificial Sequence
  Synthetic DNA
gaaaacgactcaatagag

SEQ ID NO: 22014 - DNA, 18 bp, Artificial Sequence
  Synthetic DNA
gaataagactcaccctag

SEQ ID NO: 22015 - DNA, 18 bp, Artificial Sequence
  Synthetic DNA
gaatacaattcactatgg

SEQ ID NO: 22016 - DNA, 18 bp, Artificial Sequence
  Synthetic DNA
gaataccacacattatag

SEQ ID NO: 22017 - DNA, 18 bp, Artificial Sequence
  Synthetic DNA
gaatacgacactcaatag

SEQ ID NO: 22018 - DNA, 18 bp, Artificial Sequence
  Synthetic DNA
gaatacgactttctctag

SEQ ID NO: 22019 - DNA, 18 bp, Artificial Sequence
  Synthetic DNA
gaatacgatacattatag

SEQ ID NO: 22020 - DNA, 18 bp, Artificial Sequence
  Synthetic DNA
gaatactactgactttag

SEQ ID NO: 22021 - DNA, 18 bp, Artificial Sequence
  Synthetic DNA
gattacgactaaccatag

SEQ ID NO: 22022 - DNA, 18 bp, Artificial Sequence
  Synthetic DNA
gattacgactccctttag

SEQ ID NO: 22023 - DNA, 18 bp, Artificial Sequence
  Synthetic DNA
gattacgacttactacag

SEQ ID NO: 22024 - DNA, 18 bp, Artificial Sequence
  Synthetic DNA
gattacgattcacgatag

SEQ ID NO: 22025 - DNA, 18 bp, Artificial Sequence
  Synthetic DNA
gcataggattcactatag

SEQ ID NO: 22026 - DNA, 18 bp, Artificial Sequence
  Synthetic DNA
gcttacgactctctatag

SEQ ID NO: 22027 - DNA, 18 bp, Artificial Sequence
  Synthetic DNA
gtatacaactcactacag

SEQ ID NO: 22028 - DNA, 18 bp, Artificial Sequence
  Synthetic DNA
taaaaagacacactaaag

SEQ ID NO: 22029 - DNA, 18 bp, Artificial Sequence
  Synthetic DNA
taaaaaggctcactttag

SEQ ID NO: 22030 - DNA, 18 bp, Artificial Sequence
  Synthetic DNA
taaaaatagtcactatag

SEQ ID NO: 22031 - DNA, 18 bp, Artificial Sequence
  Synthetic DNA
taaaacaacctactatag

SEQ ID NO: 22032 - DNA, 18 bp, Artificial Sequence
  Synthetic DNA
taaaacaactctctagag

SEQ ID NO: 22033 - DNA, 18 bp, Artificial Sequence
  Synthetic DNA
taaaaccacccacaatag

SEQ ID NO: 22034 - DNA, 18 bp, Artificial Sequence
  Synthetic DNA
taaaacgaatcacagtag

SEQ ID NO: 22035 - DNA, 18 bp, Artificial Sequence
  Synthetic DNA
taaaacgaatcaccacag

SEQ ID NO: 22036 - DNA, 18 bp, Artificial Sequence
  Synthetic DNA
taaaacgacccacagtag

SEQ ID NO: 22037 - DNA, 18 bp, Artificial Sequence
  Synthetic DNA
taaaacgactccctaacg

SEQ ID NO: 22038 - DNA, 18 bp, Artificial Sequence
  Synthetic DNA
taaaacgactctccctag

SEQ ID NO: 22039 - DNA, 18 bp, Artificial Sequence
  Synthetic DNA
taaaacgactctctttgg

SEQ ID NO: 22040 - DNA, 18 bp, Artificial Sequence
  Synthetic DNA
taaaacgagtctctaaag

SEQ ID NO: 22041 - DNA, 18 bp, Artificial Sequence
  Synthetic DNA
taaaacgattaactttag

SEQ ID NO: 22042 - DNA, 18 bp, Artificial Sequence
  Synthetic DNA
taaaacgattcacaagag

SEQ ID NO: 22043 - DNA, 18 bp, Artificial Sequence
  Synthetic DNA
taaaacgcatccctatag

SEQ ID NO: 22044 - DNA, 18 bp, Artificial Sequence
  Synthetic DNA
taaaacgcctcattttag

SEQ ID NO: 22045 - DNA, 18 bp, Artificial Sequence
  Synthetic DNA
taaaacgcttctctatag

SEQ ID NO: 22046 - DNA, 18 bp, Artificial Sequence
  Synthetic DNA
taaaacggatcactatgg

SEQ ID NO: 22047 - DNA, 18 bp, Artificial Sequence
  Synthetic DNA
taaaacggctcaccaaag

SEQ ID NO: 22048 - DNA, 18 bp, Artificial Sequence
  Synthetic DNA
taaaacgtctaactagag

SEQ ID NO: 22049 - DNA, 18 bp, Artificial Sequence
  Synthetic DNA
taaaacgtctcactcaag

SEQ ID NO: 22050 - DNA, 18 bp, Artificial Sequence
  Synthetic DNA
taaaacgtctctctatgg

SEQ ID NO: 22051 - DNA, 18 bp, Artificial Sequence
  Synthetic DNA
taaaacgtgttactatag

SEQ ID NO: 22052 - DNA, 18 bp, Artificial Sequence
  Synthetic DNA
taaaactactcactgcag

SEQ ID NO: 22053 - DNA, 18 bp, Artificial Sequence
  Synthetic DNA
taaaactactgactttag

SEQ ID NO: 22054 - DNA, 18 bp, Artificial Sequence
  Synthetic DNA
taaaagaactcactgtag

SEQ ID NO: 22055 - DNA, 18 bp, Artificial Sequence
  Synthetic DNA
taaaagaactctctatag

SEQ ID NO: 22056 - DNA, 18 bp, Artificial Sequence
  Synthetic DNA
taaaaggacccactaaag

SEQ ID NO: 22057 - DNA, 18 bp, Artificial Sequence
  Synthetic DNA
taaaaggacccactttag

SEQ ID NO: 22058 - DNA, 18 bp, Artificial Sequence
  Synthetic DNA
taaaaggactccatatag

SEQ ID NO: 22059 - DNA, 18 bp, Artificial Sequence
  Synthetic DNA
taaaatgaatcactttag

SEQ ID NO: 22060 - DNA, 18 bp, Artificial Sequence
  Synthetic DNA
taaaatgactcagtttag

SEQ ID NO: 22061 - DNA, 18 bp, Artificial Sequence
  Synthetic DNA
taaaatgagtcactatgg

SEQ ID NO: 22062 - DNA, 18 bp, Artificial Sequence
  Synthetic DNA
taaaccgagtctctatag

SEQ ID NO: 22063 - DNA, 18 bp, Artificial Sequence
  Synthetic DNA
taaaccggctcagtatag

SEQ ID NO: 22064 - DNA, 18 bp, Artificial Sequence
  Synthetic DNA
taaactgaatcactatag

SEQ ID NO: 22065 - DNA, 18 bp, Artificial Sequence
  Synthetic DNA
taaagctactcattatag

SEQ ID NO: 22066 - DNA, 18 bp, Artificial Sequence
  Synthetic DNA
taaagggactctctatag

SEQ ID NO: 22067 - DNA, 18 bp, Artificial Sequence
  Synthetic DNA
taacaaacctcactatag

SEQ ID NO: 22068 - DNA, 18 bp, Artificial Sequence
  Synthetic DNA
taacaagactaaccatag

SEQ ID NO: 22069 - DNA, 18 bp, Artificial Sequence
  Synthetic DNA
taacaatactctctatag

SEQ ID NO: 22070 - DNA, 18 bp, Artificial Sequence
  Synthetic DNA
taacacaactcagaatag

SEQ ID NO: 22071 - DNA, 18 bp, Artificial Sequence
  Synthetic DNA
taacaccactcaccgtag

SEQ ID NO: 22072 - DNA, 18 bp, Artificial Sequence
  Synthetic DNA
taacacgaatccctaaag

SEQ ID NO: 22073 - DNA, 18 bp, Artificial Sequence
  Synthetic DNA
taacacgactcacccaag

SEQ ID NO: 22074 - DNA, 18 bp, Artificial Sequence
  Synthetic DNA
taacacgcatcactttag

SEQ ID NO: 22075 - DNA, 18 bp, Artificial Sequence
  Synthetic DNA
taacacgtcacactagag

SEQ ID NO: 22076 - DNA, 18 bp, Artificial Sequence
  Synthetic DNA
taacacgtctctctctag

SEQ ID NO: 22077 - DNA, 18 bp, Artificial Sequence
  Synthetic DNA
taacactactctctgtag

SEQ ID NO: 22078 - DNA, 18 bp, Artificial Sequence
  Synthetic DNA
taacactagtcactttag

SEQ ID NO: 22079 - DNA, 18 bp, Artificial Sequence
  Synthetic DNA
taacagaacgcactatag

SEQ ID NO: 22080 - DNA, 18 bp, Artificial Sequence
  Synthetic DNA
taacaggaatcagtatag

SEQ ID NO: 22081 - DNA, 18 bp, Artificial Sequence
  Synthetic DNA
taacatgacacaatatag

SEQ ID NO: 22082 - DNA, 18 bp, Artificial Sequence
  Synthetic DNA
taacattactcactaaag

SEQ ID NO: 22083 - DNA, 18 bp, Artificial Sequence
  Synthetic DNA
taacccgactcacaaaag

SEQ ID NO: 22084 - DNA, 18 bp, Artificial Sequence
  Synthetic DNA
taacgcaactcagtatag

SEQ ID NO: 22085 - DNA, 18 bp, Artificial Sequence
  Synthetic DNA
taagaaggctcactagag

SEQ ID NO: 22086 - DNA, 18 bp, Artificial Sequence
  Synthetic DNA
taagacgtctcaagatag

SEQ ID NO: 22087 - DNA, 18 bp, Artificial Sequence
  Synthetic DNA
taagacgtctctgtatag

SEQ ID NO: 22088 - DNA, 18 bp, Artificial Sequence
  Synthetic DNA
taataaaacttactacag

SEQ ID NO: 22089 - DNA, 18 bp, Artificial Sequence
  Synthetic DNA
taataaagctcattatag

SEQ ID NO: 22090 - DNA, 18 bp, Artificial Sequence
  Synthetic DNA
taataacaatcacaatag

SEQ ID NO: 22091 - DNA, 18 bp, Artificial Sequence
  Synthetic DNA
taataacacacagtatag

SEQ ID NO: 22092 - DNA, 18 bp, Artificial Sequence
  Synthetic DNA
taataacacaccctatag

SEQ ID NO: 22093 - DNA, 18 bp, Artificial Sequence
  Synthetic DNA
taataacactcaacatag

SEQ ID NO: 22094 - DNA, 18 bp, Artificial Sequence
  Synthetic DNA
taataacactctcaatag

SEQ ID NO: 22095 - DNA, 18 bp, Artificial Sequence
  Synthetic DNA
taataacactctccatag

SEQ ID NO: 22096 - DNA, 18 bp, Artificial Sequence
  Synthetic DNA
taataagaatcacttaag

SEQ ID NO: 22097 - DNA, 18 bp, Artificial Sequence
  Synthetic DNA
taataagacacattctag

SEQ ID NO: 22098 - DNA, 18 bp, Artificial Sequence
  Synthetic DNA
taataagaccctatatag

SEQ ID NO: 22099 - DNA, 18 bp, Artificial Sequence
  Synthetic DNA
taataagacgctctatgg

SEQ ID NO: 22100 - DNA, 18 bp, Artificial Sequence
  Synthetic DNA
taataagcatcactatcg

SEQ ID NO: 22101 - DNA, 18 bp, Artificial Sequence
  Synthetic DNA
taataagcctctttatag

SEQ ID NO: 22102 - DNA, 18 bp, Artificial Sequence
  Synthetic DNA
taataaggctcataatag

SEQ ID NO: 22103 - DNA, 18 bp, Artificial Sequence
  Synthetic DNA
taataagtcacacgatag

SEQ ID NO: 22104 - DNA, 18 bp, Artificial Sequence
  Synthetic DNA
taataagtctcaatgtag

SEQ ID NO: 22105 - DNA, 18 bp, Artificial Sequence
  Synthetic DNA
taataataatcactaaag

SEQ ID NO: 22106 - DNA, 18 bp, Artificial Sequence
  Synthetic DNA
taataataattactatag

SEQ ID NO: 22107 - DNA, 18 bp, Artificial Sequence
  Synthetic DNA
taatacaaatgattatag

SEQ ID NO: 22108 - DNA, 18 bp, Artificial Sequence
  Synthetic DNA
taatacaactacttatag

SEQ ID NO: 22109 - DNA, 18 bp, Artificial Sequence
  Synthetic DNA
taatacaactcatattag

SEQ ID NO: 22110 - DNA, 18 bp, Artificial Sequence
  Synthetic DNA
taatacaactgactgcag

SEQ ID NO: 22111 - DNA, 18 bp, Artificial Sequence
  Synthetic DNA
taatacatcccattatag

SEQ ID NO: 22112 - DNA, 18 bp, Artificial Sequence
  Synthetic DNA
taataccaagtactatag

SEQ ID NO: 22113 - DNA, 18 bp, Artificial Sequence
  Synthetic DNA
taataccaatcactgtcg

SEQ ID NO: 22114 - DNA, 18 bp, Artificial Sequence
  Synthetic DNA
taataccacacaatacag

SEQ ID NO: 22115 - DNA, 18 bp, Artificial Sequence
  Synthetic DNA
taataccacatactctag

SEQ ID NO: 22116 - DNA, 18 bp, Artificial Sequence
  Synthetic DNA
taataccactcaccttgg

SEQ ID NO: 22117 - DNA, 18 bp, Artificial Sequence
  Synthetic DNA
taataccacttactaccg

SEQ ID NO: 22118 - DNA, 18 bp, Artificial Sequence
  Synthetic DNA
taataccactttctatcg

SEQ ID NO: 22119 - DNA, 18 bp, Artificial Sequence
  Synthetic DNA
taataccagccacaatag

SEQ ID NO: 22120 - DNA, 18 bp, Artificial Sequence
  Synthetic DNA
taatacctcgcactaaag

SEQ ID NO: 22121 - DNA, 18 bp, Artificial Sequence
  Synthetic DNA
taatacgaaactctgtag

SEQ ID NO: 22122 - DNA, 18 bp, Artificial Sequence
  Synthetic DNA
taatacgaatcataatgg

SEQ ID NO: 22123 - DNA, 18 bp, Artificial Sequence
  Synthetic DNA
taatacgaatctgcatag

SEQ ID NO: 22124 - DNA, 18 bp, Artificial Sequence
  Synthetic DNA
taatacgacaaaatctag

SEQ ID NO: 22125 - DNA, 18 bp, Artificial Sequence
  Synthetic DNA
taatacgacaaacagtag

SEQ ID NO: 22126 - DNA, 18 bp, Artificial Sequence
  Synthetic DNA
taatacgacaccatatgg

SEQ ID NO: 22127 - DNA, 18 bp, Artificial Sequence
  Synthetic DNA
taatacgacactgtgtag

SEQ ID NO: 22128 - DNA, 18 bp, Artificial Sequence
  Synthetic DNA
taatacgaccctacatag

SEQ ID NO: 22129 - DNA, 18 bp, Artificial Sequence
  Synthetic DNA
taatacgacctcctatcg

SEQ ID NO: 22130 - DNA, 18 bp, Artificial Sequence
  Synthetic DNA
taatacgactatatatcg

SEQ ID NO: 22131 - DNA, 18 bp, Artificial Sequence
  Synthetic DNA
taatacgactatcgttag

SEQ ID NO: 22132 - DNA, 18 bp, Artificial Sequence
  Synthetic DNA
taatacgactatttacag

SEQ ID NO: 22133 - DNA, 18 bp, Artificial Sequence
  Synthetic DNA
taatacgactcattgagg

SEQ ID NO: 22134 - DNA, 18 bp, Artificial Sequence
  Synthetic DNA
taatacgactccaaacag

SEQ ID NO: 22135 - DNA, 18 bp, Artificial Sequence
  Synthetic DNA
taatacgactcctgttag

SEQ ID NO: 22136 - DNA, 18 bp, Artificial Sequence
  Synthetic DNA
taatacgactctataagg

SEQ ID NO: 22137 - DNA, 18 bp, Artificial Sequence
  Synthetic DNA
taatacgactctatttgg

SEQ ID NO: 22138 - DNA, 18 bp, Artificial Sequence
  Synthetic DNA
taatacgactctcaccag

SEQ ID NO: 22139 - DNA, 18 bp, Artificial Sequence
  Synthetic DNA
taatacgactgtgtgtag

SEQ ID NO: 22140 - DNA, 18 bp, Artificial Sequence
  Synthetic DNA
taatacgactttcaatcg

SEQ ID NO: 22141 - DNA, 18 bp, Artificial Sequence
  Synthetic DNA
taatacgagtcaaaatgg

SEQ ID NO: 22142 - DNA, 18 bp, Artificial Sequence
  Synthetic DNA
taatacgatcctctacag

SEQ ID NO: 22143 - DNA, 18 bp, Artificial Sequence
  Synthetic DNA
taatacgattaattatcg

SEQ ID NO: 22144 - DNA, 18 bp, Artificial Sequence
  Synthetic DNA
taatacgattcactcaaa

SEQ ID NO: 22145 - DNA, 18 bp, Artificial Sequence
  Synthetic DNA
taatacgattgagtagag

SEQ ID NO: 22146 - DNA, 18 bp, Artificial Sequence
  Synthetic DNA
taatacgatttaatatcg

SEQ ID NO: 22147 - DNA, 18 bp, Artificial Sequence
  Synthetic DNA
taatacgcatctctctag

SEQ ID NO: 22148 - DNA, 18 bp, Artificial Sequence
  Synthetic DNA
taatacgccacacaatgg

SEQ ID NO: 22149 - DNA, 18 bp, Artificial Sequence
  Synthetic DNA
taatacgccacaccgtag

SEQ ID NO: 22150 - DNA, 18 bp, Artificial Sequence
  Synthetic DNA
taatacgccacactggag

SEQ ID NO: 22151 - DNA, 18 bp, Artificial Sequence
  Synthetic DNA
taatacgccacacttcag

SEQ ID NO: 22152 - DNA, 18 bp, Artificial Sequence
  Synthetic DNA
taatacgcgtatctatag

SEQ ID NO: 22153 - DNA, 18 bp, Artificial Sequence
  Synthetic DNA
taatacgcttcacgacag

SEQ ID NO: 22154 - DNA, 18 bp, Artificial Sequence
  Synthetic DNA
taatacggaacattatag

SEQ ID NO: 22155 - DNA, 18 bp, Artificial Sequence
  Synthetic DNA
taatacggcaatctatag

SEQ ID NO: 22156 - DNA, 18 bp, Artificial Sequence
  Synthetic DNA
taatacggcacattaaag

SEQ ID NO: 22157 - DNA, 18 bp, Artificial Sequence
  Synthetic DNA
taatacgggccactatgg

SEQ ID NO: 22158 - DNA, 18 bp, Artificial Sequence
  Synthetic DNA
taatacggttaactttag

SEQ ID NO: 22159 - DNA, 18 bp, Artificial Sequence
  Synthetic DNA
taatacgtcatacgatag

SEQ ID NO: 22160 - DNA, 18 bp, Artificial Sequence
  Synthetic DNA
taatacgtccaactgtag

SEQ ID NO: 22161 - DNA, 18 bp, Artificial Sequence
  Synthetic DNA
taatacgtccccatatag

SEQ ID NO: 22162 - DNA, 18 bp, Artificial Sequence
  Synthetic DNA
taatacgtcgcattttag

SEQ ID NO: 22163 - DNA, 18 bp, Artificial Sequence
  Synthetic DNA
taatacgtctccacatag

SEQ ID NO: 22164 - DNA, 18 bp, Artificial Sequence
  Synthetic DNA
taatacgtctgacaatcg

SEQ ID NO: 22165 - DNA, 18 bp, Artificial Sequence
  Synthetic DNA
taatacgtgtaactatcg

SEQ ID NO: 22166 - DNA, 18 bp, Artificial Sequence
  Synthetic DNA
taatacgtgtccctatcg

SEQ ID NO: 22167 - DNA, 18 bp, Artificial Sequence
  Synthetic DNA
taatacgttccactaaag

SEQ ID NO: 22168 - DNA, 18 bp, Artificial Sequence
  Synthetic DNA
taatactacaccctacag

SEQ ID NO: 22169 - DNA, 18 bp, Artificial Sequence
  Synthetic DNA
taatactactaacttgag

SEQ ID NO: 22170 - DNA, 18 bp, Artificial Sequence
  Synthetic DNA
taatactactcatttgag

SEQ ID NO: 22171 - DNA, 18 bp, Artificial Sequence
  Synthetic DNA
taatactactctctaccg

SEQ ID NO: 22172 - DNA, 18 bp, Artificial Sequence
  Synthetic DNA
taatactactgcatatag

SEQ ID NO: 22173 - DNA, 18 bp, Artificial Sequence
  Synthetic DNA
taatactatacactatcg

SEQ ID NO: 22174 - DNA, 18 bp, Artificial Sequence
  Synthetic DNA
taatactgctcataatag

SEQ ID NO: 22175 - DNA, 18 bp, Artificial Sequence
  Synthetic DNA
taatactgttcactaaag

SEQ ID NO: 22176 - DNA, 18 bp, Artificial Sequence
  Synthetic DNA
taatacttctccctacag

SEQ ID NO: 22177 - DNA, 18 bp, Artificial Sequence
  Synthetic DNA
taatagaactcaatttag

SEQ ID NO: 22178 - DNA, 18 bp, Artificial Sequence
  Synthetic DNA
taatagaactcaccaaag

SEQ ID NO: 22179 - DNA, 18 bp, Artificial Sequence
  Synthetic DNA
taatagaactctatatag

SEQ ID NO: 22180 - DNA, 18 bp, Artificial Sequence
  Synthetic DNA
taatagaactctttatag

SEQ ID NO: 22181 - DNA, 18 bp, Artificial Sequence
  Synthetic DNA
taataggaataactgtag

SEQ ID NO: 22182 - DNA, 18 bp, Artificial Sequence
  Synthetic DNA
taataggacacacactag

SEQ ID NO: 22183 - DNA, 18 bp, Artificial Sequence
  Synthetic DNA
taataggacatacgatag

SEQ ID NO: 22184 - DNA, 18 bp, Artificial Sequence
  Synthetic DNA
taataggactcaaaaaag

SEQ ID NO: 22185 - DNA, 18 bp, Artificial Sequence
  Synthetic DNA
taataggactcacttacg

SEQ ID NO: 22186 - DNA, 18 bp, Artificial Sequence
  Synthetic DNA
taataggattcactaagg

SEQ ID NO: 22187 - DNA, 18 bp, Artificial Sequence
  Synthetic DNA
taatagggcaaactatag

SEQ ID NO: 22188 - DNA, 18 bp, Artificial Sequence
  Synthetic DNA
taatagggctcattaaag

SEQ ID NO: 22189 - DNA, 18 bp, Artificial Sequence
  Synthetic DNA
taatagggcttactatcg

SEQ ID NO: 22190 - DNA, 18 bp, Artificial Sequence
  Synthetic DNA
taataggtcactctatag

SEQ ID NO: 22191 - DNA, 18 bp, Artificial Sequence
  Synthetic DNA
taataggtcccagtatag

SEQ ID NO: 22192 - DNA, 18 bp, Artificial Sequence
  Synthetic DNA
taataggtctctcgatag

SEQ ID NO: 22193 - DNA, 18 bp, Artificial Sequence
  Synthetic DNA
taatagtattcactatgg

SEQ ID NO: 22194 - DNA, 18 bp, Artificial Sequence
  Synthetic DNA
taatatatcttactatag

SEQ ID NO: 22195 - DNA, 18 bp, Artificial Sequence
  Synthetic DNA
taatatcacgcacaatag

SEQ ID NO: 22196 - DNA, 18 bp, Artificial Sequence
  Synthetic DNA
taatatcactcattatcg

SEQ ID NO: 22197 - DNA, 18 bp, Artificial Sequence
  Synthetic DNA
taatatcactgactttag

SEQ ID NO: 22198 - DNA, 18 bp, Artificial Sequence
  Synthetic DNA
taatatgaatgattatag

SEQ ID NO: 22199 - DNA, 18 bp, Artificial Sequence
  Synthetic DNA
taatatgacgctctatgg

SEQ ID NO: 22200 - DNA, 18 bp, Artificial Sequence
  Synthetic DNA
taatatgactcacgtaag

SEQ ID NO: 22201 - DNA, 18 bp, Artificial Sequence
  Synthetic DNA
taatatgactcatgatgg

SEQ ID NO: 22202 - DNA, 18 bp, Artificial Sequence
  Synthetic DNA
taatatgactctctaagg

SEQ ID NO: 22203 - DNA, 18 bp, Artificial Sequence
  Synthetic DNA
taatatgagttactatgg

SEQ ID NO: 22204 - DNA, 18 bp, Artificial Sequence
  Synthetic DNA
taatatgataaactatag

SEQ ID NO: 22205 - DNA, 18 bp, Artificial Sequence
  Synthetic DNA
taatatgattaactaaag

SEQ ID NO: 22206 - DNA, 18 bp, Artificial Sequence
  Synthetic DNA
taatatgccacactttag

SEQ ID NO: 22207 - DNA, 18 bp, Artificial Sequence
  Synthetic DNA
taatatgccccattatag

SEQ ID NO: 22208 - DNA, 18 bp, Artificial Sequence
  Synthetic DNA
taatatggctctctaaag

SEQ ID NO: 22209 - DNA, 18 bp, Artificial Sequence
  Synthetic DNA
taatattgatcactatag

SEQ ID NO: 22210 - DNA, 18 bp, Artificial Sequence
  Synthetic DNA
taatcagcctctctatag

SEQ ID NO: 22211 - DNA, 18 bp, Artificial Sequence
  Synthetic DNA
taatcagtatcactatag

SEQ ID NO: 22212 - DNA, 18 bp, Artificial Sequence
  Synthetic DNA
taatcagtctaactatag

SEQ ID NO: 22213 - DNA, 18 bp, Artificial Sequence
  Synthetic DNA
taatcatactgactatag

SEQ ID NO: 22214 - DNA, 18 bp, Artificial Sequence
  Synthetic DNA
taatccgacccactcaag

SEQ ID NO: 22215 - DNA, 18 bp, Artificial Sequence
  Synthetic DNA
taatccgagcaactatag

SEQ ID NO: 22216 - DNA, 18 bp, Artificial Sequence
  Synthetic DNA
taatccgattatctatag

SEQ ID NO: 22217 - DNA, 18 bp, Artificial Sequence
  Synthetic DNA
taatccgatttattatag

SEQ ID NO: 22218 - DNA, 18 bp, Artificial Sequence
  Synthetic DNA
taatccgcatcactacag

SEQ ID NO: 22219 - DNA, 18 bp, Artificial Sequence
  Synthetic DNA
taatccgccaaactatag

SEQ ID NO: 22220 - DNA, 18 bp, Artificial Sequence
  Synthetic DNA
taatccggttcactttag

SEQ ID NO: 22221 - DNA, 18 bp, Artificial Sequence
  Synthetic DNA
taatccgtcccactatcg

SEQ ID NO: 22222 - DNA, 18 bp, Artificial Sequence
  Synthetic DNA
taatccgtcttactacag

SEQ ID NO: 22223 - DNA, 18 bp, Artificial Sequence
  Synthetic DNA
taatccgttccactatag

SEQ ID NO: 22224 - DNA, 18 bp, Artificial Sequence
  Synthetic DNA
taatcctactcacaaaag

SEQ ID NO: 22225 - DNA, 18 bp, Artificial Sequence
  Synthetic DNA
taatcctacttactaaag

SEQ ID NO: 22226 - DNA, 18 bp, Artificial Sequence
  Synthetic DNA
taatgagactcacttcag

SEQ ID NO: 22227 - DNA, 18 bp, Artificial Sequence
  Synthetic DNA
taatgagacttactaaag

SEQ ID NO: 22228 - DNA, 18 bp, Artificial Sequence
  Synthetic DNA
taatgcaactcacattag

SEQ ID NO: 22229 - DNA, 18 bp, Artificial Sequence
  Synthetic DNA
taatgcgaatcacactag

SEQ ID NO: 22230 - DNA, 18 bp, Artificial Sequence
  Synthetic DNA
taatgcgacacacaacag

SEQ ID NO: 22231 - DNA, 18 bp, Artificial Sequence
  Synthetic DNA
taatgcgacgtcctatag

SEQ ID NO: 22232 - DNA, 18 bp, Artificial Sequence
  Synthetic DNA
taatgcgactcaaaatcg

SEQ ID NO: 22233 - DNA, 18 bp, Artificial Sequence
  Synthetic DNA
taatgcgactcagattag

SEQ ID NO: 22234 - DNA, 18 bp, Artificial Sequence
  Synthetic DNA
taatgcgactcattaagg

SEQ ID NO: 22235 - DNA, 18 bp, Artificial Sequence
  Synthetic DNA
taatgcgactcccaacag

SEQ ID NO: 22236 - DNA, 18 bp, Artificial Sequence
  Synthetic DNA
taatgcgactcccttcag

SEQ ID NO: 22237 - DNA, 18 bp, Artificial Sequence
  Synthetic DNA
taatgcgactctcagtag

SEQ ID NO: 22238 - DNA, 18 bp, Artificial Sequence
  Synthetic DNA
taatgcgagtcaagatag

SEQ ID NO: 22239 - DNA, 18 bp, Artificial Sequence
  Synthetic DNA
taatgcgcctctctaaag

SEQ ID NO: 22240 - DNA, 18 bp, Artificial Sequence
  Synthetic DNA
taatgcggctcactctgg

SEQ ID NO: 22241 - DNA, 18 bp, Artificial Sequence
  Synthetic DNA
taatgcgtatcacaatag

SEQ ID NO: 22242 - DNA, 18 bp, Artificial Sequence
  Synthetic DNA
taatgcgtcttactctag

SEQ ID NO: 22243 - DNA, 18 bp, Artificial Sequence
  Synthetic DNA
taatgctagacactatag

SEQ ID NO: 22244 - DNA, 18 bp, Artificial Sequence
  Synthetic DNA
taatgctcatcactatag

SEQ ID NO: 22245 - DNA, 18 bp, Artificial Sequence
  Synthetic DNA
taatgggactcaatttag

SEQ ID NO: 22246 - DNA, 18 bp, Artificial Sequence
  Synthetic DNA
taatgggactccctttag

SEQ ID NO: 22247 - DNA, 18 bp, Artificial Sequence
  Synthetic DNA
taatgggacttactttag

SEQ ID NO: 22248 - DNA, 18 bp, Artificial Sequence
  Synthetic DNA
taatgggactttctatag

SEQ ID NO: 22249 - DNA, 18 bp, Artificial Sequence
  Synthetic DNA
taatgtggctcacaatag

SEQ ID NO: 22250 - DNA, 18 bp, Artificial Sequence
  Synthetic DNA
tacaacttctcactatag

SEQ ID NO: 22251 - DNA, 18 bp, Artificial Sequence
  Synthetic DNA
tacgacgactgactatgg

SEQ ID NO: 22252 - DNA, 18 bp, Artificial Sequence
  Synthetic DNA
tactaagattcactttag

SEQ ID NO: 22253 - DNA, 18 bp, Artificial Sequence
  Synthetic DNA
tactacaattctctatag

SEQ ID NO: 22254 - DNA, 18 bp, Artificial Sequence
  Synthetic DNA
tactaccacacattatag

SEQ ID NO: 22255 - DNA, 18 bp, Artificial Sequence
  Synthetic DNA
tactaccactctatatag

SEQ ID NO: 22256 - DNA, 18 bp, Artificial Sequence
  Synthetic DNA
tactacgaattactttag

SEQ ID NO: 22257 - DNA, 18 bp, Artificial Sequence
  Synthetic DNA
tactacgacatactatcg

SEQ ID NO: 22258 - DNA, 18 bp, Artificial Sequence
  Synthetic DNA
tactacgacatattatag

SEQ ID NO: 22259 - DNA, 18 bp, Artificial Sequence
  Synthetic DNA
tactacgactctctgaag

SEQ ID NO: 22260 - DNA, 18 bp, Artificial Sequence
  Synthetic DNA
tactacggcttaatatag

SEQ ID NO: 22261 - DNA, 18 bp, Artificial Sequence
  Synthetic DNA
tactacgtctgactgtag

SEQ ID NO: 22262 - DNA, 18 bp, Artificial Sequence
  Synthetic DNA
tactactactgacaatag

SEQ ID NO: 22263 - DNA, 18 bp, Artificial Sequence
  Synthetic DNA
tactacttctcactaaag

SEQ ID NO: 22264 - DNA, 18 bp, Artificial Sequence
  Synthetic DNA
tactacttctcactatgg

SEQ ID NO: 22265 - DNA, 18 bp, Artificial Sequence
  Synthetic DNA
tactatcactctctatag

SEQ ID NO: 22266 - DNA, 18 bp, Artificial Sequence
  Synthetic DNA
tactatgactcaatttag

SEQ ID NO: 22267 - DNA, 18 bp, Artificial Sequence
  Synthetic DNA
tactatgactcattagag

SEQ ID NO: 22268 - DNA, 18 bp, Artificial Sequence
  Synthetic DNA
tactgcgagtcacaatag

SEQ ID NO: 22269 - DNA, 18 bp, Artificial Sequence
  Synthetic DNA
tagaacgacgtactatag

SEQ ID NO: 22270 - DNA, 18 bp, Artificial Sequence
  Synthetic DNA
tagaacgactcagtgtag

SEQ ID NO: 22271 - DNA, 18 bp, Artificial Sequence
  Synthetic DNA
tagaatgaatcactatag

SEQ ID NO: 22272 - DNA, 18 bp, Artificial Sequence
  Synthetic DNA
tagaccgactcactacag

SEQ ID NO: 22273 - DNA, 18 bp, Artificial Sequence
  Synthetic DNA
tagaccgtctcactatag

SEQ ID NO: 22274 - DNA, 18 bp, Artificial Sequence
  Synthetic DNA
tagactgactcactatag

SEQ ID NO: 22275 - DNA, 18 bp, Artificial Sequence
  Synthetic DNA
tagcaagactcaccatag

SEQ ID NO: 22276 - DNA, 18 bp, Artificial Sequence
  Synthetic DNA
tagcactactcactttag

SEQ ID NO: 22277 - DNA, 18 bp, Artificial Sequence
  Synthetic DNA
tagtaaaactcactttag

SEQ ID NO: 22278 - DNA, 18 bp, Artificial Sequence
  Synthetic DNA
tagtaaaagtcactatag

SEQ ID NO: 22279 - DNA, 18 bp, Artificial Sequence
  Synthetic DNA
tagtacaatttactatag

SEQ ID NO: 22280 - DNA, 18 bp, Artificial Sequence
  Synthetic DNA
tagtaccaatctctatag

SEQ ID NO: 22281 - DNA, 18 bp, Artificial Sequence
  Synthetic DNA
tagtaccatacactatag

SEQ ID NO: 22282 - DNA, 18 bp, Artificial Sequence
  Synthetic DNA
tagtacgaatcactttcg

SEQ ID NO: 22283 - DNA, 18 bp, Artificial Sequence
  Synthetic DNA
tagtacgactcatttaag

SEQ ID NO: 22284 - DNA, 18 bp, Artificial Sequence
  Synthetic DNA
tagtacgactctttatgg

SEQ ID NO: 22285 - DNA, 18 bp, Artificial Sequence
  Synthetic DNA
tagtacgattcattttag

SEQ ID NO: 22286 - DNA, 18 bp, Artificial Sequence
  Synthetic DNA
tagtactactcaagatag

SEQ ID NO: 22287 - DNA, 18 bp, Artificial Sequence
  Synthetic DNA
tagtactactcacttcag

SEQ ID NO: 22288 - DNA, 18 bp, Artificial Sequence
  Synthetic DNA
tagtacttctcactataa

SEQ ID NO: 22289 - DNA, 18 bp, Artificial Sequence
  Synthetic DNA
tagtatgaatcaatatag

SEQ ID NO: 22290 - DNA, 18 bp, Artificial Sequence
  Synthetic DNA
tagtatgattcactatcg

SEQ ID NO: 22291 - DNA, 18 bp, Artificial Sequence
  Synthetic DNA
tagtccgacaaactatag

SEQ ID NO: 22292 - DNA, 18 bp, Artificial Sequence
  Synthetic DNA
tagtccgattcactgtag

SEQ ID NO: 22293 - DNA, 18 bp, Artificial Sequence
  Synthetic DNA
tagtgcgaatcactaaag

SEQ ID NO: 22294 - DNA, 18 bp, Artificial Sequence
  Synthetic DNA
tataacgaatcactgtag

SEQ ID NO: 22295 - DNA, 18 bp, Artificial Sequence
  Synthetic DNA
tataacgactaactctag

SEQ ID NO: 22296 - DNA, 18 bp, Artificial Sequence
  Synthetic DNA
tataacgactcaatatcg

SEQ ID NO: 22297 - DNA, 18 bp, Artificial Sequence
  Synthetic DNA
tataacgactcccaatag

SEQ ID NO: 22298 - DNA, 18 bp, Artificial Sequence
  Synthetic DNA
tataacgactccctatcg

SEQ ID NO: 22299 - DNA, 18 bp, Artificial Sequence
  Synthetic DNA
tataacgacttactagag

SEQ ID NO: 22300 - DNA, 18 bp, Artificial Sequence
  Synthetic DNA
tataacgagccactatag

SEQ ID NO: 22301 - DNA, 18 bp, Artificial Sequence
  Synthetic DNA
tatcacgaattactatag

SEQ ID NO: 22302 - DNA, 18 bp, Artificial Sequence
  Synthetic DNA
tatcacgcctctctatag

SEQ ID NO: 22303 - DNA, 18 bp, Artificial Sequence
  Synthetic DNA
tatgacgacacactaaag

SEQ ID NO: 22304 - DNA, 18 bp, Artificial Sequence
  Synthetic DNA
tattaagcctaactatag

SEQ ID NO: 22305 - DNA, 18 bp, Artificial Sequence
  Synthetic DNA
tattaaggctcaatatag

SEQ ID NO: 22306 - DNA, 18 bp, Artificial Sequence
  Synthetic DNA
tattaatagtcactatag

SEQ ID NO: 22307 - DNA, 18 bp, Artificial Sequence
  Synthetic DNA
tattaatcctcactatag

SEQ ID NO: 22308 - DNA, 18 bp, Artificial Sequence
  Synthetic DNA
tattacaacccactaaag

SEQ ID NO: 22309 - DNA, 18 bp, Artificial Sequence
  Synthetic DNA
tattacaactcactcgag

SEQ ID NO: 22310 - DNA, 18 bp, Artificial Sequence
  Synthetic DNA
tattacaactctctagag

SEQ ID NO: 22311 - DNA, 18 bp, Artificial Sequence
  Synthetic DNA
tattacaactctctatcg

SEQ ID NO: 22312 - DNA, 18 bp, Artificial Sequence
  Synthetic DNA
tattacaacttattatag

SEQ ID NO: 22313 - DNA, 18 bp, Artificial Sequence
  Synthetic DNA
tattacaagtcagtatag

SEQ ID NO: 22314 - DNA, 18 bp, Artificial Sequence
  Synthetic DNA
tattacacgtcactatag

SEQ ID NO: 22315 - DNA, 18 bp, Artificial Sequence
  Synthetic DNA
tattacagctcattatag

SEQ ID NO: 22316 - DNA, 18 bp, Artificial Sequence
  Synthetic DNA
tattaccacacagtatag

SEQ ID NO: 22317 - DNA, 18 bp, Artificial Sequence
  Synthetic DNA
tattaccacttacaatag

SEQ ID NO: 22318 - DNA, 18 bp, Artificial Sequence
  Synthetic DNA
tattacctcacactatag

SEQ ID NO: 22319 - DNA, 18 bp, Artificial Sequence
  Synthetic DNA
tattacgacccactacgg

SEQ ID NO: 22320 - DNA, 18 bp, Artificial Sequence
  Synthetic DNA
tattacgactcacagtgg

SEQ ID NO: 22321 - DNA, 18 bp, Artificial Sequence
  Synthetic DNA
tattacgactcacattgg

SEQ ID NO: 22322 - DNA, 18 bp, Artificial Sequence
  Synthetic DNA
tattacgactcacggcag

SEQ ID NO: 22323 - DNA, 18 bp, Artificial Sequence
  Synthetic DNA
tattacgactcagtttgg

SEQ ID NO: 22324 - DNA, 18 bp, Artificial Sequence
  Synthetic DNA
tattacgactgtcaatag

SEQ ID NO: 22325 - DNA, 18 bp, Artificial Sequence
  Synthetic DNA
tattacgacttactttcg

SEQ ID NO: 22326 - DNA, 18 bp, Artificial Sequence
  Synthetic DNA
tattacgacttagtatcg

SEQ ID NO: 22327 - DNA, 18 bp, Artificial Sequence
  Synthetic DNA
tattacgacttattagag

SEQ ID NO: 22328 - DNA, 18 bp, Artificial Sequence
  Synthetic DNA
tattacgacttattatgg

SEQ ID NO: 22329 - DNA, 18 bp, Artificial Sequence
  Synthetic DNA
tattacgagactctatag

SEQ ID NO: 22330 - DNA, 18 bp, Artificial Sequence
  Synthetic DNA
tattacgagatactatag

SEQ ID NO: 22331 - DNA, 18 bp, Artificial Sequence
  Synthetic DNA
tattacgagcctctatag

SEQ ID NO: 22332 - DNA, 18 bp, Artificial Sequence
  Synthetic DNA
tattacgattcaatagag

SEQ ID NO: 22333 - DNA, 18 bp, Artificial Sequence
  Synthetic DNA
tattacgattcactgtcg

SEQ ID NO: 22334 - DNA, 18 bp, Artificial Sequence
  Synthetic DNA
tattacggctcacgaaag

SEQ ID NO: 22335 - DNA, 18 bp, Artificial Sequence
  Synthetic DNA
tattacggctgtctatag

SEQ ID NO: 22336 - DNA, 18 bp, Artificial Sequence
  Synthetic DNA
tattacgtcttactatgg

SEQ ID NO: 22337 - DNA, 18 bp, Artificial Sequence
  Synthetic DNA
tattactaaccactatag

SEQ ID NO: 22338 - DNA, 18 bp, Artificial Sequence
  Synthetic DNA
tattactactcaaaatag

SEQ ID NO: 22339 - DNA, 18 bp, Artificial Sequence
  Synthetic DNA
tattactactcaagatag

SEQ ID NO: 22340 - DNA, 18 bp, Artificial Sequence
  Synthetic DNA
tattactactctctatgg

SEQ ID NO: 22341 - DNA, 18 bp, Artificial Sequence
  Synthetic DNA
tattactaggcactatag

SEQ ID NO: 22342 - DNA, 18 bp, Artificial Sequence
  Synthetic DNA
tattactcctcaatatag

SEQ ID NO: 22343 - DNA, 18 bp, Artificial Sequence
  Synthetic DNA
tattaggaccaactatag

SEQ ID NO: 22344 - DNA, 18 bp, Artificial Sequence
  Synthetic DNA
tattaggactcactgaag

SEQ ID NO: 22345 - DNA, 18 bp, Artificial Sequence
  Synthetic DNA
tattaggcctcactttag

SEQ ID NO: 22346 - DNA, 18 bp, Artificial Sequence
  Synthetic DNA
tattatcgctcactatag

SEQ ID NO: 22347 - DNA, 18 bp, Artificial Sequence
  Synthetic DNA
tattatgactcaatatgg

SEQ ID NO: 22348 - DNA, 18 bp, Artificial Sequence
  Synthetic DNA
tattatgactctgtatag

SEQ ID NO: 22349 - DNA, 18 bp, Artificial Sequence
  Synthetic DNA
tattcagacacactatag

SEQ ID NO: 22350 - DNA, 18 bp, Artificial Sequence
  Synthetic DNA
tattccgaccccctatag

SEQ ID NO: 22351 - DNA, 18 bp, Artificial Sequence
  Synthetic DNA
tattccgactccatatag

SEQ ID NO: 22352 - DNA, 18 bp, Artificial Sequence
  Synthetic DNA
tattcctattcactatag

SEQ ID NO: 22353 - DNA, 18 bp, Artificial Sequence
  Synthetic DNA
tattgagaatcactatag

SEQ ID NO: 22354 - DNA, 18 bp, Artificial Sequence
  Synthetic DNA
tattgcgaatcactgtag

SEQ ID NO: 22355 - DNA, 18 bp, Artificial Sequence
  Synthetic DNA
tattgcgactctgtatag

SEQ ID NO: 22356 - DNA, 18 bp, Artificial Sequence
  Synthetic DNA
tattgcggctcattatag

SEQ ID NO: 22357 - DNA, 18 bp, Artificial Sequence
  Synthetic DNA
tcaaaggactcacaatag

SEQ ID NO: 22358 - DNA, 18 bp, Artificial Sequence
  Synthetic DNA
tcataagactaactttag

SEQ ID NO: 22359 - DNA, 18 bp, Artificial Sequence
  Synthetic DNA
tcataagactctatatag

SEQ ID NO: 22360 - DNA, 18 bp, Artificial Sequence
  Synthetic DNA
tcatacagctcattatag

SEQ ID NO: 22361 - DNA, 18 bp, Artificial Sequence
  Synthetic DNA
tcataccactgactacag

SEQ ID NO: 22362 - DNA, 18 bp, Artificial Sequence
  Synthetic DNA
tcataccattcactagag

SEQ ID NO: 22363 - DNA, 18 bp, Artificial Sequence
  Synthetic DNA
tcataccattcactatgg

SEQ ID NO: 22364 - DNA, 18 bp, Artificial Sequence
  Synthetic DNA
tcatacgacccaaaatag

SEQ ID NO: 22365 - DNA, 18 bp, Artificial Sequence
  Synthetic DNA
tcatacgacgcaccaaag

SEQ ID NO: 22366 - DNA, 18 bp, Artificial Sequence
  Synthetic DNA
tcatacgactacctctag

SEQ ID NO: 22367 - DNA, 18 bp, Artificial Sequence
  Synthetic DNA
tcatacgactcctaatag

SEQ ID NO: 22368 - DNA, 18 bp, Artificial Sequence
  Synthetic DNA
tcatacgactctatttag

SEQ ID NO: 22369 - DNA, 18 bp, Artificial Sequence
  Synthetic DNA
tcatacgactgactaagg

SEQ ID NO: 22370 - DNA, 18 bp, Artificial Sequence
  Synthetic DNA
tcatacgacttccaatag

SEQ ID NO: 22371 - DNA, 18 bp, Artificial Sequence
  Synthetic DNA
tcatacgagacactttag

SEQ ID NO: 22372 - DNA, 18 bp, Artificial Sequence
  Synthetic DNA
tcatacgatacactagag

SEQ ID NO: 22373 - DNA, 18 bp, Artificial Sequence
  Synthetic DNA
tcatacgcctgactatcg

SEQ ID NO: 22374 - DNA, 18 bp, Artificial Sequence
  Synthetic DNA
tcatacggatcactttag

SEQ ID NO: 22375 - DNA, 18 bp, Artificial Sequence
  Synthetic DNA
tcatacggctcaccttag

SEQ ID NO: 22376 - DNA, 18 bp, Artificial Sequence
  Synthetic DNA
tcatacgtctcacaatgg

SEQ ID NO: 22377 - DNA, 18 bp, Artificial Sequence
  Synthetic DNA
tcatacgtctcactgaag

SEQ ID NO: 22378 - DNA, 18 bp, Artificial Sequence
  Synthetic DNA
tcatacgtctcccaatag

SEQ ID NO: 22379 - DNA, 18 bp, Artificial Sequence
  Synthetic DNA
tcatactactgactaaag

SEQ ID NO: 22380 - DNA, 18 bp, Artificial Sequence
  Synthetic DNA
tcataggtctcactatgg

SEQ ID NO: 22381 - DNA, 18 bp, Artificial Sequence
  Synthetic DNA
tcatatgtctccctatag

SEQ ID NO: 22382 - DNA, 18 bp, Artificial Sequence
  Synthetic DNA
tcatattactcattatag

SEQ ID NO: 22383 - DNA, 18 bp, Artificial Sequence
  Synthetic DNA
tcatatttctcactatag

SEQ ID NO: 22384 - DNA, 18 bp, Artificial Sequence
  Synthetic DNA
tcatccgactcaatctag

SEQ ID NO: 22385 - DNA, 18 bp, Artificial Sequence
  Synthetic DNA
tcatgcggctcacaatag

SEQ ID NO: 22386 - DNA, 18 bp, Artificial Sequence
  Synthetic DNA
tcatgtgactcactacag

SEQ ID NO: 22387 - DNA, 18 bp, Artificial Sequence
  Synthetic DNA
tcctacgactaactctag

SEQ ID NO: 22388 - DNA, 18 bp, Artificial Sequence
  Synthetic DNA
tcctacgactcactaacg

SEQ ID NO: 22389 - DNA, 18 bp, Artificial Sequence
  Synthetic DNA
tcctacgactcactttgg

SEQ ID NO: 22390 - DNA, 18 bp, Artificial Sequence
  Synthetic DNA
tctcacgactcactttag

SEQ ID NO: 22391 - DNA, 18 bp, Artificial Sequence
  Synthetic DNA
tcttacgactctccatag

SEQ ID NO: 22392 - DNA, 18 bp, Artificial Sequence
  Synthetic DNA
tcttacgactgacaatag

SEQ ID NO: 22393 - DNA, 18 bp, Artificial Sequence
  Synthetic DNA
tcttacgacttaccatag

SEQ ID NO: 22394 - DNA, 18 bp, Artificial Sequence
  Synthetic DNA
tgaaaagactcattatag

SEQ ID NO: 22395 - DNA, 18 bp, Artificial Sequence
  Synthetic DNA
tgaaaccactcactagag

SEQ ID NO: 22396 - DNA, 18 bp, Artificial Sequence
  Synthetic DNA
tgaaacgatacactatag

SEQ ID NO: 22397 - DNA, 18 bp, Artificial Sequence
  Synthetic DNA
tgacaagagtcactatag

SEQ ID NO: 22398 - DNA, 18 bp, Artificial Sequence
  Synthetic DNA
tgacatgactcactatgg

SEQ ID NO: 22399 - DNA, 18 bp, Artificial Sequence
  Synthetic DNA
tgatacaacttactacag

SEQ ID NO: 22400 - DNA, 18 bp, Artificial Sequence
  Synthetic DNA
tgataccaatcactatgg

SEQ ID NO: 22401 - DNA, 18 bp, Artificial Sequence
  Synthetic DNA
tgatacctctctctatag

SEQ ID NO: 22402 - DNA, 18 bp, Artificial Sequence
  Synthetic DNA
tgatacgaataattatag

SEQ ID NO: 22403 - DNA, 18 bp, Artificial Sequence
  Synthetic DNA
tgatacgacatacaatag

SEQ ID NO: 22404 - DNA, 18 bp, Artificial Sequence
  Synthetic DNA
tgatacgactcaagttag

SEQ ID NO: 22405 - DNA, 18 bp, Artificial Sequence
  Synthetic DNA
tgatacgactcattaacg

SEQ ID NO: 22406 - DNA, 18 bp, Artificial Sequence
  Synthetic DNA
tgatacgactcccaacag

SEQ ID NO: 22407 - DNA, 18 bp, Artificial Sequence
  Synthetic DNA
tgatacgacttaatttag

SEQ ID NO: 22408 - DNA, 18 bp, Artificial Sequence
  Synthetic DNA
tgatacgatttacaatag

SEQ ID NO: 22409 - DNA, 18 bp, Artificial Sequence
  Synthetic DNA
tgatacgtctcattacag

SEQ ID NO: 22410 - DNA, 18 bp, Artificial Sequence
  Synthetic DNA
tgatacgtctctcgatag

SEQ ID NO: 22411 - DNA, 18 bp, Artificial Sequence
  Synthetic DNA
tgatacgtgacactatag

SEQ ID NO: 22412 - DNA, 18 bp, Artificial Sequence
  Synthetic DNA
tgatactattcactatcg

SEQ ID NO: 22413 - DNA, 18 bp, Artificial Sequence
  Synthetic DNA
tgatatgaatcacaatag

SEQ ID NO: 22414 - DNA, 18 bp, Artificial Sequence
  Synthetic DNA
tgatccgatacactatag

SEQ ID NO: 22415 - DNA, 18 bp, Artificial Sequence
  Synthetic DNA
tgatgcaactcactttag

SEQ ID NO: 22416 - DNA, 18 bp, Artificial Sequence
  Synthetic DNA
tgatgcgacccactctag

SEQ ID NO: 22417 - DNA, 18 bp, Artificial Sequence
  Synthetic DNA
tgatgcgattcacaatag

SEQ ID NO: 22418 - DNA, 18 bp, Artificial Sequence
  Synthetic DNA
tggtacgaatcactagag

SEQ ID NO: 22419 - DNA, 18 bp, Artificial Sequence
  Synthetic DNA
tgtaacgaatcactatag

SEQ ID NO: 22420 - DNA, 18 bp, Artificial Sequence
  Synthetic DNA
tgttacgactaacaatag

SEQ ID NO: 22421 - DNA, 18 bp, Artificial Sequence
  Synthetic DNA
tgttacggctcactgtag

SEQ ID NO: 22422 - DNA, 18 bp, Artificial Sequence
  Synthetic DNA
tgttataactcactatag

SEQ ID NO: 22423 - DNA, 18 bp, Artificial Sequence
  Synthetic DNA
ttaaacaacccactatag

SEQ ID NO: 22424 - DNA, 18 bp, Artificial Sequence
  Synthetic DNA
ttaaacaactcactatgg

SEQ ID NO: 22425 - DNA, 18 bp, Artificial Sequence
  Synthetic DNA
ttaaacgacccaccatag

SEQ ID NO: 22426 - DNA, 18 bp, Artificial Sequence
  Synthetic DNA
ttaaacgactcagtatcg

SEQ ID NO: 22427 - DNA, 18 bp, Artificial Sequence
  Synthetic DNA
ttaaacgactcatgatag

SEQ ID NO: 22428 - DNA, 18 bp, Artificial Sequence
  Synthetic DNA
ttaaacgactcattagag

SEQ ID NO: 22429 - DNA, 18 bp, Artificial Sequence
  Synthetic DNA
ttaaacgacttactacag

SEQ ID NO: 22430 - DNA, 18 bp, Artificial Sequence
  Synthetic DNA
ttaaacgagccactatag

SEQ ID NO: 22431 - DNA, 18 bp, Artificial Sequence
  Synthetic DNA
ttaaacggcttactatag

SEQ ID NO: 22432 - DNA, 18 bp, Artificial Sequence
  Synthetic DNA
ttaaccgactcagtatag

SEQ ID NO: 22433 - DNA, 18 bp, Artificial Sequence
  Synthetic DNA
ttaagcgtctcactatag

SEQ ID NO: 22434 - DNA, 18 bp, Artificial Sequence
  Synthetic DNA
ttacaccactcactaaag

SEQ ID NO: 22435 - DNA, 18 bp, Artificial Sequence
  Synthetic DNA
ttacacgaaacactatag

SEQ ID NO: 22436 - DNA, 18 bp, Artificial Sequence
  Synthetic DNA
ttacacgactccatatag

SEQ ID NO: 22437 - DNA, 18 bp, Artificial Sequence
  Synthetic DNA
ttacacgactgactaaag

SEQ ID NO: 22438 - DNA, 18 bp, Artificial Sequence
  Synthetic DNA
ttagacaattcactatag

SEQ ID NO: 22439 - DNA, 18 bp, Artificial Sequence
  Synthetic DNA
ttataacacacactatag

SEQ ID NO: 22440 - DNA, 18 bp, Artificial Sequence
  Synthetic DNA
ttataagagtcactaaag

SEQ ID NO: 22441 - DNA, 18 bp, Artificial Sequence
  Synthetic DNA
ttatacaactcacgacag

SEQ ID NO: 22442 - DNA, 18 bp, Artificial Sequence
  Synthetic DNA
ttatacaactgactatcg

SEQ ID NO: 22443 - DNA, 18 bp, Artificial Sequence
  Synthetic DNA
ttataccactcattatcg

SEQ ID NO: 22444 - DNA, 18 bp, Artificial Sequence
  Synthetic DNA
ttataccattcactacag

SEQ ID NO: 22445 - DNA, 18 bp, Artificial Sequence
  Synthetic DNA
ttatacccctccctatag

SEQ ID NO: 22446 - DNA, 18 bp, Artificial Sequence
  Synthetic DNA
ttataccgatcactatag

SEQ ID NO: 22447 - DNA, 18 bp, Artificial Sequence
  Synthetic DNA
ttataccgctcacgatag

SEQ ID NO: 22448 - DNA, 18 bp, Artificial Sequence
  Synthetic DNA
ttatacgaagctctatag

SEQ ID NO: 22449 - DNA, 18 bp, Artificial Sequence
  Synthetic DNA
ttatacgaatcacaatgg

SEQ ID NO: 22450 - DNA, 18 bp, Artificial Sequence
  Synthetic DNA
ttatacgaatcagtaaag

SEQ ID NO: 22451 - DNA, 18 bp, Artificial Sequence
  Synthetic DNA
ttatacgacacacgacag

SEQ ID NO: 22452 - DNA, 18 bp, Artificial Sequence
  Synthetic DNA
ttatacgacccacaaaag

SEQ ID NO: 22453 - DNA, 18 bp, Artificial Sequence
  Synthetic DNA
ttatacgacccatgatag

SEQ ID NO: 22454 - DNA, 18 bp, Artificial Sequence
  Synthetic DNA
ttatacgacctactaaag

SEQ ID NO: 22455 - DNA, 18 bp, Artificial Sequence
  Synthetic DNA
ttatacgactcaccctcg

SEQ ID NO: 22456 - DNA, 18 bp, Artificial Sequence
  Synthetic DNA
ttatacgactcacggaag

SEQ ID NO: 22457 - DNA, 18 bp, Artificial Sequence
  Synthetic DNA
ttatacgactcatcatgg

SEQ ID NO: 22458 - DNA, 18 bp, Artificial Sequence
  Synthetic DNA
ttatacgactcccgctag

SEQ ID NO: 22459 - DNA, 18 bp, Artificial Sequence
  Synthetic DNA
ttatacgactctctcgag

SEQ ID NO: 22460 - DNA, 18 bp, Artificial Sequence
  Synthetic DNA
ttatacgacttactgtcg

SEQ ID NO: 22461 - DNA, 18 bp, Artificial Sequence
  Synthetic DNA
ttatacgacttactttcg

SEQ ID NO: 22462 - DNA, 18 bp, Artificial Sequence
  Synthetic DNA
ttatacgacttagtttag

SEQ ID NO: 22463 - DNA, 18 bp, Artificial Sequence
  Synthetic DNA
ttatacgacttcctaaag

SEQ ID NO: 22464 - DNA, 18 bp, Artificial Sequence
  Synthetic DNA
ttatacgagtcacattag

SEQ ID NO: 22465 - DNA, 18 bp, Artificial Sequence
  Synthetic DNA
ttatacgatccactatcg

SEQ ID NO: 22466 - DNA, 18 bp, Artificial Sequence
  Synthetic DNA
ttatacgccgctctatag

SEQ ID NO: 22467 - DNA, 18 bp, Artificial Sequence
  Synthetic DNA
ttatacgcctcattttag

SEQ ID NO: 22468 - DNA, 18 bp, Artificial Sequence
  Synthetic DNA
ttatacggctccatatag

SEQ ID NO: 22469 - DNA, 18 bp, Artificial Sequence
  Synthetic DNA
ttatacgtctctccatag

SEQ ID NO: 22470 - DNA, 18 bp, Artificial Sequence
  Synthetic DNA
ttatactaatcactagag

SEQ ID NO: 22471 - DNA, 18 bp, Artificial Sequence
  Synthetic DNA
ttatactacacactacag

SEQ ID NO: 22472 - DNA, 18 bp, Artificial Sequence
  Synthetic DNA
ttatactacgtactatag

SEQ ID NO: 22473 - DNA, 18 bp, Artificial Sequence
  Synthetic DNA
ttatactactcaggatag

SEQ ID NO: 22474 - DNA, 18 bp, Artificial Sequence
  Synthetic DNA
ttatactattcaatatag

SEQ ID NO: 22475 - DNA, 18 bp, Artificial Sequence
  Synthetic DNA
ttataggactctatatag

SEQ ID NO: 22476 - DNA, 18 bp, Artificial Sequence
  Synthetic DNA
ttataggactctctatcg

SEQ ID NO: 22477 - DNA, 18 bp, Artificial Sequence
  Synthetic DNA
ttataggtctcactgtag

SEQ ID NO: 22478 - DNA, 18 bp, Artificial Sequence
  Synthetic DNA
ttatataactcactctag

SEQ ID NO: 22479 - DNA, 18 bp, Artificial Sequence
  Synthetic DNA
ttatatgaatcaccatag

SEQ ID NO: 22480 - DNA, 18 bp, Artificial Sequence
  Synthetic DNA
ttatatgactaactatgg

SEQ ID NO: 22481 - DNA, 18 bp, Artificial Sequence
  Synthetic DNA
ttatatggcccactatag

SEQ ID NO: 22482 - DNA, 18 bp, Artificial Sequence
  Synthetic DNA
ttatccgactctctatgg

SEQ ID NO: 22483 - DNA, 18 bp, Artificial Sequence
  Synthetic DNA
ttatccgacttactaaag

SEQ ID NO: 22484 - DNA, 18 bp, Artificial Sequence
  Synthetic DNA
ttatccgtcccactatag

SEQ ID NO: 22485 - DNA, 18 bp, Artificial Sequence
  Synthetic DNA
ttatgcgactcacaatgg

SEQ ID NO: 22486 - DNA, 18 bp, Artificial Sequence
  Synthetic DNA
ttatgcggctaactatag

SEQ ID NO: 22487 - DNA, 18 bp, Artificial Sequence
  Synthetic DNA
ttctacgtcgcactatag

SEQ ID NO: 22488 - DNA, 18 bp, Artificial Sequence
  Synthetic DNA
ttctatgactcactctag

SEQ ID NO: 22489 - DNA, 18 bp, Artificial Sequence
  Synthetic DNA
ttgtacgactcagtatgg

SEQ ID NO: 22490 - DNA, 18 bp, Artificial Sequence
  Synthetic DNA
ttgtacgactccccatag

SEQ ID NO: 22491 - DNA, 18 bp, Artificial Sequence
  Synthetic DNA
ttgtacgattcactgtag

SEQ ID NO: 22492 - DNA, 18 bp, Artificial Sequence
  Synthetic DNA
tttcacgagtcactatag

SEQ ID NO: 22493 - DNA, 18 bp, Artificial Sequence
  Synthetic DNA
ttttatgactaactatag

SEQ ID NO: 22494 - DNA, 18 bp, Artificial Sequence
  Synthetic DNA
aatttcgactcactatcg

SEQ ID NO: 22495 - DNA, 18 bp, Artificial Sequence
  Synthetic DNA
taattagattcaatatag

SEQ ID NO: 22496 - DNA, 18 bp, Artificial Sequence
  Synthetic DNA
cattacgtcacactatag

SEQ ID NO: 22497 - DNA, 18 bp, Artificial Sequence
  Synthetic DNA
tttcacgactcactttag

SEQ ID NO: 22498 - DNA, 18 bp, Artificial Sequence
  Synthetic DNA
aaatatgtctcactacag

SEQ ID NO: 22499 - DNA, 18 bp, Artificial Sequence
  Synthetic DNA
taaaacgattcattttag

SEQ ID NO: 22500 - DNA, 18 bp, Artificial Sequence
  Synthetic DNA
taatacgacgagctattg

SEQ ID NO: 22501 - DNA, 18 bp, Artificial Sequence
  Synthetic DNA
gcattcgactcaatatag

SEQ ID NO: 22502 - DNA, 18 bp, Artificial Sequence
  Synthetic DNA
taatatgactcccttttg

SEQ ID NO: 22503 - DNA, 18 bp, Artificial Sequence
  Synthetic DNA
taattcgattcaataaag

SEQ ID NO: 22504 - DNA, 18 bp, Artificial Sequence
  Synthetic DNA
taattcgtattactatag

SEQ ID NO: 22505 - DNA, 18 bp, Artificial Sequence
  Synthetic DNA
tattacaactcactactg

SEQ ID NO: 22506 - DNA, 18 bp, Artificial Sequence
  Synthetic DNA
tattatgactcacaattg

SEQ ID NO: 22507 - DNA, 18 bp, Artificial Sequence
  Synthetic DNA
ttattcgactcagtaaag

SEQ ID NO: 22508 - DNA, 18 bp, Artificial Sequence
  Synthetic DNA
ttgtacgacacactattg

SEQ ID NO: 22509 - DNA, 18 bp, Artificial Sequence
  Synthetic DNA
aatgacgactcactttag

SEQ ID NO: 22510 - DNA, 18 bp, Artificial Sequence
  Synthetic DNA
taaaacgacacagtaaag

SEQ ID NO: 22511 - DNA, 18 bp, Artificial Sequence
  Synthetic DNA
taatacgataccctttag

SEQ ID NO: 22512 - DNA, 18 bp, Artificial Sequence
  Synthetic DNA
taatacgtaacactttag

SEQ ID NO: 22513 - DNA, 18 bp, Artificial Sequence
  Synthetic DNA
taatacgtctcataaaag

SEQ ID NO: 22514 - DNA, 18 bp, Artificial Sequence
  Synthetic DNA
tataactactcactctag

SEQ ID NO: 22515 - DNA, 18 bp, Artificial Sequence
  Synthetic DNA
tgatacgtctttctatag

SEQ ID NO: 22516 - DNA, 18 bp, Artificial Sequence
  Synthetic DNA
ttatacgacccaataaag

SEQ ID NO: 22517 - DNA, 18 bp, Artificial Sequence
  Synthetic DNA
ttatacgacttactaacg

SEQ ID NO: 22518 - DNA, 18 bp, Artificial Sequence
  Synthetic DNA
ttatacgacttattctag

SEQ ID NO: 22519 - DNA, 18 bp, Artificial Sequence
  Synthetic DNA
ttttacgactcacattag

SEQ ID NO: 22520 - DNA, 18 bp, Artificial Sequence
  Synthetic DNA
tatattgactcactatag

SEQ ID NO: 22521 - DNA, 18 bp, Artificial Sequence
  Synthetic DNA
tataacgactctctaaag

SEQ ID NO: 22522 - DNA, 18 bp, Artificial Sequence
  Synthetic DNA
tattatgactcgctattg

SEQ ID NO: 22523 - DNA, 18 bp, Artificial Sequence
  Synthetic DNA
aaaaaccactcactattg

SEQ ID NO: 22524 - DNA, 18 bp, Artificial Sequence
  Synthetic DNA
aaatacgactctccattg

SEQ ID NO: 22525 - DNA, 18 bp, Artificial Sequence
  Synthetic DNA
aaattcgactcaatatcg

SEQ ID NO: 22526 - DNA, 18 bp, Artificial Sequence
  Synthetic DNA
aaattcgactctctacag

SEQ ID NO: 22527 - DNA, 18 bp, Artificial Sequence
  Synthetic DNA
aaatttgtctcactatag

SEQ ID NO: 22528 - DNA, 18 bp, Artificial Sequence
  Synthetic DNA
caaatcgtctcactatag

SEQ ID NO: 22529 - DNA, 18 bp, Artificial Sequence
  Synthetic DNA
taaataaactcactatag

SEQ ID NO: 22530 - DNA, 18 bp, Artificial Sequence
  Synthetic DNA
taactagactcactctag

SEQ ID NO: 22531 - DNA, 18 bp, Artificial Sequence
  Synthetic DNA
taactcgactctcaatag

SEQ ID NO: 22532 - DNA, 18 bp, Artificial Sequence
  Synthetic DNA
taagacgacttgctaaag

SEQ ID NO: 22533 - DNA, 18 bp, Artificial Sequence
  Synthetic DNA
taataagactcactcatg

SEQ ID NO: 22534 - DNA, 18 bp, Artificial Sequence
  Synthetic DNA
taataagactcgcttaag

SEQ ID NO: 22535 - DNA, 18 bp, Artificial Sequence
  Synthetic DNA
taataccactcattaatg

SEQ ID NO: 22536 - DNA, 18 bp, Artificial Sequence
  Synthetic DNA
taataccactgactaatg

SEQ ID NO: 22537 - DNA, 18 bp, Artificial Sequence
  Synthetic DNA
taatacgaatctctaatg

SEQ ID NO: 22538 - DNA, 18 bp, Artificial Sequence
  Synthetic DNA
taatacgagtcattaatg

SEQ ID NO: 22539 - DNA, 18 bp, Artificial Sequence
  Synthetic DNA
taatacgcctcattaatg

SEQ ID NO: 22540 - DNA, 18 bp, Artificial Sequence
  Synthetic DNA
taatacgtatcactactg

SEQ ID NO: 22541 - DNA, 18 bp, Artificial Sequence
  Synthetic DNA
taatactacgccctattg

SEQ ID NO: 22542 - DNA, 18 bp, Artificial Sequence
  Synthetic DNA
taataggacacactagtg

SEQ ID NO: 22543 - DNA, 18 bp, Artificial Sequence
  Synthetic DNA
taatataactcgcaatag

SEQ ID NO: 22544 - DNA, 18 bp, Artificial Sequence
  Synthetic DNA
taatattactcactagtg

SEQ ID NO: 22545 - DNA, 18 bp, Artificial Sequence
  Synthetic DNA
taatccgactcgctaacg

SEQ ID NO: 22546 - DNA, 18 bp, Artificial Sequence
  Synthetic DNA
taatgcgaataactattg

SEQ ID NO: 22547 - DNA, 18 bp, Artificial Sequence
  Synthetic DNA
taattcgtatcactatgg

SEQ ID NO: 22548 - DNA, 18 bp, Artificial Sequence
  Synthetic DNA
taattcgtctcaatatcg

SEQ ID NO: 22549 - DNA, 18 bp, Artificial Sequence
  Synthetic DNA
taattctactatctatag

SEQ ID NO: 22550 - DNA, 18 bp, Artificial Sequence
  Synthetic DNA
taatttgacttactacag

SEQ ID NO: 22551 - DNA, 18 bp, Artificial Sequence
  Synthetic DNA
tagtacggctcattattg

SEQ ID NO: 22552 - DNA, 18 bp, Artificial Sequence
  Synthetic DNA
tattaagactcaatattg

SEQ ID NO: 22553 - DNA, 18 bp, Artificial Sequence
  Synthetic DNA
tatttcgactcactaacg

SEQ ID NO: 22554 - DNA, 18 bp, Artificial Sequence
  Synthetic DNA
ttatacgactaaccattg

SEQ ID NO: 22555 - DNA, 18 bp, Artificial Sequence
  Synthetic DNA
ttattcgactaactttag

SEQ ID NO: 22556 - DNA, 18 bp, Artificial Sequence
  Synthetic DNA
aaaaacgaatcaatatag

SEQ ID NO: 22557 - DNA, 18 bp, Artificial Sequence
  Synthetic DNA
aaataagactcaatttag

SEQ ID NO: 22558 - DNA, 18 bp, Artificial Sequence
  Synthetic DNA
aaataagattcacaatag

SEQ ID NO: 22559 - DNA, 18 bp, Artificial Sequence
  Synthetic DNA
aaatacaacactctatag

SEQ ID NO: 22560 - DNA, 18 bp, Artificial Sequence
  Synthetic DNA
aaatacgaatcactttgg

SEQ ID NO: 22561 - DNA, 18 bp, Artificial Sequence
  Synthetic DNA
aaatacgatccactaaag

SEQ ID NO: 22562 - DNA, 18 bp, Artificial Sequence
  Synthetic DNA
aaatactattcattatag

SEQ ID NO: 22563 - DNA, 18 bp, Artificial Sequence
  Synthetic DNA
aaataggactctatatag

SEQ ID NO: 22564 - DNA, 18 bp, Artificial Sequence
  Synthetic DNA
aaatccgcctcacaatag

SEQ ID NO: 22565 - DNA, 18 bp, Artificial Sequence
  Synthetic DNA
acatacgactcataatag

SEQ ID NO: 22566 - DNA, 18 bp, Artificial Sequence
  Synthetic DNA
atacacgacttactatag

SEQ ID NO: 22567 - DNA, 18 bp, Artificial Sequence
  Synthetic DNA
caaaacgactcaccacag

SEQ ID NO: 22568 - DNA, 18 bp, Artificial Sequence
  Synthetic DNA
caatacgcatcactaaag

SEQ ID NO: 22569 - DNA, 18 bp, Artificial Sequence
  Synthetic DNA
taaaacgattctctgtag

SEQ ID NO: 22570 - DNA, 18 bp, Artificial Sequence
  Synthetic DNA
taaaacgctttactatag

SEQ ID NO: 22571 - DNA, 18 bp, Artificial Sequence
  Synthetic DNA
taaaacgtcacactatgg

SEQ ID NO: 22572 - DNA, 18 bp, Artificial Sequence
  Synthetic DNA
taaagccactcactacag

SEQ ID NO: 22573 - DNA, 18 bp, Artificial Sequence
  Synthetic DNA
taagacaacacaatatag

SEQ ID NO: 22574 - DNA, 18 bp, Artificial Sequence
  Synthetic DNA
taataaaactctctaaag

SEQ ID NO: 22575 - DNA, 18 bp, Artificial Sequence
  Synthetic DNA
taataagaatcaaaatag

SEQ ID NO: 22576 - DNA, 18 bp, Artificial Sequence
  Synthetic DNA
taataagaatcactaacg

SEQ ID NO: 22577 - DNA, 18 bp, Artificial Sequence
  Synthetic DNA
taataagactccatatgg

SEQ ID NO: 22578 - DNA, 18 bp, Artificial Sequence
  Synthetic DNA
taatacaaccaactttag

SEQ ID NO: 22579 - DNA, 18 bp, Artificial Sequence
  Synthetic DNA
taatacaactcacccaag

SEQ ID NO: 22580 - DNA, 18 bp, Artificial Sequence
  Synthetic DNA
taataccaatcattatgg

SEQ ID NO: 22581 - DNA, 18 bp, Artificial Sequence
  Synthetic DNA
taatacgacagacactag

SEQ ID NO: 22582 - DNA, 18 bp, Artificial Sequence
  Synthetic DNA
taatacgattcaatgaag

SEQ ID NO: 22583 - DNA, 18 bp, Artificial Sequence
  Synthetic DNA
taatacgcatcacattag

SEQ ID NO: 22584 - DNA, 18 bp, Artificial Sequence
  Synthetic DNA
taatacggttcactgaag

SEQ ID NO: 22585 - DNA, 18 bp, Artificial Sequence
  Synthetic DNA
taatacgtccctctttag

SEQ ID NO: 22586 - DNA, 18 bp, Artificial Sequence
  Synthetic DNA
taatacgtctcataatcg

SEQ ID NO: 22587 - DNA, 18 bp, Artificial Sequence
  Synthetic DNA
taatactacactctgtag

SEQ ID NO: 22588 - DNA, 18 bp, Artificial Sequence
  Synthetic DNA
taatactacgctcaatag

SEQ ID NO: 22589 - DNA, 18 bp, Artificial Sequence
  Synthetic DNA
taatatgacttaatctag

SEQ ID NO: 22590 - DNA, 18 bp, Artificial Sequence
  Synthetic DNA
taatccaactcataatag

SEQ ID NO: 22591 - DNA, 18 bp, Artificial Sequence
  Synthetic DNA
taatccgactctttatgg

SEQ ID NO: 22592 - DNA, 18 bp, Artificial Sequence
  Synthetic DNA
taatcctactctcaatag

SEQ ID NO: 22593 - DNA, 18 bp, Artificial Sequence
  Synthetic DNA
tactacgactaacattag

SEQ ID NO: 22594 - DNA, 18 bp, Artificial Sequence
  Synthetic DNA
tagtaatactctctatag

SEQ ID NO: 22595 - DNA, 18 bp, Artificial Sequence
  Synthetic DNA
tataaccgctcactatag

SEQ ID NO: 22596 - DNA, 18 bp, Artificial Sequence
  Synthetic DNA
tataacgactaaatatag

SEQ ID NO: 22597 - DNA, 18 bp, Artificial Sequence
  Synthetic DNA
tataacggctctctatag

SEQ ID NO: 22598 - DNA, 18 bp, Artificial Sequence
  Synthetic DNA
tataactactcactttag

SEQ ID NO: 22599 - DNA, 18 bp, Artificial Sequence
  Synthetic DNA
tatcacgaatcactaaag

SEQ ID NO: 22600 - DNA, 18 bp, Artificial Sequence
  Synthetic DNA
tattaagtctcactctag

SEQ ID NO: 22601 - DNA, 18 bp, Artificial Sequence
  Synthetic DNA
tattacgactaaacatag

SEQ ID NO: 22602 - DNA, 18 bp, Artificial Sequence
  Synthetic DNA
tattacgtatcactgtag

SEQ ID NO: 22603 - DNA, 18 bp, Artificial Sequence
  Synthetic DNA
tattacgtctcactaccg

SEQ ID NO: 22604 - DNA, 18 bp, Artificial Sequence
  Synthetic DNA
tattacgtctcactgtcg

SEQ ID NO: 22605 - DNA, 18 bp, Artificial Sequence
  Synthetic DNA
tattccgtctcagtatag

SEQ ID NO: 22606 - DNA, 18 bp, Artificial Sequence
  Synthetic DNA
tattctgactcactaaag

SEQ ID NO: 22607 - DNA, 18 bp, Artificial Sequence
  Synthetic DNA
tattctgactcactagag

SEQ ID NO: 22608 - DNA, 18 bp, Artificial Sequence
  Synthetic DNA
tcatacggctcaataaag

SEQ ID NO: 22609 - DNA, 18 bp, Artificial Sequence
  Synthetic DNA
tcatacgtcacactgtag

SEQ ID NO: 22610 - DNA, 18 bp, Artificial Sequence
  Synthetic DNA
tgatacgacacacagtag

SEQ ID NO: 22611 - DNA, 18 bp, Artificial Sequence
  Synthetic DNA
ttataagactcagtttag

SEQ ID NO: 22612 - DNA, 18 bp, Artificial Sequence
  Synthetic DNA
ttatacgactgacaatcg

SEQ ID NO: 22613 - DNA, 18 bp, Artificial Sequence
  Synthetic DNA
ttatacggctctctaaag

SEQ ID NO: 22614 - DNA, 18 bp, Artificial Sequence
  Synthetic DNA
ttatacgtctcactggag

SEQ ID NO: 22615 - DNA, 18 bp, Artificial Sequence
  Synthetic DNA
ttcaacgactaactatag

SEQ ID NO: 22616 - DNA, 18 bp, Artificial Sequence
  Synthetic DNA
ttgtacgactcacagtag

SEQ ID NO: 22617 - DNA, 18 bp, Artificial Sequence
  Synthetic DNA
tttaacgactcaatatag

SEQ ID NO: 22618 - DNA, 18 bp, Artificial Sequence
  Synthetic DNA
ttttacgactaactttag

SEQ ID NO: 22619 - DNA, 18 bp, Artificial Sequence
  Synthetic DNA
ttattcgaatcattatag

SEQ ID NO: 22620 - DNA, 18 bp, Artificial Sequence
  Synthetic DNA
atacacgactctctatag

SEQ ID NO: 22621 - DNA, 18 bp, Artificial Sequence
  Synthetic DNA
caattcgactgcctatag

SEQ ID NO: 22622 - DNA, 18 bp, Artificial Sequence
  Synthetic DNA
taatacatcacactattg

SEQ ID NO: 22623 - DNA, 18 bp, Artificial Sequence
  Synthetic DNA
taatacgacactgtattg

SEQ ID NO: 22624 - DNA, 18 bp, Artificial Sequence
  Synthetic DNA
taattctactacctatag

SEQ ID NO: 22625 - DNA, 18 bp, Artificial Sequence
  Synthetic DNA
tattacaactcaatattg

SEQ ID NO: 22626 - DNA, 18 bp, Artificial Sequence
  Synthetic DNA
tatttctaatcactatag

SEQ ID NO: 22627 - DNA, 18 bp, Artificial Sequence
  Synthetic DNA
tctaacgactcactattg

SEQ ID NO: 22628 - DNA, 18 bp, Artificial Sequence
  Synthetic DNA
ttatacaactcgcaatag

SEQ ID NO: 22629 - DNA, 18 bp, Artificial Sequence
  Synthetic DNA
aaatatgactcacttaag

SEQ ID NO: 22630 - DNA, 18 bp, Artificial Sequence
  Synthetic DNA
taaaacgattctatatag

SEQ ID NO: 22631 - DNA, 18 bp, Artificial Sequence
  Synthetic DNA
taaaacgtctcaccttag

SEQ ID NO: 22632 - DNA, 18 bp, Artificial Sequence
  Synthetic DNA
taataagaaacattatag

SEQ ID NO: 22633 - DNA, 18 bp, Artificial Sequence
  Synthetic DNA
taatacaacacaatatcg

SEQ ID NO: 22634 - DNA, 18 bp, Artificial Sequence
  Synthetic DNA
taatacaacactctacag

SEQ ID NO: 22635 - DNA, 18 bp, Artificial Sequence
  Synthetic DNA
taatacgactaaaaaaag

SEQ ID NO: 22636 - DNA, 18 bp, Artificial Sequence
  Synthetic DNA
taatactacccacaaaag

SEQ ID NO: 22637 - DNA, 18 bp, Artificial Sequence
  Synthetic DNA
taatactcctcacttaag

SEQ ID NO: 22638 - DNA, 18 bp, Artificial Sequence
  Synthetic DNA
taatatgacttacattag

SEQ ID NO: 22639 - DNA, 18 bp, Artificial Sequence
  Synthetic DNA
taatcctactcattaaag

SEQ ID NO: 22640 - DNA, 18 bp, Artificial Sequence
  Synthetic DNA
taatgcaactctcaatag

SEQ ID NO: 22641 - DNA, 18 bp, Artificial Sequence
  Synthetic DNA
tactacgtctctctttag

SEQ ID NO: 22642 - DNA, 18 bp, Artificial Sequence
  Synthetic DNA
tataacaactcactatcg

SEQ ID NO: 22643 - DNA, 18 bp, Artificial Sequence
  Synthetic DNA
tataactactcactatcg

SEQ ID NO: 22644 - DNA, 18 bp, Artificial Sequence
  Synthetic DNA
tattacaactcagaatag

SEQ ID NO: 22645 - DNA, 18 bp, Artificial Sequence
  Synthetic DNA
tattgcgtctcaatatag

SEQ ID NO: 22646 - DNA, 18 bp, Artificial Sequence
  Synthetic DNA
ttacaccattcactatag

SEQ ID NO: 22647 - DNA, 18 bp, Artificial Sequence
  Synthetic DNA
ttatattactcactgtag

SEQ ID NO: 22648 - DNA, 18 bp, Artificial Sequence
  Synthetic DNA
taatatgactcgctaatg

SEQ ID NO: 22649 - DNA, 18 bp, Artificial Sequence
  Synthetic DNA
tgattcgacacactattg

SEQ ID NO: 22650 - DNA, 18 bp, Artificial Sequence
  Synthetic DNA
ttattcgaatcactttag

SEQ ID NO: 22651 - DNA, 18 bp, Artificial Sequence
  Synthetic DNA
taaaatgactctcaatag

SEQ ID NO: 22652 - DNA, 18 bp, Artificial Sequence
  Synthetic DNA
aaattccactcactgtag

SEQ ID NO: 22653 - DNA, 18 bp, Artificial Sequence
  Synthetic DNA
atattcggctcactatag

SEQ ID NO: 22654 - DNA, 18 bp, Artificial Sequence
  Synthetic DNA
ctatacgtctcgctatag

SEQ ID NO: 22655 - DNA, 18 bp, Artificial Sequence
  Synthetic DNA
taaaacgacacagtattg

SEQ ID NO: 22656 - DNA, 18 bp, Artificial Sequence
  Synthetic DNA
taatacttctcacttttg

SEQ ID NO: 22657 - DNA, 18 bp, Artificial Sequence
  Synthetic DNA
taatttgacttactaaag

SEQ ID NO: 22658 - DNA, 18 bp, Artificial Sequence
  Synthetic DNA
tatttcgactcataatag

SEQ ID NO: 22659 - DNA, 18 bp, Artificial Sequence
  Synthetic DNA
ttattcgacacactgtag

SEQ ID NO: 22660 - DNA, 18 bp, Artificial Sequence
  Synthetic DNA
atttacgactcactatcg

SEQ ID NO: 22661 - DNA, 18 bp, Artificial Sequence
  Synthetic DNA
cgatacgactctcaatag

SEQ ID NO: 22662 - DNA, 18 bp, Artificial Sequence
  Synthetic DNA
taaaacgacaaacaatag

SEQ ID NO: 22663 - DNA, 18 bp, Artificial Sequence
  Synthetic DNA
tatcacgattcaccatag

SEQ ID NO: 22664 - DNA, 18 bp, Artificial Sequence
  Synthetic DNA
tattatgactaacaatag

SEQ ID NO: 22665 - DNA, 18 bp, Artificial Sequence
  Synthetic DNA
tattatgactcacaatcg

SEQ ID NO: 22666 - DNA, 18 bp, Artificial Sequence
  Synthetic DNA
tattccgactcacattag

SEQ ID NO: 22667 - DNA, 18 bp, Artificial Sequence
  Synthetic DNA
ttatacgactctttttag

SEQ ID NO: 22668 - DNA, 18 bp, Artificial Sequence
  Synthetic DNA
ttttacgactcacttcag

SEQ ID NO: 22669 - DNA, 18 bp, Artificial Sequence
  Synthetic DNA
ttttacgacttactctag

SEQ ID NO: 22670 - DNA, 18 bp, Artificial Sequence
  Synthetic DNA
caattcgactcacaattg

SEQ ID NO: 22671 - DNA, 18 bp, Artificial Sequence
  Synthetic DNA
taacccgactcgctattg

SEQ ID NO: 22672 - DNA, 18 bp, Artificial Sequence
  Synthetic DNA
taatacaactggctattg

SEQ ID NO: 22673 - DNA, 18 bp, Artificial Sequence
  Synthetic DNA
taatacgaatcgcttttg

SEQ ID NO: 22674 - DNA, 18 bp, Artificial Sequence
  Synthetic DNA
taatacgacacgccattg

SEQ ID NO: 22675 - DNA, 18 bp, Artificial Sequence
  Synthetic DNA
taatacggctcgctgttg

SEQ ID NO: 22676 - DNA, 18 bp, Artificial Sequence
  Synthetic DNA
taattcaactagctatag

SEQ ID NO: 22677 - DNA, 18 bp, Artificial Sequence
  Synthetic DNA
taattccactcaccattg

SEQ ID NO: 22678 - DNA, 18 bp, Artificial Sequence
  Synthetic DNA
taattcgaattgctatag

SEQ ID NO: 22679 - DNA, 18 bp, Artificial Sequence
  Synthetic DNA
taattcgactcaacattg

SEQ ID NO: 22680 - DNA, 18 bp, Artificial Sequence
  Synthetic DNA
taattcgactcgcttcag

SEQ ID NO: 22681 - DNA, 18 bp, Artificial Sequence
  Synthetic DNA
taattcggctcaccattg

SEQ ID NO: 22682 - DNA, 18 bp, Artificial Sequence
  Synthetic DNA
taattcgtctagctatag

SEQ ID NO: 22683 - DNA, 18 bp, Artificial Sequence
  Synthetic DNA
taattcgtctcgctctag

SEQ ID NO: 22684 - DNA, 18 bp, Artificial Sequence
  Synthetic DNA
taattctactcaccattg

SEQ ID NO: 22685 - DNA, 18 bp, Artificial Sequence
  Synthetic DNA
taattggactccctattg

SEQ ID NO: 22686 - DNA, 18 bp, Artificial Sequence
  Synthetic DNA
taatttgactcgctatgg

SEQ ID NO: 22687 - DNA, 18 bp, Artificial Sequence
  Synthetic DNA
tactacgaatcgctattg

SEQ ID NO: 22688 - DNA, 18 bp, Artificial Sequence
  Synthetic DNA
tactacggctcgctattg

SEQ ID NO: 22689 - DNA, 18 bp, Artificial Sequence
  Synthetic DNA
tacttagactcactattg

SEQ ID NO: 22690 - DNA, 18 bp, Artificial Sequence
  Synthetic DNA
aaataccgctcgctatag

SEQ ID NO: 22691 - DNA, 18 bp, Artificial Sequence
  Synthetic DNA
aaatacgactcacgactg

SEQ ID NO: 22692 - DNA, 18 bp, Artificial Sequence
  Synthetic DNA
aaatacgactccccattg

SEQ ID NO: 22693 - DNA, 18 bp, Artificial Sequence
  Synthetic DNA
aaattcaactccctatag

SEQ ID NO: 22694 - DNA, 18 bp, Artificial Sequence
  Synthetic DNA
aaattcgactcaccatgg

SEQ ID NO: 22695 - DNA, 18 bp, Artificial Sequence
  Synthetic DNA
aaattcgactgattatag

SEQ ID NO: 22696 - DNA, 18 bp, Artificial Sequence
  Synthetic DNA
aaattcgacttactgtag

SEQ ID NO: 22697 - DNA, 18 bp, Artificial Sequence
  Synthetic DNA
aacaacgactcgctatag

SEQ ID NO: 22698 - DNA, 18 bp, Artificial Sequence
  Synthetic DNA
aacttagactcactatag

SEQ ID NO: 22699 - DNA, 18 bp, Artificial Sequence
  Synthetic DNA
aagtacgaatcactattg

SEQ ID NO: 22700 - DNA, 18 bp, Artificial Sequence
  Synthetic DNA
caaaacgactctctattg

SEQ ID NO: 22701 - DNA, 18 bp, Artificial Sequence
  Synthetic DNA
caaatcgactcactttag

SEQ ID NO: 22702 - DNA, 18 bp, Artificial Sequence
  Synthetic DNA
caatacaactcagtattg

SEQ ID NO: 22703 - DNA, 18 bp, Artificial Sequence
  Synthetic DNA
caatacgactaactactg

SEQ ID NO: 22704 - DNA, 18 bp, Artificial Sequence
  Synthetic DNA
caattcgacccactttag

SEQ ID NO: 22705 - DNA, 18 bp, Artificial Sequence
  Synthetic DNA
caattcgactcactaacg

SEQ ID NO: 22706 - DNA, 18 bp, Artificial Sequence
  Synthetic DNA
caattcgcctcactttag

SEQ ID NO: 22707 - DNA, 18 bp, Artificial Sequence
  Synthetic DNA
cataacgactcgctatag

SEQ ID NO: 22708 - DNA, 18 bp, Artificial Sequence
  Synthetic DNA
ccatacaactcactattg

SEQ ID NO: 22709 - DNA, 18 bp, Artificial Sequence
  Synthetic DNA
gaataaaactcactattg

SEQ ID NO: 22710 - DNA, 18 bp, Artificial Sequence
  Synthetic DNA
gaatacgaatccctattg

SEQ ID NO: 22711 - DNA, 18 bp, Artificial Sequence
  Synthetic DNA
gaatacgatttactattg

SEQ ID NO: 22712 - DNA, 18 bp, Artificial Sequence
  Synthetic DNA
gacttcgactcagtatag

SEQ ID NO: 22713 - DNA, 18 bp, Artificial Sequence
  Synthetic DNA
gattacgattcactattg

SEQ ID NO: 22714 - DNA, 18 bp, Artificial Sequence
  Synthetic DNA
gtatacgactcactaatg

SEQ ID NO: 22715 - DNA, 18 bp, Artificial Sequence
  Synthetic DNA
gtatacgtctcactattg

SEQ ID NO: 22716 - DNA, 18 bp, Artificial Sequence
  Synthetic DNA
taaaaagactcactatta

SEQ ID NO: 22717 - DNA, 18 bp, Artificial Sequence
  Synthetic DNA
taaaacgactacctattg

SEQ ID NO: 22718 - DNA, 18 bp, Artificial Sequence
  Synthetic DNA
taaaacgtctcaatattg

SEQ ID NO: 22719 - DNA, 18 bp, Artificial Sequence
  Synthetic DNA
taaaacgtctcggtatag

SEQ ID NO: 22720 - DNA, 18 bp, Artificial Sequence
  Synthetic DNA
taaaatgactcactgttg

SEQ ID NO: 22721 - DNA, 18 bp, Artificial Sequence
  Synthetic DNA
taaaccgactcgctacag

SEQ ID NO: 22722 - DNA, 18 bp, Artificial Sequence
  Synthetic DNA
taaatcgaatcagtatag

SEQ ID NO: 22723 - DNA, 18 bp, Artificial Sequence
  Synthetic DNA
taaatcgactccctttag

SEQ ID NO: 22724 - DNA, 18 bp, Artificial Sequence
  Synthetic DNA
taacaagactcaccattg

SEQ ID NO: 22725 - DNA, 18 bp, Artificial Sequence
  Synthetic DNA
taacacaacccactattg

SEQ ID NO: 22726 - DNA, 18 bp, Artificial Sequence
  Synthetic DNA
taacacgactcacaactg

SEQ ID NO: 22727 - DNA, 18 bp, Artificial Sequence
  Synthetic DNA
taacacgacttactactg

SEQ ID NO: 22728 - DNA, 18 bp, Artificial Sequence
  Synthetic DNA
taacacgatttgctatag

SEQ ID NO: 22729 - DNA, 18 bp, Artificial Sequence
  Synthetic DNA
taacacgtctcacttttg

SEQ ID NO: 22730 - DNA, 18 bp, Artificial Sequence
  Synthetic DNA
taacgcgcctcactattg

SEQ ID NO: 22731 - DNA, 18 bp, Artificial Sequence
  Synthetic DNA
taactcacctcactatag

SEQ ID NO: 22732 - DNA, 18 bp, Artificial Sequence
  Synthetic DNA
taactcgaatcactttag

SEQ ID NO: 22733 - DNA, 18 bp, Artificial Sequence
  Synthetic DNA
taagactactcacttttg

SEQ ID NO: 22734 - DNA, 18 bp, Artificial Sequence
  Synthetic DNA
taagatgcctcactattg

SEQ ID NO: 22735 - DNA, 18 bp, Artificial Sequence
  Synthetic DNA
taagtccactcaatatag

SEQ ID NO: 22736 - DNA, 18 bp, Artificial Sequence
  Synthetic DNA
taagtcggctccctatag

SEQ ID NO: 22737 - DNA, 18 bp, Artificial Sequence
  Synthetic DNA
taataacaatcactattg

SEQ ID NO: 22738 - DNA, 18 bp, Artificial Sequence
  Synthetic DNA
taataagaatcgatatag

SEQ ID NO: 22739 - DNA, 18 bp, Artificial Sequence
  Synthetic DNA
taataagtctagctatag

SEQ ID NO: 22740 - DNA, 18 bp, Artificial Sequence
  Synthetic DNA
taatacaactcacctttg

SEQ ID NO: 22741 - DNA, 18 bp, Artificial Sequence
  Synthetic DNA
taatacaactctctcttg

SEQ ID NO: 22742 - DNA, 18 bp, Artificial Sequence
  Synthetic DNA
taatacaacttactagtg

SEQ ID NO: 22743 - DNA, 18 bp, Artificial Sequence
  Synthetic DNA
taatacaccccgctatag

SEQ ID NO: 22744 - DNA, 18 bp, Artificial Sequence
  Synthetic DNA
taatacgaaacgctaaag

SEQ ID NO: 22745 - DNA, 18 bp, Artificial Sequence
  Synthetic DNA
taatacgaaccacttttg

SEQ ID NO: 22746 - DNA, 18 bp, Artificial Sequence
  Synthetic DNA
taatacgaatctctactg

SEQ ID NO: 22747 - DNA, 18 bp, Artificial Sequence
  Synthetic DNA
taatacgacacagttttg

SEQ ID NO: 22748 - DNA, 18 bp, Artificial Sequence
  Synthetic DNA
taatacgacacccttttg

SEQ ID NO: 22749 - DNA, 18 bp, Artificial Sequence
  Synthetic DNA
taatacgacacgcagtag

SEQ ID NO: 22750 - DNA, 18 bp, Artificial Sequence
  Synthetic DNA
taatacgacatactatta

SEQ ID NO: 22751 - DNA, 18 bp, Artificial Sequence
  Synthetic DNA
taatacgaccaaccattg

SEQ ID NO: 22752 - DNA, 18 bp, Artificial Sequence
  Synthetic DNA
taatacgaccctctaatg

SEQ ID NO: 22753 - DNA, 18 bp, Artificial Sequence
  Synthetic DNA
taatacgaccggctacag

SEQ ID NO: 22754 - DNA, 18 bp, Artificial Sequence
  Synthetic DNA
taatacgacgcggtttag

SEQ ID NO: 22755 - DNA, 18 bp, Artificial Sequence
  Synthetic DNA
taatacgactaagtcttg

SEQ ID NO: 22756 - DNA, 18 bp, Artificial Sequence
  Synthetic DNA
taatacgactcagcactg

SEQ ID NO: 22757 - DNA, 18 bp, Artificial Sequence
  Synthetic DNA
taatacgactcccatttg

SEQ ID NO: 22758 - DNA, 18 bp, Artificial Sequence
  Synthetic DNA
taatacgactctggattg

SEQ ID NO: 22759 - DNA, 18 bp, Artificial Sequence
  Synthetic DNA
taatacgacttactcatg

SEQ ID NO: 22760 - DNA, 18 bp, Artificial Sequence
  Synthetic DNA
taatacgatgctctattg

SEQ ID NO: 22761 - DNA, 18 bp, Artificial Sequence
  Synthetic DNA
taatacgattctctagtg

SEQ ID NO: 22762 - DNA, 18 bp, Artificial Sequence
  Synthetic DNA
taatacgattgacaattg

SEQ ID NO: 22763 - DNA, 18 bp, Artificial Sequence
  Synthetic DNA
taatacgcaccactattg

SEQ ID NO: 22764 - DNA, 18 bp, Artificial Sequence
  Synthetic DNA
taatacgcctcacagttg

SEQ ID NO: 22765 - DNA, 18 bp, Artificial Sequence
  Synthetic DNA
taatacgcctgattattg

SEQ ID NO: 22766 - DNA, 18 bp, Artificial Sequence
  Synthetic DNA
taatacggttcattattg

SEQ ID NO: 22767 - DNA, 18 bp, Artificial Sequence
  Synthetic DNA
taatacgtctcgcttaag

SEQ ID NO: 22768 - DNA, 18 bp, Artificial Sequence
  Synthetic DNA
taatacgtcttaccattg

SEQ ID NO: 22769 - DNA, 18 bp, Artificial Sequence
  Synthetic DNA
taatactacctactattg

SEQ ID NO: 22770 - DNA, 18 bp, Artificial Sequence
  Synthetic DNA
taatactactcaatcttg

SEQ ID NO: 22771 - DNA, 18 bp, Artificial Sequence
  Synthetic DNA
taatactacttactgttg

SEQ ID NO: 22772 - DNA, 18 bp, Artificial Sequence
  Synthetic DNA
taatactattgactattg

SEQ ID NO: 22773 - DNA, 18 bp, Artificial Sequence
  Synthetic DNA
taatactcctcacttttg

SEQ ID NO: 22774 - DNA, 18 bp, Artificial Sequence
  Synthetic DNA
taatagaactcgctacag

SEQ ID NO: 22775 - DNA, 18 bp, Artificial Sequence
  Synthetic DNA
taataggactcacaaatg

SEQ ID NO: 22776 - DNA, 18 bp, Artificial Sequence
  Synthetic DNA
taataggtcttactattg

SEQ ID NO: 22777 - DNA, 18 bp, Artificial Sequence
  Synthetic DNA
taatatgacacaccattg

SEQ ID NO: 22778 - DNA, 18 bp, Artificial Sequence
  Synthetic DNA
taatatgacacgctttag

SEQ ID NO: 22779 - DNA, 18 bp, Artificial Sequence
  Synthetic DNA
taatattagtcactattg

SEQ ID NO: 22780 - DNA, 18 bp, Artificial Sequence
  Synthetic DNA
taatccgaatcattattg

SEQ ID NO: 22781 - DNA, 18 bp, Artificial Sequence
  Synthetic DNA
taatcggactcacaattg

SEQ ID NO: 22782 - DNA, 18 bp, Artificial Sequence
  Synthetic DNA
taatgcgactcgcaaaag

SEQ ID NO: 22783 - DNA, 18 bp, Artificial Sequence
  Synthetic DNA
taatgcgacttaatattg

SEQ ID NO: 22784 - DNA, 18 bp, Artificial Sequence
  Synthetic DNA
taattaaactcactaaag

SEQ ID NO: 22785 - DNA, 18 bp, Artificial Sequence
  Synthetic DNA
taattagactcagcatag

SEQ ID NO: 22786 - DNA, 18 bp, Artificial Sequence
  Synthetic DNA
taattagactccctttag

SEQ ID NO: 22787 - DNA, 18 bp, Artificial Sequence
  Synthetic DNA
taattagagtctctatag

SEQ ID NO: 22788 - DNA, 18 bp, Artificial Sequence
  Synthetic DNA
taattagattaactatag

SEQ ID NO: 22789 - DNA, 18 bp, Artificial Sequence
  Synthetic DNA
taattagtctcactatcg

SEQ ID NO: 22790 - DNA, 18 bp, Artificial Sequence
  Synthetic DNA
taattagtcttactatag

SEQ ID NO: 22791 - DNA, 18 bp, Artificial Sequence
  Synthetic DNA
taattcaaatccctatag

SEQ ID NO: 22792 - DNA, 18 bp, Artificial Sequence
  Synthetic DNA
taattcaacacacaatag

SEQ ID NO: 22793 - DNA, 18 bp, Artificial Sequence
  Synthetic DNA
taattcaacctactatag

SEQ ID NO: 22794 - DNA, 18 bp, Artificial Sequence
  Synthetic DNA
taattcaactcactgtgg

SEQ ID NO: 22795 - DNA, 18 bp, Artificial Sequence
  Synthetic DNA
taattccacacactctag

SEQ ID NO: 22796 - DNA, 18 bp, Artificial Sequence
  Synthetic DNA
taattcgaaaaactatag

SEQ ID NO: 22797 - DNA, 18 bp, Artificial Sequence
  Synthetic DNA
taattcgaaacactatgg

SEQ ID NO: 22798 - DNA, 18 bp, Artificial Sequence
  Synthetic DNA
taattcgaagcactacag

SEQ ID NO: 22799 - DNA, 18 bp, Artificial Sequence
  Synthetic DNA
taattcgaatcacagtag

SEQ ID NO: 22800 - DNA, 18 bp, Artificial Sequence
  Synthetic DNA
taattcgaatcaccgtag

SEQ ID NO: 22801 - DNA, 18 bp, Artificial Sequence
  Synthetic DNA
taattcgacacattatcg

SEQ ID NO: 22802 - DNA, 18 bp, Artificial Sequence
  Synthetic DNA
taattcgactcaaaagag

SEQ ID NO: 22803 - DNA, 18 bp, Artificial Sequence
  Synthetic DNA
taattcgactcaagttag

SEQ ID NO: 22804 - DNA, 18 bp, Artificial Sequence
  Synthetic DNA
taattcgactccttaaag

SEQ ID NO: 22805 - DNA, 18 bp, Artificial Sequence
  Synthetic DNA
taattcgactctcagtag

SEQ ID NO: 22806 - DNA, 18 bp, Artificial Sequence
  Synthetic DNA
taattcgactctccctag

SEQ ID NO: 22807 - DNA, 18 bp, Artificial Sequence
  Synthetic DNA
taattcgactctttacag

SEQ ID NO: 22808 - DNA, 18 bp, Artificial Sequence
  Synthetic DNA
taattcgattgaccatag

SEQ ID NO: 22809 - DNA, 18 bp, Artificial Sequence
  Synthetic DNA
taattcgccacacgatag

SEQ ID NO: 22810 - DNA, 18 bp, Artificial Sequence
  Synthetic DNA
taattcgccacactagag

SEQ ID NO: 22811 - DNA, 18 bp, Artificial Sequence
  Synthetic DNA
taattcgtatcactctag

SEQ ID NO: 22812 - DNA, 18 bp, Artificial Sequence
  Synthetic DNA
taattcgtcccactctag

SEQ ID NO: 22813 - DNA, 18 bp, Artificial Sequence
  Synthetic DNA
taattcgtcttactatgg

SEQ ID NO: 22814 - DNA, 18 bp, Artificial Sequence
  Synthetic DNA
taattcgtgacactatag

SEQ ID NO: 22815 - DNA, 18 bp, Artificial Sequence
  Synthetic DNA
taattctacccaccatag

SEQ ID NO: 22816 - DNA, 18 bp, Artificial Sequence
  Synthetic DNA
taattctactaactagag

SEQ ID NO: 22817 - DNA, 18 bp, Artificial Sequence
  Synthetic DNA
taattctattcacaatag

SEQ ID NO: 22818 - DNA, 18 bp, Artificial Sequence
  Synthetic DNA
taattggactcactctcg

SEQ ID NO: 22819 - DNA, 18 bp, Artificial Sequence
  Synthetic DNA
taatttgactcactaagg

SEQ ID NO: 22820 - DNA, 18 bp, Artificial Sequence
  Synthetic DNA
taatttgcctcactttag

SEQ ID NO: 22821 - DNA, 18 bp, Artificial Sequence
  Synthetic DNA
taatttgcctgactatag

SEQ ID NO: 22822 - DNA, 18 bp, Artificial Sequence
  Synthetic DNA
tacaacgacacactattg

SEQ ID NO: 22823 - DNA, 18 bp, Artificial Sequence
  Synthetic DNA
tacaacgactcattattg

SEQ ID NO: 22824 - DNA, 18 bp, Artificial Sequence
  Synthetic DNA
tactacgactcgcttcag

SEQ ID NO: 22825 - DNA, 18 bp, Artificial Sequence
  Synthetic DNA
tactactactctctattg

SEQ ID NO: 22826 - DNA, 18 bp, Artificial Sequence
  Synthetic DNA
tactaggactcgcaatag

SEQ ID NO: 22827 - DNA, 18 bp, Artificial Sequence
  Synthetic DNA
tacttcgactcactggag

SEQ ID NO: 22828 - DNA, 18 bp, Artificial Sequence
  Synthetic DNA
tacttcgagtcactacag

SEQ ID NO: 22829 - DNA, 18 bp, Artificial Sequence
  Synthetic DNA
tacttctactcactatcg

SEQ ID NO: 22830 - DNA, 18 bp, Artificial Sequence
  Synthetic DNA
tagctcgacacactatag

SEQ ID NO: 22831 - DNA, 18 bp, Artificial Sequence
  Synthetic DNA
tagttcgcctcactaaag

SEQ ID NO: 22832 - DNA, 18 bp, Artificial Sequence
  Synthetic DNA
tattacgactcacttgtg

SEQ ID NO: 22833 - DNA, 18 bp, Artificial Sequence
  Synthetic DNA
tattacgactcagtcttg

SEQ ID NO: 22834 - DNA, 18 bp, Artificial Sequence
  Synthetic DNA
tattacgacttattattg

SEQ ID NO: 22835 - DNA, 18 bp, Artificial Sequence
  Synthetic DNA
tattacgtctcgttatag

SEQ ID NO: 22836 - DNA, 18 bp, Artificial Sequence
  Synthetic DNA
tattatgactcgcaatag

SEQ ID NO: 22837 - DNA, 18 bp, Artificial Sequence
  Synthetic DNA
tattgctactcactattg

SEQ ID NO: 22838 - DNA, 18 bp, Artificial Sequence
  Synthetic DNA
tatttccagtcactatag

SEQ ID NO: 22839 - DNA, 18 bp, Artificial Sequence
  Synthetic DNA
tcaatcgacgcactatag

SEQ ID NO: 22840 - DNA, 18 bp, Artificial Sequence
  Synthetic DNA
tcactcgcctcactatag

SEQ ID NO: 22841 - DNA, 18 bp, Artificial Sequence
  Synthetic DNA
tcatacgtcacgctatag

SEQ ID NO: 22842 - DNA, 18 bp, Artificial Sequence
  Synthetic DNA
tcattcgaatcaatatag

SEQ ID NO: 22843 - DNA, 18 bp, Artificial Sequence
  Synthetic DNA
tcattcgacagactatag

SEQ ID NO: 22844 - DNA, 18 bp, Artificial Sequence
  Synthetic DNA
tcatttgacttactatag

SEQ ID NO: 22845 - DNA, 18 bp, Artificial Sequence
  Synthetic DNA
tcctactactcactattg

SEQ ID NO: 22846 - DNA, 18 bp, Artificial Sequence
  Synthetic DNA
tctttcgactcactagag

SEQ ID NO: 22847 - DNA, 18 bp, Artificial Sequence
  Synthetic DNA
tgaaacgactcacaattg

SEQ ID NO: 22848 - DNA, 18 bp, Artificial Sequence
  Synthetic DNA
tgatacgacacacaattg

SEQ ID NO: 22849 - DNA, 18 bp, Artificial Sequence
  Synthetic DNA
tgatacgacaccctattg

SEQ ID NO: 22850 - DNA, 18 bp, Artificial Sequence
  Synthetic DNA
tgatacgactctgtattg

SEQ ID NO: 22851 - DNA, 18 bp, Artificial Sequence
  Synthetic DNA
tgatacgattaactattg

SEQ ID NO: 22852 - DNA, 18 bp, Artificial Sequence
  Synthetic DNA
tgatacgattcacgattg

SEQ ID NO: 22853 - DNA, 18 bp, Artificial Sequence
  Synthetic DNA
tgatacgtcttactattg

SEQ ID NO: 22854 - DNA, 18 bp, Artificial Sequence
  Synthetic DNA
tgatccgactgactattg

SEQ ID NO: 22855 - DNA, 18 bp, Artificial Sequence
  Synthetic DNA
tgatccgtctcactattg

SEQ ID NO: 22856 - DNA, 18 bp, Artificial Sequence
  Synthetic DNA
tgatgcgactcattattg

SEQ ID NO: 22857 - DNA, 18 bp, Artificial Sequence
  Synthetic DNA
tgattcgactgagtatag

SEQ ID NO: 22858 - DNA, 18 bp, Artificial Sequence
  Synthetic DNA
tgattctactcattatag

SEQ ID NO: 22859 - DNA, 18 bp, Artificial Sequence
  Synthetic DNA
tgcatcgactcactatag

SEQ ID NO: 22860 - DNA, 18 bp, Artificial Sequence
  Synthetic DNA
tgttccgactcactattg

SEQ ID NO: 22861 - DNA, 18 bp, Artificial Sequence
  Synthetic DNA
ttatacaactcaccattg

SEQ ID NO: 22862 - DNA, 18 bp, Artificial Sequence
  Synthetic DNA
ttatacgacacactagtg

SEQ ID NO: 22863 - DNA, 18 bp, Artificial Sequence
  Synthetic DNA
ttatacgacacgctatcg

SEQ ID NO: 22864 - DNA, 18 bp, Artificial Sequence
  Synthetic DNA
ttatacgactcactcctg

SEQ ID NO: 22865 - DNA, 18 bp, Artificial Sequence
  Synthetic DNA
ttataggattcactattg

SEQ ID NO: 22866 - DNA, 18 bp, Artificial Sequence
  Synthetic DNA
ttatccgactcgctttag

SEQ ID NO: 22867 - DNA, 18 bp, Artificial Sequence
  Synthetic DNA
ttatgggactcactattg

SEQ ID NO: 22868 - DNA, 18 bp, Artificial Sequence
  Synthetic DNA
ttattagactcactatcg

SEQ ID NO: 22869 - DNA, 18 bp, Artificial Sequence
  Synthetic DNA
ttattagactcactctag

SEQ ID NO: 22870 - DNA, 18 bp, Artificial Sequence
  Synthetic DNA
ttattcaagtcactatag

SEQ ID NO: 22871 - DNA, 18 bp, Artificial Sequence
  Synthetic DNA
ttattcgacacactacag

SEQ ID NO: 22872 - DNA, 18 bp, Artificial Sequence
  Synthetic DNA
ttattcgagacactatag

SEQ ID NO: 22873 - DNA, 18 bp, Artificial Sequence
  Synthetic DNA
ttattcggatcactatag

SEQ ID NO: 22874 - DNA, 18 bp, Artificial Sequence
  Synthetic DNA
ttattcgtctcactctag

SEQ ID NO: 22875 - DNA, 18 bp, Artificial Sequence
  Synthetic DNA
ttctacgacttactattg

SEQ ID NO: 22876 - DNA, 18 bp, Artificial Sequence
  Synthetic DNA
aaaaatgactcactaaag

SEQ ID NO: 22877 - DNA, 18 bp, Artificial Sequence
  Synthetic DNA
aaaagcggctcactatag

SEQ ID NO: 22878 - DNA, 18 bp, Artificial Sequence
  Synthetic DNA
aaacacgactaactctag

SEQ ID NO: 22879 - DNA, 18 bp, Artificial Sequence
  Synthetic DNA
aaacacgattcactttag

SEQ ID NO: 22880 - DNA, 18 bp, Artificial Sequence
  Synthetic DNA
aaataacactcacaatag

SEQ ID NO: 22881 - DNA, 18 bp, Artificial Sequence
  Synthetic DNA
aaataagaaccactatag

SEQ ID NO: 22882 - DNA, 18 bp, Artificial Sequence
  Synthetic DNA
aaataagacgctctatag

SEQ ID NO: 22883 - DNA, 18 bp, Artificial Sequence
  Synthetic DNA
aaatacaaatcactatcg

SEQ ID NO: 22884 - DNA, 18 bp, Artificial Sequence
  Synthetic DNA
aaatacaactaactatgg

SEQ ID NO: 22885 - DNA, 18 bp, Artificial Sequence
  Synthetic DNA
aaatacagctcacaatag

SEQ ID NO: 22886 - DNA, 18 bp, Artificial Sequence
  Synthetic DNA
aaataccaccaactatag

SEQ ID NO: 22887 - DNA, 18 bp, Artificial Sequence
  Synthetic DNA
aaataccactcactgaag

SEQ ID NO: 22888 - DNA, 18 bp, Artificial Sequence
  Synthetic DNA
aaatacgactctccatgg

SEQ ID NO: 22889 - DNA, 18 bp, Artificial Sequence
  Synthetic DNA
aaatacgactgacttaag

SEQ ID NO: 22890 - DNA, 18 bp, Artificial Sequence
  Synthetic DNA
aaatacgactgagtaaag

SEQ ID NO: 22891 - DNA, 18 bp, Artificial Sequence
  Synthetic DNA
aaatacgacttactttgg

SEQ ID NO: 22892 - DNA, 18 bp, Artificial Sequence
  Synthetic DNA
aaatacgcatcaatatag

SEQ ID NO: 22893 - DNA, 18 bp, Artificial Sequence
  Synthetic DNA
aaatactacccactaaag

SEQ ID NO: 22894 - DNA, 18 bp, Artificial Sequence
  Synthetic DNA
aaataggactaactttag

SEQ ID NO: 22895 - DNA, 18 bp, Artificial Sequence
  Synthetic DNA
aaataggactcaatctag

SEQ ID NO: 22896 - DNA, 18 bp, Artificial Sequence
  Synthetic DNA
aaataggactcaccaaag

SEQ ID NO: 22897 - DNA, 18 bp, Artificial Sequence
  Synthetic DNA
aaatatcactaactatag

SEQ ID NO: 22898 - DNA, 18 bp, Artificial Sequence
  Synthetic DNA
aaatatgactcattctag

SEQ ID NO: 22899 - DNA, 18 bp, Artificial Sequence
  Synthetic DNA
aaatatgattcaatatag

SEQ ID NO: 22900 - DNA, 18 bp, Artificial Sequence
  Synthetic DNA
aaatattactcactacag

SEQ ID NO: 22901 - DNA, 18 bp, Artificial Sequence
  Synthetic DNA
aaatccgacaaactatag

SEQ ID NO: 22902 - DNA, 18 bp, Artificial Sequence
  Synthetic DNA
aaatccgtctcactctag

SEQ ID NO: 22903 - DNA, 18 bp, Artificial Sequence
  Synthetic DNA
aaatgcgtctctctatag

SEQ ID NO: 22904 - DNA, 18 bp, Artificial Sequence
  Synthetic DNA
aactacgactcattttag

SEQ ID NO: 22905 - DNA, 18 bp, Artificial Sequence
  Synthetic DNA
aactccgacacactatag

SEQ ID NO: 22906 - DNA, 18 bp, Artificial Sequence
  Synthetic DNA
aagtacaactcacaatag

SEQ ID NO: 22907 - DNA, 18 bp, Artificial Sequence
  Synthetic DNA
aattaagcctcactatag

SEQ ID NO: 22908 - DNA, 18 bp, Artificial Sequence
  Synthetic DNA
aattacaacccactatag

SEQ ID NO: 22909 - DNA, 18 bp, Artificial Sequence
  Synthetic DNA
aattaccacgcactatag

SEQ ID NO: 22910 - DNA, 18 bp, Artificial Sequence
  Synthetic DNA
aattacgtcgcactatag

SEQ ID NO: 22911 - DNA, 18 bp, Artificial Sequence
  Synthetic DNA
aattaggactcattatag

SEQ ID NO: 22912 - DNA, 18 bp, Artificial Sequence
  Synthetic DNA
aattgcgactcacgatag

SEQ ID NO: 22913 - DNA, 18 bp, Artificial Sequence
  Synthetic DNA
acataggactcacgatag

SEQ ID NO: 22914 - DNA, 18 bp, Artificial Sequence
  Synthetic DNA
acatccgactcactaaag

SEQ ID NO: 22915 - DNA, 18 bp, Artificial Sequence
  Synthetic DNA
agatacgacttactttag

SEQ ID NO: 22916 - DNA, 18 bp, Artificial Sequence
  Synthetic DNA
agcaacgactcactatag

SEQ ID NO: 22917 - DNA, 18 bp, Artificial Sequence
  Synthetic DNA
atacacgacgcactatag

SEQ ID NO: 22918 - DNA, 18 bp, Artificial Sequence
  Synthetic DNA
atatacgacccattatag

SEQ ID NO: 22919 - DNA, 18 bp, Artificial Sequence
  Synthetic DNA
atatacgactcactctgg

SEQ ID NO: 22920 - DNA, 18 bp, Artificial Sequence
  Synthetic DNA
atatacgactcccgatag

SEQ ID NO: 22921 - DNA, 18 bp, Artificial Sequence
  Synthetic DNA
atatacgatgcactatag

SEQ ID NO: 22922 - DNA, 18 bp, Artificial Sequence
  Synthetic DNA
atatccgactcaatatag

SEQ ID NO: 22923 - DNA, 18 bp, Artificial Sequence
  Synthetic DNA
atatgcgactcaatatag

SEQ ID NO: 22924 - DNA, 18 bp, Artificial Sequence
  Synthetic DNA
caaaacgactcagtctag

SEQ ID NO: 22925 - DNA, 18 bp, Artificial Sequence
  Synthetic DNA
caaaactacccactatag

SEQ ID NO: 22926 - DNA, 18 bp, Artificial Sequence
  Synthetic DNA
caagatgactcactttag

SEQ ID NO: 22927 - DNA, 18 bp, Artificial Sequence
  Synthetic DNA
caatacaacacactctag

SEQ ID NO: 22928 - DNA, 18 bp, Artificial Sequence
  Synthetic DNA
caatacaactaattatag

SEQ ID NO: 22929 - DNA, 18 bp, Artificial Sequence
  Synthetic DNA
caatacgacaaactaaag

SEQ ID NO: 22930 - DNA, 18 bp, Artificial Sequence
  Synthetic DNA
caatacgacacactaacg

SEQ ID NO: 22931 - DNA, 18 bp, Artificial Sequence
  Synthetic DNA
caatacgattcactaagg

SEQ ID NO: 22932 - DNA, 18 bp, Artificial Sequence
  Synthetic DNA
caatacgattccttatag

SEQ ID NO: 22933 - DNA, 18 bp, Artificial Sequence
  Synthetic DNA
caatacggctcattatgg

SEQ ID NO: 22934 - DNA, 18 bp, Artificial Sequence
  Synthetic DNA
caatacgtcttactatcg

SEQ ID NO: 22935 - DNA, 18 bp, Artificial Sequence
  Synthetic DNA
caatactacacactaaag

SEQ ID NO: 22936 - DNA, 18 bp, Artificial Sequence
  Synthetic DNA
caatactactcattctag

SEQ ID NO: 22937 - DNA, 18 bp, Artificial Sequence
  Synthetic DNA
caatatgactcaataaag

SEQ ID NO: 22938 - DNA, 18 bp, Artificial Sequence
  Synthetic DNA
caatatgactcactttcg

SEQ ID NO: 22939 - DNA, 18 bp, Artificial Sequence
  Synthetic DNA
caatccgactctgtatag

SEQ ID NO: 22940 - DNA, 18 bp, Artificial Sequence
  Synthetic DNA
caatgcgccccactatag

SEQ ID NO: 22941 - DNA, 18 bp, Artificial Sequence
  Synthetic DNA
caatgcgtctcaatatag

SEQ ID NO: 22942 - DNA, 18 bp, Artificial Sequence
  Synthetic DNA
caatgctactctctatag

SEQ ID NO: 22943 - DNA, 18 bp, Artificial Sequence
  Synthetic DNA
cactaagactcactagag

SEQ ID NO: 22944 - DNA, 18 bp, Artificial Sequence
  Synthetic DNA
cactatgactcactttag

SEQ ID NO: 22945 - DNA, 18 bp, Artificial Sequence
  Synthetic DNA
cagaacgacttactatag

SEQ ID NO: 22946 - DNA, 18 bp, Artificial Sequence
  Synthetic DNA
cagtacgaatcacaatag

SEQ ID NO: 22947 - DNA, 18 bp, Artificial Sequence
  Synthetic DNA
cagtacgacaaactatag

SEQ ID NO: 22948 - DNA, 18 bp, Artificial Sequence
  Synthetic DNA
cataacgattcactatag

SEQ ID NO: 22949 - DNA, 18 bp, Artificial Sequence
  Synthetic DNA
cattacgacacacgatag

SEQ ID NO: 22950 - DNA, 18 bp, Artificial Sequence
  Synthetic DNA
cattacgactctctgtag

SEQ ID NO: 22951 - DNA, 18 bp, Artificial Sequence
  Synthetic DNA
cattacgatacactatag

SEQ ID NO: 22952 - DNA, 18 bp, Artificial Sequence
  Synthetic DNA
cattccgactaactatag

SEQ ID NO: 22953 - DNA, 18 bp, Artificial Sequence
  Synthetic DNA
cattgcgagtcactatag

SEQ ID NO: 22954 - DNA, 18 bp, Artificial Sequence
  Synthetic DNA
ccatacaagtcactatag

SEQ ID NO: 22955 - DNA, 18 bp, Artificial Sequence
  Synthetic DNA
ccatacgacacactaaag

SEQ ID NO: 22956 - DNA, 18 bp, Artificial Sequence
  Synthetic DNA
ccgtacgactcattatag

SEQ ID NO: 22957 - DNA, 18 bp, Artificial Sequence
  Synthetic DNA
cgagaccactcactatag

SEQ ID NO: 22958 - DNA, 18 bp, Artificial Sequence
  Synthetic DNA
cgcaacgactcactatag

SEQ ID NO: 22959 - DNA, 18 bp, Artificial Sequence
  Synthetic DNA
cgctacgagtcactatag

SEQ ID NO: 22960 - DNA, 18 bp, Artificial Sequence
  Synthetic DNA
ctatacgactcaatagag

SEQ ID NO: 22961 - DNA, 18 bp, Artificial Sequence
  Synthetic DNA
ctatacgactcattaaag

SEQ ID NO: 22962 - DNA, 18 bp, Artificial Sequence
  Synthetic DNA
ctatacgccccactatag

SEQ ID NO: 22963 - DNA, 18 bp, Artificial Sequence
  Synthetic DNA
ctataggacttactatag

SEQ ID NO: 22964 - DNA, 18 bp, Artificial Sequence
  Synthetic DNA
ctgtacgactcactttag

SEQ ID NO: 22965 - DNA, 18 bp, Artificial Sequence
  Synthetic DNA
gaatacccctcaatatag

SEQ ID NO: 22966 - DNA, 18 bp, Artificial Sequence
  Synthetic DNA
gaatacgaatatctatag

SEQ ID NO: 22967 - DNA, 18 bp, Artificial Sequence
  Synthetic DNA
gaatacgactctcaaaag

SEQ ID NO: 22968 - DNA, 18 bp, Artificial Sequence
  Synthetic DNA
gaatagaactcactaaag

SEQ ID NO: 22969 - DNA, 18 bp, Artificial Sequence
  Synthetic DNA
gactactgctcactatag

SEQ ID NO: 22970 - DNA, 18 bp, Artificial Sequence
  Synthetic DNA
gattaccactcacaatag

SEQ ID NO: 22971 - DNA, 18 bp, Artificial Sequence
  Synthetic DNA
gattacgactatctatag

SEQ ID NO: 22972 - DNA, 18 bp, Artificial Sequence
  Synthetic DNA
gattacgtgtcactatag

SEQ ID NO: 22973 - DNA, 18 bp, Artificial Sequence
  Synthetic DNA
gattaggagtcactatag

SEQ ID NO: 22974 - DNA, 18 bp, Artificial Sequence
  Synthetic DNA
gcataagacttactatag

SEQ ID NO: 22975 - DNA, 18 bp, Artificial Sequence
  Synthetic DNA
gcatacgactaactacag

SEQ ID NO: 22976 - DNA, 18 bp, Artificial Sequence
  Synthetic DNA
gcatacgattcacaatag

SEQ ID NO: 22977 - DNA, 18 bp, Artificial Sequence
  Synthetic DNA
ggatacgactatctatag

SEQ ID NO: 22978 - DNA, 18 bp, Artificial Sequence
  Synthetic DNA
gtatacgaatcactctag

SEQ ID NO: 22979 - DNA, 18 bp, Artificial Sequence
  Synthetic DNA
gtatacgtctctctatag

SEQ ID NO: 22980 - DNA, 18 bp, Artificial Sequence
  Synthetic DNA
gtatatgactaactatag

SEQ ID NO: 22981 - DNA, 18 bp, Artificial Sequence
  Synthetic DNA
taaaacaactaacgatag

SEQ ID NO: 22982 - DNA, 18 bp, Artificial Sequence
  Synthetic DNA
taaaacctttcactatag

SEQ ID NO: 22983 - DNA, 18 bp, Artificial Sequence
  Synthetic DNA
taaaacgaaccactagag

SEQ ID NO: 22984 - DNA, 18 bp, Artificial Sequence
  Synthetic DNA
taaaacgaatcacttcag

SEQ ID NO: 22985 - DNA, 18 bp, Artificial Sequence
  Synthetic DNA
taaaacgaatcagtctag

SEQ ID NO: 22986 - DNA, 18 bp, Artificial Sequence
  Synthetic DNA
taaaacgactcaccaagg

SEQ ID NO: 22987 - DNA, 18 bp, Artificial Sequence
  Synthetic DNA
taaaacgactcactcccg

SEQ ID NO: 22988 - DNA, 18 bp, Artificial Sequence
  Synthetic DNA
taaaacgactctatagag

SEQ ID NO: 22989 - DNA, 18 bp, Artificial Sequence
  Synthetic DNA
taaaacgactctgtgtag

SEQ ID NO: 22990 - DNA, 18 bp, Artificial Sequence
  Synthetic DNA
taaaacgactctttctag

SEQ ID NO: 22991 - DNA, 18 bp, Artificial Sequence
  Synthetic DNA
taaaacgacttactccag

SEQ ID NO: 22992 - DNA, 18 bp, Artificial Sequence
  Synthetic DNA
taaaacgattcactttcg

SEQ ID NO: 22993 - DNA, 18 bp, Artificial Sequence
  Synthetic DNA
taaaacgcctaactacag

SEQ ID NO: 22994 - DNA, 18 bp, Artificial Sequence
  Synthetic DNA
taaaacgcctcataatag

SEQ ID NO: 22995 - DNA, 18 bp, Artificial Sequence
  Synthetic DNA
taaaacgcctccccatag

SEQ ID NO: 22996 - DNA, 18 bp, Artificial Sequence
  Synthetic DNA
taaaacgcctctctatgg

SEQ ID NO: 22997 - DNA, 18 bp, Artificial Sequence
  Synthetic DNA
taaaacgcttcactaaag

SEQ ID NO: 22998 - DNA, 18 bp, Artificial Sequence
  Synthetic DNA
taaaacgtatcactaaag

SEQ ID NO: 22999 - DNA, 18 bp, Artificial Sequence
  Synthetic DNA
taaaacgtcgcactttag

SEQ ID NO: 23000 - DNA, 18 bp, Artificial Sequence
  Synthetic DNA
taaaacgtctgactttag

SEQ ID NO: 23001 - DNA, 18 bp, Artificial Sequence
  Synthetic DNA
taaaactaatcattatag

SEQ ID NO: 23002 - DNA, 18 bp, Artificial Sequence
  Synthetic DNA
taaaactactcattatcg

SEQ ID NO: 23003 - DNA, 18 bp, Artificial Sequence
  Synthetic DNA
taaaactactccccatag

SEQ ID NO: 23004 - DNA, 18 bp, Artificial Sequence
  Synthetic DNA
taaaacttctcactatcg

SEQ ID NO: 23005 - DNA, 18 bp, Artificial Sequence
  Synthetic DNA
taaaagcagtcactatag

SEQ ID NO: 23006 - DNA, 18 bp, Artificial Sequence
  Synthetic DNA
taaaaggactctctacag

SEQ ID NO: 23007 - DNA, 18 bp, Artificial Sequence
  Synthetic DNA
taaaaggactgactaaag

SEQ ID NO: 23008 - DNA, 18 bp, Artificial Sequence
  Synthetic DNA
taaaatgactcactaacg

SEQ ID NO: 23009 - DNA, 18 bp, Artificial Sequence
  Synthetic DNA
taaaatgacttactagag

SEQ ID NO: 23010 - DNA, 18 bp, Artificial Sequence
  Synthetic DNA
taaaatgcatcactatag

SEQ ID NO: 23011 - DNA, 18 bp, Artificial Sequence
  Synthetic DNA
taaaatgtctcactagag

SEQ ID NO: 23012 - DNA, 18 bp, Artificial Sequence
  Synthetic DNA
taaaatgtctcactatgg

SEQ ID NO: 23013 - DNA, 18 bp, Artificial Sequence
  Synthetic DNA
taaaccgagtcactaaag

SEQ ID NO: 23014 - DNA, 18 bp, Artificial Sequence
  Synthetic DNA
taaaccggatcactatag

SEQ ID NO: 23015 - DNA, 18 bp, Artificial Sequence
  Synthetic DNA
taaacctactcactgtag

SEQ ID NO: 23016 - DNA, 18 bp, Artificial Sequence
  Synthetic DNA
taaagcaactcattatag

SEQ ID NO: 23017 - DNA, 18 bp, Artificial Sequence
  Synthetic DNA
taaagcgactcaccctag

SEQ ID NO: 23018 - DNA, 18 bp, Artificial Sequence
  Synthetic DNA
taaagtgtctcactatag

SEQ ID NO: 23019 - DNA, 18 bp, Artificial Sequence
  Synthetic DNA
taacaaaacacactatag

SEQ ID NO: 23020 - DNA, 18 bp, Artificial Sequence
  Synthetic DNA
taacaagacttactacag

SEQ ID NO: 23021 - DNA, 18 bp, Artificial Sequence
  Synthetic DNA
taacacatctcactacag

SEQ ID NO: 23022 - DNA, 18 bp, Artificial Sequence
  Synthetic DNA
taacacgacacattagag

SEQ ID NO: 23023 - DNA, 18 bp, Artificial Sequence
  Synthetic DNA
taacacgacttaccatgg

SEQ ID NO: 23024 - DNA, 18 bp, Artificial Sequence
  Synthetic DNA
taacacggctcccaatag

SEQ ID NO: 23025 - DNA, 18 bp, Artificial Sequence
  Synthetic DNA
taacacgtcccactttag

SEQ ID NO: 23026 - DNA, 18 bp, Artificial Sequence
  Synthetic DNA
taacacgtctcaatatgg

SEQ ID NO: 23027 - DNA, 18 bp, Artificial Sequence
  Synthetic DNA
taacacgtgtcactatcg

SEQ ID NO: 23028 - DNA, 18 bp, Artificial Sequence
  Synthetic DNA
taacacgtttcaatatag

SEQ ID NO: 23029 - DNA, 18 bp, Artificial Sequence
  Synthetic DNA
taacactacgctctatag

SEQ ID NO: 23030 - DNA, 18 bp, Artificial Sequence
  Synthetic DNA
taacactactaactaaag

SEQ ID NO: 23031 - DNA, 18 bp, Artificial Sequence
  Synthetic DNA
taacagtactcactatcg

SEQ ID NO: 23032 - DNA, 18 bp, Artificial Sequence
  Synthetic DNA
taacatgactcacactag

SEQ ID NO: 23033 - DNA, 18 bp, Artificial Sequence
  Synthetic DNA
taaccgtactcactatag

SEQ ID NO: 23034 - DNA, 18 bp, Artificial Sequence
  Synthetic DNA
taacgcgaatcagtatag

SEQ ID NO: 23035 - DNA, 18 bp, Artificial Sequence
  Synthetic DNA
taagaagaataactatag

SEQ ID NO: 23036 - DNA, 18 bp, Artificial Sequence
  Synthetic DNA
taagacctctcacgatag

SEQ ID NO: 23037 - DNA, 18 bp, Artificial Sequence
  Synthetic DNA
taagacgaatcactgtcg

SEQ ID NO: 23038 - DNA, 18 bp, Artificial Sequence
  Synthetic DNA
taagacgaccctctaaag

SEQ ID NO: 23039 - DNA, 18 bp, Artificial Sequence
  Synthetic DNA
taagacgacttactttcg

SEQ ID NO: 23040 - DNA, 18 bp, Artificial Sequence
  Synthetic DNA
taagacgaggcattatag

SEQ ID NO: 23041 - DNA, 18 bp, Artificial Sequence
  Synthetic DNA
taagacgtctcattaaag

SEQ ID NO: 23042 - DNA, 18 bp, Artificial Sequence
  Synthetic DNA
taagacgtttcacaatag

SEQ ID NO: 23043 - DNA, 18 bp, Artificial Sequence
  Synthetic DNA
taagaggacaaactatag

SEQ ID NO: 23044 - DNA, 18 bp, Artificial Sequence
  Synthetic DNA
taagccgactctcaatag

SEQ ID NO: 23045 - DNA, 18 bp, Artificial Sequence
  Synthetic DNA
taataaaacccacaatag

SEQ ID NO: 23046 - DNA, 18 bp, Artificial Sequence
  Synthetic DNA
taataacacactctatag

SEQ ID NO: 23047 - DNA, 18 bp, Artificial Sequence
  Synthetic DNA
taataacacgcaatatag

SEQ ID NO: 23048 - DNA, 18 bp, Artificial Sequence
  Synthetic DNA
taataacactcaatttag

SEQ ID NO: 23049 - DNA, 18 bp, Artificial Sequence
  Synthetic DNA
taataacactctctatcg

SEQ ID NO: 23050 - DNA, 18 bp, Artificial Sequence
  Synthetic DNA
taataagactatctatcg

SEQ ID NO: 23051 - DNA, 18 bp, Artificial Sequence
  Synthetic DNA
taataagactcaatctcg

SEQ ID NO: 23052 - DNA, 18 bp, Artificial Sequence
  Synthetic DNA
taataagactcacctaag

SEQ ID NO: 23053 - DNA, 18 bp, Artificial Sequence
  Synthetic DNA
taataagactccataaag

SEQ ID NO: 23054 - DNA, 18 bp, Artificial Sequence
  Synthetic DNA
taataagacttcgtatag

SEQ ID NO: 23055 - DNA, 18 bp, Artificial Sequence
  Synthetic DNA
taataagagtctatatag

SEQ ID NO: 23056 - DNA, 18 bp, Artificial Sequence
  Synthetic DNA
taataagatcaactatag

SEQ ID NO: 23057 - DNA, 18 bp, Artificial Sequence
  Synthetic DNA
taataagatttactatgg

SEQ ID NO: 23058 - DNA, 18 bp, Artificial Sequence
  Synthetic DNA
taataagcccctctatag

SEQ ID NO: 23059 - DNA, 18 bp, Artificial Sequence
  Synthetic DNA
taataagtctcactaagg

SEQ ID NO: 23060 - DNA, 18 bp, Artificial Sequence
  Synthetic DNA
taataagtctctctatcg

SEQ ID NO: 23061 - DNA, 18 bp, Artificial Sequence
  Synthetic DNA
taataatactcactttcg

SEQ ID NO: 23062 - DNA, 18 bp, Artificial Sequence
  Synthetic DNA
taataatactcattgtag

SEQ ID NO: 23063 - DNA, 18 bp, Artificial Sequence
  Synthetic DNA
taataatactctccatag

SEQ ID NO: 23064 - DNA, 18 bp, Artificial Sequence
  Synthetic DNA
taataatattcactttag

SEQ ID NO: 23065 - DNA, 18 bp, Artificial Sequence
  Synthetic DNA
taataatcttcactatag

SEQ ID NO: 23066 - DNA, 18 bp, Artificial Sequence
  Synthetic DNA
taataatgctcactctag

SEQ ID NO: 23067 - DNA, 18 bp, Artificial Sequence
  Synthetic DNA
taatacaaactactatag

SEQ ID NO: 23068 - DNA, 18 bp, Artificial Sequence
  Synthetic DNA
taatacaaataaatatag

SEQ ID NO: 23069 - DNA, 18 bp, Artificial Sequence
  Synthetic DNA
taatacaaatcacaatcg

SEQ ID NO: 23070 - DNA, 18 bp, Artificial Sequence
  Synthetic DNA
taatacaacgctctatgg

SEQ ID NO: 23071 - DNA, 18 bp, Artificial Sequence
  Synthetic DNA
taatacaactcagaatcg

SEQ ID NO: 23072 - DNA, 18 bp, Artificial Sequence
  Synthetic DNA
taatacaactcatttgag

SEQ ID NO: 23073 - DNA, 18 bp, Artificial Sequence
  Synthetic DNA
taatacaagtcaataaag

SEQ ID NO: 23074 - DNA, 18 bp, Artificial Sequence
  Synthetic DNA
taatacaattcaatacag

SEQ ID NO: 23075 - DNA, 18 bp, Artificial Sequence
  Synthetic DNA
taatacacctcattaaag

SEQ ID NO: 23076 - DNA, 18 bp, Artificial Sequence
  Synthetic DNA
taatacagttctctatag

SEQ ID NO: 23077 - DNA, 18 bp, Artificial Sequence
  Synthetic DNA
taatacatatcaatatag

SEQ ID NO: 23078 - DNA, 18 bp, Artificial Sequence
  Synthetic DNA
taatacatttcagtatag

SEQ ID NO: 23079 - DNA, 18 bp, Artificial Sequence
  Synthetic DNA
taatacattttactatag

SEQ ID NO: 23080 - DNA, 18 bp, Artificial Sequence
  Synthetic DNA
taataccacactctttag

SEQ ID NO: 23081 - DNA, 18 bp, Artificial Sequence
  Synthetic DNA
taataccactcatttaag

SEQ ID NO: 23082 - DNA, 18 bp, Artificial Sequence
  Synthetic DNA
taataccactctcgatcg

SEQ ID NO: 23083 - DNA, 18 bp, Artificial Sequence
  Synthetic DNA
taataccactgatcatag

SEQ ID NO: 23084 - DNA, 18 bp, Artificial Sequence
  Synthetic DNA
taataccattaagtatag

SEQ ID NO: 23085 - DNA, 18 bp, Artificial Sequence
  Synthetic DNA
taataccgatctctatag

SEQ ID NO: 23086 - DNA, 18 bp, Artificial Sequence
  Synthetic DNA
taataccgctcattaaag

SEQ ID NO: 23087 - DNA, 18 bp, Artificial Sequence
  Synthetic DNA
taatacctcttaccatag

SEQ ID NO: 23088 - DNA, 18 bp, Artificial Sequence
  Synthetic DNA
taatacgaaccacattag

SEQ ID NO: 23089 - DNA, 18 bp, Artificial Sequence
  Synthetic DNA
taatacgaaggagtatag

SEQ ID NO: 23090 - DNA, 18 bp, Artificial Sequence
  Synthetic DNA
taatacgaataacaacag

SEQ ID NO: 23091 - DNA, 18 bp, Artificial Sequence
  Synthetic DNA
taatacgaatcataatcg

SEQ ID NO: 23092 - DNA, 18 bp, Artificial Sequence
  Synthetic DNA
taatacgaattaatttag

SEQ ID NO: 23093 - DNA, 18 bp, Artificial Sequence
  Synthetic DNA
taatacgaatttctatcg

SEQ ID NO: 23094 - DNA, 18 bp, Artificial Sequence
  Synthetic DNA
taatacgacaaaggatag

SEQ ID NO: 23095 - DNA, 18 bp, Artificial Sequence
  Synthetic DNA
taatacgacaaattaaag

SEQ ID NO: 23096 - DNA, 18 bp, Artificial Sequence
  Synthetic DNA
taatacgacacacaaccg

SEQ ID NO: 23097 - DNA, 18 bp, Artificial Sequence
  Synthetic DNA
taatacgacacacagtcg

SEQ ID NO: 23098 - DNA, 18 bp, Artificial Sequence
  Synthetic DNA
taatacgacacccttcag

SEQ ID NO: 23099 - DNA, 18 bp, Artificial Sequence
  Synthetic DNA
taatacgacctataatag

SEQ ID NO: 23100 - DNA, 18 bp, Artificial Sequence
  Synthetic DNA
taatacgaccttctctag

SEQ ID NO: 23101 - DNA, 18 bp, Artificial Sequence
  Synthetic DNA
taatacgactcaccgtcc

SEQ ID NO: 23102 - DNA, 18 bp, Artificial Sequence
  Synthetic DNA
taatacgactctgagtag

SEQ ID NO: 23103 - DNA, 18 bp, Artificial Sequence
  Synthetic DNA
taatacgactctttttgg

SEQ ID NO: 23104 - DNA, 18 bp, Artificial Sequence
  Synthetic DNA
taatacgactgtatgtag

SEQ ID NO: 23105 - DNA, 18 bp, Artificial Sequence
  Synthetic DNA
taatacgacttagaagag

SEQ ID NO: 23106 - DNA, 18 bp, Artificial Sequence
  Synthetic DNA
taatacgagacacttcag

SEQ ID NO: 23107 - DNA, 18 bp, Artificial Sequence
  Synthetic DNA
taatacgagagactaaag

SEQ ID NO: 23108 - DNA, 18 bp, Artificial Sequence
  Synthetic DNA
taatacgagatactatcg

SEQ ID NO: 23109 - DNA, 18 bp, Artificial Sequence
  Synthetic DNA
taatacgagtcaacttag

SEQ ID NO: 23110 - DNA, 18 bp, Artificial Sequence
  Synthetic DNA
taatacgatacattatcg

SEQ ID NO: 23111 - DNA, 18 bp, Artificial Sequence
  Synthetic DNA
taatacgatccattaaag

SEQ ID NO: 23112 - DNA, 18 bp, Artificial Sequence
  Synthetic DNA
taatacgattaacaacag

SEQ ID NO: 23113 - DNA, 18 bp, Artificial Sequence
  Synthetic DNA
taatacgattcactgcgg

SEQ ID NO: 23114 - DNA, 18 bp, Artificial Sequence
  Synthetic DNA
taatacgattcccaatcg

SEQ ID NO: 23115 - DNA, 18 bp, Artificial Sequence
  Synthetic DNA
taatacgattccctaacg

SEQ ID NO: 23116 - DNA, 18 bp, Artificial Sequence
  Synthetic DNA
taatacgcatctatatag

SEQ ID NO: 23117 - DNA, 18 bp, Artificial Sequence
  Synthetic DNA
taatacgccataccatag

SEQ ID NO: 23118 - DNA, 18 bp, Artificial Sequence
  Synthetic DNA
taatacgcctcaattcag

SEQ ID NO: 23119 - DNA, 18 bp, Artificial Sequence
  Synthetic DNA
taatacgcttaactttag

SEQ ID NO: 23120 - DNA, 18 bp, Artificial Sequence
  Synthetic DNA
taatacgcttcacaaaag

SEQ ID NO: 23121 - DNA, 18 bp, Artificial Sequence
  Synthetic DNA
taatacggcacaatacag

SEQ ID NO: 23122 - DNA, 18 bp, Artificial Sequence
  Synthetic DNA
taatacggcactctaaag

SEQ ID NO: 23123 - DNA, 18 bp, Artificial Sequence
  Synthetic DNA
taatacggcgcacttgag

SEQ ID NO: 23124 - DNA, 18 bp, Artificial Sequence
  Synthetic DNA
taatacggctaaaaatag

SEQ ID NO: 23125 - DNA, 18 bp, Artificial Sequence
  Synthetic DNA
taatacggcttaaaatag

SEQ ID NO: 23126 - DNA, 18 bp, Artificial Sequence
  Synthetic DNA
taatacggtccacaatag

SEQ ID NO: 23127 - DNA, 18 bp, Artificial Sequence
  Synthetic DNA
taatacgtacccctatag

SEQ ID NO: 23128 - DNA, 18 bp, Artificial Sequence
  Synthetic DNA
taatacgtatcacactag

SEQ ID NO: 23129 - DNA, 18 bp, Artificial Sequence
  Synthetic DNA
taatacgtcagactttag

SEQ ID NO: 23130 - DNA, 18 bp, Artificial Sequence
  Synthetic DNA
taatacgtcctactttag

SEQ ID NO: 23131 - DNA, 18 bp, Artificial Sequence
  Synthetic DNA
taatacgtctcacctaag

SEQ ID NO: 23132 - DNA, 18 bp, Artificial Sequence
  Synthetic DNA
taatacgtctccctaacg

SEQ ID NO: 23133 - DNA, 18 bp, Artificial Sequence
  Synthetic DNA
taatacgtctctctttcg

SEQ ID NO: 23134 - DNA, 18 bp, Artificial Sequence
  Synthetic DNA
taatacgtctgagaatag

SEQ ID NO: 23135 - DNA, 18 bp, Artificial Sequence
  Synthetic DNA
taatacgtgtcactacgg

SEQ ID NO: 23136 - DNA, 18 bp, Artificial Sequence
  Synthetic DNA
taatacgttccactttag

SEQ ID NO: 23137 - DNA, 18 bp, Artificial Sequence
  Synthetic DNA
taatacgtttcacgttag

SEQ ID NO: 23138 - DNA, 18 bp, Artificial Sequence
  Synthetic DNA
taatactaatcaccttag

SEQ ID NO: 23139 - DNA, 18 bp, Artificial Sequence
  Synthetic DNA
taatactaatcacgatcg

SEQ ID NO: 23140 - DNA, 18 bp, Artificial Sequence
  Synthetic DNA
taatactaattactttag

SEQ ID NO: 23141 - DNA, 18 bp, Artificial Sequence
  Synthetic DNA
taatactacatactatgg

SEQ ID NO: 23142 - DNA, 18 bp, Artificial Sequence
  Synthetic DNA
taatactactcaccaaaa

SEQ ID NO: 23143 - DNA, 18 bp, Artificial Sequence
  Synthetic DNA
taatactactcagtaagg

SEQ ID NO: 23144 - DNA, 18 bp, Artificial Sequence
  Synthetic DNA
taatactactctctaacg

SEQ ID NO: 23145 - DNA, 18 bp, Artificial Sequence
  Synthetic DNA
taatactactctcttgag

SEQ ID NO: 23146 - DNA, 18 bp, Artificial Sequence
  Synthetic DNA
taatactattgattatag

SEQ ID NO: 23147 - DNA, 18 bp, Artificial Sequence
  Synthetic DNA
taatactcctcattttag

SEQ ID NO: 23148 - DNA, 18 bp, Artificial Sequence
  Synthetic DNA
taatacttctcactgcag

SEQ ID NO: 23149 - DNA, 18 bp, Artificial Sequence
  Synthetic DNA
taatacttttcactagag

SEQ ID NO: 23150 - DNA, 18 bp, Artificial Sequence
  Synthetic DNA
taatagaattcactatgg

SEQ ID NO: 23151 - DNA, 18 bp, Artificial Sequence
  Synthetic DNA
taatagatctcacaatag

SEQ ID NO: 23152 - DNA, 18 bp, Artificial Sequence
  Synthetic DNA
taataggaattactaaag

SEQ ID NO: 23153 - DNA, 18 bp, Artificial Sequence
  Synthetic DNA
taataggacgtaatatag

SEQ ID NO: 23154 - DNA, 18 bp, Artificial Sequence
  Synthetic DNA
taataggtctcattatcg

SEQ ID NO: 23155 - DNA, 18 bp, Artificial Sequence
  Synthetic DNA
taataggtcttactctag

SEQ ID NO: 23156 - DNA, 18 bp, Artificial Sequence
  Synthetic DNA
taatagtaatcactctag

SEQ ID NO: 23157 - DNA, 18 bp, Artificial Sequence
  Synthetic DNA
taatagttctcactatcg

SEQ ID NO: 23158 - DNA, 18 bp, Artificial Sequence
  Synthetic DNA
taatataactcacttcag

SEQ ID NO: 23159 - DNA, 18 bp, Artificial Sequence
  Synthetic DNA
taatataactgactacag

SEQ ID NO: 23160 - DNA, 18 bp, Artificial Sequence
  Synthetic DNA
taatataactttctatag

SEQ ID NO: 23161 - DNA, 18 bp, Artificial Sequence
  Synthetic DNA
taatatcactcattttag

SEQ ID NO: 23162 - DNA, 18 bp, Artificial Sequence
  Synthetic DNA
taatatgacccacactag

SEQ ID NO: 23163 - DNA, 18 bp, Artificial Sequence
  Synthetic DNA
taatatgactcaatttgg

SEQ ID NO: 23164 - DNA, 18 bp, Artificial Sequence
  Synthetic DNA
taatatgactcagtctgg

SEQ ID NO: 23165 - DNA, 18 bp, Artificial Sequence
  Synthetic DNA
taatatgactctatatcg

SEQ ID NO: 23166 - DNA, 18 bp, Artificial Sequence
  Synthetic DNA
taatatgacttataatag

SEQ ID NO: 23167 - DNA, 18 bp, Artificial Sequence
  Synthetic DNA
taatatgcttgactatag

SEQ ID NO: 23168 - DNA, 18 bp, Artificial Sequence
  Synthetic DNA
taatatgtctgactgtag

SEQ ID NO: 23169 - DNA, 18 bp, Artificial Sequence
  Synthetic DNA
taatattacacaccatag

SEQ ID NO: 23170 - DNA, 18 bp, Artificial Sequence
  Synthetic DNA
taatattacccaatatag

SEQ ID NO: 23171 - DNA, 18 bp, Artificial Sequence
  Synthetic DNA
taatcagactcactaacg

SEQ ID NO: 23172 - DNA, 18 bp, Artificial Sequence
  Synthetic DNA
taatccatcccactatag

SEQ ID NO: 23173 - DNA, 18 bp, Artificial Sequence
  Synthetic DNA
taatccgaattaatatag

SEQ ID NO: 23174 - DNA, 18 bp, Artificial Sequence
  Synthetic DNA
taatccgactctcattag

SEQ ID NO: 23175 - DNA, 18 bp, Artificial Sequence
  Synthetic DNA
taatccgacttattatcg

SEQ ID NO: 23176 - DNA, 18 bp, Artificial Sequence
  Synthetic DNA
taatccgagtcaataaag

SEQ ID NO: 23177 - DNA, 18 bp, Artificial Sequence
  Synthetic DNA
taatccgcctcagtaaag

SEQ ID NO: 23178 - DNA, 18 bp, Artificial Sequence
  Synthetic DNA
taatccgtcagactatag

SEQ ID NO: 23179 - DNA, 18 bp, Artificial Sequence
  Synthetic DNA
taatccgtttcactaaag

SEQ ID NO: 23180 - DNA, 18 bp, Artificial Sequence
  Synthetic DNA
taatcctacacactgtag

SEQ ID NO: 23181 - DNA, 18 bp, Artificial Sequence
  Synthetic DNA
taatcctactcaatttag

SEQ ID NO: 23182 - DNA, 18 bp, Artificial Sequence
  Synthetic DNA
taatcctgctcaccatag

SEQ ID NO: 23183 - DNA, 18 bp, Artificial Sequence
  Synthetic DNA
taatcggactccctttag

SEQ ID NO: 23184 - DNA, 18 bp, Artificial Sequence
  Synthetic DNA
taatctgactcacattag

SEQ ID NO: 23185 - DNA, 18 bp, Artificial Sequence
  Synthetic DNA
taatctgccacactatag

SEQ ID NO: 23186 - DNA, 18 bp, Artificial Sequence
  Synthetic DNA
taatctgcctcactatcg

SEQ ID NO: 23187 - DNA, 18 bp, Artificial Sequence
  Synthetic DNA
taatgagacccactacag

SEQ ID NO: 23188 - DNA, 18 bp, Artificial Sequence
  Synthetic DNA
taatgagacttacaatag

SEQ ID NO: 23189 - DNA, 18 bp, Artificial Sequence
  Synthetic DNA
taatgccactctctaaag

SEQ ID NO: 23190 - DNA, 18 bp, Artificial Sequence
  Synthetic DNA
taatgcccctcacaatag

SEQ ID NO: 23191 - DNA, 18 bp, Artificial Sequence
  Synthetic DNA
taatgcgacattctatag

SEQ ID NO: 23192 - DNA, 18 bp, Artificial Sequence
  Synthetic DNA
taatgcgactcacgtaag

SEQ ID NO: 23193 - DNA, 18 bp, Artificial Sequence
  Synthetic DNA
taatgcgactccttttag

SEQ ID NO: 23194 - DNA, 18 bp, Artificial Sequence
  Synthetic DNA
taatgcgactctctcaag

SEQ ID NO: 23195 - DNA, 18 bp, Artificial Sequence
  Synthetic DNA
taatgcgtcccactttag

SEQ ID NO: 23196 - DNA, 18 bp, Artificial Sequence
  Synthetic DNA
taatgcgtctcagtaaag

SEQ ID NO: 23197 - DNA, 18 bp, Artificial Sequence
  Synthetic DNA
taatgcgtctcattagag

SEQ ID NO: 23198 - DNA, 18 bp, Artificial Sequence
  Synthetic DNA
taatgctaattactatag

SEQ ID NO: 23199 - DNA, 18 bp, Artificial Sequence
  Synthetic DNA
taatgctactcaccttag

SEQ ID NO: 23200 - DNA, 18 bp, Artificial Sequence
  Synthetic DNA
taatgctagtcactacag

SEQ ID NO: 23201 - DNA, 18 bp, Artificial Sequence
  Synthetic DNA
taatgtgaatcactctag

SEQ ID NO: 23202 - DNA, 18 bp, Artificial Sequence
  Synthetic DNA
tacaaagactccctatag

SEQ ID NO: 23203 - DNA, 18 bp, Artificial Sequence
  Synthetic DNA
tacaacgacacaccatag

SEQ ID NO: 23204 - DNA, 18 bp, Artificial Sequence
  Synthetic DNA
tacaacgacactctatag

SEQ ID NO: 23205 - DNA, 18 bp, Artificial Sequence
  Synthetic DNA
tacaacgactgacaatag

SEQ ID NO: 23206 - DNA, 18 bp, Artificial Sequence
  Synthetic DNA
taccaggactcacaatag

SEQ ID NO: 23207 - DNA, 18 bp, Artificial Sequence
  Synthetic DNA
tacgacgactcagtctag

SEQ ID NO: 23208 - DNA, 18 bp, Artificial Sequence
  Synthetic DNA
tactaagactaattatag

SEQ ID NO: 23209 - DNA, 18 bp, Artificial Sequence
  Synthetic DNA
tactaagacttactaaag

SEQ ID NO: 23210 - DNA, 18 bp, Artificial Sequence
  Synthetic DNA
tactaatactaactatag

SEQ ID NO: 23211 - DNA, 18 bp, Artificial Sequence
  Synthetic DNA
tactacaactaactaaag

SEQ ID NO: 23212 - DNA, 18 bp, Artificial Sequence
  Synthetic DNA
tactacaactcattatcg

SEQ ID NO: 23213 - DNA, 18 bp, Artificial Sequence
  Synthetic DNA
tactacaacttactctag

SEQ ID NO: 23214 - DNA, 18 bp, Artificial Sequence
  Synthetic DNA
tactacatctcaatatag

SEQ ID NO: 23215 - DNA, 18 bp, Artificial Sequence
  Synthetic DNA
tactaccactaactaaag

SEQ ID NO: 23216 - DNA, 18 bp, Artificial Sequence
  Synthetic DNA
tactacgagtcaccaaag

SEQ ID NO: 23217 - DNA, 18 bp, Artificial Sequence
  Synthetic DNA
tactacgattcaatacag

SEQ ID NO: 23218 - DNA, 18 bp, Artificial Sequence
  Synthetic DNA
tactacgcctaacaatag

SEQ ID NO: 23219 - DNA, 18 bp, Artificial Sequence
  Synthetic DNA
tactacgtgacactatag

SEQ ID NO: 23220 - DNA, 18 bp, Artificial Sequence
  Synthetic DNA
tactaggacacattatag

SEQ ID NO: 23221 - DNA, 18 bp, Artificial Sequence
  Synthetic DNA
tactaggattcactacag

SEQ ID NO: 23222 - DNA, 18 bp, Artificial Sequence
  Synthetic DNA
tactatgaaccactatag

SEQ ID NO: 23223 - DNA, 18 bp, Artificial Sequence
  Synthetic DNA
tactatgattcactatgg

SEQ ID NO: 23224 - DNA, 18 bp, Artificial Sequence
  Synthetic DNA
tactcctaatcactatag

SEQ ID NO: 23225 - DNA, 18 bp, Artificial Sequence
  Synthetic DNA
tactgcgacacaccatag

SEQ ID NO: 23226 - DNA, 18 bp, Artificial Sequence
  Synthetic DNA
tagaaagtctcactatag

SEQ ID NO: 23227 - DNA, 18 bp, Artificial Sequence
  Synthetic DNA
tagaaccactctctatag

SEQ ID NO: 23228 - DNA, 18 bp, Artificial Sequence
  Synthetic DNA
tagaacgacagactatag

SEQ ID NO: 23229 - DNA, 18 bp, Artificial Sequence
  Synthetic DNA
tagcatgactctctatag

SEQ ID NO: 23230 - DNA, 18 bp, Artificial Sequence
  Synthetic DNA
taggacgactcacattag

SEQ ID NO: 23231 - DNA, 18 bp, Artificial Sequence
  Synthetic DNA
tagtaacactcactatcg

SEQ ID NO: 23232 - DNA, 18 bp, Artificial Sequence
  Synthetic DNA
tagtaacacttactatag

SEQ ID NO: 23233 - DNA, 18 bp, Artificial Sequence
  Synthetic DNA
tagtaagacccactttag

SEQ ID NO: 23234 - DNA, 18 bp, Artificial Sequence
  Synthetic DNA
tagtacaaccctctatag

SEQ ID NO: 23235 - DNA, 18 bp, Artificial Sequence
  Synthetic DNA
tagtacaactcaatatcg

SEQ ID NO: 23236 - DNA, 18 bp, Artificial Sequence
  Synthetic DNA
tagtacgacagattatag

SEQ ID NO: 23237 - DNA, 18 bp, Artificial Sequence
  Synthetic DNA
tagtacgacttaatatgg

SEQ ID NO: 23238 - DNA, 18 bp, Artificial Sequence
  Synthetic DNA
tagtacgtctatctatag

SEQ ID NO: 23239 - DNA, 18 bp, Artificial Sequence
  Synthetic DNA
tagtacgtctcagtttag

SEQ ID NO: 23240 - DNA, 18 bp, Artificial Sequence
  Synthetic DNA
tagtactaatcattatag

SEQ ID NO: 23241 - DNA, 18 bp, Artificial Sequence
  Synthetic DNA
tagtaggacaccctatag

SEQ ID NO: 23242 - DNA, 18 bp, Artificial Sequence
  Synthetic DNA
tataaagactcactagag

SEQ ID NO: 23243 - DNA, 18 bp, Artificial Sequence
  Synthetic DNA
tataacgactcaatctag

SEQ ID NO: 23244 - DNA, 18 bp, Artificial Sequence
  Synthetic DNA
tataacgactcacaatgg

SEQ ID NO: 23245 - DNA, 18 bp, Artificial Sequence
  Synthetic DNA
tataacgactcactaacg

SEQ ID NO: 23246 - DNA, 18 bp, Artificial Sequence
  Synthetic DNA
tataacgactctctacag

SEQ ID NO: 23247 - DNA, 18 bp, Artificial Sequence
  Synthetic DNA
tataacgattctctatag

SEQ ID NO: 23248 - DNA, 18 bp, Artificial Sequence
  Synthetic DNA
tatcacgtctcactgtag

SEQ ID NO: 23249 - DNA, 18 bp, Artificial Sequence
  Synthetic DNA
tatcactactcactatgg

SEQ ID NO: 23250 - DNA, 18 bp, Artificial Sequence
  Synthetic DNA
tatcaggactcactttag

SEQ ID NO: 23251 - DNA, 18 bp, Artificial Sequence
  Synthetic DNA
tatcaggactcagtatag

SEQ ID NO: 23252 - DNA, 18 bp, Artificial Sequence
  Synthetic DNA
tatgccgactcactaaag

SEQ ID NO: 23253 - DNA, 18 bp, Artificial Sequence
  Synthetic DNA
tattaagattaactatag

SEQ ID NO: 23254 - DNA, 18 bp, Artificial Sequence
  Synthetic DNA
tattacaactcaatgtag

SEQ ID NO: 23255 - DNA, 18 bp, Artificial Sequence
  Synthetic DNA
tattacaattcactatat

SEQ ID NO: 23256 - DNA, 18 bp, Artificial Sequence
  Synthetic DNA
tattaccaatcacgatag

SEQ ID NO: 23257 - DNA, 18 bp, Artificial Sequence
  Synthetic DNA
tattaccactcacaatcg

SEQ ID NO: 23258 - DNA, 18 bp, Artificial Sequence
  Synthetic DNA
tattaccattcactttag

SEQ ID NO: 23259 - DNA, 18 bp, Artificial Sequence
  Synthetic DNA
tattacgaataactgtag

SEQ ID NO: 23260 - DNA, 18 bp, Artificial Sequence
  Synthetic DNA
tattacgacccaatttag

SEQ ID NO: 23261 - DNA, 18 bp, Artificial Sequence
  Synthetic DNA
tattacgactcaaactag

SEQ ID NO: 23262 - DNA, 18 bp, Artificial Sequence
  Synthetic DNA
tattacgactcacaacgg

SEQ ID NO: 23263 - DNA, 18 bp, Artificial Sequence
  Synthetic DNA
tattacgactcacccaag

SEQ ID NO: 23264 - DNA, 18 bp, Artificial Sequence
  Synthetic DNA
tattacgactcataatcg

SEQ ID NO: 23265 - DNA, 18 bp, Artificial Sequence
  Synthetic DNA
tattacgactctttatcg

SEQ ID NO: 23266 - DNA, 18 bp, Artificial Sequence
  Synthetic DNA
tattacgagtcaccatcg

SEQ ID NO: 23267 - DNA, 18 bp, Artificial Sequence
  Synthetic DNA
tattacgatacactatcg

SEQ ID NO: 23268 - DNA, 18 bp, Artificial Sequence
  Synthetic DNA
tattacggttaactatag

SEQ ID NO: 23269 - DNA, 18 bp, Artificial Sequence
  Synthetic DNA
tattacgtatcactacag

SEQ ID NO: 23270 - DNA, 18 bp, Artificial Sequence
  Synthetic DNA
tattacgtctcactgaag

SEQ ID NO: 23271 - DNA, 18 bp, Artificial Sequence
  Synthetic DNA
tattactactcaccttag

SEQ ID NO: 23272 - DNA, 18 bp, Artificial Sequence
  Synthetic DNA
tattaggtcttactatag

SEQ ID NO: 23273 - DNA, 18 bp, Artificial Sequence
  Synthetic DNA
tattatcactcaccatag

SEQ ID NO: 23274 - DNA, 18 bp, Artificial Sequence
  Synthetic DNA
tattatgacacactatgg

SEQ ID NO: 23275 - DNA, 18 bp, Artificial Sequence
  Synthetic DNA
tattatgactaactaaag

SEQ ID NO: 23276 - DNA, 18 bp, Artificial Sequence
  Synthetic DNA
tattcccaatcactatag

SEQ ID NO: 23277 - DNA, 18 bp, Artificial Sequence
  Synthetic DNA
tattctggctcactatag

SEQ ID NO: 23278 - DNA, 18 bp, Artificial Sequence
  Synthetic DNA
tattgcgactcattaaag

SEQ ID NO: 23279 - DNA, 18 bp, Artificial Sequence
  Synthetic DNA
tcaaaagacttactatag

SEQ ID NO: 23280 - DNA, 18 bp, Artificial Sequence
  Synthetic DNA
tcaaacgactcagtgtag

SEQ ID NO: 23281 - DNA, 18 bp, Artificial Sequence
  Synthetic DNA
tcacacgactaactaaag

SEQ ID NO: 23282 - DNA, 18 bp, Artificial Sequence
  Synthetic DNA
tcacacgcttcactatag

SEQ ID NO: 23283 - DNA, 18 bp, Artificial Sequence
  Synthetic DNA
tcacgcgactcactttag

SEQ ID NO: 23284 - DNA, 18 bp, Artificial Sequence
  Synthetic DNA
tcagaggactctctatag

SEQ ID NO: 23285 - DNA, 18 bp, Artificial Sequence
  Synthetic DNA
tcataccactcaataaag

SEQ ID NO: 23286 - DNA, 18 bp, Artificial Sequence
  Synthetic DNA
tcatacgacccaccaaag

SEQ ID NO: 23287 - DNA, 18 bp, Artificial Sequence
  Synthetic DNA
tcatacgactcaatttcg

SEQ ID NO: 23288 - DNA, 18 bp, Artificial Sequence
  Synthetic DNA
tcatacgactgacattag

SEQ ID NO: 23289 - DNA, 18 bp, Artificial Sequence
  Synthetic DNA
tcatacgactttcaatag

SEQ ID NO: 23290 - DNA, 18 bp, Artificial Sequence
  Synthetic DNA
tcatacgagtcaccaaag

SEQ ID NO: 23291 - DNA, 18 bp, Artificial Sequence
  Synthetic DNA
tcatacgattaacaatag

SEQ ID NO: 23292 - DNA, 18 bp, Artificial Sequence
  Synthetic DNA
tcatacgattcaatagag

SEQ ID NO: 23293 - DNA, 18 bp, Artificial Sequence
  Synthetic DNA
tcatacgtctcactttgg

SEQ ID NO: 23294 - DNA, 18 bp, Artificial Sequence
  Synthetic DNA
tcatactactcaatttag

SEQ ID NO: 23295 - DNA, 18 bp, Artificial Sequence
  Synthetic DNA
tcatactactctctatcg

SEQ ID NO: 23296 - DNA, 18 bp, Artificial Sequence
  Synthetic DNA
tcataggactcaataaag

SEQ ID NO: 23297 - DNA, 18 bp, Artificial Sequence
  Synthetic DNA
tcatccgattcacaatag

SEQ ID NO: 23298 - DNA, 18 bp, Artificial Sequence
  Synthetic DNA
tcgaacgattcactatag

SEQ ID NO: 23299 - DNA, 18 bp, Artificial Sequence
  Synthetic DNA
tcgtacgacactctatag

SEQ ID NO: 23300 - DNA, 18 bp, Artificial Sequence
  Synthetic DNA
tcttaagactcactttag

SEQ ID NO: 23301 - DNA, 18 bp, Artificial Sequence
  Synthetic DNA
tcttacaacttactatag

SEQ ID NO: 23302 - DNA, 18 bp, Artificial Sequence
  Synthetic DNA
tcttaccgctcactatag

SEQ ID NO: 23303 - DNA, 18 bp, Artificial Sequence
  Synthetic DNA
tcttacgagtccctatag

SEQ ID NO: 23304 - DNA, 18 bp, Artificial Sequence
  Synthetic DNA
tcttactactgactatag

SEQ ID NO: 23305 - DNA, 18 bp, Artificial Sequence
  Synthetic DNA
tcttatgagtcactatag

SEQ ID NO: 23306 - DNA, 18 bp, Artificial Sequence
  Synthetic DNA
tcttctgactcactatag

SEQ ID NO: 23307 - DNA, 18 bp, Artificial Sequence
  Synthetic DNA
tgaaaccactaactatag

SEQ ID NO: 23308 - DNA, 18 bp, Artificial Sequence
  Synthetic DNA
tgaaacgattaactatag

SEQ ID NO: 23309 - DNA, 18 bp, Artificial Sequence
  Synthetic DNA
tgaaactactcaatatag

SEQ ID NO: 23310 - DNA, 18 bp, Artificial Sequence
  Synthetic DNA
tgaaatgacacactatag

SEQ ID NO: 23311 - DNA, 18 bp, Artificial Sequence
  Synthetic DNA
tgaaatgactcagtatag

SEQ ID NO: 23312 - DNA, 18 bp, Artificial Sequence
  Synthetic DNA
tgaaccgactgactatag

SEQ ID NO: 23313 - DNA, 18 bp, Artificial Sequence
  Synthetic DNA
tgacaccacttactatag

SEQ ID NO: 23314 - DNA, 18 bp, Artificial Sequence
  Synthetic DNA
tgataaaacgcactatag

SEQ ID NO: 23315 - DNA, 18 bp, Artificial Sequence
  Synthetic DNA
tgatacgacattctatag

SEQ ID NO: 23316 - DNA, 18 bp, Artificial Sequence
  Synthetic DNA
tgatacgactaacttaag

SEQ ID NO: 23317 - DNA, 18 bp, Artificial Sequence
  Synthetic DNA
tgatacgacttccaatag

SEQ ID NO: 23318 - DNA, 18 bp, Artificial Sequence
  Synthetic DNA
tgatacgattcacttgag

SEQ ID NO: 23319 - DNA, 18 bp, Artificial Sequence
  Synthetic DNA
tgatacgattgaatatag

SEQ ID NO: 23320 - DNA, 18 bp, Artificial Sequence
  Synthetic DNA
tgatacgatttactaaag

SEQ ID NO: 23321 - DNA, 18 bp, Artificial Sequence
  Synthetic DNA
tgataggaatcactttag

SEQ ID NO: 23322 - DNA, 18 bp, Artificial Sequence
  Synthetic DNA
tgatatgactcaccatcg

SEQ ID NO: 23323 - DNA, 18 bp, Artificial Sequence
  Synthetic DNA
tgatatgtttcactatag

SEQ ID NO: 23324 - DNA, 18 bp, Artificial Sequence
  Synthetic DNA
tgatccgaatgactatag

SEQ ID NO: 23325 - DNA, 18 bp, Artificial Sequence
  Synthetic DNA
tgatgcgagacactatag

SEQ ID NO: 23326 - DNA, 18 bp, Artificial Sequence
  Synthetic DNA
tgctacgactcactctcg

SEQ ID NO: 23327 - DNA, 18 bp, Artificial Sequence
  Synthetic DNA
tgctacgagtcaccatag

SEQ ID NO: 23328 - DNA, 18 bp, Artificial Sequence
  Synthetic DNA
tgctactactcactttag

SEQ ID NO: 23329 - DNA, 18 bp, Artificial Sequence
  Synthetic DNA
tggaacgactaactatag

SEQ ID NO: 23330 - DNA, 18 bp, Artificial Sequence
  Synthetic DNA
tgttaaaactcactatag

SEQ ID NO: 23331 - DNA, 18 bp, Artificial Sequence
  Synthetic DNA
tgttaagactctctatag

SEQ ID NO: 23332 - DNA, 18 bp, Artificial Sequence
  Synthetic DNA
tgttacgactatctatag

SEQ ID NO: 23333 - DNA, 18 bp, Artificial Sequence
  Synthetic DNA
tgttatgactcactctag

SEQ ID NO: 23334 - DNA, 18 bp, Artificial Sequence
  Synthetic DNA
tgttccgaatcactatag

SEQ ID NO: 23335 - DNA, 18 bp, Artificial Sequence
  Synthetic DNA
tgttgctactcactatag

SEQ ID NO: 23336 - DNA, 18 bp, Artificial Sequence
  Synthetic DNA
ttaaaagactcactatcg

SEQ ID NO: 23337 - DNA, 18 bp, Artificial Sequence
  Synthetic DNA
ttaaacgactcaccatcg

SEQ ID NO: 23338 - DNA, 18 bp, Artificial Sequence
  Synthetic DNA
ttaaacgactgacgatag

SEQ ID NO: 23339 - DNA, 18 bp, Artificial Sequence
  Synthetic DNA
ttaaacgagttactatag

SEQ ID NO: 23340 - DNA, 18 bp, Artificial Sequence
  Synthetic DNA
ttacacgaatctctatag

SEQ ID NO: 23341 - DNA, 18 bp, Artificial Sequence
  Synthetic DNA
ttacacggctctctatag

SEQ ID NO: 23342 - DNA, 18 bp, Artificial Sequence
  Synthetic DNA
ttacatgacacactatag

SEQ ID NO: 23343 - DNA, 18 bp, Artificial Sequence
  Synthetic DNA
ttagaccactcattatag

SEQ ID NO: 23344 - DNA, 18 bp, Artificial Sequence
  Synthetic DNA
ttagacgactaactaaag

SEQ ID NO: 23345 - DNA, 18 bp, Artificial Sequence
  Synthetic DNA
ttagacgactccttatag

SEQ ID NO: 23346 - DNA, 18 bp, Artificial Sequence
  Synthetic DNA
ttaggcgagtcactatag

SEQ ID NO: 23347 - DNA, 18 bp, Artificial Sequence
  Synthetic DNA
ttataagtctgactatag

SEQ ID NO: 23348 - DNA, 18 bp, Artificial Sequence
  Synthetic DNA
ttatacaattcactatcg

SEQ ID NO: 23349 - DNA, 18 bp, Artificial Sequence
  Synthetic DNA
ttatacatctcactagag

SEQ ID NO: 23350 - DNA, 18 bp, Artificial Sequence
  Synthetic DNA
ttataccactcagaatag

SEQ ID NO: 23351 - DNA, 18 bp, Artificial Sequence
  Synthetic DNA
ttatacgaatcagtctag

SEQ ID NO: 23352 - DNA, 18 bp, Artificial Sequence
  Synthetic DNA
ttatacgaatccctttag

SEQ ID NO: 23353 - DNA, 18 bp, Artificial Sequence
  Synthetic DNA
ttatacgaatgacaatag

SEQ ID NO: 23354 - DNA, 18 bp, Artificial Sequence
  Synthetic DNA
ttatacgacaccctatcg

SEQ ID NO: 23355 - DNA, 18 bp, Artificial Sequence
  Synthetic DNA
ttatacgaccaactatcg

SEQ ID NO: 23356 - DNA, 18 bp, Artificial Sequence
  Synthetic DNA
ttatacgactcacatcag

SEQ ID NO: 23357 - DNA, 18 bp, Artificial Sequence
  Synthetic DNA
ttatacgactcaccttcg

SEQ ID NO: 23358 - DNA, 18 bp, Artificial Sequence
  Synthetic DNA
ttatacgactcatgacag

SEQ ID NO: 23359 - DNA, 18 bp, Artificial Sequence
  Synthetic DNA
ttatacgactccttctag

SEQ ID NO: 23360 - DNA, 18 bp, Artificial Sequence
  Synthetic DNA
ttatacgacttaatctag

SEQ ID NO: 23361 - DNA, 18 bp, Artificial Sequence
  Synthetic DNA
ttatacgacttagcatag

SEQ ID NO: 23362 - DNA, 18 bp, Artificial Sequence
  Synthetic DNA
ttatacgagacactatcg

SEQ ID NO: 23363 - DNA, 18 bp, Artificial Sequence
  Synthetic DNA
ttatacgccaaactatag

SEQ ID NO: 23364 - DNA, 18 bp, Artificial Sequence
  Synthetic DNA
ttatacggctcaatagag

SEQ ID NO: 23365 - DNA, 18 bp, Artificial Sequence
  Synthetic DNA
ttatacgtctcactgcag

SEQ ID NO: 23366 - DNA, 18 bp, Artificial Sequence
  Synthetic DNA
ttatactacccaccatag

SEQ ID NO: 23367 - DNA, 18 bp, Artificial Sequence
  Synthetic DNA
ttatactacgcactgtag

SEQ ID NO: 23368 - DNA, 18 bp, Artificial Sequence
  Synthetic DNA
ttatagcactcaatatag

SEQ ID NO: 23369 - DNA, 18 bp, Artificial Sequence
  Synthetic DNA
ttatatgaaccactatag

SEQ ID NO: 23370 - DNA, 18 bp, Artificial Sequence
  Synthetic DNA
ttatatgaatcagtatag

SEQ ID NO: 23371 - DNA, 18 bp, Artificial Sequence
  Synthetic DNA
ttatatgaatccctatag

SEQ ID NO: 23372 - DNA, 18 bp, Artificial Sequence
  Synthetic DNA
ttatcagactcaatatag

SEQ ID NO: 23373 - DNA, 18 bp, Artificial Sequence
  Synthetic DNA
ttatccaactcactctag

SEQ ID NO: 23374 - DNA, 18 bp, Artificial Sequence
  Synthetic DNA
ttatcccactcactgtag

SEQ ID NO: 23375 - DNA, 18 bp, Artificial Sequence
  Synthetic DNA
ttatccgactcacaatgg

SEQ ID NO: 23376 - DNA, 18 bp, Artificial Sequence
  Synthetic DNA
ttatccggctcacaatag

SEQ ID NO: 23377 - DNA, 18 bp, Artificial Sequence
  Synthetic DNA
ttatgagattcactatag

SEQ ID NO: 23378 - DNA, 18 bp, Artificial Sequence
  Synthetic DNA
ttatgcgactccccatag

SEQ ID NO: 23379 - DNA, 18 bp, Artificial Sequence
  Synthetic DNA
ttatgctactcactaaag

SEQ ID NO: 23380 - DNA, 18 bp, Artificial Sequence
  Synthetic DNA
ttatgggacccactatag

SEQ ID NO: 23381 - DNA, 18 bp, Artificial Sequence
  Synthetic DNA
ttatgggactcacaatag

SEQ ID NO: 23382 - DNA, 18 bp, Artificial Sequence
  Synthetic DNA
ttccacgactcacaatag

SEQ ID NO: 23383 - DNA, 18 bp, Artificial Sequence
  Synthetic DNA
ttccactactcactatag

SEQ ID NO: 23384 - DNA, 18 bp, Artificial Sequence
  Synthetic DNA
ttctacgtctcactatcg

SEQ ID NO: 23385 - DNA, 18 bp, Artificial Sequence
  Synthetic DNA
ttctaggactcactagag

SEQ ID NO: 23386 - DNA, 18 bp, Artificial Sequence
  Synthetic DNA
ttgtaccactcaccatag

SEQ ID NO: 23387 - DNA, 18 bp, Artificial Sequence
  Synthetic DNA
ttgtacgactcactaagg

SEQ ID NO: 23388 - DNA, 18 bp, Artificial Sequence
  Synthetic DNA
ttttaagactcacaatag

SEQ ID NO: 23389 - DNA, 18 bp, Artificial Sequence
  Synthetic DNA
ttttacgactcactgaag

SEQ ID NO: 23390 - DNA, 18 bp, Artificial Sequence
  Synthetic DNA
ttttacgactctctatcg

SEQ ID NO: 23391 - DNA, 18 bp, Artificial Sequence
  Synthetic DNA
ttttccgactcactagag

SEQ ID NO: 23392 - DNA, 18 bp, Artificial Sequence
  Synthetic DNA
taaatcgactcacattag

SEQ ID NO: 23393 - DNA, 18 bp, Artificial Sequence
  Synthetic DNA
tataactactctctatag

SEQ ID NO: 23394 - DNA, 18 bp, Artificial Sequence
  Synthetic DNA
aaaaacgactcacaattg

SEQ ID NO: 23395 - DNA, 18 bp, Artificial Sequence
  Synthetic DNA
taatacgcctctcaattg

SEQ ID NO: 23396 - DNA, 18 bp, Artificial Sequence
  Synthetic DNA
taatactactaattattg

SEQ ID NO: 23397 - DNA, 18 bp, Artificial Sequence
  Synthetic DNA
caataagacacactattg

SEQ ID NO: 23398 - DNA, 18 bp, Artificial Sequence
  Synthetic DNA
taacacgactgtctattg

SEQ ID NO: 23399 - DNA, 18 bp, Artificial Sequence
  Synthetic DNA
taatcctactaactattg

SEQ ID NO: 23400 - DNA, 18 bp, Artificial Sequence
  Synthetic DNA
taatgcgagtcacttttg

SEQ ID NO: 23401 - DNA, 18 bp, Artificial Sequence
  Synthetic DNA
ttatacaactcgctaaag

SEQ ID NO: 23402 - DNA, 18 bp, Artificial Sequence
  Synthetic DNA
ttatacgactcacgaatg

SEQ ID NO: 23403 - DNA, 18 bp, Artificial Sequence
  Synthetic DNA
actaacgactcactatag

SEQ ID NO: 23404 - DNA, 18 bp, Artificial Sequence
  Synthetic DNA
atatacgacttactatgg

SEQ ID NO: 23405 - DNA, 18 bp, Artificial Sequence
  Synthetic DNA
gtatacgacttaatatag

SEQ ID NO: 23406 - DNA, 18 bp, Artificial Sequence
  Synthetic DNA
taaaaccacacactaaag

SEQ ID NO: 23407 - DNA, 18 bp, Artificial Sequence
  Synthetic DNA
taacacgaaacactaaag

SEQ ID NO: 23408 - DNA, 18 bp, Artificial Sequence
  Synthetic DNA
taatacgatctactatcg

SEQ ID NO: 23409 - DNA, 18 bp, Artificial Sequence
  Synthetic DNA
taatacgtatccttatag

SEQ ID NO: 23410 - DNA, 18 bp, Artificial Sequence
  Synthetic DNA
taatacgtttcacaaaag

SEQ ID NO: 23411 - DNA, 18 bp, Artificial Sequence
  Synthetic DNA
taatattaatcacaatag

SEQ ID NO: 23412 - DNA, 18 bp, Artificial Sequence
  Synthetic DNA
ttgtacaattcactatag

SEQ ID NO: 23413 - DNA, 18 bp, Artificial Sequence
  Synthetic DNA
taaatagtctcactatag

SEQ ID NO: 23414 - DNA, 18 bp, Artificial Sequence
  Synthetic DNA
ttatacgaatctcaatag

SEQ ID NO: 23415 - DNA, 18 bp, Artificial Sequence
  Synthetic DNA
taaatggactcactattg

SEQ ID NO: 23416 - DNA, 18 bp, Artificial Sequence
  Synthetic DNA
taataagactcgcttttg

SEQ ID NO: 23417 - DNA, 18 bp, Artificial Sequence
  Synthetic DNA
taattagtctcgctatag

SEQ ID NO: 23418 - DNA, 18 bp, Artificial Sequence
  Synthetic DNA
taatttgacgcactattg

SEQ ID NO: 23419 - DNA, 18 bp, Artificial Sequence
  Synthetic DNA
taacacgtctgactattg

SEQ ID NO: 23420 - DNA, 18 bp, Artificial Sequence
  Synthetic DNA
taataaaacacgctatag

SEQ ID NO: 23421 - DNA, 18 bp, Artificial Sequence
  Synthetic DNA
taatacgaccgactaatg

SEQ ID NO: 23422 - DNA, 18 bp, Artificial Sequence
  Synthetic DNA
taatacgagttactagtg

SEQ ID NO: 23423 - DNA, 18 bp, Artificial Sequence
  Synthetic DNA
taatacgtctcacctttg

SEQ ID NO: 23424 - DNA, 18 bp, Artificial Sequence
  Synthetic DNA
taatatgactcaacattg

SEQ ID NO: 23425 - DNA, 18 bp, Artificial Sequence
  Synthetic DNA
taatatgcctctctattg

SEQ ID NO: 23426 - DNA, 18 bp, Artificial Sequence
  Synthetic DNA
taatcctactcacttttg

SEQ ID NO: 23427 - DNA, 18 bp, Artificial Sequence
  Synthetic DNA
taatcctactcgctttag

SEQ ID NO: 23428 - DNA, 18 bp, Artificial Sequence
  Synthetic DNA
taattcagctcactttag

SEQ ID NO: 23429 - DNA, 18 bp, Artificial Sequence
  Synthetic DNA
taattcgacaaactacag

SEQ ID NO: 23430 - DNA, 18 bp, Artificial Sequence
  Synthetic DNA
taattggactctctatcg

SEQ ID NO: 23431 - DNA, 18 bp, Artificial Sequence
  Synthetic DNA
taatttgattaactatag

SEQ ID NO: 23432 - DNA, 18 bp, Artificial Sequence
  Synthetic DNA
taatttgtctcactctag

SEQ ID NO: 23433 - DNA, 18 bp, Artificial Sequence
  Synthetic DNA
tattacggctaactattg

SEQ ID NO: 23434 - DNA, 18 bp, Artificial Sequence
  Synthetic DNA
tattaggactcagtattg

SEQ ID NO: 23435 - DNA, 18 bp, Artificial Sequence
  Synthetic DNA
tcatacaactcagtattg

SEQ ID NO: 23436 - DNA, 18 bp, Artificial Sequence
  Synthetic DNA
tcattcctctcactatag

SEQ ID NO: 23437 - DNA, 18 bp, Artificial Sequence
  Synthetic DNA
tgatacgtctcattattg

SEQ ID NO: 23438 - DNA, 18 bp, Artificial Sequence
  Synthetic DNA
tgattcgtctcacaatag

SEQ ID NO: 23439 - DNA, 18 bp, Artificial Sequence
  Synthetic DNA
ttaatcgaatcactatag

SEQ ID NO: 23440 - DNA, 18 bp, Artificial Sequence
  Synthetic DNA
ttactagactcactatag

SEQ ID NO: 23441 - DNA, 18 bp, Artificial Sequence
  Synthetic DNA
ttatacgactagcaatag

SEQ ID NO: 23442 - DNA, 18 bp, Artificial Sequence
  Synthetic DNA
ttatacgactcacttgtg

SEQ ID NO: 23443 - DNA, 18 bp, Artificial Sequence
  Synthetic DNA
ttatgcgacacactattg

SEQ ID NO: 23444 - DNA, 18 bp, Artificial Sequence
  Synthetic DNA
ttttacgtctcgctatag

SEQ ID NO: 23445 - DNA, 18 bp, Artificial Sequence
  Synthetic DNA
tttttcgcctcactatag

SEQ ID NO: 23446 - DNA, 18 bp, Artificial Sequence
  Synthetic DNA
aaacactactcattatag

SEQ ID NO: 23447 - DNA, 18 bp, Artificial Sequence
  Synthetic DNA
aaagacgactatctatag

SEQ ID NO: 23448 - DNA, 18 bp, Artificial Sequence
  Synthetic DNA
aaatacgtatcactatcg

SEQ ID NO: 23449 - DNA, 18 bp, Artificial Sequence
  Synthetic DNA
aaatacgtctgactacag

SEQ ID NO: 23450 - DNA, 18 bp, Artificial Sequence
  Synthetic DNA
aaatactcatcactatag

SEQ ID NO: 23451 - DNA, 18 bp, Artificial Sequence
  Synthetic DNA
aaatatgactctcaatag

SEQ ID NO: 23452 - DNA, 18 bp, Artificial Sequence
  Synthetic DNA
aattacgtctcactctag

SEQ ID NO: 23453 - DNA, 18 bp, Artificial Sequence
  Synthetic DNA
aattactattcactatag

SEQ ID NO: 23454 - DNA, 18 bp, Artificial Sequence
  Synthetic DNA
agaaacgaatcactatag

SEQ ID NO: 23455 - DNA, 18 bp, Artificial Sequence
  Synthetic DNA
agctacgacgcactatag

SEQ ID NO: 23456 - DNA, 18 bp, Artificial Sequence
  Synthetic DNA
caataagattcactaaag

SEQ ID NO: 23457 - DNA, 18 bp, Artificial Sequence
  Synthetic DNA
caatacgactctcgatcg

SEQ ID NO: 23458 - DNA, 18 bp, Artificial Sequence
  Synthetic DNA
caatacgtttcacaatag

SEQ ID NO: 23459 - DNA, 18 bp, Artificial Sequence
  Synthetic DNA
caatatgattcactaaag

SEQ ID NO: 23460 - DNA, 18 bp, Artificial Sequence
  Synthetic DNA
cataacgactcacaatag

SEQ ID NO: 23461 - DNA, 18 bp, Artificial Sequence
  Synthetic DNA
ctgtacgactcacaatag

SEQ ID NO: 23462 - DNA, 18 bp, Artificial Sequence
  Synthetic DNA
taaaacgacaaaatatag

SEQ ID NO: 23463 - DNA, 18 bp, Artificial Sequence
  Synthetic DNA
taaaacgactctacatag

SEQ ID NO: 23464 - DNA, 18 bp, Artificial Sequence
  Synthetic DNA
taaaacgtatcactagag

SEQ ID NO: 23465 - DNA, 18 bp, Artificial Sequence
  Synthetic DNA
taaagcgtttcactatag

SEQ ID NO: 23466 - DNA, 18 bp, Artificial Sequence
  Synthetic DNA
taacaagtcacactatag

SEQ ID NO: 23467 - DNA, 18 bp, Artificial Sequence
  Synthetic DNA
taacactactcattttag

SEQ ID NO: 23468 - DNA, 18 bp, Artificial Sequence
  Synthetic DNA
taatacaattcacactag

SEQ ID NO: 23469 - DNA, 18 bp, Artificial Sequence
  Synthetic DNA
taataccacacactcaag

SEQ ID NO: 23470 - DNA, 18 bp, Artificial Sequence
  Synthetic DNA
taataccattcacattag

SEQ ID NO: 23471 - DNA, 18 bp, Artificial Sequence
  Synthetic DNA
taatacgaatgattaaag

SEQ ID NO: 23472 - DNA, 18 bp, Artificial Sequence
  Synthetic DNA
taatacgactatcaatgg

SEQ ID NO: 23473 - DNA, 18 bp, Artificial Sequence
  Synthetic DNA
taatacgactcaaactcg

SEQ ID NO: 23474 - DNA, 18 bp, Artificial Sequence
  Synthetic DNA
taatacgatttaccttag

SEQ ID NO: 23475 - DNA, 18 bp, Artificial Sequence
  Synthetic DNA
taatactgaacactatag

SEQ ID NO: 23476 - DNA, 18 bp, Artificial Sequence
  Synthetic DNA
taatacttctaactacag

SEQ ID NO: 23477 - DNA, 18 bp, Artificial Sequence
  Synthetic DNA
taatataattcactaaag

SEQ ID NO: 23478 - DNA, 18 bp, Artificial Sequence
  Synthetic DNA
taatatgactctcaatcg

SEQ ID NO: 23479 - DNA, 18 bp, Artificial Sequence
  Synthetic DNA
taatccttctcactttag

SEQ ID NO: 23480 - DNA, 18 bp, Artificial Sequence
  Synthetic DNA
taatgagactctgtatag

SEQ ID NO: 23481 - DNA, 18 bp, Artificial Sequence
  Synthetic DNA
taatgcgactatgtatag

SEQ ID NO: 23482 - DNA, 18 bp, Artificial Sequence
  Synthetic DNA
tactacgatccacgatag

SEQ ID NO: 23483 - DNA, 18 bp, Artificial Sequence
  Synthetic DNA
tagaacgactctctaaag

SEQ ID NO: 23484 - DNA, 18 bp, Artificial Sequence
  Synthetic DNA
tataacgacaaactatag

SEQ ID NO: 23485 - DNA, 18 bp, Artificial Sequence
  Synthetic DNA
tatgacaactcactttag

SEQ ID NO: 23486 - DNA, 18 bp, Artificial Sequence
  Synthetic DNA
tattaccactaactaaag

SEQ ID NO: 23487 - DNA, 18 bp, Artificial Sequence
  Synthetic DNA
tattacgaatcacttcag

SEQ ID NO: 23488 - DNA, 18 bp, Artificial Sequence
  Synthetic DNA
tattacgattaaatatag

SEQ ID NO: 23489 - DNA, 18 bp, Artificial Sequence
  Synthetic DNA
tattacgtctccatatag

SEQ ID NO: 23490 - DNA, 18 bp, Artificial Sequence
  Synthetic DNA
tattacgtcttattatag

SEQ ID NO: 23491 - DNA, 18 bp, Artificial Sequence
  Synthetic DNA
tattagaactcactatcg

SEQ ID NO: 23492 - DNA, 18 bp, Artificial Sequence
  Synthetic DNA
tattatgactcagtaaag

SEQ ID NO: 23493 - DNA, 18 bp, Artificial Sequence
  Synthetic DNA
tattccaactaactatag

SEQ ID NO: 23494 - DNA, 18 bp, Artificial Sequence
  Synthetic DNA
tattccggctcactacag

SEQ ID NO: 23495 - DNA, 18 bp, Artificial Sequence
  Synthetic DNA
tattcctactctctatag

SEQ ID NO: 23496 - DNA, 18 bp, Artificial Sequence
  Synthetic DNA
tcatactactctccatag

SEQ ID NO: 23497 - DNA, 18 bp, Artificial Sequence
  Synthetic DNA
tgatactactcacttcag

SEQ ID NO: 23498 - DNA, 18 bp, Artificial Sequence
  Synthetic DNA
ttaaacgcctcacaatag

SEQ ID NO: 23499 - DNA, 18 bp, Artificial Sequence
  Synthetic DNA
ttaaacggctcacgatag

SEQ ID NO: 23500 - DNA, 18 bp, Artificial Sequence
  Synthetic DNA
ttataccactccctttag

SEQ ID NO: 23501 - DNA, 18 bp, Artificial Sequence
  Synthetic DNA
ttatacgactaagaatag

SEQ ID NO: 23502 - DNA, 18 bp, Artificial Sequence
  Synthetic DNA
ttatacgcctcattaaag

SEQ ID NO: 23503 - DNA, 18 bp, Artificial Sequence
  Synthetic DNA
ttatacgtttcagtatag

SEQ ID NO: 23504 - DNA, 18 bp, Artificial Sequence
  Synthetic DNA
ttataggacttactttag

SEQ ID NO: 23505 - DNA, 18 bp, Artificial Sequence
  Synthetic DNA
ttatccgtctcactatcg

SEQ ID NO: 23506 - DNA, 18 bp, Artificial Sequence
  Synthetic DNA
ttatcctactcactaaag

SEQ ID NO: 23507 - DNA, 18 bp, Artificial Sequence
  Synthetic DNA
ttatgcgattcactctag

SEQ ID NO: 23508 - DNA, 18 bp, Artificial Sequence
  Synthetic DNA
ttctacgactcacttaag

SEQ ID NO: 23509 - DNA, 18 bp, Artificial Sequence
  Synthetic DNA
aaattcgtctcgctatag

SEQ ID NO: 23510 - DNA, 18 bp, Artificial Sequence
  Synthetic DNA
atatgcgactcactattg

SEQ ID NO: 23511 - DNA, 18 bp, Artificial Sequence
  Synthetic DNA
taacacgtctcactaatg

SEQ ID NO: 23512 - DNA, 18 bp, Artificial Sequence
  Synthetic DNA
tattacgaatcaccattg

SEQ ID NO: 23513 - DNA, 18 bp, Artificial Sequence
  Synthetic DNA
tattacgactcacttctg

SEQ ID NO: 23514 - DNA, 18 bp, Artificial Sequence
  Synthetic DNA
taatactacaaactctag

SEQ ID NO: 23515 - DNA, 18 bp, Artificial Sequence
  Synthetic DNA
tattacgtgtcaatatag

SEQ ID NO: 23516 - DNA, 18 bp, Artificial Sequence
  Synthetic DNA
tgttacgactcacattag

SEQ ID NO: 23517 - DNA, 18 bp, Artificial Sequence
  Synthetic DNA
ttatacgtctgacaatag

SEQ ID NO: 23518 - DNA, 18 bp, Artificial Sequence
  Synthetic DNA
tatttcgtctcactattg

SEQ ID NO: 23519 - DNA, 18 bp, Artificial Sequence
  Synthetic DNA
aaatacgactctttattg

SEQ ID NO: 23520 - DNA, 18 bp, Artificial Sequence
  Synthetic DNA
tataacgactgactattg

SEQ ID NO: 23521 - DNA, 18 bp, Artificial Sequence
  Synthetic DNA
taatacgactctattaag

SEQ ID NO: 23522 - DNA, 18 bp, Artificial Sequence
  Synthetic DNA
tatcacgacatactatag

SEQ ID NO: 23523 - DNA, 18 bp, Artificial Sequence
  Synthetic DNA
tattacgactctgtaaag

SEQ ID NO: 23524 - DNA, 18 bp, Artificial Sequence
  Synthetic DNA
aaattccactcactattg

SEQ ID NO: 23525 - DNA, 18 bp, Artificial Sequence
  Synthetic DNA
taaaacgattcgctattg

SEQ ID NO: 23526 - DNA, 18 bp, Artificial Sequence
  Synthetic DNA
taaatcgaatcgctatag

SEQ ID NO: 23527 - DNA, 18 bp, Artificial Sequence
  Synthetic DNA
taagccgactcgctattg

SEQ ID NO: 23528 - DNA, 18 bp, Artificial Sequence
  Synthetic DNA
taatacgaattgctattg

SEQ ID NO: 23529 - DNA, 18 bp, Artificial Sequence
  Synthetic DNA
taatacgactcgacattg

SEQ ID NO: 23530 - DNA, 18 bp, Artificial Sequence
  Synthetic DNA
taatactactcgatattg

SEQ ID NO: 23531 - DNA, 18 bp, Artificial Sequence
  Synthetic DNA
taatactactcgcaattg

SEQ ID NO: 23532 - DNA, 18 bp, Artificial Sequence
  Synthetic DNA
taatatgactcgcttttg

SEQ ID NO: 23533 - DNA, 18 bp, Artificial Sequence
  Synthetic DNA
taattagactcgctgtag

SEQ ID NO: 23534 - DNA, 18 bp, Artificial Sequence
  Synthetic DNA
taattcgactcagtagtg

SEQ ID NO: 23535 - DNA, 18 bp, Artificial Sequence
  Synthetic DNA
taattcgactcatttttg

SEQ ID NO: 23536 - DNA, 18 bp, Artificial Sequence
  Synthetic DNA
tacttcgactcacttttg

SEQ ID NO: 23537 - DNA, 18 bp, Artificial Sequence
  Synthetic DNA
tactttgactcactattg

SEQ ID NO: 23538 - DNA, 18 bp, Artificial Sequence
  Synthetic DNA
tatttcgacccactattg

SEQ ID NO: 23539 - DNA, 18 bp, Artificial Sequence
  Synthetic DNA
tatttcgactcgttatag

SEQ ID NO: 23540 - DNA, 18 bp, Artificial Sequence
  Synthetic DNA
tgaaacgactcgctattg

SEQ ID NO: 23541 - DNA, 18 bp, Artificial Sequence
  Synthetic DNA
tgattcgactcactcttg

SEQ ID NO: 23542 - DNA, 18 bp, Artificial Sequence
  Synthetic DNA
aaagacgactaactattg

SEQ ID NO: 23543 - DNA, 18 bp, Artificial Sequence
  Synthetic DNA
aaatacgaatcactactg

SEQ ID NO: 23544 - DNA, 18 bp, Artificial Sequence
  Synthetic DNA
aaatacgacacacttttg

SEQ ID NO: 23545 - DNA, 18 bp, Artificial Sequence
  Synthetic DNA
aaatacgactcactcctg

SEQ ID NO: 23546 - DNA, 18 bp, Artificial Sequence
  Synthetic DNA
aaatacgattcacgattg

SEQ ID NO: 23547 - DNA, 18 bp, Artificial Sequence
  Synthetic DNA
aaatacgcctcactaatg

SEQ ID NO: 23548 - DNA, 18 bp, Artificial Sequence
  Synthetic DNA
aaatactactcgttatag

SEQ ID NO: 23549 - DNA, 18 bp, Artificial Sequence
  Synthetic DNA
aaataggactccctattg

SEQ ID NO: 23550 - DNA, 18 bp, Artificial Sequence
  Synthetic DNA
aaatatggctcactattg

SEQ ID NO: 23551 - DNA, 18 bp, Artificial Sequence
  Synthetic DNA
aaatgcaactcactattg

SEQ ID NO: 23552 - DNA, 18 bp, Artificial Sequence
  Synthetic DNA
aaattcgaatcactctag

SEQ ID NO: 23553 - DNA, 18 bp, Artificial Sequence
  Synthetic DNA
aaattcgactgactttag

SEQ ID NO: 23554 - DNA, 18 bp, Artificial Sequence
  Synthetic DNA
agaatcgactcactatag

SEQ ID NO: 23555 - DNA, 18 bp, Artificial Sequence
  Synthetic DNA
caaatagactcactatag

SEQ ID NO: 23556 - DNA, 18 bp, Artificial Sequence
  Synthetic DNA
caaatcgcctcactatag

SEQ ID NO: 23557 - DNA, 18 bp, Artificial Sequence
  Synthetic DNA
caatacgactcattgttg

SEQ ID NO: 23558 - DNA, 18 bp, Artificial Sequence
  Synthetic DNA
caatacgactcgcttaag

SEQ ID NO: 23559 - DNA, 18 bp, Artificial Sequence
  Synthetic DNA
caatacgactctcttttg

SEQ ID NO: 23560 - DNA, 18 bp, Artificial Sequence
  Synthetic DNA
caatatgactaactattg

SEQ ID NO: 23561 - DNA, 18 bp, Artificial Sequence
  Synthetic DNA
caattcgtctcactacag

SEQ ID NO: 23562 - DNA, 18 bp, Artificial Sequence
  Synthetic DNA
cattacgactcacaattg

SEQ ID NO: 23563 - DNA, 18 bp, Artificial Sequence
  Synthetic DNA
catttcgactcactagag

SEQ ID NO: 23564 - DNA, 18 bp, Artificial Sequence
  Synthetic DNA
cgattcgactcactgtag

SEQ ID NO: 23565 - DNA, 18 bp, Artificial Sequence
  Synthetic DNA
ctattcgacgcactatag

SEQ ID NO: 23566 - DNA, 18 bp, Artificial Sequence
  Synthetic DNA
ctattcgactcactgtag

SEQ ID NO: 23567 - DNA, 18 bp, Artificial Sequence
  Synthetic DNA
gaatccgactcattattg

SEQ ID NO: 23568 - DNA, 18 bp, Artificial Sequence
  Synthetic DNA
gaattcaactcactacag

SEQ ID NO: 23569 - DNA, 18 bp, Artificial Sequence
  Synthetic DNA
gaattcgattctctatag

SEQ ID NO: 23570 - DNA, 18 bp, Artificial Sequence
  Synthetic DNA
gattgcgactcactattg

SEQ ID NO: 23571 - DNA, 18 bp, Artificial Sequence
  Synthetic DNA
gcatacgactcaatattg

SEQ ID NO: 23572 - DNA, 18 bp, Artificial Sequence
  Synthetic DNA
taaaaagactcacttttg

SEQ ID NO: 23573 - DNA, 18 bp, Artificial Sequence
  Synthetic DNA
taaaacacctcactattg

SEQ ID NO: 23574 - DNA, 18 bp, Artificial Sequence
  Synthetic DNA
taaaacatctcgctatag

SEQ ID NO: 23575 - DNA, 18 bp, Artificial Sequence
  Synthetic DNA
taaaacgagtcagtattg

SEQ ID NO: 23576 - DNA, 18 bp, Artificial Sequence
  Synthetic DNA
taaaacgattcactactg

SEQ ID NO: 23577 - DNA, 18 bp, Artificial Sequence
  Synthetic DNA
taaaacgcctcaccattg

SEQ ID NO: 23578 - DNA, 18 bp, Artificial Sequence
  Synthetic DNA
taaaacgcctcacttttg

SEQ ID NO: 23579 - DNA, 18 bp, Artificial Sequence
  Synthetic DNA
taaatcgacttagtatag

SEQ ID NO: 23580 - DNA, 18 bp, Artificial Sequence
  Synthetic DNA
taaatcgcatcactatag

SEQ ID NO: 23581 - DNA, 18 bp, Artificial Sequence
  Synthetic DNA
taaattgactcattatag

SEQ ID NO: 23582 - DNA, 18 bp, Artificial Sequence
  Synthetic DNA
taacacgaataactattg

SEQ ID NO: 23583 - DNA, 18 bp, Artificial Sequence
  Synthetic DNA
taacacgacaaactattg

SEQ ID NO: 23584 - DNA, 18 bp, Artificial Sequence
  Synthetic DNA
taacacgactcgctcgag

SEQ ID NO: 23585 - DNA, 18 bp, Artificial Sequence
  Synthetic DNA
taacacgacttacaattg

SEQ ID NO: 23586 - DNA, 18 bp, Artificial Sequence
  Synthetic DNA
taacacgacttactagtg

SEQ ID NO: 23587 - DNA, 18 bp, Artificial Sequence
  Synthetic DNA
taacacgagtagctatag

SEQ ID NO: 23588 - DNA, 18 bp, Artificial Sequence
  Synthetic DNA
taactcgacctactatag

SEQ ID NO: 23589 - DNA, 18 bp, Artificial Sequence
  Synthetic DNA
taagacgactcgccatcg

SEQ ID NO: 23590 - DNA, 18 bp, Artificial Sequence
  Synthetic DNA
taagtcttctcactatag

SEQ ID NO: 23591 - DNA, 18 bp, Artificial Sequence
  Synthetic DNA
taagttgactaactatag

SEQ ID NO: 23592 - DNA, 18 bp, Artificial Sequence
  Synthetic DNA
taataagactccatattg

SEQ ID NO: 23593 - DNA, 18 bp, Artificial Sequence
  Synthetic DNA
taataagattcgatatag

SEQ ID NO: 23594 - DNA, 18 bp, Artificial Sequence
  Synthetic DNA
taatacaaatcattattg

SEQ ID NO: 23595 - DNA, 18 bp, Artificial Sequence
  Synthetic DNA
taatacaactcaatagtg

SEQ ID NO: 23596 - DNA, 18 bp, Artificial Sequence
  Synthetic DNA
taataccccgcactattg

SEQ ID NO: 23597 - DNA, 18 bp, Artificial Sequence
  Synthetic DNA
taatacgaatcagtactg

SEQ ID NO: 23598 - DNA, 18 bp, Artificial Sequence
  Synthetic DNA
taatacgacaaacaattg

SEQ ID NO: 23599 - DNA, 18 bp, Artificial Sequence
  Synthetic DNA
taatacgacccaccaatg

SEQ ID NO: 23600 - DNA, 18 bp, Artificial Sequence
  Synthetic DNA
taatacgaccccttattg

SEQ ID NO: 23601 - DNA, 18 bp, Artificial Sequence
  Synthetic DNA
taatacgactaagttttg

SEQ ID NO: 23602 - DNA, 18 bp, Artificial Sequence
  Synthetic DNA
taatacgactcaaaactg

SEQ ID NO: 23603 - DNA, 18 bp, Artificial Sequence
  Synthetic DNA
taatacgagtctgtattg

SEQ ID NO: 23604 - DNA, 18 bp, Artificial Sequence
  Synthetic DNA
taatacgatacgctaaag

SEQ ID NO: 23605 - DNA, 18 bp, Artificial Sequence
  Synthetic DNA
taatacgcctcacttctg

SEQ ID NO: 23606 - DNA, 18 bp, Artificial Sequence
  Synthetic DNA
taatacgcctcgcaaaag

SEQ ID NO: 23607 - DNA, 18 bp, Artificial Sequence
  Synthetic DNA
taatacgtctcgctcaag

SEQ ID NO: 23608 - DNA, 18 bp, Artificial Sequence
  Synthetic DNA
taatacgtctggctctag

SEQ ID NO: 23609 - DNA, 18 bp, Artificial Sequence
  Synthetic DNA
taatactaatcactgttg

SEQ ID NO: 23610 - DNA, 18 bp, Artificial Sequence
  Synthetic DNA
taatactacaggctatag

SEQ ID NO: 23611 - DNA, 18 bp, Artificial Sequence
  Synthetic DNA
taatactcctctctattg

SEQ ID NO: 23612 - DNA, 18 bp, Artificial Sequence
  Synthetic DNA
taatactgcccactattg

SEQ ID NO: 23613 - DNA, 18 bp, Artificial Sequence
  Synthetic DNA
taataggaatcactaatg

SEQ ID NO: 23614 - DNA, 18 bp, Artificial Sequence
  Synthetic DNA
taataggactagctacag

SEQ ID NO: 23615 - DNA, 18 bp, Artificial Sequence
  Synthetic DNA
taatatcactcacttttg

SEQ ID NO: 23616 - DNA, 18 bp, Artificial Sequence
  Synthetic DNA
taatatgactccctagtg

SEQ ID NO: 23617 - DNA, 18 bp, Artificial Sequence
  Synthetic DNA
taatatgactctctatta

SEQ ID NO: 23618 - DNA, 18 bp, Artificial Sequence
  Synthetic DNA
taatatgacttaccattg

SEQ ID NO: 23619 - DNA, 18 bp, Artificial Sequence
  Synthetic DNA
taatatgatttactattg

SEQ ID NO: 23620 - DNA, 18 bp, Artificial Sequence
  Synthetic DNA
taatccgactcaattttg

SEQ ID NO: 23621 - DNA, 18 bp, Artificial Sequence
  Synthetic DNA
taatccgactcacgtttg

SEQ ID NO: 23622 - DNA, 18 bp, Artificial Sequence
  Synthetic DNA
taatgagattcactattg

SEQ ID NO: 23623 - DNA, 18 bp, Artificial Sequence
  Synthetic DNA
taatgcaagtcactattg

SEQ ID NO: 23624 - DNA, 18 bp, Artificial Sequence
  Synthetic DNA
taatgcgactcgttaaag

SEQ ID NO: 23625 - DNA, 18 bp, Artificial Sequence
  Synthetic DNA
taattaaactccctatag

SEQ ID NO: 23626 - DNA, 18 bp, Artificial Sequence
  Synthetic DNA
taattacactcacgatag

SEQ ID NO: 23627 - DNA, 18 bp, Artificial Sequence
  Synthetic DNA
taattattctcactatag

SEQ ID NO: 23628 - DNA, 18 bp, Artificial Sequence
  Synthetic DNA
taattcaacgcattatag

SEQ ID NO: 23629 - DNA, 18 bp, Artificial Sequence
  Synthetic DNA
taattcaactcaatatgg

SEQ ID NO: 23630 - DNA, 18 bp, Artificial Sequence
  Synthetic DNA
taattcaactcacaacag

SEQ ID NO: 23631 - DNA, 18 bp, Artificial Sequence
  Synthetic DNA
taattcaactctctatcg

SEQ ID NO: 23632 - DNA, 18 bp, Artificial Sequence
  Synthetic DNA
taattcaactctctgtag

SEQ ID NO: 23633 - DNA, 18 bp, Artificial Sequence
  Synthetic DNA
taattcatctgactatag

SEQ ID NO: 23634 - DNA, 18 bp, Artificial Sequence
  Synthetic DNA
taattccactcaccaaag

SEQ ID NO: 23635 - DNA, 18 bp, Artificial Sequence
  Synthetic DNA
taattccattcactgtag

SEQ ID NO: 23636 - DNA, 18 bp, Artificial Sequence
  Synthetic DNA
taattcgaatcacactag

SEQ ID NO: 23637 - DNA, 18 bp, Artificial Sequence
  Synthetic DNA
taattcgactaagtttag

SEQ ID NO: 23638 - DNA, 18 bp, Artificial Sequence
  Synthetic DNA
taattcgactcaagacag

SEQ ID NO: 23639 - DNA, 18 bp, Artificial Sequence
  Synthetic DNA
taattcgactctttatgg

SEQ ID NO: 23640 - DNA, 18 bp, Artificial Sequence
  Synthetic DNA
taattcgactttctctag

SEQ ID NO: 23641 - DNA, 18 bp, Artificial Sequence
  Synthetic DNA
taattcgagtgactctag

SEQ ID NO: 23642 - DNA, 18 bp, Artificial Sequence
  Synthetic DNA
taattcgcctctcgatag

SEQ ID NO: 23643 - DNA, 18 bp, Artificial Sequence
  Synthetic DNA
taattcggctcattaaag

SEQ ID NO: 23644 - DNA, 18 bp, Artificial Sequence
  Synthetic DNA
taattcggctgactaaag

SEQ ID NO: 23645 - DNA, 18 bp, Artificial Sequence
  Synthetic DNA
taattcggttcactttag

SEQ ID NO: 23646 - DNA, 18 bp, Artificial Sequence
  Synthetic DNA
taattcgtcccaatatag

SEQ ID NO: 23647 - DNA, 18 bp, Artificial Sequence
  Synthetic DNA
taattcgtctaaccatag

SEQ ID NO: 23648 - DNA, 18 bp, Artificial Sequence
  Synthetic DNA
taattcgtctcacattag

SEQ ID NO: 23649 - DNA, 18 bp, Artificial Sequence
  Synthetic DNA
taattctactcaatttag

SEQ ID NO: 23650 - DNA, 18 bp, Artificial Sequence
  Synthetic DNA
taattctagtcaatatag

SEQ ID NO: 23651 - DNA, 18 bp, Artificial Sequence
  Synthetic DNA
taattggactcagtatgg

SEQ ID NO: 23652 - DNA, 18 bp, Artificial Sequence
  Synthetic DNA
taattggactgactaaag

SEQ ID NO: 23653 - DNA, 18 bp, Artificial Sequence
  Synthetic DNA
taattggactgactttag

SEQ ID NO: 23654 - DNA, 18 bp, Artificial Sequence
  Synthetic DNA
taattgtacacactatag

SEQ ID NO: 23655 - DNA, 18 bp, Artificial Sequence
  Synthetic DNA
taatttgaatccctatag

SEQ ID NO: 23656 - DNA, 18 bp, Artificial Sequence
  Synthetic DNA
taatttgattccctatag

SEQ ID NO: 23657 - DNA, 18 bp, Artificial Sequence
  Synthetic DNA
taatttgtctcactatcg

SEQ ID NO: 23658 - DNA, 18 bp, Artificial Sequence
  Synthetic DNA
taattttactcactttag

SEQ ID NO: 23659 - DNA, 18 bp, Artificial Sequence
  Synthetic DNA
taccacgacttgctatag

SEQ ID NO: 23660 - DNA, 18 bp, Artificial Sequence
  Synthetic DNA
tactaagactcaatattg

SEQ ID NO: 23661 - DNA, 18 bp, Artificial Sequence
  Synthetic DNA
tactaccactcgctaaag

SEQ ID NO: 23662 - DNA, 18 bp, Artificial Sequence
  Synthetic DNA
tactacgaatcgctctag

SEQ ID NO: 23663 - DNA, 18 bp, Artificial Sequence
  Synthetic DNA
tactacgacccacaattg

SEQ ID NO: 23664 - DNA, 18 bp, Artificial Sequence
  Synthetic DNA
tactacgactaaatattg

SEQ ID NO: 23665 - DNA, 18 bp, Artificial Sequence
  Synthetic DNA
tactacgactgactactg

SEQ ID NO: 23666 - DNA, 18 bp, Artificial Sequence
  Synthetic DNA
tactcagactcactattg

SEQ ID NO: 23667 - DNA, 18 bp, Artificial Sequence
  Synthetic DNA
tactccgactcagtattg

SEQ ID NO: 23668 - DNA, 18 bp, Artificial Sequence
  Synthetic DNA
tacttccactcaccatag

SEQ ID NO: 23669 - DNA, 18 bp, Artificial Sequence
  Synthetic DNA
tacttccactcactgtag

SEQ ID NO: 23670 - DNA, 18 bp, Artificial Sequence
  Synthetic DNA
tactttgcctcactatag

SEQ ID NO: 23671 - DNA, 18 bp, Artificial Sequence
  Synthetic DNA
tagctcgcctcactatag

SEQ ID NO: 23672 - DNA, 18 bp, Artificial Sequence
  Synthetic DNA
taggaggactcactattg

SEQ ID NO: 23673 - DNA, 18 bp, Artificial Sequence
  Synthetic DNA
tagtacgactcgataaag

SEQ ID NO: 23674 - DNA, 18 bp, Artificial Sequence
  Synthetic DNA
tagttcgattccctatag

SEQ ID NO: 23675 - DNA, 18 bp, Artificial Sequence
  Synthetic DNA
tagttctactcacaatag

SEQ ID NO: 23676 - DNA, 18 bp, Artificial Sequence
  Synthetic DNA
tatctcggctcactatag

SEQ ID NO: 23677 - DNA, 18 bp, Artificial Sequence
  Synthetic DNA
tattacgacgcactaatg

SEQ ID NO: 23678 - DNA, 18 bp, Artificial Sequence
  Synthetic DNA
tattacggctccctattg

SEQ ID NO: 23679 - DNA, 18 bp, Artificial Sequence
  Synthetic DNA
tattacgtctcgccatag

SEQ ID NO: 23680 - DNA, 18 bp, Artificial Sequence
  Synthetic DNA
tattacgtgtcgctatag

SEQ ID NO: 23681 - DNA, 18 bp, Artificial Sequence
  Synthetic DNA
tattactactcgctttag

SEQ ID NO: 23682 - DNA, 18 bp, Artificial Sequence
  Synthetic DNA
tattaggactcattattg

SEQ ID NO: 23683 - DNA, 18 bp, Artificial Sequence
  Synthetic DNA
tattccgactcaatattg

SEQ ID NO: 23684 - DNA, 18 bp, Artificial Sequence
  Synthetic DNA
tatttagactcaccatag

SEQ ID NO: 23685 - DNA, 18 bp, Artificial Sequence
  Synthetic DNA
tatttccactaactatag

SEQ ID NO: 23686 - DNA, 18 bp, Artificial Sequence
  Synthetic DNA
tatttcgactaaccatag

SEQ ID NO: 23687 - DNA, 18 bp, Artificial Sequence
  Synthetic DNA
tatttcgagtaactatag

SEQ ID NO: 23688 - DNA, 18 bp, Artificial Sequence
  Synthetic DNA
tatttcggctcagtatag

SEQ ID NO: 23689 - DNA, 18 bp, Artificial Sequence
  Synthetic DNA
tcataccactcacttttg

SEQ ID NO: 23690 - DNA, 18 bp, Artificial Sequence
  Synthetic DNA
tcatacgacaaactattg

SEQ ID NO: 23691 - DNA, 18 bp, Artificial Sequence
  Synthetic DNA
tcatacgattcgctaaag

SEQ ID NO: 23692 - DNA, 18 bp, Artificial Sequence
  Synthetic DNA
tcatatgattcactattg

SEQ ID NO: 23693 - DNA, 18 bp, Artificial Sequence
  Synthetic DNA
tcatccgactcgctaaag

SEQ ID NO: 23694 - DNA, 18 bp, Artificial Sequence
  Synthetic DNA
tcatgcgaatcactattg

SEQ ID NO: 23695 - DNA, 18 bp, Artificial Sequence
  Synthetic DNA
tcattagactctctatag

SEQ ID NO: 23696 - DNA, 18 bp, Artificial Sequence
  Synthetic DNA
tcattagtctcactatag

SEQ ID NO: 23697 - DNA, 18 bp, Artificial Sequence
  Synthetic DNA
tcattcgactcaccatcg

SEQ ID NO: 23698 - DNA, 18 bp, Artificial Sequence
  Synthetic DNA
tcattcgacttactatgg

SEQ ID NO: 23699 - DNA, 18 bp, Artificial Sequence
  Synthetic DNA
tcattcgcctaactatag

SEQ ID NO: 23700 - DNA, 18 bp, Artificial Sequence
  Synthetic DNA
tcattcttctcactatag

SEQ ID NO: 23701 - DNA, 18 bp, Artificial Sequence
  Synthetic DNA
tctttcgactcattatag

SEQ ID NO: 23702 - DNA, 18 bp, Artificial Sequence
  Synthetic DNA
tgaatcaactcactatag

SEQ ID NO: 23703 - DNA, 18 bp, Artificial Sequence
  Synthetic DNA
tgataagactcacttttg

SEQ ID NO: 23704 - DNA, 18 bp, Artificial Sequence
  Synthetic DNA
tgatacgaatcaatattg

SEQ ID NO: 23705 - DNA, 18 bp, Artificial Sequence
  Synthetic DNA
tgatacgaccctctattg

SEQ ID NO: 23706 - DNA, 18 bp, Artificial Sequence
  Synthetic DNA
tgatacgactcccttttg

SEQ ID NO: 23707 - DNA, 18 bp, Artificial Sequence
  Synthetic DNA
tgatacgactccttattg

SEQ ID NO: 23708 - DNA, 18 bp, Artificial Sequence
  Synthetic DNA
tgatacgactcgccctag

SEQ ID NO: 23709 - DNA, 18 bp, Artificial Sequence
  Synthetic DNA
tgatacgagtcactgttg

SEQ ID NO: 23710 - DNA, 18 bp, Artificial Sequence
  Synthetic DNA
tgatacgattcacaattg

SEQ ID NO: 23711 - DNA, 18 bp, Artificial Sequence
  Synthetic DNA
tgataggactctctattg

SEQ ID NO: 23712 - DNA, 18 bp, Artificial Sequence
  Synthetic DNA
tgatgcgactcacaattg

SEQ ID NO: 23713 - DNA, 18 bp, Artificial Sequence
  Synthetic DNA
tgattcgaaacactatag

SEQ ID NO: 23714 - DNA, 18 bp, Artificial Sequence
  Synthetic DNA
tgattctactccctatag

SEQ ID NO: 23715 - DNA, 18 bp, Artificial Sequence
  Synthetic DNA
tgtttcgactcactacag

SEQ ID NO: 23716 - DNA, 18 bp, Artificial Sequence
  Synthetic DNA
ttaatcgactcaatatag

SEQ ID NO: 23717 - DNA, 18 bp, Artificial Sequence
  Synthetic DNA
ttataaggctcgctatag

SEQ ID NO: 23718 - DNA, 18 bp, Artificial Sequence
  Synthetic DNA
ttatacgaatcgccatag

SEQ ID NO: 23719 - DNA, 18 bp, Artificial Sequence
  Synthetic DNA
ttatacgaccaactattg

SEQ ID NO: 23720 - DNA, 18 bp, Artificial Sequence
  Synthetic DNA
ttatacgactcacaagtg

SEQ ID NO: 23721 - DNA, 18 bp, Artificial Sequence
  Synthetic DNA
ttatacgtatcgctatag

SEQ ID NO: 23722 - DNA, 18 bp, Artificial Sequence
  Synthetic DNA
ttatgcgactcgcgatag

SEQ ID NO: 23723 - DNA, 18 bp, Artificial Sequence
  Synthetic DNA
ttattccactcagtatag

SEQ ID NO: 23724 - DNA, 18 bp, Artificial Sequence
  Synthetic DNA
ttattcgactctctgtag

SEQ ID NO: 23725 - DNA, 18 bp, Artificial Sequence
  Synthetic DNA
tttttcgactcactagag

SEQ ID NO: 23726 - DNA, 18 bp, Artificial Sequence
  Synthetic DNA
aaaaacgactaactacag

SEQ ID NO: 23727 - DNA, 18 bp, Artificial Sequence
  Synthetic DNA
aaaaacgcttcactatag

SEQ ID NO: 23728 - DNA, 18 bp, Artificial Sequence
  Synthetic DNA
aaacacgactcactaggg

SEQ ID NO: 23729 - DNA, 18 bp, Artificial Sequence
  Synthetic DNA
aaacacgagtcaccatag

SEQ ID NO: 23730 - DNA, 18 bp, Artificial Sequence
  Synthetic DNA
aaagatgactctctatag

SEQ ID NO: 23731 - DNA, 18 bp, Artificial Sequence
  Synthetic DNA
aaataagacctactatag

SEQ ID NO: 23732 - DNA, 18 bp, Artificial Sequence
  Synthetic DNA
aaataagactcacaacag

SEQ ID NO: 23733 - DNA, 18 bp, Artificial Sequence
  Synthetic DNA
aaataatactcaatatag

SEQ ID NO: 23734 - DNA, 18 bp, Artificial Sequence
  Synthetic DNA
aaatacaacccactttag

SEQ ID NO: 23735 - DNA, 18 bp, Artificial Sequence
  Synthetic DNA
aaatacaactaactacag

SEQ ID NO: 23736 - DNA, 18 bp, Artificial Sequence
  Synthetic DNA
aaatacaactcactttgg

SEQ ID NO: 23737 - DNA, 18 bp, Artificial Sequence
  Synthetic DNA
aaatacaactctctgtag

SEQ ID NO: 23738 - DNA, 18 bp, Artificial Sequence
  Synthetic DNA
aaatacaagtcacaatag

SEQ ID NO: 23739 - DNA, 18 bp, Artificial Sequence
  Synthetic DNA
aaatacaattctctatag

SEQ ID NO: 23740 - DNA, 18 bp, Artificial Sequence
  Synthetic DNA
aaatacatcttactatag

SEQ ID NO: 23741 - DNA, 18 bp, Artificial Sequence
  Synthetic DNA
aaatacgactatcgatag

SEQ ID NO: 23742 - DNA, 18 bp, Artificial Sequence
  Synthetic DNA
aaatacgactcatactag

SEQ ID NO: 23743 - DNA, 18 bp, Artificial Sequence
  Synthetic DNA
aaatacgacttaatacag

SEQ ID NO: 23744 - DNA, 18 bp, Artificial Sequence
  Synthetic DNA
aaatacgactttatatag

SEQ ID NO: 23745 - DNA, 18 bp, Artificial Sequence
  Synthetic DNA
aaatacgagttattatag

SEQ ID NO: 23746 - DNA, 18 bp, Artificial Sequence
  Synthetic DNA
aaatacgattcagaatag

SEQ ID NO: 23747 - DNA, 18 bp, Artificial Sequence
  Synthetic DNA
aaatacgattctatatag

SEQ ID NO: 23748 - DNA, 18 bp, Artificial Sequence
  Synthetic DNA
aaatacgccacactttag

SEQ ID NO: 23749 - DNA, 18 bp, Artificial Sequence
  Synthetic DNA
aaatacgctacactatag

SEQ ID NO: 23750 - DNA, 18 bp, Artificial Sequence
  Synthetic DNA
aaatacgtctaactgtag

SEQ ID NO: 23751 - DNA, 18 bp, Artificial Sequence
  Synthetic DNA
aaatacgtctcataatag

SEQ ID NO: 23752 - DNA, 18 bp, Artificial Sequence
  Synthetic DNA
aaatacgtctcattacag

SEQ ID NO: 23753 - DNA, 18 bp, Artificial Sequence
  Synthetic DNA
aaatacgtctccgtatag

SEQ ID NO: 23754 - DNA, 18 bp, Artificial Sequence
  Synthetic DNA
aaatacgttccactatag

SEQ ID NO: 23755 - DNA, 18 bp, Artificial Sequence
  Synthetic DNA
aaatactacacactagag

SEQ ID NO: 23756 - DNA, 18 bp, Artificial Sequence
  Synthetic DNA
aaatactacctactatag

SEQ ID NO: 23757 - DNA, 18 bp, Artificial Sequence
  Synthetic DNA
aaatactactaaatatag

SEQ ID NO: 23758 - DNA, 18 bp, Artificial Sequence
  Synthetic DNA
aaatactacttactaaag

SEQ ID NO: 23759 - DNA, 18 bp, Artificial Sequence
  Synthetic DNA
aaatactacttactataa

SEQ ID NO: 23760 - DNA, 18 bp, Artificial Sequence
  Synthetic DNA
aaatactattcactagag

SEQ ID NO: 23761 - DNA, 18 bp, Artificial Sequence
  Synthetic DNA
aaatactattcactatcg

SEQ ID NO: 23762 - DNA, 18 bp, Artificial Sequence
  Synthetic DNA
aaatactcctctctatag

SEQ ID NO: 23763 - DNA, 18 bp, Artificial Sequence
  Synthetic DNA
aaatacttctcagtatag

SEQ ID NO: 23764 - DNA, 18 bp, Artificial Sequence
  Synthetic DNA
aaataggagttactatag

SEQ ID NO: 23765 - DNA, 18 bp, Artificial Sequence
  Synthetic DNA
aaatattgctcactatag

SEQ ID NO: 23766 - DNA, 18 bp, Artificial Sequence
  Synthetic DNA
aaatccggcttactatag

SEQ ID NO: 23767 - DNA, 18 bp, Artificial Sequence
  Synthetic DNA
aaatccgtcacactatag

SEQ ID NO: 23768 - DNA, 18 bp, Artificial Sequence
  Synthetic DNA
aaatgcgactcactccag

SEQ ID NO: 23769 - DNA, 18 bp, Artificial Sequence
  Synthetic DNA
aaatgcgtctcactctag

SEQ ID NO: 23770 - DNA, 18 bp, Artificial Sequence
  Synthetic DNA
aaatgtgactcactgtag

SEQ ID NO: 23771 - DNA, 18 bp, Artificial Sequence
  Synthetic DNA
aacaacgcctcactatag

SEQ ID NO: 23772 - DNA, 18 bp, Artificial Sequence
  Synthetic DNA
aactacgactgactatcg

SEQ ID NO: 23773 - DNA, 18 bp, Artificial Sequence
  Synthetic DNA
aagtactactcacaatag

SEQ ID NO: 23774 - DNA, 18 bp, Artificial Sequence
  Synthetic DNA
aataaagactcactatag

SEQ ID NO: 23775 - DNA, 18 bp, Artificial Sequence
  Synthetic DNA
aataacgacgcactatag

SEQ ID NO: 23776 - DNA, 18 bp, Artificial Sequence
  Synthetic DNA
aattaagactcactaaag

SEQ ID NO: 23777 - DNA, 18 bp, Artificial Sequence
  Synthetic DNA
aattacgactcaccagag

SEQ ID NO: 23778 - DNA, 18 bp, Artificial Sequence
  Synthetic DNA
aattacgacttcctatag

SEQ ID NO: 23779 - DNA, 18 bp, Artificial Sequence
  Synthetic DNA
acacaagactcactatag

SEQ ID NO: 23780 - DNA, 18 bp, Artificial Sequence
  Synthetic DNA
acataccactcactaaag

SEQ ID NO: 23781 - DNA, 18 bp, Artificial Sequence
  Synthetic DNA
acatacctctcactatag

SEQ ID NO: 23782 - DNA, 18 bp, Artificial Sequence
  Synthetic DNA
acatacgaattactatag

SEQ ID NO: 23783 - DNA, 18 bp, Artificial Sequence
  Synthetic DNA
acatactactctctatag

SEQ ID NO: 23784 - DNA, 18 bp, Artificial Sequence
  Synthetic DNA
agatacgactctcaatag

SEQ ID NO: 23785 - DNA, 18 bp, Artificial Sequence
  Synthetic DNA
agataggactcactatcg

SEQ ID NO: 23786 - DNA, 18 bp, Artificial Sequence
  Synthetic DNA
atatacgaatcacgatag

SEQ ID NO: 23787 - DNA, 18 bp, Artificial Sequence
  Synthetic DNA
atatacgacccactctag

SEQ ID NO: 23788 - DNA, 18 bp, Artificial Sequence
  Synthetic DNA
atatgcgaatcactatag

SEQ ID NO: 23789 - DNA, 18 bp, Artificial Sequence
  Synthetic DNA
caaaacgattgactatag

SEQ ID NO: 23790 - DNA, 18 bp, Artificial Sequence
  Synthetic DNA
caaaactactcattatag

SEQ ID NO: 23791 - DNA, 18 bp, Artificial Sequence
  Synthetic DNA
caacacgactcactcgag

SEQ ID NO: 23792 - DNA, 18 bp, Artificial Sequence
  Synthetic DNA
caacacgattcaccatag

SEQ ID NO: 23793 - DNA, 18 bp, Artificial Sequence
  Synthetic DNA
caataagacacactatgg

SEQ ID NO: 23794 - DNA, 18 bp, Artificial Sequence
  Synthetic DNA
caatacaacccactacag

SEQ ID NO: 23795 - DNA, 18 bp, Artificial Sequence
  Synthetic DNA
caataccacccactatgg

SEQ ID NO: 23796 - DNA, 18 bp, Artificial Sequence
  Synthetic DNA
caatacctctccctatag

SEQ ID NO: 23797 - DNA, 18 bp, Artificial Sequence
  Synthetic DNA
caatacgaatgactttag

SEQ ID NO: 23798 - DNA, 18 bp, Artificial Sequence
  Synthetic DNA
caatacgactaacttaag

SEQ ID NO: 23799 - DNA, 18 bp, Artificial Sequence
  Synthetic DNA
caatacgactcaattcag

SEQ ID NO: 23800 - DNA, 18 bp, Artificial Sequence
  Synthetic DNA
caatacgactcaatttcg

SEQ ID NO: 23801 - DNA, 18 bp, Artificial Sequence
  Synthetic DNA
caatacgagtctctaaag

SEQ ID NO: 23802 - DNA, 18 bp, Artificial Sequence
  Synthetic DNA
caatacgattcacaatgg

SEQ ID NO: 23803 - DNA, 18 bp, Artificial Sequence
  Synthetic DNA
caatacgatttactacag

SEQ ID NO: 23804 - DNA, 18 bp, Artificial Sequence
  Synthetic DNA
caatacgtcatactatag

SEQ ID NO: 23805 - DNA, 18 bp, Artificial Sequence
  Synthetic DNA
caatacgtcttactaaag

SEQ ID NO: 23806 - DNA, 18 bp, Artificial Sequence
  Synthetic DNA
caatacgtgtcactaaag

SEQ ID NO: 23807 - DNA, 18 bp, Artificial Sequence
  Synthetic DNA
caatactactctctatcg

SEQ ID NO: 23808 - DNA, 18 bp, Artificial Sequence
  Synthetic DNA
caatacttctcactttag

SEQ ID NO: 23809 - DNA, 18 bp, Artificial Sequence
  Synthetic DNA
caatgcgaatcattatag

SEQ ID NO: 23810 - DNA, 18 bp, Artificial Sequence
  Synthetic DNA
cactacgaccctctatag

SEQ ID NO: 23811 - DNA, 18 bp, Artificial Sequence
  Synthetic DNA
cactacgattctctatag

SEQ ID NO: 23812 - DNA, 18 bp, Artificial Sequence
  Synthetic DNA
cattacaactcactctag

SEQ ID NO: 23813 - DNA, 18 bp, Artificial Sequence
  Synthetic DNA
cattacatctcactatag

SEQ ID NO: 23814 - DNA, 18 bp, Artificial Sequence
  Synthetic DNA
cattacgacaaactatag

SEQ ID NO: 23815 - DNA, 18 bp, Artificial Sequence
  Synthetic DNA
cattacgacccactaaag

SEQ ID NO: 23816 - DNA, 18 bp, Artificial Sequence
  Synthetic DNA
cattacgattcactgtag

SEQ ID NO: 23817 - DNA, 18 bp, Artificial Sequence
  Synthetic DNA
cattacgtctcactagag

SEQ ID NO: 23818 - DNA, 18 bp, Artificial Sequence
  Synthetic DNA
cattctgactcactatag

SEQ ID NO: 23819 - DNA, 18 bp, Artificial Sequence
  Synthetic DNA
ccaaacgacacactatag

SEQ ID NO: 23820 - DNA, 18 bp, Artificial Sequence
  Synthetic DNA
cgatgcgactcactacag

SEQ ID NO: 23821 - DNA, 18 bp, Artificial Sequence
  Synthetic DNA
ctaaacgactcactatgg

SEQ ID NO: 23822 - DNA, 18 bp, Artificial Sequence
  Synthetic DNA
ctatacgaatcagtatag

SEQ ID NO: 23823 - DNA, 18 bp, Artificial Sequence
  Synthetic DNA
ctctactactcactatag

SEQ ID NO: 23824 - DNA, 18 bp, Artificial Sequence
  Synthetic DNA
ctttaccactcactatag

SEQ ID NO: 23825 - DNA, 18 bp, Artificial Sequence
  Synthetic DNA
ctttacgactccctatag

SEQ ID NO: 23826 - DNA, 18 bp, Artificial Sequence
  Synthetic DNA
gaaaacgactcatcatag

SEQ ID NO: 23827 - DNA, 18 bp, Artificial Sequence
  Synthetic DNA
gaaaactaatcactatag

SEQ ID NO: 23828 - DNA, 18 bp, Artificial Sequence
  Synthetic DNA
gaatacatcacactatag

SEQ ID NO: 23829 - DNA, 18 bp, Artificial Sequence
  Synthetic DNA
gaatacatctcattatag

SEQ ID NO: 23830 - DNA, 18 bp, Artificial Sequence
  Synthetic DNA
gaatacgatacactaaag

SEQ ID NO: 23831 - DNA, 18 bp, Artificial Sequence
  Synthetic DNA
gaatatgactatctatag

SEQ ID NO: 23832 - DNA, 18 bp, Artificial Sequence
  Synthetic DNA
gaggacgactcaatatag

SEQ ID NO: 23833 - DNA, 18 bp, Artificial Sequence
  Synthetic DNA
gcaaatgactcactatag

SEQ ID NO: 23834 - DNA, 18 bp, Artificial Sequence
  Synthetic DNA
gcatacgtctcactttag

SEQ ID NO: 23835 - DNA, 18 bp, Artificial Sequence
  Synthetic DNA
ggatacaagtcactatag

SEQ ID NO: 23836 - DNA, 18 bp, Artificial Sequence
  Synthetic DNA
ggctacgactcaatatag

SEQ ID NO: 23837 - DNA, 18 bp, Artificial Sequence
  Synthetic DNA
taaaaagactcagtaaag

SEQ ID NO: 23838 - DNA, 18 bp, Artificial Sequence
  Synthetic DNA
taaaacaacccagtatag

SEQ ID NO: 23839 - DNA, 18 bp, Artificial Sequence
  Synthetic DNA
taaaaccactcactaagg

SEQ ID NO: 23840 - DNA, 18 bp, Artificial Sequence
  Synthetic DNA
taaaaccactcagtacag

SEQ ID NO: 23841 - DNA, 18 bp, Artificial Sequence
  Synthetic DNA
taaaacgaaacactaaag

SEQ ID NO: 23842 - DNA, 18 bp, Artificial Sequence
  Synthetic DNA
taaaacgaatcagtatcg

SEQ ID NO: 23843 - DNA, 18 bp, Artificial Sequence
  Synthetic DNA
taaaacgaccctctgtag

SEQ ID NO: 23844 - DNA, 18 bp, Artificial Sequence
  Synthetic DNA
taaaacgactcaaagtag

SEQ ID NO: 23845 - DNA, 18 bp, Artificial Sequence
  Synthetic DNA
taaaacgattccctatcg

SEQ ID NO: 23846 - DNA, 18 bp, Artificial Sequence
  Synthetic DNA
taaaacgcatcactaaag

SEQ ID NO: 23847 - DNA, 18 bp, Artificial Sequence
  Synthetic DNA
taaaacgcctcacttaag

SEQ ID NO: 23848 - DNA, 18 bp, Artificial Sequence
  Synthetic DNA
taaaacgtcgcacaatag

SEQ ID NO: 23849 - DNA, 18 bp, Artificial Sequence
  Synthetic DNA
taaaactactcaatacag

SEQ ID NO: 23850 - DNA, 18 bp, Artificial Sequence
  Synthetic DNA
taaaactactcaatatcg

SEQ ID NO: 23851 - DNA, 18 bp, Artificial Sequence
  Synthetic DNA
taaaactcctcaatatag

SEQ ID NO: 23852 - DNA, 18 bp, Artificial Sequence
  Synthetic DNA
taaaactccttactatag

SEQ ID NO: 23853 - DNA, 18 bp, Artificial Sequence
  Synthetic DNA
taaaactcttcactatag

SEQ ID NO: 23854 - DNA, 18 bp, Artificial Sequence
  Synthetic DNA
taaaaggacatactatag

SEQ ID NO: 23855 - DNA, 18 bp, Artificial Sequence
  Synthetic DNA
taaaaggactcacaaaag

SEQ ID NO: 23856 - DNA, 18 bp, Artificial Sequence
  Synthetic DNA
taaaaggactctctttag

SEQ ID NO: 23857 - DNA, 18 bp, Artificial Sequence
  Synthetic DNA
taaaagggctcagtatag

SEQ ID NO: 23858 - DNA, 18 bp, Artificial Sequence
  Synthetic DNA
taaaatgacaaactatag

SEQ ID NO: 23859 - DNA, 18 bp, Artificial Sequence
  Synthetic DNA
taaaatgacttattatag

SEQ ID NO: 23860 - DNA, 18 bp, Artificial Sequence
  Synthetic DNA
taaacagactcactatgg

SEQ ID NO: 23861 - DNA, 18 bp, Artificial Sequence
  Synthetic DNA
taaaccgaatcactacag

SEQ ID NO: 23862 - DNA, 18 bp, Artificial Sequence
  Synthetic DNA
taaaccgacaccctatag

SEQ ID NO: 23863 - DNA, 18 bp, Artificial Sequence
  Synthetic DNA
taaaccgactcactcaag

SEQ ID NO: 23864 - DNA, 18 bp, Artificial Sequence
  Synthetic DNA
taaactgcctcactatag

SEQ ID NO: 23865 - DNA, 18 bp, Artificial Sequence
  Synthetic DNA
taaagcgaatcacaatag

SEQ ID NO: 23866 - DNA, 18 bp, Artificial Sequence
  Synthetic DNA
taaagcgactcatgatag

SEQ ID NO: 23867 - DNA, 18 bp, Artificial Sequence
  Synthetic DNA
taacaagactcacagtag

SEQ ID NO: 23868 - DNA, 18 bp, Artificial Sequence
  Synthetic DNA
taacaatagtcactatag

SEQ ID NO: 23869 - DNA, 18 bp, Artificial Sequence
  Synthetic DNA
taacacaactaactaaag

SEQ ID NO: 23870 - DNA, 18 bp, Artificial Sequence
  Synthetic DNA
taacacaactcataatag

SEQ ID NO: 23871 - DNA, 18 bp, Artificial Sequence
  Synthetic DNA
taacaccactctctttag

SEQ ID NO: 23872 - DNA, 18 bp, Artificial Sequence
  Synthetic DNA
taacacgacacacttgag

SEQ ID NO: 23873 - DNA, 18 bp, Artificial Sequence
  Synthetic DNA
taacacgacactctatcg

SEQ ID NO: 23874 - DNA, 18 bp, Artificial Sequence
  Synthetic DNA
taacacgactaactggag

SEQ ID NO: 23875 - DNA, 18 bp, Artificial Sequence
  Synthetic DNA
taacacgattaactttag

SEQ ID NO: 23876 - DNA, 18 bp, Artificial Sequence
  Synthetic DNA
taacacgattgtctatag

SEQ ID NO: 23877 - DNA, 18 bp, Artificial Sequence
  Synthetic DNA
taacacgtattactatag

SEQ ID NO: 23878 - DNA, 18 bp, Artificial Sequence
  Synthetic DNA
taacactacacactttag

SEQ ID NO: 23879 - DNA, 18 bp, Artificial Sequence
  Synthetic DNA
taacacttctcactacag

SEQ ID NO: 23880 - DNA, 18 bp, Artificial Sequence
  Synthetic DNA
taacaggacacactaaag

SEQ ID NO: 23881 - DNA, 18 bp, Artificial Sequence
  Synthetic DNA
taacagtactcactttag

SEQ ID NO: 23882 - DNA, 18 bp, Artificial Sequence
  Synthetic DNA
taaccctactcactaaag

SEQ ID NO: 23883 - DNA, 18 bp, Artificial Sequence
  Synthetic DNA
taagaaaactctctatag

SEQ ID NO: 23884 - DNA, 18 bp, Artificial Sequence
  Synthetic DNA
taagaagacacactttag

SEQ ID NO: 23885 - DNA, 18 bp, Artificial Sequence
  Synthetic DNA
taagacgaatcacttcag

SEQ ID NO: 23886 - DNA, 18 bp, Artificial Sequence
  Synthetic DNA
taagacgtttcactatgg

SEQ ID NO: 23887 - DNA, 18 bp, Artificial Sequence
  Synthetic DNA
taagactactcaaaatag

SEQ ID NO: 23888 - DNA, 18 bp, Artificial Sequence
  Synthetic DNA
taagactactcaatttag

SEQ ID NO: 23889 - DNA, 18 bp, Artificial Sequence
  Synthetic DNA
taagactactcaccttag

SEQ ID NO: 23890 - DNA, 18 bp, Artificial Sequence
  Synthetic DNA
taagactactctctatgg

SEQ ID NO: 23891 - DNA, 18 bp, Artificial Sequence
  Synthetic DNA
taagactacttactaaag

SEQ ID NO: 23892 - DNA, 18 bp, Artificial Sequence
  Synthetic DNA
taagatgacttcctatag

SEQ ID NO: 23893 - DNA, 18 bp, Artificial Sequence
  Synthetic DNA
taagatttctcactatag

SEQ ID NO: 23894 - DNA, 18 bp, Artificial Sequence
  Synthetic DNA
taaggtgactcactatgg

SEQ ID NO: 23895 - DNA, 18 bp, Artificial Sequence
  Synthetic DNA
taataaaaatctctatag

SEQ ID NO: 23896 - DNA, 18 bp, Artificial Sequence
  Synthetic DNA
taataaaactaaccatag

SEQ ID NO: 23897 - DNA, 18 bp, Artificial Sequence
  Synthetic DNA
taataaaactaactttag

SEQ ID NO: 23898 - DNA, 18 bp, Artificial Sequence
  Synthetic DNA
taataaatctcacgatag

SEQ ID NO: 23899 - DNA, 18 bp, Artificial Sequence
  Synthetic DNA
taataacacttagtatag

SEQ ID NO: 23900 - DNA, 18 bp, Artificial Sequence
  Synthetic DNA
taataagaccgattatag

SEQ ID NO: 23901 - DNA, 18 bp, Artificial Sequence
  Synthetic DNA
taataagactcaaattag

SEQ ID NO: 23902 - DNA, 18 bp, Artificial Sequence
  Synthetic DNA
taataagactctttatcg

SEQ ID NO: 23903 - DNA, 18 bp, Artificial Sequence
  Synthetic DNA
taataagacttacactag

SEQ ID NO: 23904 - DNA, 18 bp, Artificial Sequence
  Synthetic DNA
taataagagacactgtag

SEQ ID NO: 23905 - DNA, 18 bp, Artificial Sequence
  Synthetic DNA
taataagatccacaatag

SEQ ID NO: 23906 - DNA, 18 bp, Artificial Sequence
  Synthetic DNA
taataagattcacgacag

SEQ ID NO: 23907 - DNA, 18 bp, Artificial Sequence
  Synthetic DNA
taataagtatcactaaag

SEQ ID NO: 23908 - DNA, 18 bp, Artificial Sequence
  Synthetic DNA
taataagttccactatag

SEQ ID NO: 23909 - DNA, 18 bp, Artificial Sequence
  Synthetic DNA
taataatacacacaatag

SEQ ID NO: 23910 - DNA, 18 bp, Artificial Sequence
  Synthetic DNA
taataatactctgtatag

SEQ ID NO: 23911 - DNA, 18 bp, Artificial Sequence
  Synthetic DNA
taatacaacacaccaaag

SEQ ID NO: 23912 - DNA, 18 bp, Artificial Sequence
  Synthetic DNA
taatacaacccagcatag

SEQ ID NO: 23913 - DNA, 18 bp, Artificial Sequence
  Synthetic DNA
taatacaactcacttacg

SEQ ID NO: 23914 - DNA, 18 bp, Artificial Sequence
  Synthetic DNA
taatacaactcattttcg

SEQ ID NO: 23915 - DNA, 18 bp, Artificial Sequence
  Synthetic DNA
taatacaactccatacag

SEQ ID NO: 23916 - DNA, 18 bp, Artificial Sequence
  Synthetic DNA
taatacaactccctctcg

SEQ ID NO: 23917 - DNA, 18 bp, Artificial Sequence
  Synthetic DNA
taatacaacttacttgag

SEQ ID NO: 23918 - DNA, 18 bp, Artificial Sequence
  Synthetic DNA
taatacaatttaccatag

SEQ ID NO: 23919 - DNA, 18 bp, Artificial Sequence
  Synthetic DNA
taatacacctaactttag

SEQ ID NO: 23920 - DNA, 18 bp, Artificial Sequence
  Synthetic DNA
taatacacttcactctag

SEQ ID NO: 23921 - DNA, 18 bp, Artificial Sequence
  Synthetic DNA
taatacatctcacactag

SEQ ID NO: 23922 - DNA, 18 bp, Artificial Sequence
  Synthetic DNA
taataccaatgactaaag

SEQ ID NO: 23923 - DNA, 18 bp, Artificial Sequence
  Synthetic DNA
taataccacttatcatag

SEQ ID NO: 23924 - DNA, 18 bp, Artificial Sequence
  Synthetic DNA
taataccattcaatctag

SEQ ID NO: 23925 - DNA, 18 bp, Artificial Sequence
  Synthetic DNA
taataccgctcccgatag

SEQ ID NO: 23926 - DNA, 18 bp, Artificial Sequence
  Synthetic DNA
taatacctcatactatag

SEQ ID NO: 23927 - DNA, 18 bp, Artificial Sequence
  Synthetic DNA
taatacctctcactccag

SEQ ID NO: 23928 - DNA, 18 bp, Artificial Sequence
  Synthetic DNA
taatacctgtctctatag

SEQ ID NO: 23929 - DNA, 18 bp, Artificial Sequence
  Synthetic DNA
taatacctttcactatgg

SEQ ID NO: 23930 - DNA, 18 bp, Artificial Sequence
  Synthetic DNA
taatacgaaacactgcag

SEQ ID NO: 23931 - DNA, 18 bp, Artificial Sequence
  Synthetic DNA
taatacgaacctatatag

SEQ ID NO: 23932 - DNA, 18 bp, Artificial Sequence
  Synthetic DNA
taatacgaatcaccctcg

SEQ ID NO: 23933 - DNA, 18 bp, Artificial Sequence
  Synthetic DNA
taatacgacaaactcaag

SEQ ID NO: 23934 - DNA, 18 bp, Artificial Sequence
  Synthetic DNA
taatacgacaatctctag

SEQ ID NO: 23935 - DNA, 18 bp, Artificial Sequence
  Synthetic DNA
taatacgacactcgttag

SEQ ID NO: 23936 - DNA, 18 bp, Artificial Sequence
  Synthetic DNA
taatacgacagacttgag

SEQ ID NO: 23937 - DNA, 18 bp, Artificial Sequence
  Synthetic DNA
taatacgacccattttgg

SEQ ID NO: 23938 - DNA, 18 bp, Artificial Sequence
  Synthetic DNA
taatacgacctactttcg

SEQ ID NO: 23939 - DNA, 18 bp, Artificial Sequence
  Synthetic DNA
taatacgacgctccatcg

SEQ ID NO: 23940 - DNA, 18 bp, Artificial Sequence
  Synthetic DNA
taatacgactcagataag

SEQ ID NO: 23941 - DNA, 18 bp, Artificial Sequence
  Synthetic DNA
taatacgactccttaacg

SEQ ID NO: 23942 - DNA, 18 bp, Artificial Sequence
  Synthetic DNA
taatacgactgcttctag

SEQ ID NO: 23943 - DNA, 18 bp, Artificial Sequence
  Synthetic DNA
taatacgacttaacatcg

SEQ ID NO: 23944 - DNA, 18 bp, Artificial Sequence
  Synthetic DNA
taatacgactttataaag

SEQ ID NO: 23945 - DNA, 18 bp, Artificial Sequence
  Synthetic DNA
taatacgactttccttag

SEQ ID NO: 23946 - DNA, 18 bp, Artificial Sequence
  Synthetic DNA
taatacgagtcaccaagg

SEQ ID NO: 23947 - DNA, 18 bp, Artificial Sequence
  Synthetic DNA
taatacgagttatcatag

SEQ ID NO: 23948 - DNA, 18 bp, Artificial Sequence
  Synthetic DNA
taatacgagttattatgg

SEQ ID NO: 23949 - DNA, 18 bp, Artificial Sequence
  Synthetic DNA
taatacgatgaattatag

SEQ ID NO: 23950 - DNA, 18 bp, Artificial Sequence
  Synthetic DNA
taatacgatgcacttaag

SEQ ID NO: 23951 - DNA, 18 bp, Artificial Sequence
  Synthetic DNA
taatacgattaagtttag

SEQ ID NO: 23952 - DNA, 18 bp, Artificial Sequence
  Synthetic DNA
taatacgattcagttaag

SEQ ID NO: 23953 - DNA, 18 bp, Artificial Sequence
  Synthetic DNA
taatacgattcatgttag

SEQ ID NO: 23954 - DNA, 18 bp, Artificial Sequence
  Synthetic DNA
taatacgattcattctgg

SEQ ID NO: 23955 - DNA, 18 bp, Artificial Sequence
  Synthetic DNA
taatacgcctaacgttag

SEQ ID NO: 23956 - DNA, 18 bp, Artificial Sequence
  Synthetic DNA
taatacgcctgacattag

SEQ ID NO: 23957 - DNA, 18 bp, Artificial Sequence
  Synthetic DNA
taatacgcctgtcaatag

SEQ ID NO: 23958 - DNA, 18 bp, Artificial Sequence
  Synthetic DNA
taatacggctcaacaaag

SEQ ID NO: 23959 - DNA, 18 bp, Artificial Sequence
  Synthetic DNA
taatacggctctcttaag

SEQ ID NO: 23960 - DNA, 18 bp, Artificial Sequence
  Synthetic DNA
taatacgtaccactacag

SEQ ID NO: 23961 - DNA, 18 bp, Artificial Sequence
  Synthetic DNA
taatacgtcccacttaag

SEQ ID NO: 23962 - DNA, 18 bp, Artificial Sequence
  Synthetic DNA
taatacgtctcacagtcg

SEQ ID NO: 23963 - DNA, 18 bp, Artificial Sequence
  Synthetic DNA
taatacgtctctgtttag

SEQ ID NO: 23964 - DNA, 18 bp, Artificial Sequence
  Synthetic DNA
taatacgtgtcacaatcg

SEQ ID NO: 23965 - DNA, 18 bp, Artificial Sequence
  Synthetic DNA
taatacgtttaattatag

SEQ ID NO: 23966 - DNA, 18 bp, Artificial Sequence
  Synthetic DNA
taatacgtttcatcatag

SEQ ID NO: 23967 - DNA, 18 bp, Artificial Sequence
  Synthetic DNA
taatactacatactagag

SEQ ID NO: 23968 - DNA, 18 bp, Artificial Sequence
  Synthetic DNA
taatactactcaacttag

SEQ ID NO: 23969 - DNA, 18 bp, Artificial Sequence
  Synthetic DNA
taatactactcagaacag

SEQ ID NO: 23970 - DNA, 18 bp, Artificial Sequence
  Synthetic DNA
taatactactctctctcg

SEQ ID NO: 23971 - DNA, 18 bp, Artificial Sequence
  Synthetic DNA
taatactagatactatag

SEQ ID NO: 23972 - DNA, 18 bp, Artificial Sequence
  Synthetic DNA
taatactagtcaccaaag

SEQ ID NO: 23973 - DNA, 18 bp, Artificial Sequence
  Synthetic DNA
taatactattaattatag

SEQ ID NO: 23974 - DNA, 18 bp, Artificial Sequence
  Synthetic DNA
taatactattcacttcag

SEQ ID NO: 23975 - DNA, 18 bp, Artificial Sequence
  Synthetic DNA
taatacttctcacaagag

SEQ ID NO: 23976 - DNA, 18 bp, Artificial Sequence
  Synthetic DNA
taatagcactctcaatag

SEQ ID NO: 23977 - DNA, 18 bp, Artificial Sequence
  Synthetic DNA
taataggaatgcctatag

SEQ ID NO: 23978 - DNA, 18 bp, Artificial Sequence
  Synthetic DNA
taataggacccacattag

SEQ ID NO: 23979 - DNA, 18 bp, Artificial Sequence
  Synthetic DNA
taataggacgctctgtag

SEQ ID NO: 23980 - DNA, 18 bp, Artificial Sequence
  Synthetic DNA
taataggactaacttaag

SEQ ID NO: 23981 - DNA, 18 bp, Artificial Sequence
  Synthetic DNA
taataggacttcctaaag

SEQ ID NO: 23982 - DNA, 18 bp, Artificial Sequence
  Synthetic DNA
taatagggctttctatag

SEQ ID NO: 23983 - DNA, 18 bp, Artificial Sequence
  Synthetic DNA
taataggtttcactaaag

SEQ ID NO: 23984 - DNA, 18 bp, Artificial Sequence
  Synthetic DNA
taatataactcatcatag

SEQ ID NO: 23985 - DNA, 18 bp, Artificial Sequence
  Synthetic DNA
taatatgacacaatacag

SEQ ID NO: 23986 - DNA, 18 bp, Artificial Sequence
  Synthetic DNA
taatatgactaattttag

SEQ ID NO: 23987 - DNA, 18 bp, Artificial Sequence
  Synthetic DNA
taatatgactctccatgg

SEQ ID NO: 23988 - DNA, 18 bp, Artificial Sequence
  Synthetic DNA
taatatgactctcttcag

SEQ ID NO: 23989 - DNA, 18 bp, Artificial Sequence
  Synthetic DNA
taatatgactgagaatag

SEQ ID NO: 23990 - DNA, 18 bp, Artificial Sequence
  Synthetic DNA
taatatgacttattctag

SEQ ID NO: 23991 - DNA, 18 bp, Artificial Sequence
  Synthetic DNA
taatatgagtctctatcg

SEQ ID NO: 23992 - DNA, 18 bp, Artificial Sequence
  Synthetic DNA
taatatgattcaataaag

SEQ ID NO: 23993 - DNA, 18 bp, Artificial Sequence
  Synthetic DNA
taatatgattcacgacag

SEQ ID NO: 23994 - DNA, 18 bp, Artificial Sequence
  Synthetic DNA
taatatgattcataatag

SEQ ID NO: 23995 - DNA, 18 bp, Artificial Sequence
  Synthetic DNA
taatatggcccactacag

SEQ ID NO: 23996 - DNA, 18 bp, Artificial Sequence
  Synthetic DNA
taatatggctccctacag

SEQ ID NO: 23997 - DNA, 18 bp, Artificial Sequence
  Synthetic DNA
taatatgtttcattatag

SEQ ID NO: 23998 - DNA, 18 bp, Artificial Sequence
  Synthetic DNA
taatattaccaactatag

SEQ ID NO: 23999 - DNA, 18 bp, Artificial Sequence
  Synthetic DNA
taatattactcaccaaag

SEQ ID NO: 24000 - DNA, 18 bp, Artificial Sequence
  Synthetic DNA
taatattactcacttcag

SEQ ID NO: 24001 - DNA, 18 bp, Artificial Sequence
  Synthetic DNA
taatattattcactctag

SEQ ID NO: 24002 - DNA, 18 bp, Artificial Sequence
  Synthetic DNA
taatcagacttaccatag

SEQ ID NO: 24003 - DNA, 18 bp, Artificial Sequence
  Synthetic DNA
taatcaggctcactttag

SEQ ID NO: 24004 - DNA, 18 bp, Artificial Sequence
  Synthetic DNA
taatccaactcagtttag

SEQ ID NO: 24005 - DNA, 18 bp, Artificial Sequence
  Synthetic DNA
taatccgaatgactaaag

SEQ ID NO: 24006 - DNA, 18 bp, Artificial Sequence
  Synthetic DNA
taatccgactcaattaag

SEQ ID NO: 24007 - DNA, 18 bp, Artificial Sequence
  Synthetic DNA
taatcctactcaatgtag

SEQ ID NO: 24008 - DNA, 18 bp, Artificial Sequence
  Synthetic DNA
taatcctactctctgtag

SEQ ID NO: 24009 - DNA, 18 bp, Artificial Sequence
  Synthetic DNA
taatcctagtcacaatag

SEQ ID NO: 24010 - DNA, 18 bp, Artificial Sequence
  Synthetic DNA
taatcctattcactacag

SEQ ID NO: 24011 - DNA, 18 bp, Artificial Sequence
  Synthetic DNA
taatcctcctcactaaag

SEQ ID NO: 24012 - DNA, 18 bp, Artificial Sequence
  Synthetic DNA
taatctcactcattatag

SEQ ID NO: 24013 - DNA, 18 bp, Artificial Sequence
  Synthetic DNA
taatctgactcataatag

SEQ ID NO: 24014 - DNA, 18 bp, Artificial Sequence
  Synthetic DNA
taatgagagtcattatag

SEQ ID NO: 24015 - DNA, 18 bp, Artificial Sequence
  Synthetic DNA
taatgcaacacaccatag

SEQ ID NO: 24016 - DNA, 18 bp, Artificial Sequence
  Synthetic DNA
taatgccattctctatag

SEQ ID NO: 24017 - DNA, 18 bp, Artificial Sequence
  Synthetic DNA
taatgcctttcactatag

SEQ ID NO: 24018 - DNA, 18 bp, Artificial Sequence
  Synthetic DNA
taatgcgaataactgtag

SEQ ID NO: 24019 - DNA, 18 bp, Artificial Sequence
  Synthetic DNA
taatgcgacctactacag

SEQ ID NO: 24020 - DNA, 18 bp, Artificial Sequence
  Synthetic DNA
taatgcgactctccaaag

SEQ ID NO: 24021 - DNA, 18 bp, Artificial Sequence
  Synthetic DNA
taatgcgactgattatcg

SEQ ID NO: 24022 - DNA, 18 bp, Artificial Sequence
  Synthetic DNA
taatgcgagccattatag

SEQ ID NO: 24023 - DNA, 18 bp, Artificial Sequence
  Synthetic DNA
taatgcgagtgattatag

SEQ ID NO: 24024 - DNA, 18 bp, Artificial Sequence
  Synthetic DNA
taatgcgattccctgtag

SEQ ID NO: 24025 - DNA, 18 bp, Artificial Sequence
  Synthetic DNA
taatgcgattgactttag

SEQ ID NO: 24026 - DNA, 18 bp, Artificial Sequence
  Synthetic DNA
taatgcgcctttctatag

SEQ ID NO: 24027 - DNA, 18 bp, Artificial Sequence
  Synthetic DNA
taatgcggctcattttag

SEQ ID NO: 24028 - DNA, 18 bp, Artificial Sequence
  Synthetic DNA
taatgcgtctctctacag

SEQ ID NO: 24029 - DNA, 18 bp, Artificial Sequence
  Synthetic DNA
taatgcgtttaactatag

SEQ ID NO: 24030 - DNA, 18 bp, Artificial Sequence
  Synthetic DNA
taatgcttctcactgtag

SEQ ID NO: 24031 - DNA, 18 bp, Artificial Sequence
  Synthetic DNA
taatggtacccactatag

SEQ ID NO: 24032 - DNA, 18 bp, Artificial Sequence
  Synthetic DNA
taatgttactcacaatag

SEQ ID NO: 24033 - DNA, 18 bp, Artificial Sequence
  Synthetic DNA
tacaacggctcactaaag

SEQ ID NO: 24034 - DNA, 18 bp, Artificial Sequence
  Synthetic DNA
tacaatgacacactatag

SEQ ID NO: 24035 - DNA, 18 bp, Artificial Sequence
  Synthetic DNA
tacaatgactcaccatag

SEQ ID NO: 24036 - DNA, 18 bp, Artificial Sequence
  Synthetic DNA
taccacgacccactttag

SEQ ID NO: 24037 - DNA, 18 bp, Artificial Sequence
  Synthetic DNA
taccacgactatctatag

SEQ ID NO: 24038 - DNA, 18 bp, Artificial Sequence
  Synthetic DNA
tactacaacagactatag

SEQ ID NO: 24039 - DNA, 18 bp, Artificial Sequence
  Synthetic DNA
tactacaactcaccttag

SEQ ID NO: 24040 - DNA, 18 bp, Artificial Sequence
  Synthetic DNA
tactacaactccctgtag

SEQ ID NO: 24041 - DNA, 18 bp, Artificial Sequence
  Synthetic DNA
tactacaactctatatag

SEQ ID NO: 24042 - DNA, 18 bp, Artificial Sequence
  Synthetic DNA
tactacaacttaatatag

SEQ ID NO: 24043 - DNA, 18 bp, Artificial Sequence
  Synthetic DNA
tactaccaatcaccatag

SEQ ID NO: 24044 - DNA, 18 bp, Artificial Sequence
  Synthetic DNA
tactacctctcactgtag

SEQ ID NO: 24045 - DNA, 18 bp, Artificial Sequence
  Synthetic DNA
tactacgacccagtttag

SEQ ID NO: 24046 - DNA, 18 bp, Artificial Sequence
  Synthetic DNA
tactacgacgctcaatag

SEQ ID NO: 24047 - DNA, 18 bp, Artificial Sequence
  Synthetic DNA
tactacgattcaaaatag

SEQ ID NO: 24048 - DNA, 18 bp, Artificial Sequence
  Synthetic DNA
tactacgattcactttgg

SEQ ID NO: 24049 - DNA, 18 bp, Artificial Sequence
  Synthetic DNA
tactacggctcaatgtag

SEQ ID NO: 24050 - DNA, 18 bp, Artificial Sequence
  Synthetic DNA
tactacgtcccacaatag

SEQ ID NO: 24051 - DNA, 18 bp, Artificial Sequence
  Synthetic DNA
tactactactcaataaag

SEQ ID NO: 24052 - DNA, 18 bp, Artificial Sequence
  Synthetic DNA
tactactactcaccttag

SEQ ID NO: 24053 - DNA, 18 bp, Artificial Sequence
  Synthetic DNA
tactacttctccctatag

SEQ ID NO: 24054 - DNA, 18 bp, Artificial Sequence
  Synthetic DNA
tactatgactcccaatag

SEQ ID NO: 24055 - DNA, 18 bp, Artificial Sequence
  Synthetic DNA
tactgtgacacactatag

SEQ ID NO: 24056 - DNA, 18 bp, Artificial Sequence
  Synthetic DNA
tagaaagattcactatag

SEQ ID NO: 24057 - DNA, 18 bp, Artificial Sequence
  Synthetic DNA
tagaaatactcactatag

SEQ ID NO: 24058 - DNA, 18 bp, Artificial Sequence
  Synthetic DNA
tagaacaaatcactatag

SEQ ID NO: 24059 - DNA, 18 bp, Artificial Sequence
  Synthetic DNA
tagaacaactcacaatag

SEQ ID NO: 24060 - DNA, 18 bp, Artificial Sequence
  Synthetic DNA
tagtaacacacactatag

SEQ ID NO: 24061 - DNA, 18 bp, Artificial Sequence
  Synthetic DNA
tagtacaaatcaccatag

SEQ ID NO: 24062 - DNA, 18 bp, Artificial Sequence
  Synthetic DNA
tagtacgacgctctttag

SEQ ID NO: 24063 - DNA, 18 bp, Artificial Sequence
  Synthetic DNA
tagtacgactcactgcgg

SEQ ID NO: 24064 - DNA, 18 bp, Artificial Sequence
  Synthetic DNA
tagtacgactcacttagg

SEQ ID NO: 24065 - DNA, 18 bp, Artificial Sequence
  Synthetic DNA
tagtacgactcattctgg

SEQ ID NO: 24066 - DNA, 18 bp, Artificial Sequence
  Synthetic DNA
tagtacgactctatttag

SEQ ID NO: 24067 - DNA, 18 bp, Artificial Sequence
  Synthetic DNA
tagtacgattcacaatgg

SEQ ID NO: 24068 - DNA, 18 bp, Artificial Sequence
  Synthetic DNA
tagtacggctcatcatag

SEQ ID NO: 24069 - DNA, 18 bp, Artificial Sequence
  Synthetic DNA
tagtacgtctaacaatag

SEQ ID NO: 24070 - DNA, 18 bp, Artificial Sequence
  Synthetic DNA
tagtacgttacactatag

SEQ ID NO: 24071 - DNA, 18 bp, Artificial Sequence
  Synthetic DNA
tagtagggctcactatgg

SEQ ID NO: 24072 - DNA, 18 bp, Artificial Sequence
  Synthetic DNA
tagtatgactcactagcg

SEQ ID NO: 24073 - DNA, 18 bp, Artificial Sequence
  Synthetic DNA
tagtatgtctcacaatag

SEQ ID NO: 24074 - DNA, 18 bp, Artificial Sequence
  Synthetic DNA
tagtccgacacacaatag

SEQ ID NO: 24075 - DNA, 18 bp, Artificial Sequence
  Synthetic DNA
tagtcctactctctatag

SEQ ID NO: 24076 - DNA, 18 bp, Artificial Sequence
  Synthetic DNA
tagtgcgacacactaaag

SEQ ID NO: 24077 - DNA, 18 bp, Artificial Sequence
  Synthetic DNA
tataacaactcattatag

SEQ ID NO: 24078 - DNA, 18 bp, Artificial Sequence
  Synthetic DNA
tataacgaatcactatcg

SEQ ID NO: 24079 - DNA, 18 bp, Artificial Sequence
  Synthetic DNA
tataacggctcactatgg

SEQ ID NO: 24080 - DNA, 18 bp, Artificial Sequence
  Synthetic DNA
tataaggactcattatag

SEQ ID NO: 24081 - DNA, 18 bp, Artificial Sequence
  Synthetic DNA
tatcaagactcactatcg

SEQ ID NO: 24082 - DNA, 18 bp, Artificial Sequence
  Synthetic DNA
tatcacaactcaatatag

SEQ ID NO: 24083 - DNA, 18 bp, Artificial Sequence
  Synthetic DNA
tatcacaattcactatag

SEQ ID NO: 24084 - DNA, 18 bp, Artificial Sequence
  Synthetic DNA
tatcacgacctactatag

SEQ ID NO: 24085 - DNA, 18 bp, Artificial Sequence
  Synthetic DNA
tatcacgactcacaaaag

SEQ ID NO: 24086 - DNA, 18 bp, Artificial Sequence
  Synthetic DNA
tatcgcgactcactaaag

SEQ ID NO: 24087 - DNA, 18 bp, Artificial Sequence
  Synthetic DNA
tatcgggactcactatag

SEQ ID NO: 24088 - DNA, 18 bp, Artificial Sequence
  Synthetic DNA
tatgacaagtcactatag

SEQ ID NO: 24089 - DNA, 18 bp, Artificial Sequence
  Synthetic DNA
tattaagacacactctag

SEQ ID NO: 24090 - DNA, 18 bp, Artificial Sequence
  Synthetic DNA
tattaagacctactatag

SEQ ID NO: 24091 - DNA, 18 bp, Artificial Sequence
  Synthetic DNA
tattaagactcaatctag

SEQ ID NO: 24092 - DNA, 18 bp, Artificial Sequence
  Synthetic DNA
tattaagattcattatag

SEQ ID NO: 24093 - DNA, 18 bp, Artificial Sequence
  Synthetic DNA
tattacaactccctatcg

SEQ ID NO: 24094 - DNA, 18 bp, Artificial Sequence
  Synthetic DNA
tattaccactcaatatgg

SEQ ID NO: 24095 - DNA, 18 bp, Artificial Sequence
  Synthetic DNA
tattaccactcaatttag

SEQ ID NO: 24096 - DNA, 18 bp, Artificial Sequence
  Synthetic DNA
tattaccactcacttgag

SEQ ID NO: 24097 - DNA, 18 bp, Artificial Sequence
  Synthetic DNA
tattacctctcactaaag

SEQ ID NO: 24098 - DNA, 18 bp, Artificial Sequence
  Synthetic DNA
tattacgaatccctacag

SEQ ID NO: 24099 - DNA, 18 bp, Artificial Sequence
  Synthetic DNA
tattacgaatctccatag

SEQ ID NO: 24100 - DNA, 18 bp, Artificial Sequence
  Synthetic DNA
tattacgacacaatatgg

SEQ ID NO: 24101 - DNA, 18 bp, Artificial Sequence
  Synthetic DNA
tattacgacacactgaag

SEQ ID NO: 24102 - DNA, 18 bp, Artificial Sequence
  Synthetic DNA
tattacgacaccctatcg

SEQ ID NO: 24103 - DNA, 18 bp, Artificial Sequence
  Synthetic DNA
tattacgacagactttag

SEQ ID NO: 24104 - DNA, 18 bp, Artificial Sequence
  Synthetic DNA
tattacgacgcacactag

SEQ ID NO: 24105 - DNA, 18 bp, Artificial Sequence
  Synthetic DNA
tattacgacgcattaaag

SEQ ID NO: 24106 - DNA, 18 bp, Artificial Sequence
  Synthetic DNA
tattacgactcacctaag

SEQ ID NO: 24107 - DNA, 18 bp, Artificial Sequence
  Synthetic DNA
tattacgactcatttgag

SEQ ID NO: 24108 - DNA, 18 bp, Artificial Sequence
  Synthetic DNA
tattacgactctttatgg

SEQ ID NO: 24109 - DNA, 18 bp, Artificial Sequence
  Synthetic DNA
tattacgacttattatcg

SEQ ID NO: 24110 - DNA, 18 bp, Artificial Sequence
  Synthetic DNA
tattacgactttctatcg

SEQ ID NO: 24111 - DNA, 18 bp, Artificial Sequence
  Synthetic DNA
tattacgagaaactatag

SEQ ID NO: 24112 - DNA, 18 bp, Artificial Sequence
  Synthetic DNA
tattacgattctccatag

SEQ ID NO: 24113 - DNA, 18 bp, Artificial Sequence
  Synthetic DNA
tattacgcctaactaaag

SEQ ID NO: 24114 - DNA, 18 bp, Artificial Sequence
  Synthetic DNA
tattacggataactatag

SEQ ID NO: 24115 - DNA, 18 bp, Artificial Sequence
  Synthetic DNA
tattacggctctgtatag

SEQ ID NO: 24116 - DNA, 18 bp, Artificial Sequence
  Synthetic DNA
tattacgtctcaatacag

SEQ ID NO: 24117 - DNA, 18 bp, Artificial Sequence
  Synthetic DNA
tattacgtctctctatgg

SEQ ID NO: 24118 - DNA, 18 bp, Artificial Sequence
  Synthetic DNA
tattacgtctgtctatag

SEQ ID NO: 24119 - DNA, 18 bp, Artificial Sequence
  Synthetic DNA
tattacgtgtcactagag

SEQ ID NO: 24120 - DNA, 18 bp, Artificial Sequence
  Synthetic DNA
tattacgtgtgactatag

SEQ ID NO: 24121 - DNA, 18 bp, Artificial Sequence
  Synthetic DNA
tattactaataactatag

SEQ ID NO: 24122 - DNA, 18 bp, Artificial Sequence
  Synthetic DNA
tattataactcaccatag

SEQ ID NO: 24123 - DNA, 18 bp, Artificial Sequence
  Synthetic DNA
tattataagtcactatag

SEQ ID NO: 24124 - DNA, 18 bp, Artificial Sequence
  Synthetic DNA
tattatcacccactatag

SEQ ID NO: 24125 - DNA, 18 bp, Artificial Sequence
  Synthetic DNA
tattatgaaccactatag

SEQ ID NO: 24126 - DNA, 18 bp, Artificial Sequence
  Synthetic DNA
tattatgactcaagatag

SEQ ID NO: 24127 - DNA, 18 bp, Artificial Sequence
  Synthetic DNA
tattatgactcactaccg

SEQ ID NO: 24128 - DNA, 18 bp, Artificial Sequence
  Synthetic DNA
tattatttctcactatag

SEQ ID NO: 24129 - DNA, 18 bp, Artificial Sequence
  Synthetic DNA
tattccgtctgactatag

SEQ ID NO: 24130 - DNA, 18 bp, Artificial Sequence
  Synthetic DNA
tattgcgactcaaaatag

SEQ ID NO: 24131 - DNA, 18 bp, Artificial Sequence
  Synthetic DNA
tattgcgacttactaaag

SEQ ID NO: 24132 - DNA, 18 bp, Artificial Sequence
  Synthetic DNA
tattgcgattcaatatag

SEQ ID NO: 24133 - DNA, 18 bp, Artificial Sequence
  Synthetic DNA
tattgtgactcactaaag

SEQ ID NO: 24134 - DNA, 18 bp, Artificial Sequence
  Synthetic DNA
tcaagcgactctctatag

SEQ ID NO: 24135 - DNA, 18 bp, Artificial Sequence
  Synthetic DNA
tcataagacactctatag

SEQ ID NO: 24136 - DNA, 18 bp, Artificial Sequence
  Synthetic DNA
tcataagagtcattatag

SEQ ID NO: 24137 - DNA, 18 bp, Artificial Sequence
  Synthetic DNA
tcataagtcacactatag

SEQ ID NO: 24138 - DNA, 18 bp, Artificial Sequence
  Synthetic DNA
tcatacaatacactatag

SEQ ID NO: 24139 - DNA, 18 bp, Artificial Sequence
  Synthetic DNA
tcatacgaaccactctag

SEQ ID NO: 24140 - DNA, 18 bp, Artificial Sequence
  Synthetic DNA
tcatacgactaataatag

SEQ ID NO: 24141 - DNA, 18 bp, Artificial Sequence
  Synthetic DNA
tcatacgactcacaaagg

SEQ ID NO: 24142 - DNA, 18 bp, Artificial Sequence
  Synthetic DNA
tcatacgactcatcaaag

SEQ ID NO: 24143 - DNA, 18 bp, Artificial Sequence
  Synthetic DNA
tcatactccacactatag

SEQ ID NO: 24144 - DNA, 18 bp, Artificial Sequence
  Synthetic DNA
tcatacttctcactacag

SEQ ID NO: 24145 - DNA, 18 bp, Artificial Sequence
  Synthetic DNA
tcatagaagtcactatag

SEQ ID NO: 24146 - DNA, 18 bp, Artificial Sequence
  Synthetic DNA
tcatatgtctcactacag

SEQ ID NO: 24147 - DNA, 18 bp, Artificial Sequence
  Synthetic DNA
tcatcctactctctatag

SEQ ID NO: 24148 - DNA, 18 bp, Artificial Sequence
  Synthetic DNA
tcatcggactcactatgg

SEQ ID NO: 24149 - DNA, 18 bp, Artificial Sequence
  Synthetic DNA
tcatgcgacacacaatag

SEQ ID NO: 24150 - DNA, 18 bp, Artificial Sequence
  Synthetic DNA
tcgtacgacacactacag

SEQ ID NO: 24151 - DNA, 18 bp, Artificial Sequence
  Synthetic DNA
tcgtacgacttcctatag

SEQ ID NO: 24152 - DNA, 18 bp, Artificial Sequence
  Synthetic DNA
tctaacgacacactatag

SEQ ID NO: 24153 - DNA, 18 bp, Artificial Sequence
  Synthetic DNA
tcttacgaatcaatatag

SEQ ID NO: 24154 - DNA, 18 bp, Artificial Sequence
  Synthetic DNA
tcttacggttcactatag

SEQ ID NO: 24155 - DNA, 18 bp, Artificial Sequence
  Synthetic DNA
tgaaaagacttactatag

SEQ ID NO: 24156 - DNA, 18 bp, Artificial Sequence
  Synthetic DNA
tgaaacgatttactatag

SEQ ID NO: 24157 - DNA, 18 bp, Artificial Sequence
  Synthetic DNA
tgaaacgtctctctatag

SEQ ID NO: 24158 - DNA, 18 bp, Artificial Sequence
  Synthetic DNA
tgaaatgactcaatatag

SEQ ID NO: 24159 - DNA, 18 bp, Artificial Sequence
  Synthetic DNA
tgacacaaatcactatag

SEQ ID NO: 24160 - DNA, 18 bp, Artificial Sequence
  Synthetic DNA
tgagacgtctcaccatag

SEQ ID NO: 24161 - DNA, 18 bp, Artificial Sequence
  Synthetic DNA
tgataagacacactctag

SEQ ID NO: 24162 - DNA, 18 bp, Artificial Sequence
  Synthetic DNA
tgataatactcactaaag

SEQ ID NO: 24163 - DNA, 18 bp, Artificial Sequence
  Synthetic DNA
tgatacaactccccatag

SEQ ID NO: 24164 - DNA, 18 bp, Artificial Sequence
  Synthetic DNA
tgatacatcacactatag

SEQ ID NO: 24165 - DNA, 18 bp, Artificial Sequence
  Synthetic DNA
tgatacgaatcaataaag

SEQ ID NO: 24166 - DNA, 18 bp, Artificial Sequence
  Synthetic DNA
tgatacgaatcagtttag

SEQ ID NO: 24167 - DNA, 18 bp, Artificial Sequence
  Synthetic DNA
tgatacgactaacttcag

SEQ ID NO: 24168 - DNA, 18 bp, Artificial Sequence
  Synthetic DNA
tgatacgactcttaatag

SEQ ID NO: 24169 - DNA, 18 bp, Artificial Sequence
  Synthetic DNA
tgatacgcctatctatag

SEQ ID NO: 24170 - DNA, 18 bp, Artificial Sequence
  Synthetic DNA
tgatacgtctcaagatag

SEQ ID NO: 24171 - DNA, 18 bp, Artificial Sequence
  Synthetic DNA
tgatacgtcttactatcg

SEQ ID NO: 24172 - DNA, 18 bp, Artificial Sequence
  Synthetic DNA
tgatactattcaatatag

SEQ ID NO: 24173 - DNA, 18 bp, Artificial Sequence
  Synthetic DNA
tgataggaatcaatatag

SEQ ID NO: 24174 - DNA, 18 bp, Artificial Sequence
  Synthetic DNA
tgatatcaatcactatag

SEQ ID NO: 24175 - DNA, 18 bp, Artificial Sequence
  Synthetic DNA
tgatatgacttactaaag

SEQ ID NO: 24176 - DNA, 18 bp, Artificial Sequence
  Synthetic DNA
tgatccgacccactatgg

SEQ ID NO: 24177 - DNA, 18 bp, Artificial Sequence
  Synthetic DNA
tgatccgactcattatcg

SEQ ID NO: 24178 - DNA, 18 bp, Artificial Sequence
  Synthetic DNA
tgatccgtctcaatatag

SEQ ID NO: 24179 - DNA, 18 bp, Artificial Sequence
  Synthetic DNA
tgatccgtctcactagag

SEQ ID NO: 24180 - DNA, 18 bp, Artificial Sequence
  Synthetic DNA
tgatgcatctcactatag

SEQ ID NO: 24181 - DNA, 18 bp, Artificial Sequence
  Synthetic DNA
tgatgcgcctcacaatag

SEQ ID NO: 24182 - DNA, 18 bp, Artificial Sequence
  Synthetic DNA
tgatgcgtttcactatag

SEQ ID NO: 24183 - DNA, 18 bp, Artificial Sequence
  Synthetic DNA
tgctaagactctctatag

SEQ ID NO: 24184 - DNA, 18 bp, Artificial Sequence
  Synthetic DNA
tgctattactcactatag

SEQ ID NO: 24185 - DNA, 18 bp, Artificial Sequence
  Synthetic DNA
tggtaagactcaccatag

SEQ ID NO: 24186 - DNA, 18 bp, Artificial Sequence
  Synthetic DNA
tggtacgactcaatgtag

SEQ ID NO: 24187 - DNA, 18 bp, Artificial Sequence
  Synthetic DNA
tggtacgactcagtaaag

SEQ ID NO: 24188 - DNA, 18 bp, Artificial Sequence
  Synthetic DNA
tggtacgccacactatag

SEQ ID NO: 24189 - DNA, 18 bp, Artificial Sequence
  Synthetic DNA
tgtaacgattcactatag

SEQ ID NO: 24190 - DNA, 18 bp, Artificial Sequence
  Synthetic DNA
tgttacaactcactacag

SEQ ID NO: 24191 - DNA, 18 bp, Artificial Sequence
  Synthetic DNA
tgttacggctcattatag

SEQ ID NO: 24192 - DNA, 18 bp, Artificial Sequence
  Synthetic DNA
tgttactactcactacag

SEQ ID NO: 24193 - DNA, 18 bp, Artificial Sequence
  Synthetic DNA
tgttatgactctctatag

SEQ ID NO: 24194 - DNA, 18 bp, Artificial Sequence
  Synthetic DNA
tgttgtgactcactatag

SEQ ID NO: 24195 - DNA, 18 bp, Artificial Sequence
  Synthetic DNA
ttaaacgacgcactttag

SEQ ID NO: 24196 - DNA, 18 bp, Artificial Sequence
  Synthetic DNA
ttaaatgactcactacag

SEQ ID NO: 24197 - DNA, 18 bp, Artificial Sequence
  Synthetic DNA
ttaaatgactgactatag

SEQ ID NO: 24198 - DNA, 18 bp, Artificial Sequence
  Synthetic DNA
ttaaccgactcactaaag

SEQ ID NO: 24199 - DNA, 18 bp, Artificial Sequence
  Synthetic DNA
ttaagcgaatcactatag

SEQ ID NO: 24200 - DNA, 18 bp, Artificial Sequence
  Synthetic DNA
ttacacgactcacaacag

SEQ ID NO: 24201 - DNA, 18 bp, Artificial Sequence
  Synthetic DNA
ttataagatccactatag

SEQ ID NO: 24202 - DNA, 18 bp, Artificial Sequence
  Synthetic DNA
ttatacaactaagtatag

SEQ ID NO: 24203 - DNA, 18 bp, Artificial Sequence
  Synthetic DNA
ttatacaactcactttcg

SEQ ID NO: 24204 - DNA, 18 bp, Artificial Sequence
  Synthetic DNA
ttatacaactctctctag

SEQ ID NO: 24205 - DNA, 18 bp, Artificial Sequence
  Synthetic DNA
ttataccactcactttgg

SEQ ID NO: 24206 - DNA, 18 bp, Artificial Sequence
  Synthetic DNA
ttataccactccctatcg

SEQ ID NO: 24207 - DNA, 18 bp, Artificial Sequence
  Synthetic DNA
ttatacgacacattgtag

SEQ ID NO: 24208 - DNA, 18 bp, Artificial Sequence
  Synthetic DNA
ttatacgacccactaccg

SEQ ID NO: 24209 - DNA, 18 bp, Artificial Sequence
  Synthetic DNA
ttatacgactacctctag

SEQ ID NO: 24210 - DNA, 18 bp, Artificial Sequence
  Synthetic DNA
ttatacgactcataagag

SEQ ID NO: 24211 - DNA, 18 bp, Artificial Sequence
  Synthetic DNA
ttatacgactcatactag

SEQ ID NO: 24212 - DNA, 18 bp, Artificial Sequence
  Synthetic DNA
ttatacgactgtctagag

SEQ ID NO: 24213 - DNA, 18 bp, Artificial Sequence
  Synthetic DNA
ttatacgattcaatagag

SEQ ID NO: 24214 - DNA, 18 bp, Artificial Sequence
  Synthetic DNA
ttatacgccacacaatag

SEQ ID NO: 24215 - DNA, 18 bp, Artificial Sequence
  Synthetic DNA
ttatacgccacactaaag

SEQ ID NO: 24216 - DNA, 18 bp, Artificial Sequence
  Synthetic DNA
ttatacgccccaatatag

SEQ ID NO: 24217 - DNA, 18 bp, Artificial Sequence
  Synthetic DNA
ttatacgcctcaatatcg

SEQ ID NO: 24218 - DNA, 18 bp, Artificial Sequence
  Synthetic DNA
ttatacggctctctgtag

SEQ ID NO: 24219 - DNA, 18 bp, Artificial Sequence
  Synthetic DNA
ttatacgtctcagtgtag

SEQ ID NO: 24220 - DNA, 18 bp, Artificial Sequence
  Synthetic DNA
ttatagtactcacaatag

SEQ ID NO: 24221 - DNA, 18 bp, Artificial Sequence
  Synthetic DNA
ttatatgactcaacatag

SEQ ID NO: 24222 - DNA, 18 bp, Artificial Sequence
  Synthetic DNA
ttatatgccccactatag

SEQ ID NO: 24223 - DNA, 18 bp, Artificial Sequence
  Synthetic DNA
ttatatgcctcactatgg

SEQ ID NO: 24224 - DNA, 18 bp, Artificial Sequence
  Synthetic DNA
ttatccgacacagtatag

SEQ ID NO: 24225 - DNA, 18 bp, Artificial Sequence
  Synthetic DNA
ttatccgactcattatcg

SEQ ID NO: 24226 - DNA, 18 bp, Artificial Sequence
  Synthetic DNA
ttatcctactcactatcg

SEQ ID NO: 24227 - DNA, 18 bp, Artificial Sequence
  Synthetic DNA
ttatgagaatcactatag

SEQ ID NO: 24228 - DNA, 18 bp, Artificial Sequence
  Synthetic DNA
ttatgcgaatctctatag

SEQ ID NO: 24229 - DNA, 18 bp, Artificial Sequence
  Synthetic DNA
ttatgcgactcaatttag

SEQ ID NO: 24230 - DNA, 18 bp, Artificial Sequence
  Synthetic DNA
ttatgcgactctctttag

SEQ ID NO: 24231 - DNA, 18 bp, Artificial Sequence
  Synthetic DNA
ttatgcgtcccactatag

SEQ ID NO: 24232 - DNA, 18 bp, Artificial Sequence
  Synthetic DNA
ttatgctactcactttag

SEQ ID NO: 24233 - DNA, 18 bp, Artificial Sequence
  Synthetic DNA
ttctacgactcattatgg

SEQ ID NO: 24234 - DNA, 18 bp, Artificial Sequence
  Synthetic DNA
ttctacttctcactatag

SEQ ID NO: 24235 - DNA, 18 bp, Artificial Sequence
  Synthetic DNA
ttgtaagactctctatag

SEQ ID NO: 24236 - DNA, 18 bp, Artificial Sequence
  Synthetic DNA
ttgtacgactccctacag

SEQ ID NO: 24237 - DNA, 18 bp, Artificial Sequence
  Synthetic DNA
tttaacgactcacgatag

SEQ ID NO: 24238 - DNA, 18 bp, Artificial Sequence
  Synthetic DNA
ttttacgactcactaagg

SEQ ID NO: 24239 - DNA, 18 bp, Artificial Sequence
  Synthetic DNA
ttttacgattaactatag

SEQ ID NO: 24240 - DNA, 18 bp, Artificial Sequence
  Synthetic DNA
ttttacgcctcagtatag

SEQ ID NO: 24241 - DNA, 18 bp, Artificial Sequence
  Synthetic DNA
ttttacggctcactaaag

SEQ ID NO: 24242 - DNA, 18 bp, Artificial Sequence
  Synthetic DNA
ttttaggactcattatag

SEQ ID NO: 24243 - DNA, 18 bp, Artificial Sequence
  Synthetic DNA
atattcgactcactttag

SEQ ID NO: 24244 - DNA, 18 bp, Artificial Sequence
  Synthetic DNA
taatataactcactaatg

SEQ ID NO: 24245 - DNA, 18 bp, Artificial Sequence
  Synthetic DNA
tattacgactcattaatg

SEQ ID NO: 24246 - DNA, 18 bp, Artificial Sequence
  Synthetic DNA
ttatacatctcactaaag

SEQ ID NO: 24247 - DNA, 18 bp, Artificial Sequence
  Synthetic DNA
tgtttcgtctcactatag

SEQ ID NO: 24248 - DNA, 18 bp, Artificial Sequence
  Synthetic DNA
ttaaacaactcactattg

SEQ ID NO: 24249 - DNA, 18 bp, Artificial Sequence
  Synthetic DNA
ttattagactcaatatag

SEQ ID NO: 24250 - DNA, 18 bp, Artificial Sequence
  Synthetic DNA
taattagactaactattg

SEQ ID NO: 24251 - DNA, 18 bp, Artificial Sequence
  Synthetic DNA
aattacgacttactattg

SEQ ID NO: 24252 - DNA, 18 bp, Artificial Sequence
  Synthetic DNA
caatacgacactctattg

SEQ ID NO: 24253 - DNA, 18 bp, Artificial Sequence
  Synthetic DNA
caattctactcacaatag

SEQ ID NO: 24254 - DNA, 18 bp, Artificial Sequence
  Synthetic DNA
tattgcaactcactattg

SEQ ID NO: 24255 - DNA, 18 bp, Artificial Sequence
  Synthetic DNA
ttattagtctcactatag

SEQ ID NO: 24256 - DNA, 18 bp, Artificial Sequence
  Synthetic DNA
taatacgacacaaaaaag

SEQ ID NO: 24257 - DNA, 18 bp, Artificial Sequence
  Synthetic DNA
taatgaaactcattatag

SEQ ID NO: 24258 - DNA, 18 bp, Artificial Sequence
  Synthetic DNA
tataacgacacattatag

SEQ ID NO: 24259 - DNA, 18 bp, Artificial Sequence
  Synthetic DNA
tatgacgactcacattag

SEQ ID NO: 24260 - DNA, 18 bp, Artificial Sequence
  Synthetic DNA
tattacgcctcactaagg

SEQ ID NO: 24261 - DNA, 18 bp, Artificial Sequence
  Synthetic DNA
tattatgaatctctatag

SEQ ID NO: 24262 - DNA, 18 bp, Artificial Sequence
  Synthetic DNA
ttaaacgtctcaccatag

SEQ ID NO: 24263 - DNA, 18 bp, Artificial Sequence
  Synthetic DNA
ttatacaactcaatttag

SEQ ID NO: 24264 - DNA, 18 bp, Artificial Sequence
  Synthetic DNA
ttatacaactcacactag

SEQ ID NO: 24265 - DNA, 18 bp, Artificial Sequence
  Synthetic DNA
ttatacgactcactcacg

SEQ ID NO: 24266 - DNA, 18 bp, Artificial Sequence
  Synthetic DNA
ttatacgataaactatag

SEQ ID NO: 24267 - DNA, 18 bp, Artificial Sequence
  Synthetic DNA
ttaaacgtcacactatag

SEQ ID NO: 24268 - DNA, 18 bp, Artificial Sequence
  Synthetic DNA
aaattcgactctctattg

SEQ ID NO: 24269 - DNA, 18 bp, Artificial Sequence
  Synthetic DNA
taatacatctcgctattg

SEQ ID NO: 24270 - DNA, 18 bp, Artificial Sequence
  Synthetic DNA
taatacgactcgtaattg

SEQ ID NO: 24271 - DNA, 18 bp, Artificial Sequence
  Synthetic DNA
tcattcgactccctattg

SEQ ID NO: 24272 - DNA, 18 bp, Artificial Sequence
  Synthetic DNA
tgattcgtctcactattg

SEQ ID NO: 24273 - DNA, 18 bp, Artificial Sequence
  Synthetic DNA
aaatacgacacacaattg

SEQ ID NO: 24274 - DNA, 18 bp, Artificial Sequence
  Synthetic DNA
aaattcgtctcactctag

SEQ ID NO: 24275 - DNA, 18 bp, Artificial Sequence
  Synthetic DNA
acattcgactaactatag

SEQ ID NO: 24276 - DNA, 18 bp, Artificial Sequence
  Synthetic DNA
caatacgtctcacttttg

SEQ ID NO: 24277 - DNA, 18 bp, Artificial Sequence
  Synthetic DNA
caattctactctctatag

SEQ ID NO: 24278 - DNA, 18 bp, Artificial Sequence
  Synthetic DNA
taaaacgaatcactcttg

SEQ ID NO: 24279 - DNA, 18 bp, Artificial Sequence
  Synthetic DNA
taaagcaactcactattg

SEQ ID NO: 24280 - DNA, 18 bp, Artificial Sequence
  Synthetic DNA
taaatcgacacactatcg

SEQ ID NO: 24281 - DNA, 18 bp, Artificial Sequence
  Synthetic DNA
taataagacacactcttg

SEQ ID NO: 24282 - DNA, 18 bp, Artificial Sequence
  Synthetic DNA
taataagactcagttttg

SEQ ID NO: 24283 - DNA, 18 bp, Artificial Sequence
  Synthetic DNA
taatacgactatatattg

SEQ ID NO: 24284 - DNA, 18 bp, Artificial Sequence
  Synthetic DNA
taatacgacttactgatg

SEQ ID NO: 24285 - DNA, 18 bp, Artificial Sequence
  Synthetic DNA
taatattactcactactg

SEQ ID NO: 24286 - DNA, 18 bp, Artificial Sequence
  Synthetic DNA
taattagtctcactttag

SEQ ID NO: 24287 - DNA, 18 bp, Artificial Sequence
  Synthetic DNA
taattatattcactatag

SEQ ID NO: 24288 - DNA, 18 bp, Artificial Sequence
  Synthetic DNA
taattcgacttacttaag

SEQ ID NO: 24289 - DNA, 18 bp, Artificial Sequence
  Synthetic DNA
taattcgtcacactctag

SEQ ID NO: 24290 - DNA, 18 bp, Artificial Sequence
  Synthetic DNA
taattctactcataatag

SEQ ID NO: 24291 - DNA, 18 bp, Artificial Sequence
  Synthetic DNA
taattggacacactttag

SEQ ID NO: 24292 - DNA, 18 bp, Artificial Sequence
  Synthetic DNA
taatttgtgtcactatag

SEQ ID NO: 24293 - DNA, 18 bp, Artificial Sequence
  Synthetic DNA
tacttcgactcacaacag

SEQ ID NO: 24294 - DNA, 18 bp, Artificial Sequence
  Synthetic DNA
tagtacacctcactattg

SEQ ID NO: 24295 - DNA, 18 bp, Artificial Sequence
  Synthetic DNA
tagtacgactctcaattg

SEQ ID NO: 24296 - DNA, 18 bp, Artificial Sequence
  Synthetic DNA
tagtacgtttcactattg

SEQ ID NO: 24297 - DNA, 18 bp, Artificial Sequence
  Synthetic DNA
tataccgactcgctatag

SEQ ID NO: 24298 - DNA, 18 bp, Artificial Sequence
  Synthetic DNA
tattaagactcacttttg

SEQ ID NO: 24299 - DNA, 18 bp, Artificial Sequence
  Synthetic DNA
tatttcgacccactttag

SEQ ID NO: 24300 - DNA, 18 bp, Artificial Sequence
  Synthetic DNA
tatttcgactcacgttag

SEQ ID NO: 24301 - DNA, 18 bp, Artificial Sequence
  Synthetic DNA
tcttacgactcactaatg

SEQ ID NO: 24302 - DNA, 18 bp, Artificial Sequence
  Synthetic DNA
tgactcgtctcactatag

SEQ ID NO: 24303 - DNA, 18 bp, Artificial Sequence
  Synthetic DNA
ttatacaattcgctatag

SEQ ID NO: 24304 - DNA, 18 bp, Artificial Sequence
  Synthetic DNA
ttattagcctcactatag

SEQ ID NO: 24305 - DNA, 18 bp, Artificial Sequence
  Synthetic DNA
ttttacgactcgctaaag

SEQ ID NO: 24306 - DNA, 18 bp, Artificial Sequence
  Synthetic DNA
aaataccactcactttcg

SEQ ID NO: 24307 - DNA, 18 bp, Artificial Sequence
  Synthetic DNA
aaatactattcacaatag

SEQ ID NO: 24308 - DNA, 18 bp, Artificial Sequence
  Synthetic DNA
aaatagcactcactttag

SEQ ID NO: 24309 - DNA, 18 bp, Artificial Sequence
  Synthetic DNA
aaatatgactatctatag

SEQ ID NO: 24310 - DNA, 18 bp, Artificial Sequence
  Synthetic DNA
agataccagtcactatag

SEQ ID NO: 24311 - DNA, 18 bp, Artificial Sequence
  Synthetic DNA
atatacgactctctgtag

SEQ ID NO: 24312 - DNA, 18 bp, Artificial Sequence
  Synthetic DNA
caatacgtctcacttaag

SEQ ID NO: 24313 - DNA, 18 bp, Artificial Sequence
  Synthetic DNA
ccatataactcactatag

SEQ ID NO: 24314 - DNA, 18 bp, Artificial Sequence
  Synthetic DNA
taaaacatctcagtatag

SEQ ID NO: 24315 - DNA, 18 bp, Artificial Sequence
  Synthetic DNA
taaaatgacttactttag

SEQ ID NO: 24316 - DNA, 18 bp, Artificial Sequence
  Synthetic DNA
taacacaaatcactttag

SEQ ID NO: 24317 - DNA, 18 bp, Artificial Sequence
  Synthetic DNA
taacactaatcactttag

SEQ ID NO: 24318 - DNA, 18 bp, Artificial Sequence
  Synthetic DNA
taaccagacacactatag

SEQ ID NO: 24319 - DNA, 18 bp, Artificial Sequence
  Synthetic DNA
taataagattcacttaag

SEQ ID NO: 24320 - DNA, 18 bp, Artificial Sequence
  Synthetic DNA
taataatacttactctag

SEQ ID NO: 24321 - DNA, 18 bp, Artificial Sequence
  Synthetic DNA
taatacatctcattaaag

SEQ ID NO: 24322 - DNA, 18 bp, Artificial Sequence
  Synthetic DNA
taataccactcacatcag

SEQ ID NO: 24323 - DNA, 18 bp, Artificial Sequence
  Synthetic DNA
taatacgaatcagattag

SEQ ID NO: 24324 - DNA, 18 bp, Artificial Sequence
  Synthetic DNA
taatacgacacattgtgg

SEQ ID NO: 24325 - DNA, 18 bp, Artificial Sequence
  Synthetic DNA
taatacgattgacttaag

SEQ ID NO: 24326 - DNA, 18 bp, Artificial Sequence
  Synthetic DNA
taatactactcaacaaag

SEQ ID NO: 24327 - DNA, 18 bp, Artificial Sequence
  Synthetic DNA
taatacttctcacaatcg

SEQ ID NO: 24328 - DNA, 18 bp, Artificial Sequence
  Synthetic DNA
taataggaatctctctag

SEQ ID NO: 24329 - DNA, 18 bp, Artificial Sequence
  Synthetic DNA
taataggacagactatgg

SEQ ID NO: 24330 - DNA, 18 bp, Artificial Sequence
  Synthetic DNA
taatatcacttaatatag

SEQ ID NO: 24331 - DNA, 18 bp, Artificial Sequence
  Synthetic DNA
taatatgtctcactttcg

SEQ ID NO: 24332 - DNA, 18 bp, Artificial Sequence
  Synthetic DNA
taatcaaactcactacag

SEQ ID NO: 24333 - DNA, 18 bp, Artificial Sequence
  Synthetic DNA
tactacaactctcaatag

SEQ ID NO: 24334 - DNA, 18 bp, Artificial Sequence
  Synthetic DNA
tactacgattcaccaaag

SEQ ID NO: 24335 - DNA, 18 bp, Artificial Sequence
  Synthetic DNA
tactacgattcagtaaag

SEQ ID NO: 24336 - DNA, 18 bp, Artificial Sequence
  Synthetic DNA
tatcaagtctcactatag

SEQ ID NO: 24337 - DNA, 18 bp, Artificial Sequence
  Synthetic DNA
tatcaccactcactatgg

SEQ ID NO: 24338 - DNA, 18 bp, Artificial Sequence
  Synthetic DNA
tatcacgactcaatatcg

SEQ ID NO: 24339 - DNA, 18 bp, Artificial Sequence
  Synthetic DNA
tattacgatccactttag

SEQ ID NO: 24340 - DNA, 18 bp, Artificial Sequence
  Synthetic DNA
tattacgcctctctatgg

SEQ ID NO: 24341 - DNA, 18 bp, Artificial Sequence
  Synthetic DNA
tattacggctgactttag

SEQ ID NO: 24342 - DNA, 18 bp, Artificial Sequence
  Synthetic DNA
tattacgtctcactcaag

SEQ ID NO: 24343 - DNA, 18 bp, Artificial Sequence
  Synthetic DNA
tattacgtctctctgtag

SEQ ID NO: 24344 - DNA, 18 bp, Artificial Sequence
  Synthetic DNA
tattacgtttcattatag

SEQ ID NO: 24345 - DNA, 18 bp, Artificial Sequence
  Synthetic DNA
tattactactcaataaag

SEQ ID NO: 24346 - DNA, 18 bp, Artificial Sequence
  Synthetic DNA
tattatgactcattacag

SEQ ID NO: 24347 - DNA, 18 bp, Artificial Sequence
  Synthetic DNA
tattccgattcactttag

SEQ ID NO: 24348 - DNA, 18 bp, Artificial Sequence
  Synthetic DNA
tcaaacgtctcactacag

SEQ ID NO: 24349 - DNA, 18 bp, Artificial Sequence
  Synthetic DNA
tcatacgactaacattag

SEQ ID NO: 24350 - DNA, 18 bp, Artificial Sequence
  Synthetic DNA
tcatacgatttattatag

SEQ ID NO: 24351 - DNA, 18 bp, Artificial Sequence
  Synthetic DNA
tcatactacacaatatag

SEQ ID NO: 24352 - DNA, 18 bp, Artificial Sequence
  Synthetic DNA
tgttactactctctatag

SEQ ID NO: 24353 - DNA, 18 bp, Artificial Sequence
  Synthetic DNA
ttatacaactcaacatag

SEQ ID NO: 24354 - DNA, 18 bp, Artificial Sequence
  Synthetic DNA
ttatacgactaagtacag

SEQ ID NO: 24355 - DNA, 18 bp, Artificial Sequence
  Synthetic DNA
ttatacgactcagtgcag

SEQ ID NO: 24356 - DNA, 18 bp, Artificial Sequence
  Synthetic DNA
ttatacgagttactaaag

SEQ ID NO: 24357 - DNA, 18 bp, Artificial Sequence
  Synthetic DNA
ttatgcgactaactaaag

SEQ ID NO: 24358 - DNA, 18 bp, Artificial Sequence
  Synthetic DNA
ttctaggtctcactatag

SEQ ID NO: 24359 - DNA, 18 bp, Artificial Sequence
  Synthetic DNA
ttgtacgatccactatag

SEQ ID NO: 24360 - DNA, 18 bp, Artificial Sequence
  Synthetic DNA
ttttacgacccactttag

SEQ ID NO: 24361 - DNA, 18 bp, Artificial Sequence
  Synthetic DNA
ttttatgacccactatag

SEQ ID NO: 24362 - DNA, 18 bp, Artificial Sequence
  Synthetic DNA
taatacgtctcacttatg

SEQ ID NO: 24363 - DNA, 18 bp, Artificial Sequence
  Synthetic DNA
taatatgcctcactaatg

SEQ ID NO: 24364 - DNA, 18 bp, Artificial Sequence
  Synthetic DNA
atacacgactcactattg

SEQ ID NO: 24365 - DNA, 18 bp, Artificial Sequence
  Synthetic DNA
taataagtctcaccattg

SEQ ID NO: 24366 - DNA, 18 bp, Artificial Sequence
  Synthetic DNA
taatacatatcactattg

SEQ ID NO: 24367 - DNA, 18 bp, Artificial Sequence
  Synthetic DNA
taatttgacactctatag

SEQ ID NO: 24368 - DNA, 18 bp, Artificial Sequence
  Synthetic DNA
tactacgtctctctattg

SEQ ID NO: 24369 - DNA, 18 bp, Artificial Sequence
  Synthetic DNA
tagttcgactcacaaaag

SEQ ID NO: 24370 - DNA, 18 bp, Artificial Sequence
  Synthetic DNA
tgcttcgactctctatag

SEQ ID NO: 24371 - DNA, 18 bp, Artificial Sequence
  Synthetic DNA
ttaatcgacacactatag

SEQ ID NO: 24372 - DNA, 18 bp, Artificial Sequence
  Synthetic DNA
ttttatgactcactattg

SEQ ID NO: 24373 - DNA, 18 bp, Artificial Sequence
  Synthetic DNA
ctatattactcactatag

SEQ ID NO: 24374 - DNA, 18 bp, Artificial Sequence
  Synthetic DNA
taaaacgaatttctatag

SEQ ID NO: 24375 - DNA, 18 bp, Artificial Sequence
  Synthetic DNA
taatacgtctaaccaaag

SEQ ID NO: 24376 - DNA, 18 bp, Artificial Sequence
  Synthetic DNA
tattaagactcactgaag

SEQ ID NO: 24377 - DNA, 18 bp, Artificial Sequence
  Synthetic DNA
ttataagtctcactaaag

SEQ ID NO: 24378 - DNA, 18 bp, Artificial Sequence
  Synthetic DNA
ttatacgtctctctacag

SEQ ID NO: 24379 - DNA, 18 bp, Artificial Sequence
  Synthetic DNA
ttatatgactcactaacg

SEQ ID NO: 24380 - DNA, 18 bp, Artificial Sequence
  Synthetic DNA
ttatatgactcacttaag

SEQ ID NO: 24381 - DNA, 18 bp, Artificial Sequence
  Synthetic DNA
ttttacgcctcactttag

SEQ ID NO: 24382 - DNA, 18 bp, Artificial Sequence
  Synthetic DNA
aaattcgactctctaaag

SEQ ID NO: 24383 - DNA, 18 bp, Artificial Sequence
  Synthetic DNA
atattcgactcactacag

SEQ ID NO: 24384 - DNA, 18 bp, Artificial Sequence
  Synthetic DNA
tcttacgactctctttag

SEQ ID NO: 24385 - DNA, 18 bp, Artificial Sequence
  Synthetic DNA
taattcgtcacacaatag

SEQ ID NO: 24386 - DNA, 18 bp, Artificial Sequence
  Synthetic DNA
taattcaactaactattg

SEQ ID NO: 24387 - DNA, 18 bp, Artificial Sequence
  Synthetic DNA
taattcaactcgctttag

SEQ ID NO: 24388 - DNA, 18 bp, Artificial Sequence
  Synthetic DNA
taattcaacttactattg

SEQ ID NO: 24389 - DNA, 18 bp, Artificial Sequence
  Synthetic DNA
taattcgactcagaattg

SEQ ID NO: 24390 - DNA, 18 bp, Artificial Sequence
  Synthetic DNA
ttatatgactcgctattg

SEQ ID NO: 24391 - DNA, 18 bp, Artificial Sequence
  Synthetic DNA
ctattcgtctcactatag

SEQ ID NO: 24392 - DNA, 18 bp, Artificial Sequence
  Synthetic DNA
taaatcgactcattaaag

SEQ ID NO: 24393 - DNA, 18 bp, Artificial Sequence
  Synthetic DNA
taatacgaaacacttttg

SEQ ID NO: 24394 - DNA, 18 bp, Artificial Sequence
  Synthetic DNA
taatacgtctaactaatg

SEQ ID NO: 24395 - DNA, 18 bp, Artificial Sequence
  Synthetic DNA
taattctacacaatatag

SEQ ID NO: 24396 - DNA, 18 bp, Artificial Sequence
  Synthetic DNA
taatttgacgcactacag

SEQ ID NO: 24397 - DNA, 18 bp, Artificial Sequence
  Synthetic DNA
tactacgtctcactaatg

SEQ ID NO: 24398 - DNA, 18 bp, Artificial Sequence
  Synthetic DNA
tatttcaactcactacag

SEQ ID NO: 24399 - DNA, 18 bp, Artificial Sequence
  Synthetic DNA
tatttctactcaccatag

SEQ ID NO: 24400 - DNA, 18 bp, Artificial Sequence
  Synthetic DNA
taaaactacccacaatag

SEQ ID NO: 24401 - DNA, 18 bp, Artificial Sequence
  Synthetic DNA
taatacgtctaaatttag

SEQ ID NO: 24402 - DNA, 18 bp, Artificial Sequence
  Synthetic DNA
taatacgtctctgtaaag

SEQ ID NO: 24403 - DNA, 18 bp, Artificial Sequence
  Synthetic DNA
tcatactacactctatag

SEQ ID NO: 24404 - DNA, 18 bp, Artificial Sequence
  Synthetic DNA
ttataagtctcactctag

SEQ ID NO: 24405 - DNA, 18 bp, Artificial Sequence
  Synthetic DNA
atattcgactcgctatag

SEQ ID NO: 24406 - DNA, 18 bp, Artificial Sequence
  Synthetic DNA
caaatcgactcactattg

SEQ ID NO: 24407 - DNA, 18 bp, Artificial Sequence
  Synthetic DNA
taataccactcgcttttg

SEQ ID NO: 24408 - DNA, 18 bp, Artificial Sequence
  Synthetic DNA
taatacgactcgttactg

SEQ ID NO: 24409 - DNA, 18 bp, Artificial Sequence
  Synthetic DNA
taattccactcgctaaag

SEQ ID NO: 24410 - DNA, 18 bp, Artificial Sequence
  Synthetic DNA
taattcgactggctctag

SEQ ID NO: 24411 - DNA, 18 bp, Artificial Sequence
  Synthetic DNA
taattcgcctctctattg

SEQ ID NO: 24412 - DNA, 18 bp, Artificial Sequence
  Synthetic DNA
taattcggctctctattg

SEQ ID NO: 24413 - DNA, 18 bp, Artificial Sequence
  Synthetic DNA
taattcgtctcgctttag

SEQ ID NO: 24414 - DNA, 18 bp, Artificial Sequence
  Synthetic DNA
taatttgactcaatattg

SEQ ID NO: 24415 - DNA, 18 bp, Artificial Sequence
  Synthetic DNA
tacttcgactcactactg

SEQ ID NO: 24416 - DNA, 18 bp, Artificial Sequence
  Synthetic DNA
tcatacgtctcgctattg

SEQ ID NO: 24417 - DNA, 18 bp, Artificial Sequence
  Synthetic DNA
tgatacgtctcgctattg

SEQ ID NO: 24418 - DNA, 18 bp, Artificial Sequence
  Synthetic DNA
aaaatcgactcactacag

SEQ ID NO: 24419 - DNA, 18 bp, Artificial Sequence
  Synthetic DNA
aaatacaacttactattg

SEQ ID NO: 24420 - DNA, 18 bp, Artificial Sequence
  Synthetic DNA
aaatacgacacaccattg

SEQ ID NO: 24421 - DNA, 18 bp, Artificial Sequence
  Synthetic DNA
aaatacgactaactactg

SEQ ID NO: 24422 - DNA, 18 bp, Artificial Sequence
  Synthetic DNA
aaatacgactcaccgttg

SEQ ID NO: 24423 - DNA, 18 bp, Artificial Sequence
  Synthetic DNA
aaatacgactcccaattg

SEQ ID NO: 24424 - DNA, 18 bp, Artificial Sequence
  Synthetic DNA
aaatacgtcacgctatag

SEQ ID NO: 24425 - DNA, 18 bp, Artificial Sequence
  Synthetic DNA
aaatacgtcttgctatag

SEQ ID NO: 24426 - DNA, 18 bp, Artificial Sequence
  Synthetic DNA
aaatgagactcactattg

SEQ ID NO: 24427 - DNA, 18 bp, Artificial Sequence
  Synthetic DNA
aaattcggctcactacag

SEQ ID NO: 24428 - DNA, 18 bp, Artificial Sequence
  Synthetic DNA
aaattcgtcgcactatag

SEQ ID NO: 24429 - DNA, 18 bp, Artificial Sequence
  Synthetic DNA
aaattggactctctatag

SEQ ID NO: 24430 - DNA, 18 bp, Artificial Sequence
  Synthetic DNA
aaattttactcactatag

SEQ ID NO: 24431 - DNA, 18 bp, Artificial Sequence
  Synthetic DNA
aactaagactcgctatag

SEQ ID NO: 24432 - DNA, 18 bp, Artificial Sequence
  Synthetic DNA
aactacgactcgatatag

SEQ ID NO: 24433 - DNA, 18 bp, Artificial Sequence
  Synthetic DNA
aacttcgaatcactatag

SEQ ID NO: 24434 - DNA, 18 bp, Artificial Sequence
  Synthetic DNA
acattcgtctcactatag

SEQ ID NO: 24435 - DNA, 18 bp, Artificial Sequence
  Synthetic DNA
caacacgactaactattg

SEQ ID NO: 24436 - DNA, 18 bp, Artificial Sequence
  Synthetic DNA
caataccactctctattg

SEQ ID NO: 24437 - DNA, 18 bp, Artificial Sequence
  Synthetic DNA
caatacgccacactattg

SEQ ID NO: 24438 - DNA, 18 bp, Artificial Sequence
  Synthetic DNA
caatacggctcacaattg

SEQ ID NO: 24439 - DNA, 18 bp, Artificial Sequence
  Synthetic DNA
caatccgactcacaattg

SEQ ID NO: 24440 - DNA, 18 bp, Artificial Sequence
  Synthetic DNA
caatgagactcactattg

SEQ ID NO: 24441 - DNA, 18 bp, Artificial Sequence
  Synthetic DNA
caattggattcactatag

SEQ ID NO: 24442 - DNA, 18 bp, Artificial Sequence
  Synthetic DNA
cagtacgactcacttttg

SEQ ID NO: 24443 - DNA, 18 bp, Artificial Sequence
  Synthetic DNA
catttcgaatcactatag

SEQ ID NO: 24444 - DNA, 18 bp, Artificial Sequence
  Synthetic DNA
catttcgactaactatag

SEQ ID NO: 24445 - DNA, 18 bp, Artificial Sequence
  Synthetic DNA
catttctactcactatag

SEQ ID NO: 24446 - DNA, 18 bp, Artificial Sequence
  Synthetic DNA
cgatacgacacactattg

SEQ ID NO: 24447 - DNA, 18 bp, Artificial Sequence
  Synthetic DNA
gagtaagactcactattg

SEQ ID NO: 24448 - DNA, 18 bp, Artificial Sequence
  Synthetic DNA
taaaaagactcactaatg

SEQ ID NO: 24449 - DNA, 18 bp, Artificial Sequence
  Synthetic DNA
taaaacaactcacttttg

SEQ ID NO: 24450 - DNA, 18 bp, Artificial Sequence
  Synthetic DNA
taaaacgacgaactattg

SEQ ID NO: 24451 - DNA, 18 bp, Artificial Sequence
  Synthetic DNA
taaaacgccttgctatag

SEQ ID NO: 24452 - DNA, 18 bp, Artificial Sequence
  Synthetic DNA
taaagcgattcactattg

SEQ ID NO: 24453 - DNA, 18 bp, Artificial Sequence
  Synthetic DNA
taaatagactcactgtag

SEQ ID NO: 24454 - DNA, 18 bp, Artificial Sequence
  Synthetic DNA
taaatagactcattatag

SEQ ID NO: 24455 - DNA, 18 bp, Artificial Sequence
  Synthetic DNA
taaatccactcaccatag

SEQ ID NO: 24456 - DNA, 18 bp, Artificial Sequence
  Synthetic DNA
taacatgacacactattg

SEQ ID NO: 24457 - DNA, 18 bp, Artificial Sequence
  Synthetic DNA
taactcgactctttatag

SEQ ID NO: 24458 - DNA, 18 bp, Artificial Sequence
  Synthetic DNA
taagactactctctattg

SEQ ID NO: 24459 - DNA, 18 bp, Artificial Sequence
  Synthetic DNA
taagtcgattcactaaag

SEQ ID NO: 24460 - DNA, 18 bp, Artificial Sequence
  Synthetic DNA
taataacactcaccattg

SEQ ID NO: 24461 - DNA, 18 bp, Artificial Sequence
  Synthetic DNA
taataagacaagctatag

SEQ ID NO: 24462 - DNA, 18 bp, Artificial Sequence
  Synthetic DNA
taataagtctcgccatag

SEQ ID NO: 24463 - DNA, 18 bp, Artificial Sequence
  Synthetic DNA
taatacaaatcgctaaag

SEQ ID NO: 24464 - DNA, 18 bp, Artificial Sequence
  Synthetic DNA
taatacaaatcgctctag

SEQ ID NO: 24465 - DNA, 18 bp, Artificial Sequence
  Synthetic DNA
taataccattcactactg

SEQ ID NO: 24466 - DNA, 18 bp, Artificial Sequence
  Synthetic DNA
taatacgacacacatttg

SEQ ID NO: 24467 - DNA, 18 bp, Artificial Sequence
  Synthetic DNA
taatacgacccgccttag

SEQ ID NO: 24468 - DNA, 18 bp, Artificial Sequence
  Synthetic DNA
taatacgactcagtgatg

SEQ ID NO: 24469 - DNA, 18 bp, Artificial Sequence
  Synthetic DNA
taatacgagccactagtg

SEQ ID NO: 24470 - DNA, 18 bp, Artificial Sequence
  Synthetic DNA
taatacgattacctattg

SEQ ID NO: 24471 - DNA, 18 bp, Artificial Sequence
  Synthetic DNA
taatacgcatcgctttag

SEQ ID NO: 24472 - DNA, 18 bp, Artificial Sequence
  Synthetic DNA
taatacgcttcgcaatag

SEQ ID NO: 24473 - DNA, 18 bp, Artificial Sequence
  Synthetic DNA
taatacggctcactggtg

SEQ ID NO: 24474 - DNA, 18 bp, Artificial Sequence
  Synthetic DNA
taatacgtcacacgattg

SEQ ID NO: 24475 - DNA, 18 bp, Artificial Sequence
  Synthetic DNA
taatacgtcacgcgatag

SEQ ID NO: 24476 - DNA, 18 bp, Artificial Sequence
  Synthetic DNA
taatacgtctccttattg

SEQ ID NO: 24477 - DNA, 18 bp, Artificial Sequence
  Synthetic DNA
taatacgtctcgcaaaag

SEQ ID NO: 24478 - DNA, 18 bp, Artificial Sequence
  Synthetic DNA
taatacgtctcgctctcg

SEQ ID NO: 24479 - DNA, 18 bp, Artificial Sequence
  Synthetic DNA
taatacgtctgactactg

SEQ ID NO: 24480 - DNA, 18 bp, Artificial Sequence
  Synthetic DNA
taatacgtgtcactaatg

SEQ ID NO: 24481 - DNA, 18 bp, Artificial Sequence
  Synthetic DNA
taatactactctctgttg

SEQ ID NO: 24482 - DNA, 18 bp, Artificial Sequence
  Synthetic DNA
taatactagccactattg

SEQ ID NO: 24483 - DNA, 18 bp, Artificial Sequence
  Synthetic DNA
taatactcctcactagtg

SEQ ID NO: 24484 - DNA, 18 bp, Artificial Sequence
  Synthetic DNA
taatagaactcgccatag

SEQ ID NO: 24485 - DNA, 18 bp, Artificial Sequence
  Synthetic DNA
taataggactcagcattg

SEQ ID NO: 24486 - DNA, 18 bp, Artificial Sequence
  Synthetic DNA
taataggactcattgttg

SEQ ID NO: 24487 - DNA, 18 bp, Artificial Sequence
  Synthetic DNA
taatataactcgctaaag

SEQ ID NO: 24488 - DNA, 18 bp, Artificial Sequence
  Synthetic DNA
taatatgacttactagtg

SEQ ID NO: 24489 - DNA, 18 bp, Artificial Sequence
  Synthetic DNA
taatatgcctcaccattg

SEQ ID NO: 24490 - DNA, 18 bp, Artificial Sequence
  Synthetic DNA
taatatgtctcagtattg

SEQ ID NO: 24491 - DNA, 18 bp, Artificial Sequence
  Synthetic DNA
taatccgacactctattg

SEQ ID NO: 24492 - DNA, 18 bp, Artificial Sequence
  Synthetic DNA
taatccgactctccattg

SEQ ID NO: 24493 - DNA, 18 bp, Artificial Sequence
  Synthetic DNA
taatccgactgactactg

SEQ ID NO: 24494 - DNA, 18 bp, Artificial Sequence
  Synthetic DNA
taatccgagtcaatattg

SEQ ID NO: 24495 - DNA, 18 bp, Artificial Sequence
  Synthetic DNA
taatccgattccctattg

SEQ ID NO: 24496 - DNA, 18 bp, Artificial Sequence
  Synthetic DNA
taatccgtcccactattg

SEQ ID NO: 24497 - DNA, 18 bp, Artificial Sequence
  Synthetic DNA
taatccgtcttactattg

SEQ ID NO: 24498 - DNA, 18 bp, Artificial Sequence
  Synthetic DNA
taattagactaaatatag

SEQ ID NO: 24499 - DNA, 18 bp, Artificial Sequence
  Synthetic DNA
taattagactcacgttag

SEQ ID NO: 24500 - DNA, 18 bp, Artificial Sequence
  Synthetic DNA
taattagactcactaagg

SEQ ID NO: 24501 - DNA, 18 bp, Artificial Sequence
  Synthetic DNA
taattatactcactgtag

SEQ ID NO: 24502 - DNA, 18 bp, Artificial Sequence
  Synthetic DNA
taattcaactcacaatgg

SEQ ID NO: 24503 - DNA, 18 bp, Artificial Sequence
  Synthetic DNA
taattcgaatctctatgg

SEQ ID NO: 24504 - DNA, 18 bp, Artificial Sequence
  Synthetic DNA
taattcgacatcctatag

SEQ ID NO: 24505 - DNA, 18 bp, Artificial Sequence
  Synthetic DNA
taattcgacccacaatcg

SEQ ID NO: 24506 - DNA, 18 bp, Artificial Sequence
  Synthetic DNA
taattcgacgccctttag

SEQ ID NO: 24507 - DNA, 18 bp, Artificial Sequence
  Synthetic DNA
taattcgactaacttcag

SEQ ID NO: 24508 - DNA, 18 bp, Artificial Sequence
  Synthetic DNA
taattcgactcaacacag

SEQ ID NO: 24509 - DNA, 18 bp, Artificial Sequence
  Synthetic DNA
taattcgactcaacatcg

SEQ ID NO: 24510 - DNA, 18 bp, Artificial Sequence
  Synthetic DNA
taattcgactcataaaag

SEQ ID NO: 24511 - DNA, 18 bp, Artificial Sequence
  Synthetic DNA
taattcgactctatctag

SEQ ID NO: 24512 - DNA, 18 bp, Artificial Sequence
  Synthetic DNA
taattcgactgtctaaag

SEQ ID NO: 24513 - DNA, 18 bp, Artificial Sequence
  Synthetic DNA
taattcgactgtctctag

SEQ ID NO: 24514 - DNA, 18 bp, Artificial Sequence
  Synthetic DNA
taattcgcctcacaagag

SEQ ID NO: 24515 - DNA, 18 bp, Artificial Sequence
  Synthetic DNA
taattcgcctccctagag

SEQ ID NO: 24516 - DNA, 18 bp, Artificial Sequence
  Synthetic DNA
taattcgtgtctctatag

SEQ ID NO: 24517 - DNA, 18 bp, Artificial Sequence
  Synthetic DNA
taattctaatcactatgg

SEQ ID NO: 24518 - DNA, 18 bp, Artificial Sequence
  Synthetic DNA
taattggattcactgtag

SEQ ID NO: 24519 - DNA, 18 bp, Artificial Sequence
  Synthetic DNA
taatttgacacactttag

SEQ ID NO: 24520 - DNA, 18 bp, Artificial Sequence
  Synthetic DNA
tacatcgactgactatag

SEQ ID NO: 24521 - DNA, 18 bp, Artificial Sequence
  Synthetic DNA
tacttagactcactatcg

SEQ ID NO: 24522 - DNA, 18 bp, Artificial Sequence
  Synthetic DNA
tacttcgactcacactag

SEQ ID NO: 24523 - DNA, 18 bp, Artificial Sequence
  Synthetic DNA
tacttcgactcactcaag

SEQ ID NO: 24524 - DNA, 18 bp, Artificial Sequence
  Synthetic DNA
tacttcgacttaatatag

SEQ ID NO: 24525 - DNA, 18 bp, Artificial Sequence
  Synthetic DNA
tagaacgactcattattg

SEQ ID NO: 24526 - DNA, 18 bp, Artificial Sequence
  Synthetic DNA
tagtacgactaacaattg

SEQ ID NO: 24527 - DNA, 18 bp, Artificial Sequence
  Synthetic DNA
tagtatgactcgatatag

SEQ ID NO: 24528 - DNA, 18 bp, Artificial Sequence
  Synthetic DNA
tagttggtctcactatag

SEQ ID NO: 24529 - DNA, 18 bp, Artificial Sequence
  Synthetic DNA
tatcacgactcgttatag

SEQ ID NO: 24530 - DNA, 18 bp, Artificial Sequence
  Synthetic DNA
tatcacgactgactattg

SEQ ID NO: 24531 - DNA, 18 bp, Artificial Sequence
  Synthetic DNA
tatcacgacttgctatag

SEQ ID NO: 24532 - DNA, 18 bp, Artificial Sequence
  Synthetic DNA
tattacaaatcgctatag

SEQ ID NO: 24533 - DNA, 18 bp, Artificial Sequence
  Synthetic DNA
tattaccactcgctttag

SEQ ID NO: 24534 - DNA, 18 bp, Artificial Sequence
  Synthetic DNA
tattacgactcactgctg

SEQ ID NO: 24535 - DNA, 18 bp, Artificial Sequence
  Synthetic DNA
tattacgattagctatag

SEQ ID NO: 24536 - DNA, 18 bp, Artificial Sequence
  Synthetic DNA
tattacggcttactattg

SEQ ID NO: 24537 - DNA, 18 bp, Artificial Sequence
  Synthetic DNA
tattattactcactattg

SEQ ID NO: 24538 - DNA, 18 bp, Artificial Sequence
  Synthetic DNA
tattattactcgctatag

SEQ ID NO: 24539 - DNA, 18 bp, Artificial Sequence
  Synthetic DNA
tattgcgacttactattg

SEQ ID NO: 24540 - DNA, 18 bp, Artificial Sequence
  Synthetic DNA
tatttcaactcagtatag

SEQ ID NO: 24541 - DNA, 18 bp, Artificial Sequence
  Synthetic DNA
tatttcgactcattatgg

SEQ ID NO: 24542 - DNA, 18 bp, Artificial Sequence
  Synthetic DNA
tatttcgattcactacag

SEQ ID NO: 24543 - DNA, 18 bp, Artificial Sequence
  Synthetic DNA
tattttgactcactctag

SEQ ID NO: 24544 - DNA, 18 bp, Artificial Sequence
  Synthetic DNA
tcaaacgacccactattg

SEQ ID NO: 24545 - DNA, 18 bp, Artificial Sequence
  Synthetic DNA
tcaaacgagtcactattg

SEQ ID NO: 24546 - DNA, 18 bp, Artificial Sequence
  Synthetic DNA
tcaaatgactcactattg

SEQ ID NO: 24547 - DNA, 18 bp, Artificial Sequence
  Synthetic DNA
tcaatagactcactatag

SEQ ID NO: 24548 - DNA, 18 bp, Artificial Sequence
  Synthetic DNA
tcatacaactaactattg

SEQ ID NO: 24549 - DNA, 18 bp, Artificial Sequence
  Synthetic DNA
tcatacgactcacacttg

SEQ ID NO: 24550 - DNA, 18 bp, Artificial Sequence
  Synthetic DNA
tcatacgattctctattg

SEQ ID NO: 24551 - DNA, 18 bp, Artificial Sequence
  Synthetic DNA
tcatacgcttcactattg

SEQ ID NO: 24552 - DNA, 18 bp, Artificial Sequence
  Synthetic DNA
tcatacgtctcactaatg

SEQ ID NO: 24553 - DNA, 18 bp, Artificial Sequence
  Synthetic DNA
tcatatgactcattattg

SEQ ID NO: 24554 - DNA, 18 bp, Artificial Sequence
  Synthetic DNA
tcattccactccctatag

SEQ ID NO: 24555 - DNA, 18 bp, Artificial Sequence
  Synthetic DNA
tcattcgattcactttag

SEQ ID NO: 24556 - DNA, 18 bp, Artificial Sequence
  Synthetic DNA
tcattcgcctcagtatag

SEQ ID NO: 24557 - DNA, 18 bp, Artificial Sequence
  Synthetic DNA
tcatttgtctcactatag

SEQ ID NO: 24558 - DNA, 18 bp, Artificial Sequence
  Synthetic DNA
tctttcgactcaatatag

SEQ ID NO: 24559 - DNA, 18 bp, Artificial Sequence
  Synthetic DNA
tgaaactactcactattg

SEQ ID NO: 24560 - DNA, 18 bp, Artificial Sequence
  Synthetic DNA
tgacaagactcactattg

SEQ ID NO: 24561 - DNA, 18 bp, Artificial Sequence
  Synthetic DNA
tgataagactcacgattg

SEQ ID NO: 24562 - DNA, 18 bp, Artificial Sequence
  Synthetic DNA
tgataagacttactattg

SEQ ID NO: 24563 - DNA, 18 bp, Artificial Sequence
  Synthetic DNA
tgatacgacttacaattg

SEQ ID NO: 24564 - DNA, 18 bp, Artificial Sequence
  Synthetic DNA
tgatatgactcactgttg

SEQ ID NO: 24565 - DNA, 18 bp, Artificial Sequence
  Synthetic DNA
tgatgcgacttgctatag

SEQ ID NO: 24566 - DNA, 18 bp, Artificial Sequence
  Synthetic DNA
ttaaacgactggctatag

SEQ ID NO: 24567 - DNA, 18 bp, Artificial Sequence
  Synthetic DNA
ttacacgacacactattg

SEQ ID NO: 24568 - DNA, 18 bp, Artificial Sequence
  Synthetic DNA
ttatacgactccctatta

SEQ ID NO: 24569 - DNA, 18 bp, Artificial Sequence
  Synthetic DNA
ttatacgactcgcattag

SEQ ID NO: 24570 - DNA, 18 bp, Artificial Sequence
  Synthetic DNA
ttatacgactcgctgaag

SEQ ID NO: 24571 - DNA, 18 bp, Artificial Sequence
  Synthetic DNA
ttatactactcactagtg

SEQ ID NO: 24572 - DNA, 18 bp, Artificial Sequence
  Synthetic DNA
ttatactactcgctttag

SEQ ID NO: 24573 - DNA, 18 bp, Artificial Sequence
  Synthetic DNA
ttataggaatcactattg

SEQ ID NO: 24574 - DNA, 18 bp, Artificial Sequence
  Synthetic DNA
ttatgcgactcattattg

SEQ ID NO: 24575 - DNA, 18 bp, Artificial Sequence
  Synthetic DNA
ttattcaactaactatag

SEQ ID NO: 24576 - DNA, 18 bp, Artificial Sequence
  Synthetic DNA
ttattcgacttaccatag

SEQ ID NO: 24577 - DNA, 18 bp, Artificial Sequence
  Synthetic DNA
aaaaacgactcactggag

SEQ ID NO: 24578 - DNA, 18 bp, Artificial Sequence
  Synthetic DNA
aaaaacgactctctaaag

SEQ ID NO: 24579 - DNA, 18 bp, Artificial Sequence
  Synthetic DNA
aaaaacgactctctctag

SEQ ID NO: 24580 - DNA, 18 bp, Artificial Sequence
  Synthetic DNA
aaaaacgactgaccatag

SEQ ID NO: 24581 - DNA, 18 bp, Artificial Sequence
  Synthetic DNA
aaaaacggctctctatag

SEQ ID NO: 24582 - DNA, 18 bp, Artificial Sequence
  Synthetic DNA
aaaagcgacccactatag

SEQ ID NO: 24583 - DNA, 18 bp, Artificial Sequence
  Synthetic DNA
aaacacgactatctatag

SEQ ID NO: 24584 - DNA, 18 bp, Artificial Sequence
  Synthetic DNA
aaacacgtctcactatcg

SEQ ID NO: 24585 - DNA, 18 bp, Artificial Sequence
  Synthetic DNA
aaacatgtctcactatag

SEQ ID NO: 24586 - DNA, 18 bp, Artificial Sequence
  Synthetic DNA
aaataaaactcactatcg

SEQ ID NO: 24587 - DNA, 18 bp, Artificial Sequence
  Synthetic DNA
aaataacactcacgatag

SEQ ID NO: 24588 - DNA, 18 bp, Artificial Sequence
  Synthetic DNA
aaataagtctcactctag

SEQ ID NO: 24589 - DNA, 18 bp, Artificial Sequence
  Synthetic DNA
aaataccagtcacaatag

SEQ ID NO: 24590 - DNA, 18 bp, Artificial Sequence
  Synthetic DNA
aaatacgaaacaatatag

SEQ ID NO: 24591 - DNA, 18 bp, Artificial Sequence
  Synthetic DNA
aaatacgaaccactatcg

SEQ ID NO: 24592 - DNA, 18 bp, Artificial Sequence
  Synthetic DNA
aaatacgactcacagaag

SEQ ID NO: 24593 - DNA, 18 bp, Artificial Sequence
  Synthetic DNA
aaatacgactccctcaag

SEQ ID NO: 24594 - DNA, 18 bp, Artificial Sequence
  Synthetic DNA
aaatacgactccctttcg

SEQ ID NO: 24595 - DNA, 18 bp, Artificial Sequence
  Synthetic DNA
aaatacgactctatgtag

SEQ ID NO: 24596 - DNA, 18 bp, Artificial Sequence
  Synthetic DNA
aaatacgactctcagtag

SEQ ID NO: 24597 - DNA, 18 bp, Artificial Sequence
  Synthetic DNA
aaatacgactctcttcag

SEQ ID NO: 24598 - DNA, 18 bp, Artificial Sequence
  Synthetic DNA
aaatacgactcttcatag

SEQ ID NO: 24599 - DNA, 18 bp, Artificial Sequence
  Synthetic DNA
aaatacgagtcacttaag

SEQ ID NO: 24600 - DNA, 18 bp, Artificial Sequence
  Synthetic DNA
aaatacgatttactatcg

SEQ ID NO: 24601 - DNA, 18 bp, Artificial Sequence
  Synthetic DNA
aaatacgcctctctaaag

SEQ ID NO: 24602 - DNA, 18 bp, Artificial Sequence
  Synthetic DNA
aaatacgcttcacaatag

SEQ ID NO: 24603 - DNA, 18 bp, Artificial Sequence
  Synthetic DNA
aaatacggctcacattag

SEQ ID NO: 24604 - DNA, 18 bp, Artificial Sequence
  Synthetic DNA
aaatacgtctcacgaaag

SEQ ID NO: 24605 - DNA, 18 bp, Artificial Sequence
  Synthetic DNA
aaatactattcactctag

SEQ ID NO: 24606 - DNA, 18 bp, Artificial Sequence
  Synthetic DNA
aaatatgactaactacag

SEQ ID NO: 24607 - DNA, 18 bp, Artificial Sequence
  Synthetic DNA
aaatatgactaattatag

SEQ ID NO: 24608 - DNA, 18 bp, Artificial Sequence
  Synthetic DNA
aaatatgattcattatag

SEQ ID NO: 24609 - DNA, 18 bp, Artificial Sequence
  Synthetic DNA
aaatcagactctctatag

SEQ ID NO: 24610 - DNA, 18 bp, Artificial Sequence
  Synthetic DNA
aaatccgactaattatag

SEQ ID NO: 24611 - DNA, 18 bp, Artificial Sequence
  Synthetic DNA
aaatccgactcacttgag

SEQ ID NO: 24612 - DNA, 18 bp, Artificial Sequence
  Synthetic DNA
aaatgcgactctatatag

SEQ ID NO: 24613 - DNA, 18 bp, Artificial Sequence
  Synthetic DNA
aaatgcgattcacaatag

SEQ ID NO: 24614 - DNA, 18 bp, Artificial Sequence
  Synthetic DNA
aactacgacacaccatag

SEQ ID NO: 24615 - DNA, 18 bp, Artificial Sequence
  Synthetic DNA
aactacgtctcactacag

SEQ ID NO: 24616 - DNA, 18 bp, Artificial Sequence
  Synthetic DNA
aactacgtctcactatcg

SEQ ID NO: 24617 - DNA, 18 bp, Artificial Sequence
  Synthetic DNA
aagtaagtctcactatag

SEQ ID NO: 24618 - DNA, 18 bp, Artificial Sequence
  Synthetic DNA
aagtacgactaactaaag

SEQ ID NO: 24619 - DNA, 18 bp, Artificial Sequence
  Synthetic DNA
aagtccgactaactatag

SEQ ID NO: 24620 - DNA, 18 bp, Artificial Sequence
  Synthetic DNA
aagtccgtctcactatag

SEQ ID NO: 24621 - DNA, 18 bp, Artificial Sequence
  Synthetic DNA
aagtcggactcactatag

SEQ ID NO: 24622 - DNA, 18 bp, Artificial Sequence
  Synthetic DNA
aattacaactcaatatag

SEQ ID NO: 24623 - DNA, 18 bp, Artificial Sequence
  Synthetic DNA
aattacgactcaagatag

SEQ ID NO: 24624 - DNA, 18 bp, Artificial Sequence
  Synthetic DNA
aattacgagttactatag

SEQ ID NO: 24625 - DNA, 18 bp, Artificial Sequence
  Synthetic DNA
aattacggctcactatgg

SEQ ID NO: 24626 - DNA, 18 bp, Artificial Sequence
  Synthetic DNA
acacacgactcagtatag

SEQ ID NO: 24627 - DNA, 18 bp, Artificial Sequence
  Synthetic DNA
acataccagtcactatag

SEQ ID NO: 24628 - DNA, 18 bp, Artificial Sequence
  Synthetic DNA
acatgcgactcactttag

SEQ ID NO: 24629 - DNA, 18 bp, Artificial Sequence
  Synthetic DNA
acgtacgactcacaatag

SEQ ID NO: 24630 - DNA, 18 bp, Artificial Sequence
  Synthetic DNA
acgtactactcactatag

SEQ ID NO: 24631 - DNA, 18 bp, Artificial Sequence
  Synthetic DNA
agatacaagtcactatag

SEQ ID NO: 24632 - DNA, 18 bp, Artificial Sequence
  Synthetic DNA
agatacgaatcactttag

SEQ ID NO: 24633 - DNA, 18 bp, Artificial Sequence
  Synthetic DNA
agatacgactctccatag

SEQ ID NO: 24634 - DNA, 18 bp, Artificial Sequence
  Synthetic DNA
agatacgatacactatag

SEQ ID NO: 24635 - DNA, 18 bp, Artificial Sequence
  Synthetic DNA
atatacaacccactatag

SEQ ID NO: 24636 - DNA, 18 bp, Artificial Sequence
  Synthetic DNA
atatactactcactatcg

SEQ ID NO: 24637 - DNA, 18 bp, Artificial Sequence
  Synthetic DNA
atatatggctcactatag

SEQ ID NO: 24638 - DNA, 18 bp, Artificial Sequence
  Synthetic DNA
atatgcgacgcactatag

SEQ ID NO: 24639 - DNA, 18 bp, Artificial Sequence
  Synthetic DNA
caaaacaaatcactatag

SEQ ID NO: 24640 - DNA, 18 bp, Artificial Sequence
  Synthetic DNA
caaaacatctcactatag

SEQ ID NO: 24641 - DNA, 18 bp, Artificial Sequence
  Synthetic DNA
caaaacccctcactatag

SEQ ID NO: 24642 - DNA, 18 bp, Artificial Sequence
  Synthetic DNA
caaaccgactcagtatag

SEQ ID NO: 24643 - DNA, 18 bp, Artificial Sequence
  Synthetic DNA
caatacaaaccactatag

SEQ ID NO: 24644 - DNA, 18 bp, Artificial Sequence
  Synthetic DNA
caatacaattcactaaag

SEQ ID NO: 24645 - DNA, 18 bp, Artificial Sequence
  Synthetic DNA
caatacgacacactctcg

SEQ ID NO: 24646 - DNA, 18 bp, Artificial Sequence
  Synthetic DNA
caatacgactcaattaag

SEQ ID NO: 24647 - DNA, 18 bp, Artificial Sequence
  Synthetic DNA
caatacgcaccactatag

SEQ ID NO: 24648 - DNA, 18 bp, Artificial Sequence
  Synthetic DNA
caatacgcctcacaacag

SEQ ID NO: 24649 - DNA, 18 bp, Artificial Sequence
  Synthetic DNA
caatactaatcactctag

SEQ ID NO: 24650 - DNA, 18 bp, Artificial Sequence
  Synthetic DNA
caatactactcattaaag

SEQ ID NO: 24651 - DNA, 18 bp, Artificial Sequence
  Synthetic DNA
caatactactcattacag

SEQ ID NO: 24652 - DNA, 18 bp, Artificial Sequence
  Synthetic DNA
caatagtactcactgtag

SEQ ID NO: 24653 - DNA, 18 bp, Artificial Sequence
  Synthetic DNA
caatagtactcactttag

SEQ ID NO: 24654 - DNA, 18 bp, Artificial Sequence
  Synthetic DNA
caatgcgaaacactatag

SEQ ID NO: 24655 - DNA, 18 bp, Artificial Sequence
  Synthetic DNA
cagtacgacgctctatag

SEQ ID NO: 24656 - DNA, 18 bp, Artificial Sequence
  Synthetic DNA
cataacgaatcactatag

SEQ ID NO: 24657 - DNA, 18 bp, Artificial Sequence
  Synthetic DNA
cataacgacacactatag

SEQ ID NO: 24658 - DNA, 18 bp, Artificial Sequence
  Synthetic DNA
cattaaaactcactatag

SEQ ID NO: 24659 - DNA, 18 bp, Artificial Sequence
  Synthetic DNA
cattaagactctctatag

SEQ ID NO: 24660 - DNA, 18 bp, Artificial Sequence
  Synthetic DNA
cattacgattaactatag

SEQ ID NO: 24661 - DNA, 18 bp, Artificial Sequence
  Synthetic DNA
cgctacgtctcactatag

SEQ ID NO: 24662 - DNA, 18 bp, Artificial Sequence
  Synthetic DNA
ctatacgactcaatttag

SEQ ID NO: 24663 - DNA, 18 bp, Artificial Sequence
  Synthetic DNA
ctatacgattcaccatag

SEQ ID NO: 24664 - DNA, 18 bp, Artificial Sequence
  Synthetic DNA
ctttacgactgactatag

SEQ ID NO: 24665 - DNA, 18 bp, Artificial Sequence
  Synthetic DNA
gaaaacgactctgtatag

SEQ ID NO: 24666 - DNA, 18 bp, Artificial Sequence
  Synthetic DNA
gaatacgtctctctctag

SEQ ID NO: 24667 - DNA, 18 bp, Artificial Sequence
  Synthetic DNA
gaatgcagctcactatag

SEQ ID NO: 24668 - DNA, 18 bp, Artificial Sequence
  Synthetic DNA
gaatgcgactcaccttag

SEQ ID NO: 24669 - DNA, 18 bp, Artificial Sequence
  Synthetic DNA
gactacgactcattttag

SEQ ID NO: 24670 - DNA, 18 bp, Artificial Sequence
  Synthetic DNA
gattacgtctcactaaag

SEQ ID NO: 24671 - DNA, 18 bp, Artificial Sequence
  Synthetic DNA
gtaaacaactcactatag

SEQ ID NO: 24672 - DNA, 18 bp, Artificial Sequence
  Synthetic DNA
taaaaaaactcactaaag

SEQ ID NO: 24673 - DNA, 18 bp, Artificial Sequence
  Synthetic DNA
taaaaagtctcactttag

SEQ ID NO: 24674 - DNA, 18 bp, Artificial Sequence
  Synthetic DNA
taaaaagtctcagtatag

SEQ ID NO: 24675 - DNA, 18 bp, Artificial Sequence
  Synthetic DNA
taaaacaaattactatag

SEQ ID NO: 24676 - DNA, 18 bp, Artificial Sequence
  Synthetic DNA
taaaacaacacactctag

SEQ ID NO: 24677 - DNA, 18 bp, Artificial Sequence
  Synthetic DNA
taaaacaattcactctag

SEQ ID NO: 24678 - DNA, 18 bp, Artificial Sequence
  Synthetic DNA
taaaaccactcattaaag

SEQ ID NO: 24679 - DNA, 18 bp, Artificial Sequence
  Synthetic DNA
taaaaccagtccctatag

SEQ ID NO: 24680 - DNA, 18 bp, Artificial Sequence
  Synthetic DNA
taaaacgaatatctatag

SEQ ID NO: 24681 - DNA, 18 bp, Artificial Sequence
  Synthetic DNA
taaaacgaatcaatgtag

SEQ ID NO: 24682 - DNA, 18 bp, Artificial Sequence
  Synthetic DNA
taaaacgaatcacgaaag

SEQ ID NO: 24683 - DNA, 18 bp, Artificial Sequence
  Synthetic DNA
taaaacgactatccatag

SEQ ID NO: 24684 - DNA, 18 bp, Artificial Sequence
  Synthetic DNA
taaaacgccccacaatag

SEQ ID NO: 24685 - DNA, 18 bp, Artificial Sequence
  Synthetic DNA
taaaacggttcaatatag

SEQ ID NO: 24686 - DNA, 18 bp, Artificial Sequence
  Synthetic DNA
taaaactaataactatag

SEQ ID NO: 24687 - DNA, 18 bp, Artificial Sequence
  Synthetic DNA
taaaactactcactttcg

SEQ ID NO: 24688 - DNA, 18 bp, Artificial Sequence
  Synthetic DNA
taaaactacttacgatag

SEQ ID NO: 24689 - DNA, 18 bp, Artificial Sequence
  Synthetic DNA
taaaaggacacacaatag

SEQ ID NO: 24690 - DNA, 18 bp, Artificial Sequence
  Synthetic DNA
taaaatcactcactctag

SEQ ID NO: 24691 - DNA, 18 bp, Artificial Sequence
  Synthetic DNA
taaaatgacacactatgg

SEQ ID NO: 24692 - DNA, 18 bp, Artificial Sequence
  Synthetic DNA
taaaatgactaacaatag

SEQ ID NO: 24693 - DNA, 18 bp, Artificial Sequence
  Synthetic DNA
taaaatgactcattttag

SEQ ID NO: 24694 - DNA, 18 bp, Artificial Sequence
  Synthetic DNA
taaaatgacttactctag

SEQ ID NO: 24695 - DNA, 18 bp, Artificial Sequence
  Synthetic DNA
taaaatgattcacgatag

SEQ ID NO: 24696 - DNA, 18 bp, Artificial Sequence
  Synthetic DNA
taaaccgacacacgatag

SEQ ID NO: 24697 - DNA, 18 bp, Artificial Sequence
  Synthetic DNA
taaaccgatacactatag

SEQ ID NO: 24698 - DNA, 18 bp, Artificial Sequence
  Synthetic DNA
taaaccgcctcacaatag

SEQ ID NO: 24699 - DNA, 18 bp, Artificial Sequence
  Synthetic DNA
taaaccgtctcactagag

SEQ ID NO: 24700 - DNA, 18 bp, Artificial Sequence
  Synthetic DNA
taaaccgtctccctatag

SEQ ID NO: 24701 - DNA, 18 bp, Artificial Sequence
  Synthetic DNA
taaagcgaatcactaaag

SEQ ID NO: 24702 - DNA, 18 bp, Artificial Sequence
  Synthetic DNA
taaagcgactcagtatcg

SEQ ID NO: 24703 - DNA, 18 bp, Artificial Sequence
  Synthetic DNA
taacaagacgcactacag

SEQ ID NO: 24704 - DNA, 18 bp, Artificial Sequence
  Synthetic DNA
taacaagcgtcactatag

SEQ ID NO: 24705 - DNA, 18 bp, Artificial Sequence
  Synthetic DNA
taacacaattcactatgg

SEQ ID NO: 24706 - DNA, 18 bp, Artificial Sequence
  Synthetic DNA
taacacacttcactatag

SEQ ID NO: 24707 - DNA, 18 bp, Artificial Sequence
  Synthetic DNA
taacacgaaccattatag

SEQ ID NO: 24708 - DNA, 18 bp, Artificial Sequence
  Synthetic DNA
taacacgactcaacatcg

SEQ ID NO: 24709 - DNA, 18 bp, Artificial Sequence
  Synthetic DNA
taacacgacttacagtag

SEQ ID NO: 24710 - DNA, 18 bp, Artificial Sequence
  Synthetic DNA
taacacgagacactaaag

SEQ ID NO: 24711 - DNA, 18 bp, Artificial Sequence
  Synthetic DNA
taacacgccacactaaag

SEQ ID NO: 24712 - DNA, 18 bp, Artificial Sequence
  Synthetic DNA
taacacggctcaataaag

SEQ ID NO: 24713 - DNA, 18 bp, Artificial Sequence
  Synthetic DNA
taacacgtccctctatag

SEQ ID NO: 24714 - DNA, 18 bp, Artificial Sequence
  Synthetic DNA
taacacgtctcaccatcg

SEQ ID NO: 24715 - DNA, 18 bp, Artificial Sequence
  Synthetic DNA
taacacgtctcattatcg

SEQ ID NO: 24716 - DNA, 18 bp, Artificial Sequence
  Synthetic DNA
taacacgtctctgtatag

SEQ ID NO: 24717 - DNA, 18 bp, Artificial Sequence
  Synthetic DNA
taacactactcactttgg

SEQ ID NO: 24718 - DNA, 18 bp, Artificial Sequence
  Synthetic DNA
taacactcctctctatag

SEQ ID NO: 24719 - DNA, 18 bp, Artificial Sequence
  Synthetic DNA
taacagtactcattatag

SEQ ID NO: 24720 - DNA, 18 bp, Artificial Sequence
  Synthetic DNA
taacatcactcacaatag

SEQ ID NO: 24721 - DNA, 18 bp, Artificial Sequence
  Synthetic DNA
taacatgaatcactagag

SEQ ID NO: 24722 - DNA, 18 bp, Artificial Sequence
  Synthetic DNA
taacatgactcagtagag

SEQ ID NO: 24723 - DNA, 18 bp, Artificial Sequence
  Synthetic DNA
taacatgtcacactatag

SEQ ID NO: 24724 - DNA, 18 bp, Artificial Sequence
  Synthetic DNA
taacctgactcactatgg

SEQ ID NO: 24725 - DNA, 18 bp, Artificial Sequence
  Synthetic DNA
taacgcgtctcacaatag

SEQ ID NO: 24726 - DNA, 18 bp, Artificial Sequence
  Synthetic DNA
taagaagacactctatag

SEQ ID NO: 24727 - DNA, 18 bp, Artificial Sequence
  Synthetic DNA
taagaccacgcactatgg

SEQ ID NO: 24728 - DNA, 18 bp, Artificial Sequence
  Synthetic DNA
taagacgaatcagtgtag

SEQ ID NO: 24729 - DNA, 18 bp, Artificial Sequence
  Synthetic DNA
taagacgctacactatag

SEQ ID NO: 24730 - DNA, 18 bp, Artificial Sequence
  Synthetic DNA
taagacgtctcagtttag

SEQ ID NO: 24731 - DNA, 18 bp, Artificial Sequence
  Synthetic DNA
taagacgtttcaatatag

SEQ ID NO: 24732 - DNA, 18 bp, Artificial Sequence
  Synthetic DNA
taagccgacttactatgg

SEQ ID NO: 24733 - DNA, 18 bp, Artificial Sequence
  Synthetic DNA
taataaaactcacattag

SEQ ID NO: 24734 - DNA, 18 bp, Artificial Sequence
  Synthetic DNA
taataagacacaccaaag

SEQ ID NO: 24735 - DNA, 18 bp, Artificial Sequence
  Synthetic DNA
taataagacacacttcag

SEQ ID NO: 24736 - DNA, 18 bp, Artificial Sequence
  Synthetic DNA
taataagacgaactaaag

SEQ ID NO: 24737 - DNA, 18 bp, Artificial Sequence
  Synthetic DNA
taataagacgaactttag

SEQ ID NO: 24738 - DNA, 18 bp, Artificial Sequence
  Synthetic DNA
taataagacggacaatag

SEQ ID NO: 24739 - DNA, 18 bp, Artificial Sequence
  Synthetic DNA
taataagactctcaatcg

SEQ ID NO: 24740 - DNA, 18 bp, Artificial Sequence
  Synthetic DNA
taataagacttcctttag

SEQ ID NO: 24741 - DNA, 18 bp, Artificial Sequence
  Synthetic DNA
taataagattaactaaag

SEQ ID NO: 24742 - DNA, 18 bp, Artificial Sequence
  Synthetic DNA
taataagattcaacatag

SEQ ID NO: 24743 - DNA, 18 bp, Artificial Sequence
  Synthetic DNA
taataagccaccctatag

SEQ ID NO: 24744 - DNA, 18 bp, Artificial Sequence
  Synthetic DNA
taataagcctccttatag

SEQ ID NO: 24745 - DNA, 18 bp, Artificial Sequence
  Synthetic DNA
taataagggccactatag

SEQ ID NO: 24746 - DNA, 18 bp, Artificial Sequence
  Synthetic DNA
taataagtatcaatatag

SEQ ID NO: 24747 - DNA, 18 bp, Artificial Sequence
  Synthetic DNA
taataagtctaacaatag

SEQ ID NO: 24748 - DNA, 18 bp, Artificial Sequence
  Synthetic DNA
taataagtctcacactag

SEQ ID NO: 24749 - DNA, 18 bp, Artificial Sequence
  Synthetic DNA
taataagtctcattagag

SEQ ID NO: 24750 - DNA, 18 bp, Artificial Sequence
  Synthetic DNA
taataagtctcattatcg

SEQ ID NO: 24751 - DNA, 18 bp, Artificial Sequence
  Synthetic DNA
taataatacacactatcg

SEQ ID NO: 24752 - DNA, 18 bp, Artificial Sequence
  Synthetic DNA
taataatactaaccatag

SEQ ID NO: 24753 - DNA, 18 bp, Artificial Sequence
  Synthetic DNA
taataatactcacgaaag

SEQ ID NO: 24754 - DNA, 18 bp, Artificial Sequence
  Synthetic DNA
taatacaacgaactatcg

SEQ ID NO: 24755 - DNA, 18 bp, Artificial Sequence
  Synthetic DNA
taatacaactaacaatgg

SEQ ID NO: 24756 - DNA, 18 bp, Artificial Sequence
  Synthetic DNA
taatacaactcactccgg

SEQ ID NO: 24757 - DNA, 18 bp, Artificial Sequence
  Synthetic DNA
taatacaagtcataatag

SEQ ID NO: 24758 - DNA, 18 bp, Artificial Sequence
  Synthetic DNA
taatacaattaactgtag

SEQ ID NO: 24759 - DNA, 18 bp, Artificial Sequence
  Synthetic DNA
taatacaattcaccaaag

SEQ ID NO: 24760 - DNA, 18 bp, Artificial Sequence
  Synthetic DNA
taatacaattcactccag

SEQ ID NO: 24761 - DNA, 18 bp, Artificial Sequence
  Synthetic DNA
taatacagctcacttaag

SEQ ID NO: 24762 - DNA, 18 bp, Artificial Sequence
  Synthetic DNA
taatacagttcagtatag

SEQ ID NO: 24763 - DNA, 18 bp, Artificial Sequence
  Synthetic DNA
taatacatgtaactatag

SEQ ID NO: 24764 - DNA, 18 bp, Artificial Sequence
  Synthetic DNA
taataccaatcaatagag

SEQ ID NO: 24765 - DNA, 18 bp, Artificial Sequence
  Synthetic DNA
taataccaatctatatag

SEQ ID NO: 24766 - DNA, 18 bp, Artificial Sequence
  Synthetic DNA
taataccactcagcatcg

SEQ ID NO: 24767 - DNA, 18 bp, Artificial Sequence
  Synthetic DNA
taataccactcatattag

SEQ ID NO: 24768 - DNA, 18 bp, Artificial Sequence
  Synthetic DNA
taataccactcctaatag

SEQ ID NO: 24769 - DNA, 18 bp, Artificial Sequence
  Synthetic DNA
taataccactgtatatag

SEQ ID NO: 24770 - DNA, 18 bp, Artificial Sequence
  Synthetic DNA
taataccacttaataaag

SEQ ID NO: 24771 - DNA, 18 bp, Artificial Sequence
  Synthetic DNA
taataccagtaaatatag

SEQ ID NO: 24772 - DNA, 18 bp, Artificial Sequence
  Synthetic DNA
taatacccttcactttag

SEQ ID NO: 24773 - DNA, 18 bp, Artificial Sequence
  Synthetic DNA
taatacctcgcactacag

SEQ ID NO: 24774 - DNA, 18 bp, Artificial Sequence
  Synthetic DNA
taatacctctcagtatgg

SEQ ID NO: 24775 - DNA, 18 bp, Artificial Sequence
  Synthetic DNA
taatacgaaagactgtag

SEQ ID NO: 24776 - DNA, 18 bp, Artificial Sequence
  Synthetic DNA
taatacgaacaactttag

SEQ ID NO: 24777 - DNA, 18 bp, Artificial Sequence
  Synthetic DNA
taatacgaatcaccccag

SEQ ID NO: 24778 - DNA, 18 bp, Artificial Sequence
  Synthetic DNA
taatacgaatccatacag

SEQ ID NO: 24779 - DNA, 18 bp, Artificial Sequence
  Synthetic DNA
taatacgaatgtctacag

SEQ ID NO: 24780 - DNA, 18 bp, Artificial Sequence
  Synthetic DNA
taatacgaattccaatag

SEQ ID NO: 24781 - DNA, 18 bp, Artificial Sequence
  Synthetic DNA
taatacgacaaaccttag

SEQ ID NO: 24782 - DNA, 18 bp, Artificial Sequence
  Synthetic DNA
taatacgacacacctaag

SEQ ID NO: 24783 - DNA, 18 bp, Artificial Sequence
  Synthetic DNA
taatacgacatactgtcg

SEQ ID NO: 24784 - DNA, 18 bp, Artificial Sequence
  Synthetic DNA
taatacgaccatcaatag

SEQ ID NO: 24785 - DNA, 18 bp, Artificial Sequence
  Synthetic DNA
taatacgaccctttaaag

SEQ ID NO: 24786 - DNA, 18 bp, Artificial Sequence
  Synthetic DNA
taatacgactaaaaacag

SEQ ID NO: 24787 - DNA, 18 bp, Artificial Sequence
  Synthetic DNA
taatacgacttattttcg

SEQ ID NO: 24788 - DNA, 18 bp, Artificial Sequence
  Synthetic DNA
taatacgagacaatacag

SEQ ID NO: 24789 - DNA, 18 bp, Artificial Sequence
  Synthetic DNA
taatacgaggctccatag

SEQ ID NO: 24790 - DNA, 18 bp, Artificial Sequence
  Synthetic DNA
taatacgagttacaaaag

SEQ ID NO: 24791 - DNA, 18 bp, Artificial Sequence
  Synthetic DNA
taatacgatacattctag

SEQ ID NO: 24792 - DNA, 18 bp, Artificial Sequence
  Synthetic DNA
taatacgccacacttaag

SEQ ID NO: 24793 - DNA, 18 bp, Artificial Sequence
  Synthetic DNA
taatacgcctcagattag

SEQ ID NO: 24794 - DNA, 18 bp, Artificial Sequence
  Synthetic DNA
taatacggatcagaatag

SEQ ID NO: 24795 - DNA, 18 bp, Artificial Sequence
  Synthetic DNA
taatacggcgcagcatag

SEQ ID NO: 24796 - DNA, 18 bp, Artificial Sequence
  Synthetic DNA
taatacggctcatagtag

SEQ ID NO: 24797 - DNA, 18 bp, Artificial Sequence
  Synthetic DNA
taatacggcttattatcg

SEQ ID NO: 24798 - DNA, 18 bp, Artificial Sequence
  Synthetic DNA
taatacgtataattatag

SEQ ID NO: 24799 - DNA, 18 bp, Artificial Sequence
  Synthetic DNA
taatacgtatctctatcg

SEQ ID NO: 24800 - DNA, 18 bp, Artificial Sequence
  Synthetic DNA
taatacgtccctccatag

SEQ ID NO: 24801 - DNA, 18 bp, Artificial Sequence
  Synthetic DNA
taatacgtccctctacag

SEQ ID NO: 24802 - DNA, 18 bp, Artificial Sequence
  Synthetic DNA
taatacgtctcatttgag

SEQ ID NO: 24803 - DNA, 18 bp, Artificial Sequence
  Synthetic DNA
taatacgtttaactacag

SEQ ID NO: 24804 - DNA, 18 bp, Artificial Sequence
  Synthetic DNA
taatacgtttcactagcg

SEQ ID NO: 24805 - DNA, 18 bp, Artificial Sequence
  Synthetic DNA
taatacgtttccctacag

SEQ ID NO: 24806 - DNA, 18 bp, Artificial Sequence
  Synthetic DNA
taatactactctctcaag

SEQ ID NO: 24807 - DNA, 18 bp, Artificial Sequence
  Synthetic DNA
taatactacttaaaatag

SEQ ID NO: 24808 - DNA, 18 bp, Artificial Sequence
  Synthetic DNA
taatactagtcataatag

SEQ ID NO: 24809 - DNA, 18 bp, Artificial Sequence
  Synthetic DNA
taatactattcataatag

SEQ ID NO: 24810 - DNA, 18 bp, Artificial Sequence
  Synthetic DNA
taatactccttactttag

SEQ ID NO: 24811 - DNA, 18 bp, Artificial Sequence
  Synthetic DNA
taatacttctaactatcg

SEQ ID NO: 24812 - DNA, 18 bp, Artificial Sequence
  Synthetic DNA
taatacttctcaatgtag

SEQ ID NO: 24813 - DNA, 18 bp, Artificial Sequence
  Synthetic DNA
taatacttctcagtatcg

SEQ ID NO: 24814 - DNA, 18 bp, Artificial Sequence
  Synthetic DNA
taatacttctcattatcg

SEQ ID NO: 24815 - DNA, 18 bp, Artificial Sequence
  Synthetic DNA
taatacttctccctatgg

SEQ ID NO: 24816 - DNA, 18 bp, Artificial Sequence
  Synthetic DNA
taataggacctacaatag

SEQ ID NO: 24817 - DNA, 18 bp, Artificial Sequence
  Synthetic DNA
taataggatctactatag

SEQ ID NO: 24818 - DNA, 18 bp, Artificial Sequence
  Synthetic DNA
taataggattttctatag

SEQ ID NO: 24819 - DNA, 18 bp, Artificial Sequence
  Synthetic DNA
taataggccactctatag

SEQ ID NO: 24820 - DNA, 18 bp, Artificial Sequence
  Synthetic DNA
taatataactcattatgg

SEQ ID NO: 24821 - DNA, 18 bp, Artificial Sequence
  Synthetic DNA
taatatcactctcaatag

SEQ ID NO: 24822 - DNA, 18 bp, Artificial Sequence
  Synthetic DNA
taatatgaacctctatag

SEQ ID NO: 24823 - DNA, 18 bp, Artificial Sequence
  Synthetic DNA
taatatgacaatctatag

SEQ ID NO: 24824 - DNA, 18 bp, Artificial Sequence
  Synthetic DNA
taatatgactttctacag

SEQ ID NO: 24825 - DNA, 18 bp, Artificial Sequence
  Synthetic DNA
taatatgcatctctatag

SEQ ID NO: 24826 - DNA, 18 bp, Artificial Sequence
  Synthetic DNA
taatatgcctctccatag

SEQ ID NO: 24827 - DNA, 18 bp, Artificial Sequence
  Synthetic DNA
taatatggttcacaatag

SEQ ID NO: 24828 - DNA, 18 bp, Artificial Sequence
  Synthetic DNA
taatatgtatcactacag

SEQ ID NO: 24829 - DNA, 18 bp, Artificial Sequence
  Synthetic DNA
taatatgtcacattatag

SEQ ID NO: 24830 - DNA, 18 bp, Artificial Sequence
  Synthetic DNA
taatattactccccatag

SEQ ID NO: 24831 - DNA, 18 bp, Artificial Sequence
  Synthetic DNA
taatattagtcattatag

SEQ ID NO: 24832 - DNA, 18 bp, Artificial Sequence
  Synthetic DNA
taatcagtctctctatag

SEQ ID NO: 24833 - DNA, 18 bp, Artificial Sequence
  Synthetic DNA
taatccaaaacactatag

SEQ ID NO: 24834 - DNA, 18 bp, Artificial Sequence
  Synthetic DNA
taatccgaatctctgtag

SEQ ID NO: 24835 - DNA, 18 bp, Artificial Sequence
  Synthetic DNA
taatccgactcttcatag

SEQ ID NO: 24836 - DNA, 18 bp, Artificial Sequence
  Synthetic DNA
taatccgagttactttag

SEQ ID NO: 24837 - DNA, 18 bp, Artificial Sequence
  Synthetic DNA
taatccgattcaataaag

SEQ ID NO: 24838 - DNA, 18 bp, Artificial Sequence
  Synthetic DNA
taatccggctcacttaag

SEQ ID NO: 24839 - DNA, 18 bp, Artificial Sequence
  Synthetic DNA
taatccgtctcactaccg

SEQ ID NO: 24840 - DNA, 18 bp, Artificial Sequence
  Synthetic DNA
taatccgtctttctatag

SEQ ID NO: 24841 - DNA, 18 bp, Artificial Sequence
  Synthetic DNA
taatctgacgcacaatag

SEQ ID NO: 24842 - DNA, 18 bp, Artificial Sequence
  Synthetic DNA
taatctgtctcactatgg

SEQ ID NO: 24843 - DNA, 18 bp, Artificial Sequence
  Synthetic DNA
taatgagactctctttag

SEQ ID NO: 24844 - DNA, 18 bp, Artificial Sequence
  Synthetic DNA
taatgcaaatcactaaag

SEQ ID NO: 24845 - DNA, 18 bp, Artificial Sequence
  Synthetic DNA
taatgcacctcactttag

SEQ ID NO: 24846 - DNA, 18 bp, Artificial Sequence
  Synthetic DNA
taatgccactcattacag

SEQ ID NO: 24847 - DNA, 18 bp, Artificial Sequence
  Synthetic DNA
taatgcgaatcactagcg

SEQ ID NO: 24848 - DNA, 18 bp, Artificial Sequence
  Synthetic DNA
taatgcgaattactttag

SEQ ID NO: 24849 - DNA, 18 bp, Artificial Sequence
  Synthetic DNA
taatgcgccacactaaag

SEQ ID NO: 24850 - DNA, 18 bp, Artificial Sequence
  Synthetic DNA
taatgcggctcactggag

SEQ ID NO: 24851 - DNA, 18 bp, Artificial Sequence
  Synthetic DNA
taatgcgtttcaatatag

SEQ ID NO: 24852 - DNA, 18 bp, Artificial Sequence
  Synthetic DNA
taatgcgtttgactatag

SEQ ID NO: 24853 - DNA, 18 bp, Artificial Sequence
  Synthetic DNA
taatgggactcacttaag

SEQ ID NO: 24854 - DNA, 18 bp, Artificial Sequence
  Synthetic DNA
tacaacaactcactaaag

SEQ ID NO: 24855 - DNA, 18 bp, Artificial Sequence
  Synthetic DNA
tacaacgactcaatttag

SEQ ID NO: 24856 - DNA, 18 bp, Artificial Sequence
  Synthetic DNA
tacaacgactcacaatcg

SEQ ID NO: 24857 - DNA, 18 bp, Artificial Sequence
  Synthetic DNA
taccacaactaactatag

SEQ ID NO: 24858 - DNA, 18 bp, Artificial Sequence
  Synthetic DNA
taccacgtctctctatag

SEQ ID NO: 24859 - DNA, 18 bp, Artificial Sequence
  Synthetic DNA
tacgacgactctccatag

SEQ ID NO: 24860 - DNA, 18 bp, Artificial Sequence
  Synthetic DNA
tactaagacacactgtag

SEQ ID NO: 24861 - DNA, 18 bp, Artificial Sequence
  Synthetic DNA
tactaagactcactaagg

SEQ ID NO: 24862 - DNA, 18 bp, Artificial Sequence
  Synthetic DNA
tactaagactccctatgg

SEQ ID NO: 24863 - DNA, 18 bp, Artificial Sequence
  Synthetic DNA
tactaagactctctaaag

SEQ ID NO: 24864 - DNA, 18 bp, Artificial Sequence
  Synthetic DNA
tactaagtctcaatatag

SEQ ID NO: 24865 - DNA, 18 bp, Artificial Sequence
  Synthetic DNA
tactacaaatcactttag

SEQ ID NO: 24866 - DNA, 18 bp, Artificial Sequence
  Synthetic DNA
tactacaactccctatcg

SEQ ID NO: 24867 - DNA, 18 bp, Artificial Sequence
  Synthetic DNA
tactacgacctactatcg

SEQ ID NO: 24868 - DNA, 18 bp, Artificial Sequence
  Synthetic DNA
tactacgactctgaatag

SEQ ID NO: 24869 - DNA, 18 bp, Artificial Sequence
  Synthetic DNA
tactacgattaacaatag

SEQ ID NO: 24870 - DNA, 18 bp, Artificial Sequence
  Synthetic DNA
tactacgattctctgtag

SEQ ID NO: 24871 - DNA, 18 bp, Artificial Sequence
  Synthetic DNA
tactacgcctcactagcg

SEQ ID NO: 24872 - DNA, 18 bp, Artificial Sequence
  Synthetic DNA
tactacgtcatactatag

SEQ ID NO: 24873 - DNA, 18 bp, Artificial Sequence
  Synthetic DNA
tactacgtctccctaaag

SEQ ID NO: 24874 - DNA, 18 bp, Artificial Sequence
  Synthetic DNA
tactacgtttcaatatag

SEQ ID NO: 24875 - DNA, 18 bp, Artificial Sequence
  Synthetic DNA
tactactaaacactatag

SEQ ID NO: 24876 - DNA, 18 bp, Artificial Sequence
  Synthetic DNA
tactactactctccatag

SEQ ID NO: 24877 - DNA, 18 bp, Artificial Sequence
  Synthetic DNA
tactaggaatcactagag

SEQ ID NO: 24878 - DNA, 18 bp, Artificial Sequence
  Synthetic DNA
tactatgattcacaatag

SEQ ID NO: 24879 - DNA, 18 bp, Artificial Sequence
  Synthetic DNA
tactccgactctcaatag

SEQ ID NO: 24880 - DNA, 18 bp, Artificial Sequence
  Synthetic DNA
tagaacgacacattatag

SEQ ID NO: 24881 - DNA, 18 bp, Artificial Sequence
  Synthetic DNA
tagaacgactcacttaag

SEQ ID NO: 24882 - DNA, 18 bp, Artificial Sequence
  Synthetic DNA
tagtaagactctctatgg

SEQ ID NO: 24883 - DNA, 18 bp, Artificial Sequence
  Synthetic DNA
tagtacagctcactatcg

SEQ ID NO: 24884 - DNA, 18 bp, Artificial Sequence
  Synthetic DNA
tagtacgacccagtatcg

SEQ ID NO: 24885 - DNA, 18 bp, Artificial Sequence
  Synthetic DNA
tagtacgactctcactag

SEQ ID NO: 24886 - DNA, 18 bp, Artificial Sequence
  Synthetic DNA
tagtactactaactttag

SEQ ID NO: 24887 - DNA, 18 bp, Artificial Sequence
  Synthetic DNA
tagtaggattcaatatag

SEQ ID NO: 24888 - DNA, 18 bp, Artificial Sequence
  Synthetic DNA
tagtatccctcactatag

SEQ ID NO: 24889 - DNA, 18 bp, Artificial Sequence
  Synthetic DNA
tagtccgattcagtatag

SEQ ID NO: 24890 - DNA, 18 bp, Artificial Sequence
  Synthetic DNA
tataaagactaactatag

SEQ ID NO: 24891 - DNA, 18 bp, Artificial Sequence
  Synthetic DNA
tataaggactaactatag

SEQ ID NO: 24892 - DNA, 18 bp, Artificial Sequence
  Synthetic DNA
tataccgactcactctag

SEQ ID NO: 24893 - DNA, 18 bp, Artificial Sequence
  Synthetic DNA
tatcatgacacactatag

SEQ ID NO: 24894 - DNA, 18 bp, Artificial Sequence
  Synthetic DNA
tatcccggctcactatag

SEQ ID NO: 24895 - DNA, 18 bp, Artificial Sequence
  Synthetic DNA
tatgactactctctatag

SEQ ID NO: 24896 - DNA, 18 bp, Artificial Sequence
  Synthetic DNA
tattaaaacgcactatag

SEQ ID NO: 24897 - DNA, 18 bp, Artificial Sequence
  Synthetic DNA
tattaagagccactatag

SEQ ID NO: 24898 - DNA, 18 bp, Artificial Sequence
  Synthetic DNA
tattacaacgcactttag

SEQ ID NO: 24899 - DNA, 18 bp, Artificial Sequence
  Synthetic DNA
tattacaactcccgatag

SEQ ID NO: 24900 - DNA, 18 bp, Artificial Sequence
  Synthetic DNA
tattacaactgaatatag

SEQ ID NO: 24901 - DNA, 18 bp, Artificial Sequence
  Synthetic DNA
tattacaactgactacag

SEQ ID NO: 24902 - DNA, 18 bp, Artificial Sequence
  Synthetic DNA
tattacaactgtctatag

SEQ ID NO: 24903 - DNA, 18 bp, Artificial Sequence
  Synthetic DNA
tattaccagtcactatgg

SEQ ID NO: 24904 - DNA, 18 bp, Artificial Sequence
  Synthetic DNA
tattacgaatcaccacag

SEQ ID NO: 24905 - DNA, 18 bp, Artificial Sequence
  Synthetic DNA
tattacgacactctagag

SEQ ID NO: 24906 - DNA, 18 bp, Artificial Sequence
  Synthetic DNA
tattacgacgccctttag

SEQ ID NO: 24907 - DNA, 18 bp, Artificial Sequence
  Synthetic DNA
tattacgactacttatag

SEQ ID NO: 24908 - DNA, 18 bp, Artificial Sequence
  Synthetic DNA
tattacgactcacaccag

SEQ ID NO: 24909 - DNA, 18 bp, Artificial Sequence
  Synthetic DNA
tattacgactctcaatgg

SEQ ID NO: 24910 - DNA, 18 bp, Artificial Sequence
  Synthetic DNA
tattacgacttacactag

SEQ ID NO: 24911 - DNA, 18 bp, Artificial Sequence
  Synthetic DNA
tattacgacttattctag

SEQ ID NO: 24912 - DNA, 18 bp, Artificial Sequence
  Synthetic DNA
tattacgagacactagag

SEQ ID NO: 24913 - DNA, 18 bp, Artificial Sequence
  Synthetic DNA
tattacgagccactaaag

SEQ ID NO: 24914 - DNA, 18 bp, Artificial Sequence
  Synthetic DNA
tattacgcctcacaatgg

SEQ ID NO: 24915 - DNA, 18 bp, Artificial Sequence
  Synthetic DNA
tattacgtaccactatag

SEQ ID NO: 24916 - DNA, 18 bp, Artificial Sequence
  Synthetic DNA
tattactacatactatag

SEQ ID NO: 24917 - DNA, 18 bp, Artificial Sequence
  Synthetic DNA
tattactactcacactag

SEQ ID NO: 24918 - DNA, 18 bp, Artificial Sequence
  Synthetic DNA
tattactactcattagag

SEQ ID NO: 24919 - DNA, 18 bp, Artificial Sequence
  Synthetic DNA
tattactactctccatag

SEQ ID NO: 24920 - DNA, 18 bp, Artificial Sequence
  Synthetic DNA
tattaggaatcactaaag

SEQ ID NO: 24921 - DNA, 18 bp, Artificial Sequence
  Synthetic DNA
tattaggactctctttag

SEQ ID NO: 24922 - DNA, 18 bp, Artificial Sequence
  Synthetic DNA
tattaggacttactaaag

SEQ ID NO: 24923 - DNA, 18 bp, Artificial Sequence
  Synthetic DNA
tattaggacttactttag

SEQ ID NO: 24924 - DNA, 18 bp, Artificial Sequence
  Synthetic DNA
tattatgacacactagag

SEQ ID NO: 24925 - DNA, 18 bp, Artificial Sequence
  Synthetic DNA
tattatgtgtcactatag

SEQ ID NO: 24926 - DNA, 18 bp, Artificial Sequence
  Synthetic DNA
tattattactcactagag

SEQ ID NO: 24927 - DNA, 18 bp, Artificial Sequence
  Synthetic DNA
tattccaactcattatag

SEQ ID NO: 24928 - DNA, 18 bp, Artificial Sequence
  Synthetic DNA
tattcccactcacaatag

SEQ ID NO: 24929 - DNA, 18 bp, Artificial Sequence
  Synthetic DNA
tattgcagctcactatag

SEQ ID NO: 24930 - DNA, 18 bp, Artificial Sequence
  Synthetic DNA
tattgcgactaacgatag

SEQ ID NO: 24931 - DNA, 18 bp, Artificial Sequence
  Synthetic DNA
tattgcgactcagtttag

SEQ ID NO: 24932 - DNA, 18 bp, Artificial Sequence
  Synthetic DNA
tattgcgagacactatag

SEQ ID NO: 24933 - DNA, 18 bp, Artificial Sequence
  Synthetic DNA
tcaaatgactcaatatag

SEQ ID NO: 24934 - DNA, 18 bp, Artificial Sequence
  Synthetic DNA
tcacacgacccattatag

SEQ ID NO: 24935 - DNA, 18 bp, Artificial Sequence
  Synthetic DNA
tcacacgattccctatag

SEQ ID NO: 24936 - DNA, 18 bp, Artificial Sequence
  Synthetic DNA
tcacatgactctctatag

SEQ ID NO: 24937 - DNA, 18 bp, Artificial Sequence
  Synthetic DNA
tcataagaatcactatcg

SEQ ID NO: 24938 - DNA, 18 bp, Artificial Sequence
  Synthetic DNA
tcataagattcactaaag

SEQ ID NO: 24939 - DNA, 18 bp, Artificial Sequence
  Synthetic DNA
tcatacaaatcaatatag

SEQ ID NO: 24940 - DNA, 18 bp, Artificial Sequence
  Synthetic DNA
tcatacacctcactaaag

SEQ ID NO: 24941 - DNA, 18 bp, Artificial Sequence
  Synthetic DNA
tcatacacctctctatag

SEQ ID NO: 24942 - DNA, 18 bp, Artificial Sequence
  Synthetic DNA
tcatacgaataactatgg

SEQ ID NO: 24943 - DNA, 18 bp, Artificial Sequence
  Synthetic DNA
tcatacgacactcaatag

SEQ ID NO: 24944 - DNA, 18 bp, Artificial Sequence
  Synthetic DNA
tcatacgaccctctttag

SEQ ID NO: 24945 - DNA, 18 bp, Artificial Sequence
  Synthetic DNA
tcatacgactaagtataa

SEQ ID NO: 24946 - DNA, 18 bp, Artificial Sequence
  Synthetic DNA
tcatacgactctctcaag

SEQ ID NO: 24947 - DNA, 18 bp, Artificial Sequence
  Synthetic DNA
tcatacgagtcaatgtag

SEQ ID NO: 24948 - DNA, 18 bp, Artificial Sequence
  Synthetic DNA
tcatacgatccacaatag

SEQ ID NO: 24949 - DNA, 18 bp, Artificial Sequence
  Synthetic DNA
tcatacgcatcactttag

SEQ ID NO: 24950 - DNA, 18 bp, Artificial Sequence
  Synthetic DNA
tcatacggctcattaaag

SEQ ID NO: 24951 - DNA, 18 bp, Artificial Sequence
  Synthetic DNA
tcatacgtctcacgttag

SEQ ID NO: 24952 - DNA, 18 bp, Artificial Sequence
  Synthetic DNA
tcatacgtctctatatag

SEQ ID NO: 24953 - DNA, 18 bp, Artificial Sequence
  Synthetic DNA
tcataggacacaatatag

SEQ ID NO: 24954 - DNA, 18 bp, Artificial Sequence
  Synthetic DNA
tcataggtctcactttag

SEQ ID NO: 24955 - DNA, 18 bp, Artificial Sequence
  Synthetic DNA
tcatatgacttattatag

SEQ ID NO: 24956 - DNA, 18 bp, Artificial Sequence
  Synthetic DNA
tcatatgcctctctatag

SEQ ID NO: 24957 - DNA, 18 bp, Artificial Sequence
  Synthetic DNA
tcatatgtcacactatag

SEQ ID NO: 24958 - DNA, 18 bp, Artificial Sequence
  Synthetic DNA
tcatccgagtcattatag

SEQ ID NO: 24959 - DNA, 18 bp, Artificial Sequence
  Synthetic DNA
tcatcctcctcactatag

SEQ ID NO: 24960 - DNA, 18 bp, Artificial Sequence
  Synthetic DNA
tcctacgactctttatag

SEQ ID NO: 24961 - DNA, 18 bp, Artificial Sequence
  Synthetic DNA
tcctaggactctctatag

SEQ ID NO: 24962 - DNA, 18 bp, Artificial Sequence
  Synthetic DNA
tcttacgactcataatag

SEQ ID NO: 24963 - DNA, 18 bp, Artificial Sequence
  Synthetic DNA
tcttacgactctttatag

SEQ ID NO: 24964 - DNA, 18 bp, Artificial Sequence
  Synthetic DNA
tgaaccgactcactatcg

SEQ ID NO: 24965 - DNA, 18 bp, Artificial Sequence
  Synthetic DNA
tgacaagactcattatag

SEQ ID NO: 24966 - DNA, 18 bp, Artificial Sequence
  Synthetic DNA
tgacacgacttcctatag

SEQ ID NO: 24967 - DNA, 18 bp, Artificial Sequence
  Synthetic DNA
tgacacgtctcaatatag

SEQ ID NO: 24968 - DNA, 18 bp, Artificial Sequence
  Synthetic DNA
tgataagtctcagtatag

SEQ ID NO: 24969 - DNA, 18 bp, Artificial Sequence
  Synthetic DNA
tgataagtctctctatag

SEQ ID NO: 24970 - DNA, 18 bp, Artificial Sequence
  Synthetic DNA
tgatacatctcactagag

SEQ ID NO: 24971 - DNA, 18 bp, Artificial Sequence
  Synthetic DNA
tgatacatctgactatag

SEQ ID NO: 24972 - DNA, 18 bp, Artificial Sequence
  Synthetic DNA
tgataccattcactagag

SEQ ID NO: 24973 - DNA, 18 bp, Artificial Sequence
  Synthetic DNA
tgatacgactctatatcg

SEQ ID NO: 24974 - DNA, 18 bp, Artificial Sequence
  Synthetic DNA
tgatacgactctcttaag

SEQ ID NO: 24975 - DNA, 18 bp, Artificial Sequence
  Synthetic DNA
tgatacgccttaccatag

SEQ ID NO: 24976 - DNA, 18 bp, Artificial Sequence
  Synthetic DNA
tgatacggctcattttag

SEQ ID NO: 24977 - DNA, 18 bp, Artificial Sequence
  Synthetic DNA
tgatacgtctcaatatcg

SEQ ID NO: 24978 - DNA, 18 bp, Artificial Sequence
  Synthetic DNA
tgatacgtcttactacag

SEQ ID NO: 24979 - DNA, 18 bp, Artificial Sequence
  Synthetic DNA
tgatactactcacattag

SEQ ID NO: 24980 - DNA, 18 bp, Artificial Sequence
  Synthetic DNA
tgatagtaatcactatag

SEQ ID NO: 24981 - DNA, 18 bp, Artificial Sequence
  Synthetic DNA
tgatatgactaaccatag

SEQ ID NO: 24982 - DNA, 18 bp, Artificial Sequence
  Synthetic DNA
tgatcctacacactatag

SEQ ID NO: 24983 - DNA, 18 bp, Artificial Sequence
  Synthetic DNA
tgctacgtctcacaatag

SEQ ID NO: 24984 - DNA, 18 bp, Artificial Sequence
  Synthetic DNA
tggtacgacacactgtag

SEQ ID NO: 24985 - DNA, 18 bp, Artificial Sequence
  Synthetic DNA
tggtacgcctctctatag

SEQ ID NO: 24986 - DNA, 18 bp, Artificial Sequence
  Synthetic DNA
tgtaacgactccctatag

SEQ ID NO: 24987 - DNA, 18 bp, Artificial Sequence
  Synthetic DNA
tgtcacgactcactatcg

SEQ ID NO: 24988 - DNA, 18 bp, Artificial Sequence
  Synthetic DNA
tgttacgactaactttag

SEQ ID NO: 24989 - DNA, 18 bp, Artificial Sequence
  Synthetic DNA
tgttacgactcactacgg

SEQ ID NO: 24990 - DNA, 18 bp, Artificial Sequence
  Synthetic DNA
tgttacgactcattttag

SEQ ID NO: 24991 - DNA, 18 bp, Artificial Sequence
  Synthetic DNA
tgttactactccctatag

SEQ ID NO: 24992 - DNA, 18 bp, Artificial Sequence
  Synthetic DNA
tgttccgactcactacag

SEQ ID NO: 24993 - DNA, 18 bp, Artificial Sequence
  Synthetic DNA
tgttgcgactcactttag

SEQ ID NO: 24994 - DNA, 18 bp, Artificial Sequence
  Synthetic DNA
ttaaaagactccctatag

SEQ ID NO: 24995 - DNA, 18 bp, Artificial Sequence
  Synthetic DNA
ttaaacgaatcacaatag

SEQ ID NO: 24996 - DNA, 18 bp, Artificial Sequence
  Synthetic DNA
ttaaacgactctctagag

SEQ ID NO: 24997 - DNA, 18 bp, Artificial Sequence
  Synthetic DNA
ttaaacgtctccctatag

SEQ ID NO: 24998 - DNA, 18 bp, Artificial Sequence
  Synthetic DNA
ttaaatgcctcactatag

SEQ ID NO: 24999 - DNA, 18 bp, Artificial Sequence
  Synthetic DNA
ttaagcgactcaccatag

SEQ ID NO: 25000 - DNA, 18 bp, Artificial Sequence
  Synthetic DNA
ttacacgactcaataaag

SEQ ID NO: 25001 - DNA, 18 bp, Artificial Sequence
  Synthetic DNA
ttataagaatctctatag

SEQ ID NO: 25002 - DNA, 18 bp, Artificial Sequence
  Synthetic DNA
ttataagacgcactaaag

SEQ ID NO: 25003 - DNA, 18 bp, Artificial Sequence
  Synthetic DNA
ttataagactcattgtag

SEQ ID NO: 25004 - DNA, 18 bp, Artificial Sequence
  Synthetic DNA
ttataagtctcacgatag

SEQ ID NO: 25005 - DNA, 18 bp, Artificial Sequence
  Synthetic DNA
ttataatactcactatgg

SEQ ID NO: 25006 - DNA, 18 bp, Artificial Sequence
  Synthetic DNA
ttatacaactaactatgg

SEQ ID NO: 25007 - DNA, 18 bp, Artificial Sequence
  Synthetic DNA
ttatacatctcactgtag

SEQ ID NO: 25008 - DNA, 18 bp, Artificial Sequence
  Synthetic DNA
ttataccactcactgcag

SEQ ID NO: 25009 - DNA, 18 bp, Artificial Sequence
  Synthetic DNA
ttatacgaatcaatctag

SEQ ID NO: 25010 - DNA, 18 bp, Artificial Sequence
  Synthetic DNA
ttatacgaatcagaatag

SEQ ID NO: 25011 - DNA, 18 bp, Artificial Sequence
  Synthetic DNA
ttatacgactcagcctag

SEQ ID NO: 25012 - DNA, 18 bp, Artificial Sequence
  Synthetic DNA
ttatacgagtcagaatag

SEQ ID NO: 25013 - DNA, 18 bp, Artificial Sequence
  Synthetic DNA
ttatacgatccaccatag

SEQ ID NO: 25014 - DNA, 18 bp, Artificial Sequence
  Synthetic DNA
ttatacgattctgtatag

SEQ ID NO: 25015 - DNA, 18 bp, Artificial Sequence
  Synthetic DNA
ttatacgatttactatgg

SEQ ID NO: 25016 - DNA, 18 bp, Artificial Sequence
  Synthetic DNA
ttatacgcctgactaaag

SEQ ID NO: 25017 - DNA, 18 bp, Artificial Sequence
  Synthetic DNA
ttatacggctccctttag

SEQ ID NO: 25018 - DNA, 18 bp, Artificial Sequence
  Synthetic DNA
ttatacggctctccatag

SEQ ID NO: 25019 - DNA, 18 bp, Artificial Sequence
  Synthetic DNA
ttatacgtctcagaatag

SEQ ID NO: 25020 - DNA, 18 bp, Artificial Sequence
  Synthetic DNA
ttatactaatcactttag

SEQ ID NO: 25021 - DNA, 18 bp, Artificial Sequence
  Synthetic DNA
ttatactacttactctag

SEQ ID NO: 25022 - DNA, 18 bp, Artificial Sequence
  Synthetic DNA
ttatactagtcaatatag

SEQ ID NO: 25023 - DNA, 18 bp, Artificial Sequence
  Synthetic DNA
ttataggaccaactatag

SEQ ID NO: 25024 - DNA, 18 bp, Artificial Sequence
  Synthetic DNA
ttataggactcactcgag

SEQ ID NO: 25025 - DNA, 18 bp, Artificial Sequence
  Synthetic DNA
ttataggatacactatag

SEQ ID NO: 25026 - DNA, 18 bp, Artificial Sequence
  Synthetic DNA
ttatatgaattactatag

SEQ ID NO: 25027 - DNA, 18 bp, Artificial Sequence
  Synthetic DNA
ttatatgactccctttag

SEQ ID NO: 25028 - DNA, 18 bp, Artificial Sequence
  Synthetic DNA
ttatatgacttactgtag

SEQ ID NO: 25029 - DNA, 18 bp, Artificial Sequence
  Synthetic DNA
ttatatgattcactagag

SEQ ID NO: 25030 - DNA, 18 bp, Artificial Sequence
  Synthetic DNA
ttatatgcctcaccatag

SEQ ID NO: 25031 - DNA, 18 bp, Artificial Sequence
  Synthetic DNA
ttatccgagttactatag

SEQ ID NO: 25032 - DNA, 18 bp, Artificial Sequence
  Synthetic DNA
ttatcctactcacaatag

SEQ ID NO: 25033 - DNA, 18 bp, Artificial Sequence
  Synthetic DNA
ttatgcgaatcactttag

SEQ ID NO: 25034 - DNA, 18 bp, Artificial Sequence
  Synthetic DNA
ttatgcgactcacaacag

SEQ ID NO: 25035 - DNA, 18 bp, Artificial Sequence
  Synthetic DNA
ttatgcgactcacactag

SEQ ID NO: 25036 - DNA, 18 bp, Artificial Sequence
  Synthetic DNA
ttatgcgactgactaaag

SEQ ID NO: 25037 - DNA, 18 bp, Artificial Sequence
  Synthetic DNA
ttccaagactcactatag

SEQ ID NO: 25038 - DNA, 18 bp, Artificial Sequence
  Synthetic DNA
ttctaagattcactatag

SEQ ID NO: 25039 - DNA, 18 bp, Artificial Sequence
  Synthetic DNA
ttgtaccactcagtatag

SEQ ID NO: 25040 - DNA, 18 bp, Artificial Sequence
  Synthetic DNA
ttgtacgacttactatgg

SEQ ID NO: 25041 - DNA, 18 bp, Artificial Sequence
  Synthetic DNA
ttgtacggttcactatag

SEQ ID NO: 25042 - DNA, 18 bp, Artificial Sequence
  Synthetic DNA
ttttacgactcagtacag

SEQ ID NO: 25043 - DNA, 18 bp, Artificial Sequence
  Synthetic DNA
ttttacgattcactctag

SEQ ID NO: 25044 - DNA, 18 bp, Artificial Sequence
  Synthetic DNA
ttttagaactcactatag

SEQ ID NO: 25045 - DNA, 18 bp, Artificial Sequence
  Synthetic DNA
ttttccaactcactatag

SEQ ID NO: 25046 - DNA, 18 bp, Artificial Sequence
  Synthetic DNA
taattcaacacactaaag

SEQ ID NO: 25047 - DNA, 18 bp, Artificial Sequence
  Synthetic DNA
taaaacgactcataattg

SEQ ID NO: 25048 - DNA, 18 bp, Artificial Sequence
  Synthetic DNA
ttataccaatcactattg

SEQ ID NO: 25049 - DNA, 18 bp, Artificial Sequence
  Synthetic DNA
aattacgcctcactaaag

SEQ ID NO: 25050 - DNA, 18 bp, Artificial Sequence
  Synthetic DNA
tattacgaatctctttag

SEQ ID NO: 25051 - DNA, 18 bp, Artificial Sequence
  Synthetic DNA
tcatacgactctctttcg

SEQ ID NO: 25052 - DNA, 18 bp, Artificial Sequence
  Synthetic DNA
ttatacgacttaatttag

SEQ ID NO: 25053 - DNA, 18 bp, Artificial Sequence
  Synthetic DNA
ttatacgtttcattatag

SEQ ID NO: 25054 - DNA, 18 bp, Artificial Sequence
  Synthetic DNA
tattacgactagctattg

SEQ ID NO: 25055 - DNA, 18 bp, Artificial Sequence
  Synthetic DNA
taataccaaacactattg

SEQ ID NO: 25056 - DNA, 18 bp, Artificial Sequence
  Synthetic DNA
taatgcgactcacctttg

SEQ ID NO: 25057 - DNA, 18 bp, Artificial Sequence
  Synthetic DNA
ttaaacgtctcgctatag

SEQ ID NO: 25058 - DNA, 18 bp, Artificial Sequence
  Synthetic DNA
aaatacgactctcaaaag

SEQ ID NO: 25059 - DNA, 18 bp, Artificial Sequence
  Synthetic DNA
atataggactcaatatag

SEQ ID NO: 25060 - DNA, 18 bp, Artificial Sequence
  Synthetic DNA
taacacgactgtctttag

SEQ ID NO: 25061 - DNA, 18 bp, Artificial Sequence
  Synthetic DNA
tattaagactctctctag

SEQ ID NO: 25062 - DNA, 18 bp, Artificial Sequence
  Synthetic DNA
ttaaacgactaactttag

SEQ ID NO: 25063 - DNA, 18 bp, Artificial Sequence
  Synthetic DNA
ttaaacgattcacaatag

SEQ ID NO: 25064 - DNA, 18 bp, Artificial Sequence
  Synthetic DNA
ttatacgtctcactaacg

SEQ ID NO: 25065 - DNA, 18 bp, Artificial Sequence
  Synthetic DNA
taatacgtctctttaaag

SEQ ID NO: 25066 - DNA, 18 bp, Artificial Sequence
  Synthetic DNA
tattacgactctcactag

SEQ ID NO: 25067 - DNA, 18 bp, Artificial Sequence
  Synthetic DNA
taattcgactcatcattg

SEQ ID NO: 25068 - DNA, 18 bp, Artificial Sequence
  Synthetic DNA
tattttgactcactattg

SEQ ID NO: 25069 - DNA, 18 bp, Artificial Sequence
  Synthetic DNA
tcattcgactcaatattg

SEQ ID NO: 25070 - DNA, 18 bp, Artificial Sequence
  Synthetic DNA
aaatacgactctgtattg

SEQ ID NO: 25071 - DNA, 18 bp, Artificial Sequence
  Synthetic DNA
aaattcgaataactatag

SEQ ID NO: 25072 - DNA, 18 bp, Artificial Sequence
  Synthetic DNA
aaattcgtctcactatcg

SEQ ID NO: 25073 - DNA, 18 bp, Artificial Sequence
  Synthetic DNA
atattcgactcactgtag

SEQ ID NO: 25074 - DNA, 18 bp, Artificial Sequence
  Synthetic DNA
taaaaggattcactattg

SEQ ID NO: 25075 - DNA, 18 bp, Artificial Sequence
  Synthetic DNA
taatacaactgagtattg

SEQ ID NO: 25076 - DNA, 18 bp, Artificial Sequence
  Synthetic DNA
taatacgacactctcttg

SEQ ID NO: 25077 - DNA, 18 bp, Artificial Sequence
  Synthetic DNA
taatcagactcacttttg

SEQ ID NO: 25078 - DNA, 18 bp, Artificial Sequence
  Synthetic DNA
taattccactcacattag

SEQ ID NO: 25079 - DNA, 18 bp, Artificial Sequence
  Synthetic DNA
tactacgactcacttctg

SEQ ID NO: 25080 - DNA, 18 bp, Artificial Sequence
  Synthetic DNA
tatatcgactcattatag

SEQ ID NO: 25081 - DNA, 18 bp, Artificial Sequence
  Synthetic DNA
tattacgcctcacttttg

SEQ ID NO: 25082 - DNA, 18 bp, Artificial Sequence
  Synthetic DNA
tattacgtctcactagtg

SEQ ID NO: 25083 - DNA, 18 bp, Artificial Sequence
  Synthetic DNA
tcaatcaactcactatag

SEQ ID NO: 25084 - DNA, 18 bp, Artificial Sequence
  Synthetic DNA
tgagacgacacactattg

SEQ ID NO: 25085 - DNA, 18 bp, Artificial Sequence
  Synthetic DNA
tgataagattcactattg

SEQ ID NO: 25086 - DNA, 18 bp, Artificial Sequence
  Synthetic DNA
tggtacgactctctattg

SEQ ID NO: 25087 - DNA, 18 bp, Artificial Sequence
  Synthetic DNA
ttaaacgcctcgctatag

SEQ ID NO: 25088 - DNA, 18 bp, Artificial Sequence
  Synthetic DNA
ttatacgactctctagtg

SEQ ID NO: 25089 - DNA, 18 bp, Artificial Sequence
  Synthetic DNA
ttatacgcctcattattg

SEQ ID NO: 25090 - DNA, 18 bp, Artificial Sequence
  Synthetic DNA
ttataggacttactattg

SEQ ID NO: 25091 - DNA, 18 bp, Artificial Sequence
  Synthetic DNA
ttattcgactcactcaag

SEQ ID NO: 25092 - DNA, 18 bp, Artificial Sequence
  Synthetic DNA
ttattctactcaatatag

SEQ ID NO: 25093 - DNA, 18 bp, Artificial Sequence
  Synthetic DNA
aaatacaactcacattag

SEQ ID NO: 25094 - DNA, 18 bp, Artificial Sequence
  Synthetic DNA
aaatactacttaccatag

SEQ ID NO: 25095 - DNA, 18 bp, Artificial Sequence
  Synthetic DNA
aattacgattaactatag

SEQ ID NO: 25096 - DNA, 18 bp, Artificial Sequence
  Synthetic DNA
atatacaactccctatag

SEQ ID NO: 25097 - DNA, 18 bp, Artificial Sequence
  Synthetic DNA
atatccgactcacaatag

SEQ ID NO: 25098 - DNA, 18 bp, Artificial Sequence
  Synthetic DNA
caatacgactctgtaaag

SEQ ID NO: 25099 - DNA, 18 bp, Artificial Sequence
  Synthetic DNA
caatacgatactctatag

SEQ ID NO: 25100 - DNA, 18 bp, Artificial Sequence
  Synthetic DNA
cattaccactctctatag

SEQ ID NO: 25101 - DNA, 18 bp, Artificial Sequence
  Synthetic DNA
ctatacgactcattttag

SEQ ID NO: 25102 - DNA, 18 bp, Artificial Sequence
  Synthetic DNA
ctatacgacttactttag

SEQ ID NO: 25103 - DNA, 18 bp, Artificial Sequence
  Synthetic DNA
ctttacgactaactatag

SEQ ID NO: 25104 - DNA, 18 bp, Artificial Sequence
  Synthetic DNA
taaaacgaattactaaag

SEQ ID NO: 25105 - DNA, 18 bp, Artificial Sequence
  Synthetic DNA
taaaacttctccctatag

SEQ ID NO: 25106 - DNA, 18 bp, Artificial Sequence
  Synthetic DNA
taacacgagtcaatatcg

SEQ ID NO: 25107 - DNA, 18 bp, Artificial Sequence
  Synthetic DNA
taataagactctcactag

SEQ ID NO: 25108 - DNA, 18 bp, Artificial Sequence
  Synthetic DNA
taataataatcactttag

SEQ ID NO: 25109 - DNA, 18 bp, Artificial Sequence
  Synthetic DNA
taatacaaatcacttaag

SEQ ID NO: 25110 - DNA, 18 bp, Artificial Sequence
  Synthetic DNA
taatacaaatctctaaag

SEQ ID NO: 25111 - DNA, 18 bp, Artificial Sequence
  Synthetic DNA
taatacaacactcaatag

SEQ ID NO: 25112 - DNA, 18 bp, Artificial Sequence
  Synthetic DNA
taatacatctcagtaaag

SEQ ID NO: 25113 - DNA, 18 bp, Artificial Sequence
  Synthetic DNA
taatacatctgactgtag

SEQ ID NO: 25114 - DNA, 18 bp, Artificial Sequence
  Synthetic DNA
taatacgactaaacttag

SEQ ID NO: 25115 - DNA, 18 bp, Artificial Sequence
  Synthetic DNA
taatacgactcatatcag

SEQ ID NO: 25116 - DNA, 18 bp, Artificial Sequence
  Synthetic DNA
taatacgactctcactcg

SEQ ID NO: 25117 - DNA, 18 bp, Artificial Sequence
  Synthetic DNA
taatacgattcacagaag

SEQ ID NO: 25118 - DNA, 18 bp, Artificial Sequence
  Synthetic DNA
taatacggctctcactag

SEQ ID NO: 25119 - DNA, 18 bp, Artificial Sequence
  Synthetic DNA
taatacgtattactacag

SEQ ID NO: 25120 - DNA, 18 bp, Artificial Sequence
  Synthetic DNA
taatacgtcaaactagag

SEQ ID NO: 25121 - DNA, 18 bp, Artificial Sequence
  Synthetic DNA
taatacgtttcaccaaag

SEQ ID NO: 25122 - DNA, 18 bp, Artificial Sequence
  Synthetic DNA
taatactacactatatag

SEQ ID NO: 25123 - DNA, 18 bp, Artificial Sequence
  Synthetic DNA
taatactatttactgtag

SEQ ID NO: 25124 - DNA, 18 bp, Artificial Sequence
  Synthetic DNA
taatacttctatctatag

SEQ ID NO: 25125 - DNA, 18 bp, Artificial Sequence
  Synthetic DNA
taatatgactaattctag

SEQ ID NO: 25126 - DNA, 18 bp, Artificial Sequence
  Synthetic DNA
taatatgactgacaaaag

SEQ ID NO: 25127 - DNA, 18 bp, Artificial Sequence
  Synthetic DNA
taatccgactatatatag

SEQ ID NO: 25128 - DNA, 18 bp, Artificial Sequence
  Synthetic DNA
taatccgattcactcaag

SEQ ID NO: 25129 - DNA, 18 bp, Artificial Sequence
  Synthetic DNA
taatctgcatcactatag

SEQ ID NO: 25130 - DNA, 18 bp, Artificial Sequence
  Synthetic DNA
taatgcgtctcaccttag

SEQ ID NO: 25131 - DNA, 18 bp, Artificial Sequence
  Synthetic DNA
tacaacgactcagtttag

SEQ ID NO: 25132 - DNA, 18 bp, Artificial Sequence
  Synthetic DNA
tataacaactcacaatag

SEQ ID NO: 25133 - DNA, 18 bp, Artificial Sequence
  Synthetic DNA
tattaagtctcaatatag

SEQ ID NO: 25134 - DNA, 18 bp, Artificial Sequence
  Synthetic DNA
tattacgactcacaaacg

SEQ ID NO: 25135 - DNA, 18 bp, Artificial Sequence
  Synthetic DNA
tattacgtgtcattatag

SEQ ID NO: 25136 - DNA, 18 bp, Artificial Sequence
  Synthetic DNA
tattactactcagtaaag

SEQ ID NO: 25137 - DNA, 18 bp, Artificial Sequence
  Synthetic DNA
tattatgtctcactgtag

SEQ ID NO: 25138 - DNA, 18 bp, Artificial Sequence
  Synthetic DNA
tattgcgactcactttgg

SEQ ID NO: 25139 - DNA, 18 bp, Artificial Sequence
  Synthetic DNA
tcatacaagtcactttag

SEQ ID NO: 25140 - DNA, 18 bp, Artificial Sequence
  Synthetic DNA
tcatacaattcactttag

SEQ ID NO: 25141 - DNA, 18 bp, Artificial Sequence
  Synthetic DNA
tcataccactcattaaag

SEQ ID NO: 25142 - DNA, 18 bp, Artificial Sequence
  Synthetic DNA
ttacattactcactatag

SEQ ID NO: 25143 - DNA, 18 bp, Artificial Sequence
  Synthetic DNA
ttatacgactaaccacag

SEQ ID NO: 25144 - DNA, 18 bp, Artificial Sequence
  Synthetic DNA
ttatacgagtcactaacg

SEQ ID NO: 25145 - DNA, 18 bp, Artificial Sequence
  Synthetic DNA
ttatacgagtctcaatag

SEQ ID NO: 25146 - DNA, 18 bp, Artificial Sequence
  Synthetic DNA
ttatacggatcactatcg

SEQ ID NO: 25147 - DNA, 18 bp, Artificial Sequence
  Synthetic DNA
ttatacggctctctttag

SEQ ID NO: 25148 - DNA, 18 bp, Artificial Sequence
  Synthetic DNA
ttatacgtctaactctag

SEQ ID NO: 25149 - DNA, 18 bp, Artificial Sequence
  Synthetic DNA
ttatacgtctcagtttag

SEQ ID NO: 25150 - DNA, 18 bp, Artificial Sequence
  Synthetic DNA
ttatacgtctcattctag

SEQ ID NO: 25151 - DNA, 18 bp, Artificial Sequence
  Synthetic DNA
ttatacgtttcactctag

SEQ ID NO: 25152 - DNA, 18 bp, Artificial Sequence
  Synthetic DNA
ttatactacctactatag

SEQ ID NO: 25153 - DNA, 18 bp, Artificial Sequence
  Synthetic DNA
ttatgcaactcactaaag

SEQ ID NO: 25154 - DNA, 18 bp, Artificial Sequence
  Synthetic DNA
ttctacgactgacaatag

SEQ ID NO: 25155 - DNA, 18 bp, Artificial Sequence
  Synthetic DNA
ttgtaccactcactttag

SEQ ID NO: 25156 - DNA, 18 bp, Artificial Sequence
  Synthetic DNA
ttttacttctcactatag

SEQ ID NO: 25157 - DNA, 18 bp, Artificial Sequence
  Synthetic DNA
ttatttgactctctatag

SEQ ID NO: 25158 - DNA, 18 bp, Artificial Sequence
  Synthetic DNA
tataacgactctttatag

SEQ ID NO: 25159 - DNA, 18 bp, Artificial Sequence
  Synthetic DNA
taaaaggactcacttttg

SEQ ID NO: 25160 - DNA, 18 bp, Artificial Sequence
  Synthetic DNA
taatacgtctctatattg

SEQ ID NO: 25161 - DNA, 18 bp, Artificial Sequence
  Synthetic DNA
taatactactcactgatg

SEQ ID NO: 25162 - DNA, 18 bp, Artificial Sequence
  Synthetic DNA
taattagactctctatgg

SEQ ID NO: 25163 - DNA, 18 bp, Artificial Sequence
  Synthetic DNA
tatgatgactcactattg

SEQ ID NO: 25164 - DNA, 18 bp, Artificial Sequence
  Synthetic DNA
aattatgactcactttag

SEQ ID NO: 25165 - DNA, 18 bp, Artificial Sequence
  Synthetic DNA
ctatacgactctctttag

SEQ ID NO: 25166 - DNA, 18 bp, Artificial Sequence
  Synthetic DNA
taaaactacactctatag

SEQ ID NO: 25167 - DNA, 18 bp, Artificial Sequence
  Synthetic DNA
tattacgaacctctatag

SEQ ID NO: 25168 - DNA, 18 bp, Artificial Sequence
  Synthetic DNA
ttataggacttattatag

SEQ ID NO: 25169 - DNA, 18 bp, Artificial Sequence
  Synthetic DNA
taaatagactctctatag

SEQ ID NO: 25170 - DNA, 18 bp, Artificial Sequence
  Synthetic DNA
taaatcgacacaccatag

SEQ ID NO: 25171 - DNA, 18 bp, Artificial Sequence
  Synthetic DNA
ttatacgtcaaactatag

SEQ ID NO: 25172 - DNA, 18 bp, Artificial Sequence
  Synthetic DNA
ttatacgtctctctattg

SEQ ID NO: 25173 - DNA, 18 bp, Artificial Sequence
  Synthetic DNA
ttataagactctctttag

SEQ ID NO: 25174 - DNA, 18 bp, Artificial Sequence
  Synthetic DNA
tattacgattcacttaag

SEQ ID NO: 25175 - DNA, 18 bp, Artificial Sequence
  Synthetic DNA
taattctactcactaatg

SEQ ID NO: 25176 - DNA, 18 bp, Artificial Sequence
  Synthetic DNA
taaatcgacttactacag

SEQ ID NO: 25177 - DNA, 18 bp, Artificial Sequence
  Synthetic DNA
taacacgattcacttttg

SEQ ID NO: 25178 - DNA, 18 bp, Artificial Sequence
  Synthetic DNA
taatactattcacttttg

SEQ ID NO: 25179 - DNA, 18 bp, Artificial Sequence
  Synthetic DNA
tattacgactcaataatg

SEQ ID NO: 25180 - DNA, 18 bp, Artificial Sequence
  Synthetic DNA
tatttcaactcactctag

SEQ ID NO: 25181 - DNA, 18 bp, Artificial Sequence
  Synthetic DNA
taaaacgatacactacag

SEQ ID NO: 25182 - DNA, 18 bp, Artificial Sequence
  Synthetic DNA
taaaatgactctctaaag

SEQ ID NO: 25183 - DNA, 18 bp, Artificial Sequence
  Synthetic DNA
taaaatgattcactttag

SEQ ID NO: 25184 - DNA, 18 bp, Artificial Sequence
  Synthetic DNA
tataacgatttactatag

SEQ ID NO: 25185 - DNA, 18 bp, Artificial Sequence
  Synthetic DNA
tattacatctcattatag

SEQ ID NO: 25186 - DNA, 18 bp, Artificial Sequence
  Synthetic DNA
tcatacgactctcaaaag

SEQ ID NO: 25187 - DNA, 18 bp, Artificial Sequence
  Synthetic DNA
ttatactactttctatag

SEQ ID NO: 25188 - DNA, 18 bp, Artificial Sequence
  Synthetic DNA
caattcgactccctattg

SEQ ID NO: 25189 - DNA, 18 bp, Artificial Sequence
  Synthetic DNA
taaatcgactcactgttg

SEQ ID NO: 25190 - DNA, 18 bp, Artificial Sequence
  Synthetic DNA
taactcgactcaccattg

SEQ ID NO: 25191 - DNA, 18 bp, Artificial Sequence
  Synthetic DNA
taatagaactcgctattg

SEQ ID NO: 25192 - DNA, 18 bp, Artificial Sequence
  Synthetic DNA
taataggactcgctgttg

SEQ ID NO: 25193 - DNA, 18 bp, Artificial Sequence
  Synthetic DNA
taattcgacacacgattg

SEQ ID NO: 25194 - DNA, 18 bp, Artificial Sequence
  Synthetic DNA
taattcgacccattattg

SEQ ID NO: 25195 - DNA, 18 bp, Artificial Sequence
  Synthetic DNA
taattcgactcaatagtg

SEQ ID NO: 25196 - DNA, 18 bp, Artificial Sequence
  Synthetic DNA
taattcgactctctgttg

SEQ ID NO: 25197 - DNA, 18 bp, Artificial Sequence
  Synthetic DNA
taattctacacgctatag

SEQ ID NO: 25198 - DNA, 18 bp, Artificial Sequence
  Synthetic DNA
taattctactcacgattg

SEQ ID NO: 25199 - DNA, 18 bp, Artificial Sequence
  Synthetic DNA
taattctactcactagtg

SEQ ID NO: 25200 - DNA, 18 bp, Artificial Sequence
  Synthetic DNA
tatgacgactcgctattg

SEQ ID NO: 25201 - DNA, 18 bp, Artificial Sequence
  Synthetic DNA
tatttcgactcaatattg

SEQ ID NO: 25202 - DNA, 18 bp, Artificial Sequence
  Synthetic DNA
tcattcgactcactactg

SEQ ID NO: 25203 - DNA, 18 bp, Artificial Sequence
  Synthetic DNA
aaactcgactcattatag

SEQ ID NO: 25204 - DNA, 18 bp, Artificial Sequence
  Synthetic DNA
aaataagactcagtattg

SEQ ID NO: 25205 - DNA, 18 bp, Artificial Sequence
  Synthetic DNA
aaatacgaatcactcttg

SEQ ID NO: 25206 - DNA, 18 bp, Artificial Sequence
  Synthetic DNA
aaatacgacccactcttg

SEQ ID NO: 25207 - DNA, 18 bp, Artificial Sequence
  Synthetic DNA
aaatacgactagctatgg

SEQ ID NO: 25208 - DNA, 18 bp, Artificial Sequence
  Synthetic DNA
aaatacgtctcagtattg

SEQ ID NO: 25209 - DNA, 18 bp, Artificial Sequence
  Synthetic DNA
aaatatcactcactattg

SEQ ID NO: 25210 - DNA, 18 bp, Artificial Sequence
  Synthetic DNA
aattaggactcactattg

SEQ ID NO: 25211 - DNA, 18 bp, Artificial Sequence
  Synthetic DNA
aatttagactcactatag

SEQ ID NO: 25212 - DNA, 18 bp, Artificial Sequence
  Synthetic DNA
agatacgacttactattg

SEQ ID NO: 25213 - DNA, 18 bp, Artificial Sequence
  Synthetic DNA
agattcgacacactatag

SEQ ID NO: 25214 - DNA, 18 bp, Artificial Sequence
  Synthetic DNA
agattcgactctctatag

SEQ ID NO: 25215 - DNA, 18 bp, Artificial Sequence
  Synthetic DNA
atataagactcgctatag

SEQ ID NO: 25216 - DNA, 18 bp, Artificial Sequence
  Synthetic DNA
caacacaactcactattg

SEQ ID NO: 25217 - DNA, 18 bp, Artificial Sequence
  Synthetic DNA
caataagtctcactattg

SEQ ID NO: 25218 - DNA, 18 bp, Artificial Sequence
  Synthetic DNA
caatacgactcgttaaag

SEQ ID NO: 25219 - DNA, 18 bp, Artificial Sequence
  Synthetic DNA
caatacgactctcaattg

SEQ ID NO: 25220 - DNA, 18 bp, Artificial Sequence
  Synthetic DNA
caattagactcattatag

SEQ ID NO: 25221 - DNA, 18 bp, Artificial Sequence
  Synthetic DNA
caattcgactcaaaatag

SEQ ID NO: 25222 - DNA, 18 bp, Artificial Sequence
  Synthetic DNA
caattcgactctctctag

SEQ ID NO: 25223 - DNA, 18 bp, Artificial Sequence
  Synthetic DNA
caattcgagacactatag

SEQ ID NO: 25224 - DNA, 18 bp, Artificial Sequence
  Synthetic DNA
caattcgtctaactatag

SEQ ID NO: 25225 - DNA, 18 bp, Artificial Sequence
  Synthetic DNA
ctactcgactcactatag

SEQ ID NO: 25226 - DNA, 18 bp, Artificial Sequence
  Synthetic DNA
ctatacgactcactgttg

SEQ ID NO: 25227 - DNA, 18 bp, Artificial Sequence
  Synthetic DNA
gaatacaactaactattg

SEQ ID NO: 25228 - DNA, 18 bp, Artificial Sequence
  Synthetic DNA
gcatacgactcattattg

SEQ ID NO: 25229 - DNA, 18 bp, Artificial Sequence
  Synthetic DNA
taaaacgaatcactaatg

SEQ ID NO: 25230 - DNA, 18 bp, Artificial Sequence
  Synthetic DNA
taaaacgactcgatctag

SEQ ID NO: 25231 - DNA, 18 bp, Artificial Sequence
  Synthetic DNA
taaaacgactcgctttcg

SEQ ID NO: 25232 - DNA, 18 bp, Artificial Sequence
  Synthetic DNA
taaaacgactctcgattg

SEQ ID NO: 25233 - DNA, 18 bp, Artificial Sequence
  Synthetic DNA
taaaaggaatcactattg

SEQ ID NO: 25234 - DNA, 18 bp, Artificial Sequence
  Synthetic DNA
taaataggctcactatag

SEQ ID NO: 25235 - DNA, 18 bp, Artificial Sequence
  Synthetic DNA
taaatccactcactagag

SEQ ID NO: 25236 - DNA, 18 bp, Artificial Sequence
  Synthetic DNA
taaatctacgcactatag

SEQ ID NO: 25237 - DNA, 18 bp, Artificial Sequence
  Synthetic DNA
taacacaactcacaattg

SEQ ID NO: 25238 - DNA, 18 bp, Artificial Sequence
  Synthetic DNA
taacacgactatctattg

SEQ ID NO: 25239 - DNA, 18 bp, Artificial Sequence
  Synthetic DNA
taacacgactttctattg

SEQ ID NO: 25240 - DNA, 18 bp, Artificial Sequence
  Synthetic DNA
taacacgcctcgctctag

SEQ ID NO: 25241 - DNA, 18 bp, Artificial Sequence
  Synthetic DNA
taactcaactcactctag

SEQ ID NO: 25242 - DNA, 18 bp, Artificial Sequence
  Synthetic DNA
taacttgactctctatag

SEQ ID NO: 25243 - DNA, 18 bp, Artificial Sequence
  Synthetic DNA
taacttgagtcactatag

SEQ ID NO: 25244 - DNA, 18 bp, Artificial Sequence
  Synthetic DNA
taagactactcacaattg

SEQ ID NO: 25245 - DNA, 18 bp, Artificial Sequence
  Synthetic DNA
taataacactaactattg

SEQ ID NO: 25246 - DNA, 18 bp, Artificial Sequence
  Synthetic DNA
taataagacgcacttttg

SEQ ID NO: 25247 - DNA, 18 bp, Artificial Sequence
  Synthetic DNA
taataagactaattattg

SEQ ID NO: 25248 - DNA, 18 bp, Artificial Sequence
  Synthetic DNA
taataagacttactagtg

SEQ ID NO: 25249 - DNA, 18 bp, Artificial Sequence
  Synthetic DNA
taatacaactaaatattg

SEQ ID NO: 25250 - DNA, 18 bp, Artificial Sequence
  Synthetic DNA
taatacaacttaatattg

SEQ ID NO: 25251 - DNA, 18 bp, Artificial Sequence
  Synthetic DNA
taatacaacttactcttg

SEQ ID NO: 25252 - DNA, 18 bp, Artificial Sequence
  Synthetic DNA
taatacaattccctattg

SEQ ID NO: 25253 - DNA, 18 bp, Artificial Sequence
  Synthetic DNA
taataccacaaactattg

SEQ ID NO: 25254 - DNA, 18 bp, Artificial Sequence
  Synthetic DNA
taataccacactctattg

SEQ ID NO: 25255 - DNA, 18 bp, Artificial Sequence
  Synthetic DNA
taataccacgcacttttg

SEQ ID NO: 25256 - DNA, 18 bp, Artificial Sequence
  Synthetic DNA
taataccatacactattg

SEQ ID NO: 25257 - DNA, 18 bp, Artificial Sequence
  Synthetic DNA
taataccatacgctatag

SEQ ID NO: 25258 - DNA, 18 bp, Artificial Sequence
  Synthetic DNA
taataccattcaatattg

SEQ ID NO: 25259 - DNA, 18 bp, Artificial Sequence
  Synthetic DNA
taatacgaagcactgttg

SEQ ID NO: 25260 - DNA, 18 bp, Artificial Sequence
  Synthetic DNA
taatacgacccagaattg

SEQ ID NO: 25261 - DNA, 18 bp, Artificial Sequence
  Synthetic DNA
taatacgacccatttttg

SEQ ID NO: 25262 - DNA, 18 bp, Artificial Sequence
  Synthetic DNA
taatacgactaacctttg

SEQ ID NO: 25263 - DNA, 18 bp, Artificial Sequence
  Synthetic DNA
taatacgactaacgaatg

SEQ ID NO: 25264 - DNA, 18 bp, Artificial Sequence
  Synthetic DNA
taatacgactgtcaattg

SEQ ID NO: 25265 - DNA, 18 bp, Artificial Sequence
  Synthetic DNA
taatacgactgtttattg

SEQ ID NO: 25266 - DNA, 18 bp, Artificial Sequence
  Synthetic DNA
taatacgacttacgaatg

SEQ ID NO: 25267 - DNA, 18 bp, Artificial Sequence
  Synthetic DNA
taatacgacttgatgtag

SEQ ID NO: 25268 - DNA, 18 bp, Artificial Sequence
  Synthetic DNA
taatacgagacgcaatag

SEQ ID NO: 25269 - DNA, 18 bp, Artificial Sequence
  Synthetic DNA
taatacgagtcactgatg

SEQ ID NO: 25270 - DNA, 18 bp, Artificial Sequence
  Synthetic DNA
taatacgagtcgatttag

SEQ ID NO: 25271 - DNA, 18 bp, Artificial Sequence
  Synthetic DNA
taatacgccacaatattg

SEQ ID NO: 25272 - DNA, 18 bp, Artificial Sequence
  Synthetic DNA
taatacggatcagtattg

SEQ ID NO: 25273 - DNA, 18 bp, Artificial Sequence
  Synthetic DNA
taatacgtctcgctaagg

SEQ ID NO: 25274 - DNA, 18 bp, Artificial Sequence
  Synthetic DNA
taatacgtctgactaatg

SEQ ID NO: 25275 - DNA, 18 bp, Artificial Sequence
  Synthetic DNA
taatacgttgcactattg

SEQ ID NO: 25276 - DNA, 18 bp, Artificial Sequence
  Synthetic DNA
taatactacacgctttag

SEQ ID NO: 25277 - DNA, 18 bp, Artificial Sequence
  Synthetic DNA
taatactactcatttttg

SEQ ID NO: 25278 - DNA, 18 bp, Artificial Sequence
  Synthetic DNA
taatactactgactactg

SEQ ID NO: 25279 - DNA, 18 bp, Artificial Sequence
  Synthetic DNA
taatactcctcaatattg

SEQ ID NO: 25280 - DNA, 18 bp, Artificial Sequence
  Synthetic DNA
taatactgcacactattg

SEQ ID NO: 25281 - DNA, 18 bp, Artificial Sequence
  Synthetic DNA
taataggactcactgctg

SEQ ID NO: 25282 - DNA, 18 bp, Artificial Sequence
  Synthetic DNA
taataggactcggtaaag

SEQ ID NO: 25283 - DNA, 18 bp, Artificial Sequence
  Synthetic DNA
taataggactctcgattg

SEQ ID NO: 25284 - DNA, 18 bp, Artificial Sequence
  Synthetic DNA
taatagggcacactattg

SEQ ID NO: 25285 - DNA, 18 bp, Artificial Sequence
  Synthetic DNA
taataggtctcaatattg

SEQ ID NO: 25286 - DNA, 18 bp, Artificial Sequence
  Synthetic DNA
taatataactcactatta

SEQ ID NO: 25287 - DNA, 18 bp, Artificial Sequence
  Synthetic DNA
taatatgaccaactattg

SEQ ID NO: 25288 - DNA, 18 bp, Artificial Sequence
  Synthetic DNA
taatatggctaactattg

SEQ ID NO: 25289 - DNA, 18 bp, Artificial Sequence
  Synthetic DNA
taatatggctcggtatag

SEQ ID NO: 25290 - DNA, 18 bp, Artificial Sequence
  Synthetic DNA
taatatttctcactattg

SEQ ID NO: 25291 - DNA, 18 bp, Artificial Sequence
  Synthetic DNA
taatccgaatcgctttag

SEQ ID NO: 25292 - DNA, 18 bp, Artificial Sequence
  Synthetic DNA
taatccgactaactaatg

SEQ ID NO: 25293 - DNA, 18 bp, Artificial Sequence
  Synthetic DNA
taatgcgacggactattg

SEQ ID NO: 25294 - DNA, 18 bp, Artificial Sequence
  Synthetic DNA
taatgcgactaacttttg

SEQ ID NO: 25295 - DNA, 18 bp, Artificial Sequence
  Synthetic DNA
taatgcgactcaataatg

SEQ ID NO: 25296 - DNA, 18 bp, Artificial Sequence
  Synthetic DNA
taatgcgactctttattg

SEQ ID NO: 25297 - DNA, 18 bp, Artificial Sequence
  Synthetic DNA
taatgtgactcgctaaag

SEQ ID NO: 25298 - DNA, 18 bp, Artificial Sequence
  Synthetic DNA
taatgtgcctcactattg

SEQ ID NO: 25299 - DNA, 18 bp, Artificial Sequence
  Synthetic DNA
taattagacacaatatag

SEQ ID NO: 25300 - DNA, 18 bp, Artificial Sequence
  Synthetic DNA
taattagactcaatatcg

SEQ ID NO: 25301 - DNA, 18 bp, Artificial Sequence
  Synthetic DNA
taattaggctcactttag

SEQ ID NO: 25302 - DNA, 18 bp, Artificial Sequence
  Synthetic DNA
taattagtctcactgtag

SEQ ID NO: 25303 - DNA, 18 bp, Artificial Sequence
  Synthetic DNA
taattcaacacactacag

SEQ ID NO: 25304 - DNA, 18 bp, Artificial Sequence
  Synthetic DNA
taattccactctctaaag

SEQ ID NO: 25305 - DNA, 18 bp, Artificial Sequence
  Synthetic DNA
taattcgaatatctatag

SEQ ID NO: 25306 - DNA, 18 bp, Artificial Sequence
  Synthetic DNA
taattcgacacaagatag

SEQ ID NO: 25307 - DNA, 18 bp, Artificial Sequence
  Synthetic DNA
taattcgacaccctttag

SEQ ID NO: 25308 - DNA, 18 bp, Artificial Sequence
  Synthetic DNA
taattcgacccactttcg

SEQ ID NO: 25309 - DNA, 18 bp, Artificial Sequence
  Synthetic DNA
taattcgactaaaaatag

SEQ ID NO: 25310 - DNA, 18 bp, Artificial Sequence
  Synthetic DNA
taattcgactcactcgcg

SEQ ID NO: 25311 - DNA, 18 bp, Artificial Sequence
  Synthetic DNA
taattcgactcacttccg

SEQ ID NO: 25312 - DNA, 18 bp, Artificial Sequence
  Synthetic DNA
taattcgacttaatatcg

SEQ ID NO: 25313 - DNA, 18 bp, Artificial Sequence
  Synthetic DNA
taattcgagttaatatag

SEQ ID NO: 25314 - DNA, 18 bp, Artificial Sequence
  Synthetic DNA
taattcgattttctatag

SEQ ID NO: 25315 - DNA, 18 bp, Artificial Sequence
  Synthetic DNA
taattctaataactatag

SEQ ID NO: 25316 - DNA, 18 bp, Artificial Sequence
  Synthetic DNA
taattctacacattatag

SEQ ID NO: 25317 - DNA, 18 bp, Artificial Sequence
  Synthetic DNA
taattctacccactaaag

SEQ ID NO: 25318 - DNA, 18 bp, Artificial Sequence
  Synthetic DNA
taatttcactcactttag

SEQ ID NO: 25319 - DNA, 18 bp, Artificial Sequence
  Synthetic DNA
taatttgactaactctag

SEQ ID NO: 25320 - DNA, 18 bp, Artificial Sequence
  Synthetic DNA
taatttgactcaccacag

SEQ ID NO: 25321 - DNA, 18 bp, Artificial Sequence
  Synthetic DNA
taatttgtctcactagag

SEQ ID NO: 25322 - DNA, 18 bp, Artificial Sequence
  Synthetic DNA
taatttgtcttactatag

SEQ ID NO: 25323 - DNA, 18 bp, Artificial Sequence
  Synthetic DNA
taattttactcagtatag

SEQ ID NO: 25324 - DNA, 18 bp, Artificial Sequence
  Synthetic DNA
tacatcgactcattatag

SEQ ID NO: 25325 - DNA, 18 bp, Artificial Sequence
  Synthetic DNA
tactacgactctctactg

SEQ ID NO: 25326 - DNA, 18 bp, Artificial Sequence
  Synthetic DNA
tactacgcctcgctatgg

SEQ ID NO: 25327 - DNA, 18 bp, Artificial Sequence
  Synthetic DNA
tactatgactcacaattg

SEQ ID NO: 25328 - DNA, 18 bp, Artificial Sequence
  Synthetic DNA
tacttcgacacactaaag

SEQ ID NO: 25329 - DNA, 18 bp, Artificial Sequence
  Synthetic DNA
tacttcgtatcactatag

SEQ ID NO: 25330 - DNA, 18 bp, Artificial Sequence
  Synthetic DNA
tactttgactcactttag

SEQ ID NO: 25331 - DNA, 18 bp, Artificial Sequence
  Synthetic DNA
tagaactactcactattg

SEQ ID NO: 25332 - DNA, 18 bp, Artificial Sequence
  Synthetic DNA
tagtaagactccctattg

SEQ ID NO: 25333 - DNA, 18 bp, Artificial Sequence
  Synthetic DNA
tagtaccactcgctatgg

SEQ ID NO: 25334 - DNA, 18 bp, Artificial Sequence
  Synthetic DNA
tagtacgactcacttctg

SEQ ID NO: 25335 - DNA, 18 bp, Artificial Sequence
  Synthetic DNA
tagtacgacttactactg

SEQ ID NO: 25336 - DNA, 18 bp, Artificial Sequence
  Synthetic DNA
tagtacgattcaccattg

SEQ ID NO: 25337 - DNA, 18 bp, Artificial Sequence
  Synthetic DNA
tagtactactcattattg

SEQ ID NO: 25338 - DNA, 18 bp, Artificial Sequence
  Synthetic DNA
tagttcgactcacactag

SEQ ID NO: 25339 - DNA, 18 bp, Artificial Sequence
  Synthetic DNA
tagttcgactcattctag

SEQ ID NO: 25340 - DNA, 18 bp, Artificial Sequence
  Synthetic DNA
tagttcgagtaactatag

SEQ ID NO: 25341 - DNA, 18 bp, Artificial Sequence
  Synthetic DNA
tagtttgaatcactatag

SEQ ID NO: 25342 - DNA, 18 bp, Artificial Sequence
  Synthetic DNA
tagtttgtctcactatag

SEQ ID NO: 25343 - DNA, 18 bp, Artificial Sequence
  Synthetic DNA
tataaagactcactattg

SEQ ID NO: 25344 - DNA, 18 bp, Artificial Sequence
  Synthetic DNA
tatcacgaatcactattg

SEQ ID NO: 25345 - DNA, 18 bp, Artificial Sequence
  Synthetic DNA
tatcacgactcactactg

SEQ ID NO: 25346 - DNA, 18 bp, Artificial Sequence
  Synthetic DNA
tatcatgactcgctatag

SEQ ID NO: 25347 - DNA, 18 bp, Artificial Sequence
  Synthetic DNA
tatgacgattcactattg

SEQ ID NO: 25348 - DNA, 18 bp, Artificial Sequence
  Synthetic DNA
tattaagcctcactattg

SEQ ID NO: 25349 - DNA, 18 bp, Artificial Sequence
  Synthetic DNA
tattacgactcgaaatag

SEQ ID NO: 25350 - DNA, 18 bp, Artificial Sequence
  Synthetic DNA
tattacgactcgcaacag

SEQ ID NO: 25351 - DNA, 18 bp, Artificial Sequence
  Synthetic DNA
tattacgccttactattg

SEQ ID NO: 25352 - DNA, 18 bp, Artificial Sequence
  Synthetic DNA
tattacggctcaccattg

SEQ ID NO: 25353 - DNA, 18 bp, Artificial Sequence
  Synthetic DNA
tattaggacacgctatag

SEQ ID NO: 25354 - DNA, 18 bp, Artificial Sequence
  Synthetic DNA
tattaggactcacaattg

SEQ ID NO: 25355 - DNA, 18 bp, Artificial Sequence
  Synthetic DNA
tattatgcctcactattg

SEQ ID NO: 25356 - DNA, 18 bp, Artificial Sequence
  Synthetic DNA
tatttcgacgcactttag

SEQ ID NO: 25357 - DNA, 18 bp, Artificial Sequence
  Synthetic DNA
tatttcgccacactatag

SEQ ID NO: 25358 - DNA, 18 bp, Artificial Sequence
  Synthetic DNA
tcaaacgacacactattg

SEQ ID NO: 25359 - DNA, 18 bp, Artificial Sequence
  Synthetic DNA
tcaatcgactcactttag

SEQ ID NO: 25360 - DNA, 18 bp, Artificial Sequence
  Synthetic DNA
tcatacgaccctctattg

SEQ ID NO: 25361 - DNA, 18 bp, Artificial Sequence
  Synthetic DNA
tcatacgtgtcactattg

SEQ ID NO: 25362 - DNA, 18 bp, Artificial Sequence
  Synthetic DNA
tcattcaacccactatag

SEQ ID NO: 25363 - DNA, 18 bp, Artificial Sequence
  Synthetic DNA
tcgtatgactcactattg

SEQ ID NO: 25364 - DNA, 18 bp, Artificial Sequence
  Synthetic DNA
tcgttcgcctcactatag

SEQ ID NO: 25365 - DNA, 18 bp, Artificial Sequence
  Synthetic DNA
tcttacgactcactcttg

SEQ ID NO: 25366 - DNA, 18 bp, Artificial Sequence
  Synthetic DNA
tgaatcgactcactttag

SEQ ID NO: 25367 - DNA, 18 bp, Artificial Sequence
  Synthetic DNA
tgagacgactgactattg

SEQ ID NO: 25368 - DNA, 18 bp, Artificial Sequence
  Synthetic DNA
tgatacgactcacaaatg

SEQ ID NO: 25369 - DNA, 18 bp, Artificial Sequence
  Synthetic DNA
tgatacgatttactattg

SEQ ID NO: 25370 - DNA, 18 bp, Artificial Sequence
  Synthetic DNA
tgatccgactcattattg

SEQ ID NO: 25371 - DNA, 18 bp, Artificial Sequence
  Synthetic DNA
tgattagactcactgtag

SEQ ID NO: 25372 - DNA, 18 bp, Artificial Sequence
  Synthetic DNA
tgattcaactaactatag

SEQ ID NO: 25373 - DNA, 18 bp, Artificial Sequence
  Synthetic DNA
tgattcaactcactttag

SEQ ID NO: 25374 - DNA, 18 bp, Artificial Sequence
  Synthetic DNA
tgattcgactcaccatgg

SEQ ID NO: 25375 - DNA, 18 bp, Artificial Sequence
  Synthetic DNA
tgattcgactcattttag

SEQ ID NO: 25376 - DNA, 18 bp, Artificial Sequence
  Synthetic DNA
tgattcgccacactatag

SEQ ID NO: 25377 - DNA, 18 bp, Artificial Sequence
  Synthetic DNA
ttaaacggctcactattg

SEQ ID NO: 25378 - DNA, 18 bp, Artificial Sequence
  Synthetic DNA
ttacacgactaactattg

SEQ ID NO: 25379 - DNA, 18 bp, Artificial Sequence
  Synthetic DNA
ttagccgactcactattg

SEQ ID NO: 25380 - DNA, 18 bp, Artificial Sequence
  Synthetic DNA
ttatacaacccgctatag

SEQ ID NO: 25381 - DNA, 18 bp, Artificial Sequence
  Synthetic DNA
ttatacaactcactgttg

SEQ ID NO: 25382 - DNA, 18 bp, Artificial Sequence
  Synthetic DNA
ttatacgaagcactattg

SEQ ID NO: 25383 - DNA, 18 bp, Artificial Sequence
  Synthetic DNA
ttatacgactcagtatta

SEQ ID NO: 25384 - DNA, 18 bp, Artificial Sequence
  Synthetic DNA
ttatacgacttactactg

SEQ ID NO: 25385 - DNA, 18 bp, Artificial Sequence
  Synthetic DNA
ttatacgattcgctgtag

SEQ ID NO: 25386 - DNA, 18 bp, Artificial Sequence
  Synthetic DNA
ttatacggctcgctaaag

SEQ ID NO: 25387 - DNA, 18 bp, Artificial Sequence
  Synthetic DNA
ttataggcctcactattg

SEQ ID NO: 25388 - DNA, 18 bp, Artificial Sequence
  Synthetic DNA
ttatcccactcactattg

SEQ ID NO: 25389 - DNA, 18 bp, Artificial Sequence
  Synthetic DNA
ttattcaactcactacag

SEQ ID NO: 25390 - DNA, 18 bp, Artificial Sequence
  Synthetic DNA
ttattccactcacaatag

SEQ ID NO: 25391 - DNA, 18 bp, Artificial Sequence
  Synthetic DNA
ttattcgacgcactttag

SEQ ID NO: 25392 - DNA, 18 bp, Artificial Sequence
  Synthetic DNA
ttattcgattcagtatag

SEQ ID NO: 25393 - DNA, 18 bp, Artificial Sequence
  Synthetic DNA
ttatttgactcactatcg

SEQ ID NO: 25394 - DNA, 18 bp, Artificial Sequence
  Synthetic DNA
tttttcgactcactatgg

SEQ ID NO: 25395 - DNA, 18 bp, Artificial Sequence
  Synthetic DNA
aaaaacgcctctctatag

SEQ ID NO: 25396 - DNA, 18 bp, Artificial Sequence
  Synthetic DNA
aaaaatgaatcactatag

SEQ ID NO: 25397 - DNA, 18 bp, Artificial Sequence
  Synthetic DNA
aaagatgacttactatag

SEQ ID NO: 25398 - DNA, 18 bp, Artificial Sequence
  Synthetic DNA
aaatacaaataactatag

SEQ ID NO: 25399 - DNA, 18 bp, Artificial Sequence
  Synthetic DNA
aaatacaacacactacag

SEQ ID NO: 25400 - DNA, 18 bp, Artificial Sequence
  Synthetic DNA
aaatacgaataactatgg

SEQ ID NO: 25401 - DNA, 18 bp, Artificial Sequence
  Synthetic DNA
aaatacgactaaatatcg

SEQ ID NO: 25402 - DNA, 18 bp, Artificial Sequence
  Synthetic DNA
aaatacgattcactaccg

SEQ ID NO: 25403 - DNA, 18 bp, Artificial Sequence
  Synthetic DNA
aaatacgattcattgtag

SEQ ID NO: 25404 - DNA, 18 bp, Artificial Sequence
  Synthetic DNA
aaatacgatttaccatag

SEQ ID NO: 25405 - DNA, 18 bp, Artificial Sequence
  Synthetic DNA
aaatacgcctcacaaaag

SEQ ID NO: 25406 - DNA, 18 bp, Artificial Sequence
  Synthetic DNA
aaatacgccttactttag

SEQ ID NO: 25407 - DNA, 18 bp, Artificial Sequence
  Synthetic DNA
aaatacgcttaactatag

SEQ ID NO: 25408 - DNA, 18 bp, Artificial Sequence
  Synthetic DNA
aaatacgtctaaatatag

SEQ ID NO: 25409 - DNA, 18 bp, Artificial Sequence
  Synthetic DNA
aaatactactccctaaag

SEQ ID NO: 25410 - DNA, 18 bp, Artificial Sequence
  Synthetic DNA
aaatactactctgtatag

SEQ ID NO: 25411 - DNA, 18 bp, Artificial Sequence
  Synthetic DNA
aaataggacacattatag

SEQ ID NO: 25412 - DNA, 18 bp, Artificial Sequence
  Synthetic DNA
aaatatgacgaactatag

SEQ ID NO: 25413 - DNA, 18 bp, Artificial Sequence
  Synthetic DNA
aaatatgactcaccaaag

SEQ ID NO: 25414 - DNA, 18 bp, Artificial Sequence
  Synthetic DNA
aaatctgaatcactatag

SEQ ID NO: 25415 - DNA, 18 bp, Artificial Sequence
  Synthetic DNA
aaatgcgactatctatag

SEQ ID NO: 25416 - DNA, 18 bp, Artificial Sequence
  Synthetic DNA
aaccacgactcaccatag

SEQ ID NO: 25417 - DNA, 18 bp, Artificial Sequence
  Synthetic DNA
aactaccaatcactatag

SEQ ID NO: 25418 - DNA, 18 bp, Artificial Sequence
  Synthetic DNA
aactacgagtcagtatag

SEQ ID NO: 25419 - DNA, 18 bp, Artificial Sequence
  Synthetic DNA
aactacggctaactatag

SEQ ID NO: 25420 - DNA, 18 bp, Artificial Sequence
  Synthetic DNA
aagaacgactcaccatag

SEQ ID NO: 25421 - DNA, 18 bp, Artificial Sequence
  Synthetic DNA
aagaaggactcactatag

SEQ ID NO: 25422 - DNA, 18 bp, Artificial Sequence
  Synthetic DNA
aagtaggtctcactatag

SEQ ID NO: 25423 - DNA, 18 bp, Artificial Sequence
  Synthetic DNA
aattacgactaactacag

SEQ ID NO: 25424 - DNA, 18 bp, Artificial Sequence
  Synthetic DNA
acacatgactcactatag

SEQ ID NO: 25425 - DNA, 18 bp, Artificial Sequence
  Synthetic DNA
acagacgactcactatcg

SEQ ID NO: 25426 - DNA, 18 bp, Artificial Sequence
  Synthetic DNA
acatacgactctctatcg

SEQ ID NO: 25427 - DNA, 18 bp, Artificial Sequence
  Synthetic DNA
acatgcgactctctatag

SEQ ID NO: 25428 - DNA, 18 bp, Artificial Sequence
  Synthetic DNA
acgtacgactcaatatag

SEQ ID NO: 25429 - DNA, 18 bp, Artificial Sequence
  Synthetic DNA
atataagcctcactatag

SEQ ID NO: 25430 - DNA, 18 bp, Artificial Sequence
  Synthetic DNA
atatacgcttcactatag

SEQ ID NO: 25431 - DNA, 18 bp, Artificial Sequence
  Synthetic DNA
atatacggctcactatgg

SEQ ID NO: 25432 - DNA, 18 bp, Artificial Sequence
  Synthetic DNA
atatacggttcactatag

SEQ ID NO: 25433 - DNA, 18 bp, Artificial Sequence
  Synthetic DNA
atatccgactcaccatag

SEQ ID NO: 25434 - DNA, 18 bp, Artificial Sequence
  Synthetic DNA
atatccgactcactttag

SEQ ID NO: 25435 - DNA, 18 bp, Artificial Sequence
  Synthetic DNA
caaaaaaactcactatag

SEQ ID NO: 25436 - DNA, 18 bp, Artificial Sequence
  Synthetic DNA
caaaacgactttctatag

SEQ ID NO: 25437 - DNA, 18 bp, Artificial Sequence
  Synthetic DNA
caagacgacccactctag

SEQ ID NO: 25438 - DNA, 18 bp, Artificial Sequence
  Synthetic DNA
caaggctactcactatag

SEQ ID NO: 25439 - DNA, 18 bp, Artificial Sequence
  Synthetic DNA
caatacaactcacttaag

SEQ ID NO: 25440 - DNA, 18 bp, Artificial Sequence
  Synthetic DNA
caatacaactgaatatag

SEQ ID NO: 25441 - DNA, 18 bp, Artificial Sequence
  Synthetic DNA
caatacatcttactatag

SEQ ID NO: 25442 - DNA, 18 bp, Artificial Sequence
  Synthetic DNA
caataccacacactgtag

SEQ ID NO: 25443 - DNA, 18 bp, Artificial Sequence
  Synthetic DNA
caatacgacatactaaag

SEQ ID NO: 25444 - DNA, 18 bp, Artificial Sequence
  Synthetic DNA
caatacgattctcaatag

SEQ ID NO: 25445 - DNA, 18 bp, Artificial Sequence
  Synthetic DNA
caatacgtatcacaatag

SEQ ID NO: 25446 - DNA, 18 bp, Artificial Sequence
  Synthetic DNA
caatactacccacaatag

SEQ ID NO: 25447 - DNA, 18 bp, Artificial Sequence
  Synthetic DNA
caatactacgctctatag

SEQ ID NO: 25448 - DNA, 18 bp, Artificial Sequence
  Synthetic DNA
caataggactctctttag

SEQ ID NO: 25449 - DNA, 18 bp, Artificial Sequence
  Synthetic DNA
caatccggctctctatag

SEQ ID NO: 25450 - DNA, 18 bp, Artificial Sequence
  Synthetic DNA
caatgcgactccatatag

SEQ ID NO: 25451 - DNA, 18 bp, Artificial Sequence
  Synthetic DNA
catcacgacttactatag

SEQ ID NO: 25452 - DNA, 18 bp, Artificial Sequence
  Synthetic DNA
cattacaaatcactatag

SEQ ID NO: 25453 - DNA, 18 bp, Artificial Sequence
  Synthetic DNA
cattacgaatctctatag

SEQ ID NO: 25454 - DNA, 18 bp, Artificial Sequence
  Synthetic DNA
cattacgactgtctatag

SEQ ID NO: 25455 - DNA, 18 bp, Artificial Sequence
  Synthetic DNA
cggaacgactcactatag

SEQ ID NO: 25456 - DNA, 18 bp, Artificial Sequence
  Synthetic DNA
ctacacgacacactatag

SEQ ID NO: 25457 - DNA, 18 bp, Artificial Sequence
  Synthetic DNA
ctatacgaatcactatcg

SEQ ID NO: 25458 - DNA, 18 bp, Artificial Sequence
  Synthetic DNA
ctatacgacccactttag

SEQ ID NO: 25459 - DNA, 18 bp, Artificial Sequence
  Synthetic DNA
ctatatgactcacgatag

SEQ ID NO: 25460 - DNA, 18 bp, Artificial Sequence
  Synthetic DNA
gaaaacgacacacaatag

SEQ ID NO: 25461 - DNA, 18 bp, Artificial Sequence
  Synthetic DNA
gaacacgtctcaatatag

SEQ ID NO: 25462 - DNA, 18 bp, Artificial Sequence
  Synthetic DNA
gaatatgacatactatag

SEQ ID NO: 25463 - DNA, 18 bp, Artificial Sequence
  Synthetic DNA
gtatgcgactcaatatag

SEQ ID NO: 25464 - DNA, 18 bp, Artificial Sequence
  Synthetic DNA
taaaaagtctcaatatag

SEQ ID NO: 25465 - DNA, 18 bp, Artificial Sequence
  Synthetic DNA
taaaaatacacactatag

SEQ ID NO: 25466 - DNA, 18 bp, Artificial Sequence
  Synthetic DNA
taaaaatactcacaatag

SEQ ID NO: 25467 - DNA, 18 bp, Artificial Sequence
  Synthetic DNA
taaaacaactcactgaag

SEQ ID NO: 25468 - DNA, 18 bp, Artificial Sequence
  Synthetic DNA
taaaacgaatcagtacag

SEQ ID NO: 25469 - DNA, 18 bp, Artificial Sequence
  Synthetic DNA
taaaacgacaatctatag

SEQ ID NO: 25470 - DNA, 18 bp, Artificial Sequence
  Synthetic DNA
taaaacgacacattatcg

SEQ ID NO: 25471 - DNA, 18 bp, Artificial Sequence
  Synthetic DNA
taaaacgacccacaaaag

SEQ ID NO: 25472 - DNA, 18 bp, Artificial Sequence
  Synthetic DNA
taaaacgactcaaggtag

SEQ ID NO: 25473 - DNA, 18 bp, Artificial Sequence
  Synthetic DNA
taaaacgactcaataaaa

SEQ ID NO: 25474 - DNA, 18 bp, Artificial Sequence
  Synthetic DNA
taaaacgactgtttatag

SEQ ID NO: 25475 - DNA, 18 bp, Artificial Sequence
  Synthetic DNA
taaaacgacttacaacag

SEQ ID NO: 25476 - DNA, 18 bp, Artificial Sequence
  Synthetic DNA
taaaacgattcaataaag

SEQ ID NO: 25477 - DNA, 18 bp, Artificial Sequence
  Synthetic DNA
taaaacgattcaccatcg

SEQ ID NO: 25478 - DNA, 18 bp, Artificial Sequence
  Synthetic DNA
taaaacgattcattatgg

SEQ ID NO: 25479 - DNA, 18 bp, Artificial Sequence
  Synthetic DNA
taaaacgcctcacttcag

SEQ ID NO: 25480 - DNA, 18 bp, Artificial Sequence
  Synthetic DNA
taaaacgcctgacaatag

SEQ ID NO: 25481 - DNA, 18 bp, Artificial Sequence
  Synthetic DNA
taaaacgcctgagtatag

SEQ ID NO: 25482 - DNA, 18 bp, Artificial Sequence
  Synthetic DNA
taaaacggtccactatag

SEQ ID NO: 25483 - DNA, 18 bp, Artificial Sequence
  Synthetic DNA
taaaacgtatcactatcg

SEQ ID NO: 25484 - DNA, 18 bp, Artificial Sequence
  Synthetic DNA
taaaacgtctcacttcag

SEQ ID NO: 25485 - DNA, 18 bp, Artificial Sequence
  Synthetic DNA
taaaacgtgtcacaatag

SEQ ID NO: 25486 - DNA, 18 bp, Artificial Sequence
  Synthetic DNA
taaaactacacactctag

SEQ ID NO: 25487 - DNA, 18 bp, Artificial Sequence
  Synthetic DNA
taaaagcactcactaaag

SEQ ID NO: 25488 - DNA, 18 bp, Artificial Sequence
  Synthetic DNA
taaaaggacacaatatag

SEQ ID NO: 25489 - DNA, 18 bp, Artificial Sequence
  Synthetic DNA
taaaaggactaactttag

SEQ ID NO: 25490 - DNA, 18 bp, Artificial Sequence
  Synthetic DNA
taaaaggactgactctag

SEQ ID NO: 25491 - DNA, 18 bp, Artificial Sequence
  Synthetic DNA
taaaatgactcactgaag

SEQ ID NO: 25492 - DNA, 18 bp, Artificial Sequence
  Synthetic DNA
taaaatgactcattgtag

SEQ ID NO: 25493 - DNA, 18 bp, Artificial Sequence
  Synthetic DNA
taaaatgacttactaaag

SEQ ID NO: 25494 - DNA, 18 bp, Artificial Sequence
  Synthetic DNA
taaaatgtctcaccatag

SEQ ID NO: 25495 - DNA, 18 bp, Artificial Sequence
  Synthetic DNA
taaaatgtctcactgtag

SEQ ID NO: 25496 - DNA, 18 bp, Artificial Sequence
  Synthetic DNA
taaacccactcactttag

SEQ ID NO: 25497 - DNA, 18 bp, Artificial Sequence
  Synthetic DNA
taaaccgactcaataaag

SEQ ID NO: 25498 - DNA, 18 bp, Artificial Sequence
  Synthetic DNA
taaacggactaactatag

SEQ ID NO: 25499 - DNA, 18 bp, Artificial Sequence
  Synthetic DNA
taaagcgactcaatatgg

SEQ ID NO: 25500 - DNA, 18 bp, Artificial Sequence
  Synthetic DNA
taaagcgactcacactag

SEQ ID NO: 25501 - DNA, 18 bp, Artificial Sequence
  Synthetic DNA
taaagctactcacgatag

SEQ ID NO: 25502 - DNA, 18 bp, Artificial Sequence
  Synthetic DNA
taacaaaactcacgatag

SEQ ID NO: 25503 - DNA, 18 bp, Artificial Sequence
  Synthetic DNA
taacaagactcaccatcg

SEQ ID NO: 25504 - DNA, 18 bp, Artificial Sequence
  Synthetic DNA
taacaccacacactatcg

SEQ ID NO: 25505 - DNA, 18 bp, Artificial Sequence
  Synthetic DNA
taacacctctcaatatag

SEQ ID NO: 25506 - DNA, 18 bp, Artificial Sequence
  Synthetic DNA
taacacgaatcacattag

SEQ ID NO: 25507 - DNA, 18 bp, Artificial Sequence
  Synthetic DNA
taacacgacaaaccatag

SEQ ID NO: 25508 - DNA, 18 bp, Artificial Sequence
  Synthetic DNA
taacacgacccactgtcg

SEQ ID NO: 25509 - DNA, 18 bp, Artificial Sequence
  Synthetic DNA
taacacgatacactttag

SEQ ID NO: 25510 - DNA, 18 bp, Artificial Sequence
  Synthetic DNA
taacacgattctctaaag

SEQ ID NO: 25511 - DNA, 18 bp, Artificial Sequence
  Synthetic DNA
taacacgccttacaatag

SEQ ID NO: 25512 - DNA, 18 bp, Artificial Sequence
  Synthetic DNA
taacactacacactatcg

SEQ ID NO: 25513 - DNA, 18 bp, Artificial Sequence
  Synthetic DNA
taacatgacacactttag

SEQ ID NO: 25514 - DNA, 18 bp, Artificial Sequence
  Synthetic DNA
taacatgtctcactttag

SEQ ID NO: 25515 - DNA, 18 bp, Artificial Sequence
  Synthetic DNA
taagaagtctcactatcg

SEQ ID NO: 25516 - DNA, 18 bp, Artificial Sequence
  Synthetic DNA
taagacgacccaatgtag

SEQ ID NO: 25517 - DNA, 18 bp, Artificial Sequence
  Synthetic DNA
taagacgattcataatag

SEQ ID NO: 25518 - DNA, 18 bp, Artificial Sequence
  Synthetic DNA
taagacgtctcactaacg

SEQ ID NO: 25519 - DNA, 18 bp, Artificial Sequence
  Synthetic DNA
taagacgtctcataatag

SEQ ID NO: 25520 - DNA, 18 bp, Artificial Sequence
  Synthetic DNA
taataaaactctctgtag

SEQ ID NO: 25521 - DNA, 18 bp, Artificial Sequence
  Synthetic DNA
taataaaattcactgtag

SEQ ID NO: 25522 - DNA, 18 bp, Artificial Sequence
  Synthetic DNA
taataacactctatatag

SEQ ID NO: 25523 - DNA, 18 bp, Artificial Sequence
  Synthetic DNA
taataagacacaatctag

SEQ ID NO: 25524 - DNA, 18 bp, Artificial Sequence
  Synthetic DNA
taataagacactctatcg

SEQ ID NO: 25525 - DNA, 18 bp, Artificial Sequence
  Synthetic DNA
taataagacccattttag

SEQ ID NO: 25526 - DNA, 18 bp, Artificial Sequence
  Synthetic DNA
taataagactctgtagag

SEQ ID NO: 25527 - DNA, 18 bp, Artificial Sequence
  Synthetic DNA
taataagactgtctgtag

SEQ ID NO: 25528 - DNA, 18 bp, Artificial Sequence
  Synthetic DNA
taataagattcacaatgg

SEQ ID NO: 25529 - DNA, 18 bp, Artificial Sequence
  Synthetic DNA
taataagattcactacgg

SEQ ID NO: 25530 - DNA, 18 bp, Artificial Sequence
  Synthetic DNA
taataaggctcacttaag

SEQ ID NO: 25531 - DNA, 18 bp, Artificial Sequence
  Synthetic DNA
taataagtctcactcgag

SEQ ID NO: 25532 - DNA, 18 bp, Artificial Sequence
  Synthetic DNA
taataagtctcagaatag

SEQ ID NO: 25533 - DNA, 18 bp, Artificial Sequence
  Synthetic DNA
taatacaaatcactgaag

SEQ ID NO: 25534 - DNA, 18 bp, Artificial Sequence
  Synthetic DNA
taatacaacaaaccatag

SEQ ID NO: 25535 - DNA, 18 bp, Artificial Sequence
  Synthetic DNA
taatacaacaaactctag

SEQ ID NO: 25536 - DNA, 18 bp, Artificial Sequence
  Synthetic DNA
taatacaacgaactttag

SEQ ID NO: 25537 - DNA, 18 bp, Artificial Sequence
  Synthetic DNA
taatacaacgcacttcag

SEQ ID NO: 25538 - DNA, 18 bp, Artificial Sequence
  Synthetic DNA
taatacaacgtactacag

SEQ ID NO: 25539 - DNA, 18 bp, Artificial Sequence
  Synthetic DNA
taatacaactctgtatgg

SEQ ID NO: 25540 - DNA, 18 bp, Artificial Sequence
  Synthetic DNA
taatacaatgctctatag

SEQ ID NO: 25541 - DNA, 18 bp, Artificial Sequence
  Synthetic DNA
taatacagcatactatag

SEQ ID NO: 25542 - DNA, 18 bp, Artificial Sequence
  Synthetic DNA
taatacatctaaatatag

SEQ ID NO: 25543 - DNA, 18 bp, Artificial Sequence
  Synthetic DNA
taatacatctccctgtag

SEQ ID NO: 25544 - DNA, 18 bp, Artificial Sequence
  Synthetic DNA
taatacattccactatag

SEQ ID NO: 25545 - DNA, 18 bp, Artificial Sequence
  Synthetic DNA
taataccaatcaccaaag

SEQ ID NO: 25546 - DNA, 18 bp, Artificial Sequence
  Synthetic DNA
taataccaatcactaacg

SEQ ID NO: 25547 - DNA, 18 bp, Artificial Sequence
  Synthetic DNA
taataccaatctcaatag

SEQ ID NO: 25548 - DNA, 18 bp, Artificial Sequence
  Synthetic DNA
taataccaatctctgtag

SEQ ID NO: 25549 - DNA, 18 bp, Artificial Sequence
  Synthetic DNA
taataccactaataatag

SEQ ID NO: 25550 - DNA, 18 bp, Artificial Sequence
  Synthetic DNA
taataccactatatatag

SEQ ID NO: 25551 - DNA, 18 bp, Artificial Sequence
  Synthetic DNA
taataccactatcaatag

SEQ ID NO: 25552 - DNA, 18 bp, Artificial Sequence
  Synthetic DNA
taataccactcagcagag

SEQ ID NO: 25553 - DNA, 18 bp, Artificial Sequence
  Synthetic DNA
taataccattcaatttag

SEQ ID NO: 25554 - DNA, 18 bp, Artificial Sequence
  Synthetic DNA
taataccgttctctatag

SEQ ID NO: 25555 - DNA, 18 bp, Artificial Sequence
  Synthetic DNA
taatacgaatgactgaag

SEQ ID NO: 25556 - DNA, 18 bp, Artificial Sequence
  Synthetic DNA
taatacgaattagtaaag

SEQ ID NO: 25557 - DNA, 18 bp, Artificial Sequence
  Synthetic DNA
taatacgacaaacttcag

SEQ ID NO: 25558 - DNA, 18 bp, Artificial Sequence
  Synthetic DNA
taatacgacaacttatag

SEQ ID NO: 25559 - DNA, 18 bp, Artificial Sequence
  Synthetic DNA
taatacgacacaataaaa

SEQ ID NO: 25560 - DNA, 18 bp, Artificial Sequence
  Synthetic DNA
taatacgacacaccaacg

SEQ ID NO: 25561 - DNA, 18 bp, Artificial Sequence
  Synthetic DNA
taatacgacacatagtag

SEQ ID NO: 25562 - DNA, 18 bp, Artificial Sequence
  Synthetic DNA
taatacgacacattttgg

SEQ ID NO: 25563 - DNA, 18 bp, Artificial Sequence
  Synthetic DNA
taatacgaccacctaaag

SEQ ID NO: 25564 - DNA, 18 bp, Artificial Sequence
  Synthetic DNA
taatacgacccaacaaag

SEQ ID NO: 25565 - DNA, 18 bp, Artificial Sequence
  Synthetic DNA
taatacgacgctctttcg

SEQ ID NO: 25566 - DNA, 18 bp, Artificial Sequence
  Synthetic DNA
taatacgacggtctctag

SEQ ID NO: 25567 - DNA, 18 bp, Artificial Sequence
  Synthetic DNA
taatacgactaattagcg

SEQ ID NO: 25568 - DNA, 18 bp, Artificial Sequence
  Synthetic DNA
taatacgactatatgtag

SEQ ID NO: 25569 - DNA, 18 bp, Artificial Sequence
  Synthetic DNA
taatacgactatttctag

SEQ ID NO: 25570 - DNA, 18 bp, Artificial Sequence
  Synthetic DNA
taatacgacttatagtag

SEQ ID NO: 25571 - DNA, 18 bp, Artificial Sequence
  Synthetic DNA
taatacgacttcttagag

SEQ ID NO: 25572 - DNA, 18 bp, Artificial Sequence
  Synthetic DNA
taatacgactttcaacag

SEQ ID NO: 25573 - DNA, 18 bp, Artificial Sequence
  Synthetic DNA
taatacgagctactaaag

SEQ ID NO: 25574 - DNA, 18 bp, Artificial Sequence
  Synthetic DNA
taatacgagtcatcatcg

SEQ ID NO: 25575 - DNA, 18 bp, Artificial Sequence
  Synthetic DNA
taatacgatacaggatag

SEQ ID NO: 25576 - DNA, 18 bp, Artificial Sequence
  Synthetic DNA
taatacgatatactatgg

SEQ ID NO: 25577 - DNA, 18 bp, Artificial Sequence
  Synthetic DNA
taatacgatccaccttag

SEQ ID NO: 25578 - DNA, 18 bp, Artificial Sequence
  Synthetic DNA
taatacgattcaatggag

SEQ ID NO: 25579 - DNA, 18 bp, Artificial Sequence
  Synthetic DNA
taatacgattcaatttgg

SEQ ID NO: 25580 - DNA, 18 bp, Artificial Sequence
  Synthetic DNA
taatacgattcataaaag

SEQ ID NO: 25581 - DNA, 18 bp, Artificial Sequence
  Synthetic DNA
taatacgattccccaaag

SEQ ID NO: 25582 - DNA, 18 bp, Artificial Sequence
  Synthetic DNA
taatacgattctatatgg

SEQ ID NO: 25583 - DNA, 18 bp, Artificial Sequence
  Synthetic DNA
taatacgatttaaaatag

SEQ ID NO: 25584 - DNA, 18 bp, Artificial Sequence
  Synthetic DNA
taatacgcatcacactag

SEQ ID NO: 25585 - DNA, 18 bp, Artificial Sequence
  Synthetic DNA
taatacgcatcagtagag

SEQ ID NO: 25586 - DNA, 18 bp, Artificial Sequence
  Synthetic DNA
taatacgccacattaaag

SEQ ID NO: 25587 - DNA, 18 bp, Artificial Sequence
  Synthetic DNA
taatacgccttattttag

SEQ ID NO: 25588 - DNA, 18 bp, Artificial Sequence
  Synthetic DNA
taatacggcgctctctag

SEQ ID NO: 25589 - DNA, 18 bp, Artificial Sequence
  Synthetic DNA
taatacgggacactaaag

SEQ ID NO: 25590 - DNA, 18 bp, Artificial Sequence
  Synthetic DNA
taatacggtttactttag

SEQ ID NO: 25591 - DNA, 18 bp, Artificial Sequence
  Synthetic DNA
taatacgtatctctgtag

SEQ ID NO: 25592 - DNA, 18 bp, Artificial Sequence
  Synthetic DNA
taatacgtcccacttcag

SEQ ID NO: 25593 - DNA, 18 bp, Artificial Sequence
  Synthetic DNA
taatacgtctctgtctag

SEQ ID NO: 25594 - DNA, 18 bp, Artificial Sequence
  Synthetic DNA
taatacgtcttcatatag

SEQ ID NO: 25595 - DNA, 18 bp, Artificial Sequence
  Synthetic DNA
taatacgtcttcctacag

SEQ ID NO: 25596 - DNA, 18 bp, Artificial Sequence
  Synthetic DNA
taatactaatcactaacg

SEQ ID NO: 25597 - DNA, 18 bp, Artificial Sequence
  Synthetic DNA
taatactacacattatgg

SEQ ID NO: 25598 - DNA, 18 bp, Artificial Sequence
  Synthetic DNA
taatactactcaaaatcg

SEQ ID NO: 25599 - DNA, 18 bp, Artificial Sequence
  Synthetic DNA
taatactactcattaacg

SEQ ID NO: 25600 - DNA, 18 bp, Artificial Sequence
  Synthetic DNA
taatactagacattatag

SEQ ID NO: 25601 - DNA, 18 bp, Artificial Sequence
  Synthetic DNA
taatactagtcaataaag

SEQ ID NO: 25602 - DNA, 18 bp, Artificial Sequence
  Synthetic DNA
taatactattctctaaag

SEQ ID NO: 25603 - DNA, 18 bp, Artificial Sequence
  Synthetic DNA
taatactcctccctaaag

SEQ ID NO: 25604 - DNA, 18 bp, Artificial Sequence
  Synthetic DNA
taatactgcacactatcg

SEQ ID NO: 25605 - DNA, 18 bp, Artificial Sequence
  Synthetic DNA
taatagaactatctatag

SEQ ID NO: 25606 - DNA, 18 bp, Artificial Sequence
  Synthetic DNA
taatagaactccctttag

SEQ ID NO: 25607 - DNA, 18 bp, Artificial Sequence
  Synthetic DNA
taataggactcatattag

SEQ ID NO: 25608 - DNA, 18 bp, Artificial Sequence
  Synthetic DNA
taataggattcaccttag

SEQ ID NO: 25609 - DNA, 18 bp, Artificial Sequence
  Synthetic DNA
taataggtctcacactag

SEQ ID NO: 25610 - DNA, 18 bp, Artificial Sequence
  Synthetic DNA
taataggtctcactaacg

SEQ ID NO: 25611 - DNA, 18 bp, Artificial Sequence
  Synthetic DNA
taataggtctcagtaaag

SEQ ID NO: 25612 - DNA, 18 bp, Artificial Sequence
  Synthetic DNA
taatagttctctctatag

SEQ ID NO: 25613 - DNA, 18 bp, Artificial Sequence
  Synthetic DNA
taatataactcacggtag

SEQ ID NO: 25614 - DNA, 18 bp, Artificial Sequence
  Synthetic DNA
taatatgacataatatag

SEQ ID NO: 25615 - DNA, 18 bp, Artificial Sequence
  Synthetic DNA
taatatgacttagaatag

SEQ ID NO: 25616 - DNA, 18 bp, Artificial Sequence
  Synthetic DNA
taatatgactttctatcg

SEQ ID NO: 25617 - DNA, 18 bp, Artificial Sequence
  Synthetic DNA
taatatgagtcaccaaag

SEQ ID NO: 25618 - DNA, 18 bp, Artificial Sequence
  Synthetic DNA
taatatgagtcattaaag

SEQ ID NO: 25619 - DNA, 18 bp, Artificial Sequence
  Synthetic DNA
taatatgcctccatatag

SEQ ID NO: 25620 - DNA, 18 bp, Artificial Sequence
  Synthetic DNA
taatatgtgtcactatgg

SEQ ID NO: 25621 - DNA, 18 bp, Artificial Sequence
  Synthetic DNA
taatattactgactaaag

SEQ ID NO: 25622 - DNA, 18 bp, Artificial Sequence
  Synthetic DNA
taatatttctcactgtag

SEQ ID NO: 25623 - DNA, 18 bp, Artificial Sequence
  Synthetic DNA
taatcagactaactacag

SEQ ID NO: 25624 - DNA, 18 bp, Artificial Sequence
  Synthetic DNA
taatcagtctcactttag

SEQ ID NO: 25625 - DNA, 18 bp, Artificial Sequence
  Synthetic DNA
taatcagtctcattatag

SEQ ID NO: 25626 - DNA, 18 bp, Artificial Sequence
  Synthetic DNA
taatccaattcactctag

SEQ ID NO: 25627 - DNA, 18 bp, Artificial Sequence
  Synthetic DNA
taatccatctcacaatag

SEQ ID NO: 25628 - DNA, 18 bp, Artificial Sequence
  Synthetic DNA
taatccgacgcacaaaag

SEQ ID NO: 25629 - DNA, 18 bp, Artificial Sequence
  Synthetic DNA
taatccgactcactgtcc

SEQ ID NO: 25630 - DNA, 18 bp, Artificial Sequence
  Synthetic DNA
taatccgactgattttag

SEQ ID NO: 25631 - DNA, 18 bp, Artificial Sequence
  Synthetic DNA
taatccggctacctatag

SEQ ID NO: 25632 - DNA, 18 bp, Artificial Sequence
  Synthetic DNA
taatccgtctaactaaag

SEQ ID NO: 25633 - DNA, 18 bp, Artificial Sequence
  Synthetic DNA
taatcctactaacaatag

SEQ ID NO: 25634 - DNA, 18 bp, Artificial Sequence
  Synthetic DNA
taatcctattcactatcg

SEQ ID NO: 25635 - DNA, 18 bp, Artificial Sequence
  Synthetic DNA
taatctcactcactttag

SEQ ID NO: 25636 - DNA, 18 bp, Artificial Sequence
  Synthetic DNA
taatctgactaactaaag

SEQ ID NO: 25637 - DNA, 18 bp, Artificial Sequence
  Synthetic DNA
taatctgtcacactatag

SEQ ID NO: 25638 - DNA, 18 bp, Artificial Sequence
  Synthetic DNA
taatgagactgaatatag

SEQ ID NO: 25639 - DNA, 18 bp, Artificial Sequence
  Synthetic DNA
taatgagattcactaaag

SEQ ID NO: 25640 - DNA, 18 bp, Artificial Sequence
  Synthetic DNA
taatgcctctcactgtag

SEQ ID NO: 25641 - DNA, 18 bp, Artificial Sequence
  Synthetic DNA
taatgcgacaaactttag

SEQ ID NO: 25642 - DNA, 18 bp, Artificial Sequence
  Synthetic DNA
taatgcgacgcactaagg

SEQ ID NO: 25643 - DNA, 18 bp, Artificial Sequence
  Synthetic DNA
taatgcgactcactacct

SEQ ID NO: 25644 - DNA, 18 bp, Artificial Sequence
  Synthetic DNA
taatgcgagtcaatatcg

SEQ ID NO: 25645 - DNA, 18 bp, Artificial Sequence
  Synthetic DNA
taatgcgattaattatag

SEQ ID NO: 25646 - DNA, 18 bp, Artificial Sequence
  Synthetic DNA
taatgcgtagcactatag

SEQ ID NO: 25647 - DNA, 18 bp, Artificial Sequence
  Synthetic DNA
taatgggacactctatag

SEQ ID NO: 25648 - DNA, 18 bp, Artificial Sequence
  Synthetic DNA
taatgggcctcacaatag

SEQ ID NO: 25649 - DNA, 18 bp, Artificial Sequence
  Synthetic DNA
taatgtcactcattatag

SEQ ID NO: 25650 - DNA, 18 bp, Artificial Sequence
  Synthetic DNA
taatgtgtctcactaaag

SEQ ID NO: 25651 - DNA, 18 bp, Artificial Sequence
  Synthetic DNA
tacaacgtcttactatag

SEQ ID NO: 25652 - DNA, 18 bp, Artificial Sequence
  Synthetic DNA
tacaactactcacaatag

SEQ ID NO: 25653 - DNA, 18 bp, Artificial Sequence
  Synthetic DNA
tacaaggactcacgatag

SEQ ID NO: 25654 - DNA, 18 bp, Artificial Sequence
  Synthetic DNA
tacgacgactcactctcg

SEQ ID NO: 25655 - DNA, 18 bp, Artificial Sequence
  Synthetic DNA
tactaagacacactttag

SEQ ID NO: 25656 - DNA, 18 bp, Artificial Sequence
  Synthetic DNA
tactaagactaactctag

SEQ ID NO: 25657 - DNA, 18 bp, Artificial Sequence
  Synthetic DNA
tactacaactcacaagag

SEQ ID NO: 25658 - DNA, 18 bp, Artificial Sequence
  Synthetic DNA
tactaccacacactatgg

SEQ ID NO: 25659 - DNA, 18 bp, Artificial Sequence
  Synthetic DNA
tactacgactaaatttag

SEQ ID NO: 25660 - DNA, 18 bp, Artificial Sequence
  Synthetic DNA
tactacgattcaatttag

SEQ ID NO: 25661 - DNA, 18 bp, Artificial Sequence
  Synthetic DNA
tactacgtcacaatatag

SEQ ID NO: 25662 - DNA, 18 bp, Artificial Sequence
  Synthetic DNA
tactacttctcattatag

SEQ ID NO: 25663 - DNA, 18 bp, Artificial Sequence
  Synthetic DNA
tactacttttcactatag

SEQ ID NO: 25664 - DNA, 18 bp, Artificial Sequence
  Synthetic DNA
tactataacacactatag

SEQ ID NO: 25665 - DNA, 18 bp, Artificial Sequence
  Synthetic DNA
tactataactcactaaag

SEQ ID NO: 25666 - DNA, 18 bp, Artificial Sequence
  Synthetic DNA
tactatgactgacaatag

SEQ ID NO: 25667 - DNA, 18 bp, Artificial Sequence
  Synthetic DNA
tactccgacacaccatag

SEQ ID NO: 25668 - DNA, 18 bp, Artificial Sequence
  Synthetic DNA
tactccgactttctatag

SEQ ID NO: 25669 - DNA, 18 bp, Artificial Sequence
  Synthetic DNA
tactccgtctctctatag

SEQ ID NO: 25670 - DNA, 18 bp, Artificial Sequence
  Synthetic DNA
tactgcgacacactatcg

SEQ ID NO: 25671 - DNA, 18 bp, Artificial Sequence
  Synthetic DNA
tagaaagactgactatag

SEQ ID NO: 25672 - DNA, 18 bp, Artificial Sequence
  Synthetic DNA
tagagcgactcactctag

SEQ ID NO: 25673 - DNA, 18 bp, Artificial Sequence
  Synthetic DNA
tagcacgactcagtaaag

SEQ ID NO: 25674 - DNA, 18 bp, Artificial Sequence
  Synthetic DNA
tagcactactcagtatag

SEQ ID NO: 25675 - DNA, 18 bp, Artificial Sequence
  Synthetic DNA
tagcccgactcaccatag

SEQ ID NO: 25676 - DNA, 18 bp, Artificial Sequence
  Synthetic DNA
tagtacaactctctaaag

SEQ ID NO: 25677 - DNA, 18 bp, Artificial Sequence
  Synthetic DNA
tagtacagctcaatatag

SEQ ID NO: 25678 - DNA, 18 bp, Artificial Sequence
  Synthetic DNA
tagtacgacccacaatcg

SEQ ID NO: 25679 - DNA, 18 bp, Artificial Sequence
  Synthetic DNA
tagtacgactatcaatag

SEQ ID NO: 25680 - DNA, 18 bp, Artificial Sequence
  Synthetic DNA
tagtacgattctctaaag

SEQ ID NO: 25681 - DNA, 18 bp, Artificial Sequence
  Synthetic DNA
tagtacgcctcactcaag

SEQ ID NO: 25682 - DNA, 18 bp, Artificial Sequence
  Synthetic DNA
tagtacgtctgactttag

SEQ ID NO: 25683 - DNA, 18 bp, Artificial Sequence
  Synthetic DNA
tagtatgatacactatag

SEQ ID NO: 25684 - DNA, 18 bp, Artificial Sequence
  Synthetic DNA
tataacaactgactatag

SEQ ID NO: 25685 - DNA, 18 bp, Artificial Sequence
  Synthetic DNA
tataacgacctactatag

SEQ ID NO: 25686 - DNA, 18 bp, Artificial Sequence
  Synthetic DNA
tataacgacgctctatag

SEQ ID NO: 25687 - DNA, 18 bp, Artificial Sequence
  Synthetic DNA
tataacgactcattatcg

SEQ ID NO: 25688 - DNA, 18 bp, Artificial Sequence
  Synthetic DNA
tataatgacttactatag

SEQ ID NO: 25689 - DNA, 18 bp, Artificial Sequence
  Synthetic DNA
tatcacgactcaccttag

SEQ ID NO: 25690 - DNA, 18 bp, Artificial Sequence
  Synthetic DNA
tatcacgtatcactatag

SEQ ID NO: 25691 - DNA, 18 bp, Artificial Sequence
  Synthetic DNA
tatcgcggctcactatag

SEQ ID NO: 25692 - DNA, 18 bp, Artificial Sequence
  Synthetic DNA
tatgacgactcaccttag

SEQ ID NO: 25693 - DNA, 18 bp, Artificial Sequence
  Synthetic DNA
tatgacgattcagtatag

SEQ ID NO: 25694 - DNA, 18 bp, Artificial Sequence
  Synthetic DNA
tatgactactcactatgg

SEQ ID NO: 25695 - DNA, 18 bp, Artificial Sequence
  Synthetic DNA
tattaagacccactaaag

SEQ ID NO: 25696 - DNA, 18 bp, Artificial Sequence
  Synthetic DNA
tattacatctgactatag

SEQ ID NO: 25697 - DNA, 18 bp, Artificial Sequence
  Synthetic DNA
tattaccactaaccatag

SEQ ID NO: 25698 - DNA, 18 bp, Artificial Sequence
  Synthetic DNA
tattacgacaaaccatag

SEQ ID NO: 25699 - DNA, 18 bp, Artificial Sequence
  Synthetic DNA
tattacgacagactaaag

SEQ ID NO: 25700 - DNA, 18 bp, Artificial Sequence
  Synthetic DNA
tattacgacgctccatag

SEQ ID NO: 25701 - DNA, 18 bp, Artificial Sequence
  Synthetic DNA
tattacgactcagaaaag

SEQ ID NO: 25702 - DNA, 18 bp, Artificial Sequence
  Synthetic DNA
tattacgactctctccag

SEQ ID NO: 25703 - DNA, 18 bp, Artificial Sequence
  Synthetic DNA
tattacgagtcactaagg

SEQ ID NO: 25704 - DNA, 18 bp, Artificial Sequence
  Synthetic DNA
tattacgcctccctctag

SEQ ID NO: 25705 - DNA, 18 bp, Artificial Sequence
  Synthetic DNA
tattacggatcactatcg

SEQ ID NO: 25706 - DNA, 18 bp, Artificial Sequence
  Synthetic DNA
tattacgtctaactgtag

SEQ ID NO: 25707 - DNA, 18 bp, Artificial Sequence
  Synthetic DNA
tattacgtctcaatatgg

SEQ ID NO: 25708 - DNA, 18 bp, Artificial Sequence
  Synthetic DNA
tattacgtctcactaacg

SEQ ID NO: 25709 - DNA, 18 bp, Artificial Sequence
  Synthetic DNA
tattactactcacaacag

SEQ ID NO: 25710 - DNA, 18 bp, Artificial Sequence
  Synthetic DNA
tattacttctcactatgg

SEQ ID NO: 25711 - DNA, 18 bp, Artificial Sequence
  Synthetic DNA
tattaggacaaactatag

SEQ ID NO: 25712 - DNA, 18 bp, Artificial Sequence
  Synthetic DNA
tattaggtctcattatag

SEQ ID NO: 25713 - DNA, 18 bp, Artificial Sequence
  Synthetic DNA
tattatgagttactatag

SEQ ID NO: 25714 - DNA, 18 bp, Artificial Sequence
  Synthetic DNA
tattatgtctcaatatag

SEQ ID NO: 25715 - DNA, 18 bp, Artificial Sequence
  Synthetic DNA
tcaaacgaatcactaaag

SEQ ID NO: 25716 - DNA, 18 bp, Artificial Sequence
  Synthetic DNA
tcaaacgacacactaaag

SEQ ID NO: 25717 - DNA, 18 bp, Artificial Sequence
  Synthetic DNA
tcaaactactgactatag

SEQ ID NO: 25718 - DNA, 18 bp, Artificial Sequence
  Synthetic DNA
tcataacactcacaatag

SEQ ID NO: 25719 - DNA, 18 bp, Artificial Sequence
  Synthetic DNA
tcataacactctctatag

SEQ ID NO: 25720 - DNA, 18 bp, Artificial Sequence
  Synthetic DNA
tcataatcctcactatag

SEQ ID NO: 25721 - DNA, 18 bp, Artificial Sequence
  Synthetic DNA
tcatacaactcacaacag

SEQ ID NO: 25722 - DNA, 18 bp, Artificial Sequence
  Synthetic DNA
tcatacgaatcaccgtag

SEQ ID NO: 25723 - DNA, 18 bp, Artificial Sequence
  Synthetic DNA
tcatacgactccctcgag

SEQ ID NO: 25724 - DNA, 18 bp, Artificial Sequence
  Synthetic DNA
tcatacgattaaccatag

SEQ ID NO: 25725 - DNA, 18 bp, Artificial Sequence
  Synthetic DNA
tcatacggatcactaaag

SEQ ID NO: 25726 - DNA, 18 bp, Artificial Sequence
  Synthetic DNA
tcatacgtatctctatag

SEQ ID NO: 25727 - DNA, 18 bp, Artificial Sequence
  Synthetic DNA
tcatacgtctacctatag

SEQ ID NO: 25728 - DNA, 18 bp, Artificial Sequence
  Synthetic DNA
tcatacgtctcactcaag

SEQ ID NO: 25729 - DNA, 18 bp, Artificial Sequence
  Synthetic DNA
tcatacgtctctctagag

SEQ ID NO: 25730 - DNA, 18 bp, Artificial Sequence
  Synthetic DNA
tcatactacacactctag

SEQ ID NO: 25731 - DNA, 18 bp, Artificial Sequence
  Synthetic DNA
tcatagcactcactacag

SEQ ID NO: 25732 - DNA, 18 bp, Artificial Sequence
  Synthetic DNA
tcatatcactcacaatag

SEQ ID NO: 25733 - DNA, 18 bp, Artificial Sequence
  Synthetic DNA
tcatccgactaacaatag

SEQ ID NO: 25734 - DNA, 18 bp, Artificial Sequence
  Synthetic DNA
tcatccgtctcactttag

SEQ ID NO: 25735 - DNA, 18 bp, Artificial Sequence
  Synthetic DNA
tcatgagactcactaaag

SEQ ID NO: 25736 - DNA, 18 bp, Artificial Sequence
  Synthetic DNA
tcatgcgattcactaaag

SEQ ID NO: 25737 - DNA, 18 bp, Artificial Sequence
  Synthetic DNA
tcatgcgcctcattatag

SEQ ID NO: 25738 - DNA, 18 bp, Artificial Sequence
  Synthetic DNA
tcatgggactcactttag

SEQ ID NO: 25739 - DNA, 18 bp, Artificial Sequence
  Synthetic DNA
tcctacgacacattatag

SEQ ID NO: 25740 - DNA, 18 bp, Artificial Sequence
  Synthetic DNA
tcctacgactctctaaag

SEQ ID NO: 25741 - DNA, 18 bp, Artificial Sequence
  Synthetic DNA
tcctacgattcacaatag

SEQ ID NO: 25742 - DNA, 18 bp, Artificial Sequence
  Synthetic DNA
tcgtacgtctgactatag

SEQ ID NO: 25743 - DNA, 18 bp, Artificial Sequence
  Synthetic DNA
tcttaccactcactatgg

SEQ ID NO: 25744 - DNA, 18 bp, Artificial Sequence
  Synthetic DNA
tcttacctctcactatag

SEQ ID NO: 25745 - DNA, 18 bp, Artificial Sequence
  Synthetic DNA
tcttacgacacaccatag

SEQ ID NO: 25746 - DNA, 18 bp, Artificial Sequence
  Synthetic DNA
tcttacgactcactaacg

SEQ ID NO: 25747 - DNA, 18 bp, Artificial Sequence
  Synthetic DNA
tcttacgattcactttag

SEQ ID NO: 25748 - DNA, 18 bp, Artificial Sequence
  Synthetic DNA
tgaaaatactcactatag

SEQ ID NO: 25749 - DNA, 18 bp, Artificial Sequence
  Synthetic DNA
tgaaacaactcactaaag

SEQ ID NO: 25750 - DNA, 18 bp, Artificial Sequence
  Synthetic DNA
tgaaacgacacactctag

SEQ ID NO: 25751 - DNA, 18 bp, Artificial Sequence
  Synthetic DNA
tgaaacgactaacaatag

SEQ ID NO: 25752 - DNA, 18 bp, Artificial Sequence
  Synthetic DNA
tgaaacgatccactatag

SEQ ID NO: 25753 - DNA, 18 bp, Artificial Sequence
  Synthetic DNA
tgaaacggctcattatag

SEQ ID NO: 25754 - DNA, 18 bp, Artificial Sequence
  Synthetic DNA
tgacacgacgcactaaag

SEQ ID NO: 25755 - DNA, 18 bp, Artificial Sequence
  Synthetic DNA
tgacgcgactcactagag

SEQ ID NO: 25756 - DNA, 18 bp, Artificial Sequence
  Synthetic DNA
tgatacaaaacactatag

SEQ ID NO: 25757 - DNA, 18 bp, Artificial Sequence
  Synthetic DNA
tgatacaactctctatgg

SEQ ID NO: 25758 - DNA, 18 bp, Artificial Sequence
  Synthetic DNA
tgatacgacttacttaag

SEQ ID NO: 25759 - DNA, 18 bp, Artificial Sequence
  Synthetic DNA
tgatacgcctctctttag

SEQ ID NO: 25760 - DNA, 18 bp, Artificial Sequence
  Synthetic DNA
tgatacgtatcattatag

SEQ ID NO: 25761 - DNA, 18 bp, Artificial Sequence
  Synthetic DNA
tgatacgtctcacttgag

SEQ ID NO: 25762 - DNA, 18 bp, Artificial Sequence
  Synthetic DNA
tgatactactctgtatag

SEQ ID NO: 25763 - DNA, 18 bp, Artificial Sequence
  Synthetic DNA
tgatccgactacctatag

SEQ ID NO: 25764 - DNA, 18 bp, Artificial Sequence
  Synthetic DNA
tgatcgcactcactatag

SEQ ID NO: 25765 - DNA, 18 bp, Artificial Sequence
  Synthetic DNA
tgcaacgactcattatag

SEQ ID NO: 25766 - DNA, 18 bp, Artificial Sequence
  Synthetic DNA
tgttacgaattactatag

SEQ ID NO: 25767 - DNA, 18 bp, Artificial Sequence
  Synthetic DNA
tgttacgactgactctag

SEQ ID NO: 25768 - DNA, 18 bp, Artificial Sequence
  Synthetic DNA
tgttacgattcagtatag

SEQ ID NO: 25769 - DNA, 18 bp, Artificial Sequence
  Synthetic DNA
ttaaaagaatcactatag

SEQ ID NO: 25770 - DNA, 18 bp, Artificial Sequence
  Synthetic DNA
ttaaacgaatcaccatag

SEQ ID NO: 25771 - DNA, 18 bp, Artificial Sequence
  Synthetic DNA
ttaaacgactcagtctag

SEQ ID NO: 25772 - DNA, 18 bp, Artificial Sequence
  Synthetic DNA
ttaaacgactctctatgg

SEQ ID NO: 25773 - DNA, 18 bp, Artificial Sequence
  Synthetic DNA
ttaaacgactctctgtag

SEQ ID NO: 25774 - DNA, 18 bp, Artificial Sequence
  Synthetic DNA
ttaaacgattcactatgg

SEQ ID NO: 25775 - DNA, 18 bp, Artificial Sequence
  Synthetic DNA
ttaacccactcactatag

SEQ ID NO: 25776 - DNA, 18 bp, Artificial Sequence
  Synthetic DNA
ttaagcgattcactatag

SEQ ID NO: 25777 - DNA, 18 bp, Artificial Sequence
  Synthetic DNA
ttacacgacacacaatag

SEQ ID NO: 25778 - DNA, 18 bp, Artificial Sequence
  Synthetic DNA
ttacacgactctctatcg

SEQ ID NO: 25779 - DNA, 18 bp, Artificial Sequence
  Synthetic DNA
ttacgcgactgactatag

SEQ ID NO: 25780 - DNA, 18 bp, Artificial Sequence
  Synthetic DNA
ttataagacccactaaag

SEQ ID NO: 25781 - DNA, 18 bp, Artificial Sequence
  Synthetic DNA
ttataagactcacaaaag

SEQ ID NO: 25782 - DNA, 18 bp, Artificial Sequence
  Synthetic DNA
ttatacaaatccctatag

SEQ ID NO: 25783 - DNA, 18 bp, Artificial Sequence
  Synthetic DNA
ttataccactccctaaag

SEQ ID NO: 25784 - DNA, 18 bp, Artificial Sequence
  Synthetic DNA
ttatacgaatccctaaag

SEQ ID NO: 25785 - DNA, 18 bp, Artificial Sequence
  Synthetic DNA
ttatacgacaacctatag

SEQ ID NO: 25786 - DNA, 18 bp, Artificial Sequence
  Synthetic DNA
ttatacgacacaatatcg

SEQ ID NO: 25787 - DNA, 18 bp, Artificial Sequence
  Synthetic DNA
ttatacgacacactaccg

SEQ ID NO: 25788 - DNA, 18 bp, Artificial Sequence
  Synthetic DNA
ttatacgacccagaatag

SEQ ID NO: 25789 - DNA, 18 bp, Artificial Sequence
  Synthetic DNA
ttatacgaccttctatag

SEQ ID NO: 25790 - DNA, 18 bp, Artificial Sequence
  Synthetic DNA
ttatacgactaaccaaag

SEQ ID NO: 25791 - DNA, 18 bp, Artificial Sequence
  Synthetic DNA
ttatacgactaactccag

SEQ ID NO: 25792 - DNA, 18 bp, Artificial Sequence
  Synthetic DNA
ttatacgactcaacaaag

SEQ ID NO: 25793 - DNA, 18 bp, Artificial Sequence
  Synthetic DNA
ttatacgacttacgatcg

SEQ ID NO: 25794 - DNA, 18 bp, Artificial Sequence
  Synthetic DNA
ttatacgacttactttgg

SEQ ID NO: 25795 - DNA, 18 bp, Artificial Sequence
  Synthetic DNA
ttatacgattccatatag

SEQ ID NO: 25796 - DNA, 18 bp, Artificial Sequence
  Synthetic DNA
ttatacgcctgcctatag

SEQ ID NO: 25797 - DNA, 18 bp, Artificial Sequence
  Synthetic DNA
ttatacggccgactatag

SEQ ID NO: 25798 - DNA, 18 bp, Artificial Sequence
  Synthetic DNA
ttatacgtcacagtatag

SEQ ID NO: 25799 - DNA, 18 bp, Artificial Sequence
  Synthetic DNA
ttatacgtctcactttgg

SEQ ID NO: 25800 - DNA, 18 bp, Artificial Sequence
  Synthetic DNA
ttatacgtcttacgatag

SEQ ID NO: 25801 - DNA, 18 bp, Artificial Sequence
  Synthetic DNA
ttatacgtttcactagag

SEQ ID NO: 25802 - DNA, 18 bp, Artificial Sequence
  Synthetic DNA
ttatactactcatcatag

SEQ ID NO: 25803 - DNA, 18 bp, Artificial Sequence
  Synthetic DNA
ttatactattcactacag

SEQ ID NO: 25804 - DNA, 18 bp, Artificial Sequence
  Synthetic DNA
ttatagcactcacaatag

SEQ ID NO: 25805 - DNA, 18 bp, Artificial Sequence
  Synthetic DNA
ttataggacgctctatag

SEQ ID NO: 25806 - DNA, 18 bp, Artificial Sequence
  Synthetic DNA
ttatagtactcattatag

SEQ ID NO: 25807 - DNA, 18 bp, Artificial Sequence
  Synthetic DNA
ttatatgactctttatag

SEQ ID NO: 25808 - DNA, 18 bp, Artificial Sequence
  Synthetic DNA
ttatattacccactatag

SEQ ID NO: 25809 - DNA, 18 bp, Artificial Sequence
  Synthetic DNA
ttatccgactccttatag

SEQ ID NO: 25810 - DNA, 18 bp, Artificial Sequence
  Synthetic DNA
ttatcctactcaatatag

SEQ ID NO: 25811 - DNA, 18 bp, Artificial Sequence
  Synthetic DNA
ttatctgactcactttag

SEQ ID NO: 25812 - DNA, 18 bp, Artificial Sequence
  Synthetic DNA
ttatgccactcactttag

SEQ ID NO: 25813 - DNA, 18 bp, Artificial Sequence
  Synthetic DNA
ttccacgactcactgtag

SEQ ID NO: 25814 - DNA, 18 bp, Artificial Sequence
  Synthetic DNA
ttctacgaatcactttag

SEQ ID NO: 25815 - DNA, 18 bp, Artificial Sequence
  Synthetic DNA
ttctactaatcactatag

SEQ ID NO: 25816 - DNA, 18 bp, Artificial Sequence
  Synthetic DNA
ttctccgactcagtatag

SEQ ID NO: 25817 - DNA, 18 bp, Artificial Sequence
  Synthetic DNA
ttgtacatctcactatag

SEQ ID NO: 25818 - DNA, 18 bp, Artificial Sequence
  Synthetic DNA
ttgtacgactcaatacag

SEQ ID NO: 25819 - DNA, 18 bp, Artificial Sequence
  Synthetic DNA
ttgtatgactctctatag

SEQ ID NO: 25820 - DNA, 18 bp, Artificial Sequence
  Synthetic DNA
ttgtgcaactcactatag

SEQ ID NO: 25821 - DNA, 18 bp, Artificial Sequence
  Synthetic DNA
tttaacgagtcactatag

SEQ ID NO: 25822 - DNA, 18 bp, Artificial Sequence
  Synthetic DNA
ttttacgactcacaatcg

SEQ ID NO: 25823 - DNA, 18 bp, Artificial Sequence
  Synthetic DNA
ttttacgactctctatgg

SEQ ID NO: 25824 - DNA, 18 bp, Artificial Sequence
  Synthetic DNA
taatacgactctcttatg

SEQ ID NO: 25825 - DNA, 18 bp, Artificial Sequence
  Synthetic DNA
taattagactcactaatg

SEQ ID NO: 25826 - DNA, 18 bp, Artificial Sequence
  Synthetic DNA
taattcgactcaccaatg

SEQ ID NO: 25827 - DNA, 18 bp, Artificial Sequence
  Synthetic DNA
aaataccactcacaattg

SEQ ID NO: 25828 - DNA, 18 bp, Artificial Sequence
  Synthetic DNA
ctattcgacacactatag

SEQ ID NO: 25829 - DNA, 18 bp, Artificial Sequence
  Synthetic DNA
taaatctactccctatag

SEQ ID NO: 25830 - DNA, 18 bp, Artificial Sequence
  Synthetic DNA
taatacatctcagtattg

SEQ ID NO: 25831 - DNA, 18 bp, Artificial Sequence
  Synthetic DNA
taatacgaatcatttttg

SEQ ID NO: 25832 - DNA, 18 bp, Artificial Sequence
  Synthetic DNA
taatacgatccactaatg

SEQ ID NO: 25833 - DNA, 18 bp, Artificial Sequence
  Synthetic DNA
taattcgtcttactaaag

SEQ ID NO: 25834 - DNA, 18 bp, Artificial Sequence
  Synthetic DNA
tataacgaatcactattg

SEQ ID NO: 25835 - DNA, 18 bp, Artificial Sequence
  Synthetic DNA
tatttcgattcacaatag

SEQ ID NO: 25836 - DNA, 18 bp, Artificial Sequence
  Synthetic DNA
atatacgactcaccaaag

SEQ ID NO: 25837 - DNA, 18 bp, Artificial Sequence
  Synthetic DNA
atatacgagtcactgtag

SEQ ID NO: 25838 - DNA, 18 bp, Artificial Sequence
  Synthetic DNA
ctatacgtctctctatag

SEQ ID NO: 25839 - DNA, 18 bp, Artificial Sequence
  Synthetic DNA
taatacatcaaactatag

SEQ ID NO: 25840 - DNA, 18 bp, Artificial Sequence
  Synthetic DNA
taatacgacaaacattag

SEQ ID NO: 25841 - DNA, 18 bp, Artificial Sequence
  Synthetic DNA
taatacgtttcaataaag

SEQ ID NO: 25842 - DNA, 18 bp, Artificial Sequence
  Synthetic DNA
tatcacgactctctttag

SEQ ID NO: 25843 - DNA, 18 bp, Artificial Sequence
  Synthetic DNA
tattactactccctaaag

SEQ ID NO: 25844 - DNA, 18 bp, Artificial Sequence
  Synthetic DNA
ttatacgactcaaattag

SEQ ID NO: 25845 - DNA, 18 bp, Artificial Sequence
  Synthetic DNA
taatacgtcactctattg

SEQ ID NO: 25846 - DNA, 18 bp, Artificial Sequence
  Synthetic DNA
taattcgactcgttaaag

SEQ ID NO: 25847 - DNA, 18 bp, Artificial Sequence
  Synthetic DNA
taattcgactgtctattg

SEQ ID NO: 25848 - DNA, 18 bp, Artificial Sequence
  Synthetic DNA
taattcgagtctctattg

SEQ ID NO: 25849 - DNA, 18 bp, Artificial Sequence
  Synthetic DNA
aaatattactcactattg

SEQ ID NO: 25850 - DNA, 18 bp, Artificial Sequence
  Synthetic DNA
caatacgaatcacaattg

SEQ ID NO: 25851 - DNA, 18 bp, Artificial Sequence
  Synthetic DNA
ctatacgattcgctatag

SEQ ID NO: 25852 - DNA, 18 bp, Artificial Sequence
  Synthetic DNA
taaaacgagtcattattg

SEQ ID NO: 25853 - DNA, 18 bp, Artificial Sequence
  Synthetic DNA
taataccaatcactgttg

SEQ ID NO: 25854 - DNA, 18 bp, Artificial Sequence
  Synthetic DNA
taatacgacttataattg

SEQ ID NO: 25855 - DNA, 18 bp, Artificial Sequence
  Synthetic DNA
taataggtctctctattg

SEQ ID NO: 25856 - DNA, 18 bp, Artificial Sequence
  Synthetic DNA
taattcgaatcacttcag

SEQ ID NO: 25857 - DNA, 18 bp, Artificial Sequence
  Synthetic DNA
taattcgaatctatatag

SEQ ID NO: 25858 - DNA, 18 bp, Artificial Sequence
  Synthetic DNA
taattcgactcacaaacg

SEQ ID NO: 25859 - DNA, 18 bp, Artificial Sequence
  Synthetic DNA
taattcgattcactgaag

SEQ ID NO: 25860 - DNA, 18 bp, Artificial Sequence
  Synthetic DNA
taattcgtctcacaatgg

SEQ ID NO: 25861 - DNA, 18 bp, Artificial Sequence
  Synthetic DNA
tacatcgactctctatag

SEQ ID NO: 25862 - DNA, 18 bp, Artificial Sequence
  Synthetic DNA
tactaagattcactattg

SEQ ID NO: 25863 - DNA, 18 bp, Artificial Sequence
  Synthetic DNA
tataacgacccactattg

SEQ ID NO: 25864 - DNA, 18 bp, Artificial Sequence
  Synthetic DNA
tattacgacacacttttg

SEQ ID NO: 25865 - DNA, 18 bp, Artificial Sequence
  Synthetic DNA
tattttgacttactatag

SEQ ID NO: 25866 - DNA, 18 bp, Artificial Sequence
  Synthetic DNA
ttaaacgaatcactattg

SEQ ID NO: 25867 - DNA, 18 bp, Artificial Sequence
  Synthetic DNA
ttatacgacacgttatag

SEQ ID NO: 25868 - DNA, 18 bp, Artificial Sequence
  Synthetic DNA
ttattcaacacactatag

SEQ ID NO: 25869 - DNA, 18 bp, Artificial Sequence
  Synthetic DNA
ttattcgactcataatag

SEQ ID NO: 25870 - DNA, 18 bp, Artificial Sequence
  Synthetic DNA
ttctacgactcactagtg

SEQ ID NO: 25871 - DNA, 18 bp, Artificial Sequence
  Synthetic DNA
aaaaaagattcactatag

SEQ ID NO: 25872 - DNA, 18 bp, Artificial Sequence
  Synthetic DNA
aaatacatctcactttag

SEQ ID NO: 25873 - DNA, 18 bp, Artificial Sequence
  Synthetic DNA
aaatacgaccctttatag

SEQ ID NO: 25874 - DNA, 18 bp, Artificial Sequence
  Synthetic DNA
aaatactcctcacaatag

SEQ ID NO: 25875 - DNA, 18 bp, Artificial Sequence
  Synthetic DNA
aactaggactcactatcg

SEQ ID NO: 25876 - DNA, 18 bp, Artificial Sequence
  Synthetic DNA
acatacgactcagtacag

SEQ ID NO: 25877 - DNA, 18 bp, Artificial Sequence
  Synthetic DNA
ataaacgactccctatag

SEQ ID NO: 25878 - DNA, 18 bp, Artificial Sequence
  Synthetic DNA
atatacaaatcactatag

SEQ ID NO: 25879 - DNA, 18 bp, Artificial Sequence
  Synthetic DNA
atatatgacacactatag

SEQ ID NO: 25880 - DNA, 18 bp, Artificial Sequence
  Synthetic DNA
caaaacaactcattatag

SEQ ID NO: 25881 - DNA, 18 bp, Artificial Sequence
  Synthetic DNA
caatacgaatcacaacag

SEQ ID NO: 25882 - DNA, 18 bp, Artificial Sequence
  Synthetic DNA
ctatacgacacacaatag

SEQ ID NO: 25883 - DNA, 18 bp, Artificial Sequence
  Synthetic DNA
taaaacgactgaatctag

SEQ ID NO: 25884 - DNA, 18 bp, Artificial Sequence
  Synthetic DNA
taaaacgtctcccaatag

SEQ ID NO: 25885 - DNA, 18 bp, Artificial Sequence
  Synthetic DNA
taaaactattcactttag

SEQ ID NO: 25886 - DNA, 18 bp, Artificial Sequence
  Synthetic DNA
taataagtcacactaaag

SEQ ID NO: 25887 - DNA, 18 bp, Artificial Sequence
  Synthetic DNA
taataagtctctcaatag

SEQ ID NO: 25888 - DNA, 18 bp, Artificial Sequence
  Synthetic DNA
taataagtcttactaaag

SEQ ID NO: 25889 - DNA, 18 bp, Artificial Sequence
  Synthetic DNA
taatacaacagactgtag

SEQ ID NO: 25890 - DNA, 18 bp, Artificial Sequence
  Synthetic DNA
taatacaactaaatttag

SEQ ID NO: 25891 - DNA, 18 bp, Artificial Sequence
  Synthetic DNA
taatacatctcactttcg

SEQ ID NO: 25892 - DNA, 18 bp, Artificial Sequence
  Synthetic DNA
taataccattctctctag

SEQ ID NO: 25893 - DNA, 18 bp, Artificial Sequence
  Synthetic DNA
taatacctcacaatatag

SEQ ID NO: 25894 - DNA, 18 bp, Artificial Sequence
  Synthetic DNA
taatacgacacataatcg

SEQ ID NO: 25895 - DNA, 18 bp, Artificial Sequence
  Synthetic DNA
taatacgagtcataaaag

SEQ ID NO: 25896 - DNA, 18 bp, Artificial Sequence
  Synthetic DNA
taatacgattcccagtag

SEQ ID NO: 25897 - DNA, 18 bp, Artificial Sequence
  Synthetic DNA
taatacgctccactttag

SEQ ID NO: 25898 - DNA, 18 bp, Artificial Sequence
  Synthetic DNA
taatacgtgtcaaaatag

SEQ ID NO: 25899 - DNA, 18 bp, Artificial Sequence
  Synthetic DNA
taatacttctcattttag

SEQ ID NO: 25900 - DNA, 18 bp, Artificial Sequence
  Synthetic DNA
taatacttgtctctatag

SEQ ID NO: 25901 - DNA, 18 bp, Artificial Sequence
  Synthetic DNA
taatatgactaattaaag

SEQ ID NO: 25902 - DNA, 18 bp, Artificial Sequence
  Synthetic DNA
taccatgactcactaaag

SEQ ID NO: 25903 - DNA, 18 bp, Artificial Sequence
  Synthetic DNA
tagaacgtatcactatag

SEQ ID NO: 25904 - DNA, 18 bp, Artificial Sequence
  Synthetic DNA
tagtacgacacacattag

SEQ ID NO: 25905 - DNA, 18 bp, Artificial Sequence
  Synthetic DNA
tataccgacacactatag

SEQ ID NO: 25906 - DNA, 18 bp, Artificial Sequence
  Synthetic DNA
tattacaactcaatttag

SEQ ID NO: 25907 - DNA, 18 bp, Artificial Sequence
  Synthetic DNA
tattaccactttctatag

SEQ ID NO: 25908 - DNA, 18 bp, Artificial Sequence
  Synthetic DNA
tattacgactaactaagg

SEQ ID NO: 25909 - DNA, 18 bp, Artificial Sequence
  Synthetic DNA
tattacgactcaccaagg

SEQ ID NO: 25910 - DNA, 18 bp, Artificial Sequence
  Synthetic DNA
tattacggcatactatag

SEQ ID NO: 25911 - DNA, 18 bp, Artificial Sequence
  Synthetic DNA
tattgctactcactaaag

SEQ ID NO: 25912 - DNA, 18 bp, Artificial Sequence
  Synthetic DNA
tgatgcgacccactttag

SEQ ID NO: 25913 - DNA, 18 bp, Artificial Sequence
  Synthetic DNA
tgatgcgactaattatag

SEQ ID NO: 25914 - DNA, 18 bp, Artificial Sequence
  Synthetic DNA
tgtaacgactcattatag

SEQ ID NO: 25915 - DNA, 18 bp, Artificial Sequence
  Synthetic DNA
ttaaacaaatcactatag

SEQ ID NO: 25916 - DNA, 18 bp, Artificial Sequence
  Synthetic DNA
ttatacgtctcagtaaag

SEQ ID NO: 25917 - DNA, 18 bp, Artificial Sequence
  Synthetic DNA
ttatacgtctccttatag

SEQ ID NO: 25918 - DNA, 18 bp, Artificial Sequence
  Synthetic DNA
ttatactactctctctag

SEQ ID NO: 25919 - DNA, 18 bp, Artificial Sequence
  Synthetic DNA
ttataggacacactaaag

SEQ ID NO: 25920 - DNA, 18 bp, Artificial Sequence
  Synthetic DNA
ttatatgactaacaatag

SEQ ID NO: 25921 - DNA, 18 bp, Artificial Sequence
  Synthetic DNA
ttatatgactccctaaag

SEQ ID NO: 25922 - DNA, 18 bp, Artificial Sequence
  Synthetic DNA
ttatatgcctcacaatag

SEQ ID NO: 25923 - DNA, 18 bp, Artificial Sequence
  Synthetic DNA
ttttccgagtcactatag

SEQ ID NO: 25924 - DNA, 18 bp, Artificial Sequence
  Synthetic DNA
tttaacgactcactaaag

SEQ ID NO: 25925 - DNA, 18 bp, Artificial Sequence
  Synthetic DNA
taattcgtctcactaatg

SEQ ID NO: 25926 - DNA, 18 bp, Artificial Sequence
  Synthetic DNA
agatacgtctcactattg

SEQ ID NO: 25927 - DNA, 18 bp, Artificial Sequence
  Synthetic DNA
tatcaagactcgctatag

SEQ ID NO: 25928 - DNA, 18 bp, Artificial Sequence
  Synthetic DNA
aattacgactcacttaag

SEQ ID NO: 25929 - DNA, 18 bp, Artificial Sequence
  Synthetic DNA
ataaaggactcactatag

SEQ ID NO: 25930 - DNA, 18 bp, Artificial Sequence
  Synthetic DNA
taatacgacactataaag

SEQ ID NO: 25931 - DNA, 18 bp, Artificial Sequence
  Synthetic DNA
taatcagactcactcaag

SEQ ID NO: 25932 - DNA, 18 bp, Artificial Sequence
  Synthetic DNA
tattatgactctcaatag

SEQ ID NO: 25933 - DNA, 18 bp, Artificial Sequence
  Synthetic DNA
ttatacgtcttacaatag

SEQ ID NO: 25934 - DNA, 18 bp, Artificial Sequence
  Synthetic DNA
aaatacaactcaatttag

SEQ ID NO: 25935 - DNA, 18 bp, Artificial Sequence
  Synthetic DNA
aaatacgactttctttag

SEQ ID NO: 25936 - DNA, 18 bp, Artificial Sequence
  Synthetic DNA
taatacttcttactttag

SEQ ID NO: 25937 - DNA, 18 bp, Artificial Sequence
  Synthetic DNA
atatacgactcataatag

SEQ ID NO: 25938 - DNA, 18 bp, Artificial Sequence
  Synthetic DNA
atttacgactctctatag

SEQ ID NO: 25939 - DNA, 18 bp, Artificial Sequence
  Synthetic DNA
taatacgtctctcttaag

SEQ ID NO: 25940 - DNA, 18 bp, Artificial Sequence
  Synthetic DNA
ttatacgactctatttag

SEQ ID NO: 25941 - DNA, 18 bp, Artificial Sequence
  Synthetic DNA
atatacgacttacaatag

SEQ ID NO: 25942 - DNA, 18 bp, Artificial Sequence
  Synthetic DNA
aaattcgactagctatag

SEQ ID NO: 25943 - DNA, 18 bp, Artificial Sequence
  Synthetic DNA
taaattgactcgctatag

SEQ ID NO: 25944 - DNA, 18 bp, Artificial Sequence
  Synthetic DNA
taattagcctcactattg

SEQ ID NO: 25945 - DNA, 18 bp, Artificial Sequence
  Synthetic DNA
taattcaactcacaattg

SEQ ID NO: 25946 - DNA, 18 bp, Artificial Sequence
  Synthetic DNA
taattcgaatcacttttg

SEQ ID NO: 25947 - DNA, 18 bp, Artificial Sequence
  Synthetic DNA
taattcgactcagtcttg

SEQ ID NO: 25948 - DNA, 18 bp, Artificial Sequence
  Synthetic DNA
taattcgactcattgttg

SEQ ID NO: 25949 - DNA, 18 bp, Artificial Sequence
  Synthetic DNA
taattcgactcgaaatag

SEQ ID NO: 25950 - DNA, 18 bp, Artificial Sequence
  Synthetic DNA
taattcgactcgcattag

SEQ ID NO: 25951 - DNA, 18 bp, Artificial Sequence
  Synthetic DNA
taattcgacttaatattg

SEQ ID NO: 25952 - DNA, 18 bp, Artificial Sequence
  Synthetic DNA
taattcgacttactactg

SEQ ID NO: 25953 - DNA, 18 bp, Artificial Sequence
  Synthetic DNA
taattcgcctccctattg

SEQ ID NO: 25954 - DNA, 18 bp, Artificial Sequence
  Synthetic DNA
tagctcgactcactattg

SEQ ID NO: 25955 - DNA, 18 bp, Artificial Sequence
  Synthetic DNA
ttatactactcgctattg

SEQ ID NO: 25956 - DNA, 18 bp, Artificial Sequence
  Synthetic DNA
aaataagacacgctatag

SEQ ID NO: 25957 - DNA, 18 bp, Artificial Sequence
  Synthetic DNA
aaataagactcattattg

SEQ ID NO: 25958 - DNA, 18 bp, Artificial Sequence
  Synthetic DNA
aaataagactcgctaaag

SEQ ID NO: 25959 - DNA, 18 bp, Artificial Sequence
  Synthetic DNA
aaataccactcacgattg

SEQ ID NO: 25960 - DNA, 18 bp, Artificial Sequence
  Synthetic DNA
aaatacgactatctattg

SEQ ID NO: 25961 - DNA, 18 bp, Artificial Sequence
  Synthetic DNA
aaatacgactcacgtttg

SEQ ID NO: 25962 - DNA, 18 bp, Artificial Sequence
  Synthetic DNA
aaatacgtctcgctttag

SEQ ID NO: 25963 - DNA, 18 bp, Artificial Sequence
  Synthetic DNA
aaattagtctcactatag

SEQ ID NO: 25964 - DNA, 18 bp, Artificial Sequence
  Synthetic DNA
aaattccactaactatag

SEQ ID NO: 25965 - DNA, 18 bp, Artificial Sequence
  Synthetic DNA
aaattccactcacaatag

SEQ ID NO: 25966 - DNA, 18 bp, Artificial Sequence
  Synthetic DNA
aaattcggttcactatag

SEQ ID NO: 25967 - DNA, 18 bp, Artificial Sequence
  Synthetic DNA
aattacgactagctatag

SEQ ID NO: 25968 - DNA, 18 bp, Artificial Sequence
  Synthetic DNA
acatgcgactcgctatag

SEQ ID NO: 25969 - DNA, 18 bp, Artificial Sequence
  Synthetic DNA
agattcgactcaatatag

SEQ ID NO: 25970 - DNA, 18 bp, Artificial Sequence
  Synthetic DNA
caactagactcactatag

SEQ ID NO: 25971 - DNA, 18 bp, Artificial Sequence
  Synthetic DNA
caatacgacatgctatag

SEQ ID NO: 25972 - DNA, 18 bp, Artificial Sequence
  Synthetic DNA
caattcaactcactaaag

SEQ ID NO: 25973 - DNA, 18 bp, Artificial Sequence
  Synthetic DNA
caattcgaaacactatag

SEQ ID NO: 25974 - DNA, 18 bp, Artificial Sequence
  Synthetic DNA
caattcgatacactatag

SEQ ID NO: 25975 - DNA, 18 bp, Artificial Sequence
  Synthetic DNA
caattcgtctctctatag

SEQ ID NO: 25976 - DNA, 18 bp, Artificial Sequence
  Synthetic DNA
caattctactaactatag

SEQ ID NO: 25977 - DNA, 18 bp, Artificial Sequence
  Synthetic DNA
cacttcgtctcactatag

SEQ ID NO: 25978 - DNA, 18 bp, Artificial Sequence
  Synthetic DNA
cgatacgactcgccatag

SEQ ID NO: 25979 - DNA, 18 bp, Artificial Sequence
  Synthetic DNA
ctataggactcactattg

SEQ ID NO: 25980 - DNA, 18 bp, Artificial Sequence
  Synthetic DNA
taaaaagactcacaattg

SEQ ID NO: 25981 - DNA, 18 bp, Artificial Sequence
  Synthetic DNA
taaaaccacacactattg

SEQ ID NO: 25982 - DNA, 18 bp, Artificial Sequence
  Synthetic DNA
taaaacggctcgctacag

SEQ ID NO: 25983 - DNA, 18 bp, Artificial Sequence
  Synthetic DNA
taaatccactcacaatag

SEQ ID NO: 25984 - DNA, 18 bp, Artificial Sequence
  Synthetic DNA
taaatcgactcacaatgg

SEQ ID NO: 25985 - DNA, 18 bp, Artificial Sequence
  Synthetic DNA
taaatcgtctcaatatag

SEQ ID NO: 25986 - DNA, 18 bp, Artificial Sequence
  Synthetic DNA
taacacgaaacgctatag

SEQ ID NO: 25987 - DNA, 18 bp, Artificial Sequence
  Synthetic DNA
taactagaatcactatag

SEQ ID NO: 25988 - DNA, 18 bp, Artificial Sequence
  Synthetic DNA
taactcatctcactatag

SEQ ID NO: 25989 - DNA, 18 bp, Artificial Sequence
  Synthetic DNA
taactcgactgactttag

SEQ ID NO: 25990 - DNA, 18 bp, Artificial Sequence
  Synthetic DNA
taagacgacccgctttag

SEQ ID NO: 25991 - DNA, 18 bp, Artificial Sequence
  Synthetic DNA
taagtggacacactatag

SEQ ID NO: 25992 - DNA, 18 bp, Artificial Sequence
  Synthetic DNA
taataagacgcacaattg

SEQ ID NO: 25993 - DNA, 18 bp, Artificial Sequence
  Synthetic DNA
taataagactctcgattg

SEQ ID NO: 25994 - DNA, 18 bp, Artificial Sequence
  Synthetic DNA
taatacaactatctattg

SEQ ID NO: 25995 - DNA, 18 bp, Artificial Sequence
  Synthetic DNA
taatacagctcacttttg

SEQ ID NO: 25996 - DNA, 18 bp, Artificial Sequence
  Synthetic DNA
taataccactcacaagtg

SEQ ID NO: 25997 - DNA, 18 bp, Artificial Sequence
  Synthetic DNA
taataccagtcaatattg

SEQ ID NO: 25998 - DNA, 18 bp, Artificial Sequence
  Synthetic DNA
taataccgctcattattg

SEQ ID NO: 25999 - DNA, 18 bp, Artificial Sequence
  Synthetic DNA
taatacgaaatactattg

SEQ ID NO: 26000 - DNA, 18 bp, Artificial Sequence
  Synthetic DNA
taatacgaatcacttctg

SEQ ID NO: 26001 - DNA, 18 bp, Artificial Sequence
  Synthetic DNA
taatacgactcattcctg

SEQ ID NO: 26002 - DNA, 18 bp, Artificial Sequence
  Synthetic DNA
taatacgactcgcatgag

SEQ ID NO: 26003 - DNA, 18 bp, Artificial Sequence
  Synthetic DNA
taatacgacttaatagtg

SEQ ID NO: 26004 - DNA, 18 bp, Artificial Sequence
  Synthetic DNA
taatacgacttatcattg

SEQ ID NO: 26005 - DNA, 18 bp, Artificial Sequence
  Synthetic DNA
taatacgacttccttttg

SEQ ID NO: 26006 - DNA, 18 bp, Artificial Sequence
  Synthetic DNA
taatacgagtctctgttg

SEQ ID NO: 26007 - DNA, 18 bp, Artificial Sequence
  Synthetic DNA
taatacgcataactattg

SEQ ID NO: 26008 - DNA, 18 bp, Artificial Sequence
  Synthetic DNA
taatacgccacactcttg

SEQ ID NO: 26009 - DNA, 18 bp, Artificial Sequence
  Synthetic DNA
taatacgcctcaataatg

SEQ ID NO: 26010 - DNA, 18 bp, Artificial Sequence
  Synthetic DNA
taatacgcttcacttttg

SEQ ID NO: 26011 - DNA, 18 bp, Artificial Sequence
  Synthetic DNA
taatacgcttctctattg

SEQ ID NO: 26012 - DNA, 18 bp, Artificial Sequence
  Synthetic DNA
taatacgtctagcaatag

SEQ ID NO: 26013 - DNA, 18 bp, Artificial Sequence
  Synthetic DNA
taatactacccacttttg

SEQ ID NO: 26014 - DNA, 18 bp, Artificial Sequence
  Synthetic DNA
taatactactctgtattg

SEQ ID NO: 26015 - DNA, 18 bp, Artificial Sequence
  Synthetic DNA
taatactcctcaccattg

SEQ ID NO: 26016 - DNA, 18 bp, Artificial Sequence
  Synthetic DNA
taataggtcacactattg

SEQ ID NO: 26017 - DNA, 18 bp, Artificial Sequence
  Synthetic DNA
taatagtactctctattg

SEQ ID NO: 26018 - DNA, 18 bp, Artificial Sequence
  Synthetic DNA
taatatcactaactattg

SEQ ID NO: 26019 - DNA, 18 bp, Artificial Sequence
  Synthetic DNA
taatatcacttactattg

SEQ ID NO: 26020 - DNA, 18 bp, Artificial Sequence
  Synthetic DNA
taatatgactaactaatg

SEQ ID NO: 26021 - DNA, 18 bp, Artificial Sequence
  Synthetic DNA
taatatgagtcactcttg

SEQ ID NO: 26022 - DNA, 18 bp, Artificial Sequence
  Synthetic DNA
taatattacgcgctatag

SEQ ID NO: 26023 - DNA, 18 bp, Artificial Sequence
  Synthetic DNA
taatattactaactattg

SEQ ID NO: 26024 - DNA, 18 bp, Artificial Sequence
  Synthetic DNA
taatcagactcactcttg

SEQ ID NO: 26025 - DNA, 18 bp, Artificial Sequence
  Synthetic DNA
taatcccacacactattg

SEQ ID NO: 26026 - DNA, 18 bp, Artificial Sequence
  Synthetic DNA
taatccgactaacttttg

SEQ ID NO: 26027 - DNA, 18 bp, Artificial Sequence
  Synthetic DNA
taatccgtctcgcaatag

SEQ ID NO: 26028 - DNA, 18 bp, Artificial Sequence
  Synthetic DNA
taatctaactcactattg

SEQ ID NO: 26029 - DNA, 18 bp, Artificial Sequence
  Synthetic DNA
taatgccactcgctctag

SEQ ID NO: 26030 - DNA, 18 bp, Artificial Sequence
  Synthetic DNA
taatgcgattcacttttg

SEQ ID NO: 26031 - DNA, 18 bp, Artificial Sequence
  Synthetic DNA
taatgctagtcgctatag

SEQ ID NO: 26032 - DNA, 18 bp, Artificial Sequence
  Synthetic DNA
taattagactcacgatcg

SEQ ID NO: 26033 - DNA, 18 bp, Artificial Sequence
  Synthetic DNA
taattagcatcactatag

SEQ ID NO: 26034 - DNA, 18 bp, Artificial Sequence
  Synthetic DNA
taattagtctctctatag

SEQ ID NO: 26035 - DNA, 18 bp, Artificial Sequence
  Synthetic DNA
taattcaactctctagag

SEQ ID NO: 26036 - DNA, 18 bp, Artificial Sequence
  Synthetic DNA
taattcatcacactatag

SEQ ID NO: 26037 - DNA, 18 bp, Artificial Sequence
  Synthetic DNA
taattccacacagtatag

SEQ ID NO: 26038 - DNA, 18 bp, Artificial Sequence
  Synthetic DNA
taattcgaagcactaaag

SEQ ID NO: 26039 - DNA, 18 bp, Artificial Sequence
  Synthetic DNA
taattcgaatcaataaag

SEQ ID NO: 26040 - DNA, 18 bp, Artificial Sequence
  Synthetic DNA
taattcgacacccaatag

SEQ ID NO: 26041 - DNA, 18 bp, Artificial Sequence
  Synthetic DNA
taattcgacccacttaag

SEQ ID NO: 26042 - DNA, 18 bp, Artificial Sequence
  Synthetic DNA
taattcgacctactacag

SEQ ID NO: 26043 - DNA, 18 bp, Artificial Sequence
  Synthetic DNA
taattcgactccatgtag

SEQ ID NO: 26044 - DNA, 18 bp, Artificial Sequence
  Synthetic DNA
taattcgagacaatatag

SEQ ID NO: 26045 - DNA, 18 bp, Artificial Sequence
  Synthetic DNA
taattcgattaactttag

SEQ ID NO: 26046 - DNA, 18 bp, Artificial Sequence
  Synthetic DNA
taattcgattccatatag

SEQ ID NO: 26047 - DNA, 18 bp, Artificial Sequence
  Synthetic DNA
taattcgattctccatag

SEQ ID NO: 26048 - DNA, 18 bp, Artificial Sequence
  Synthetic DNA
taattcggctcacttcag

SEQ ID NO: 26049 - DNA, 18 bp, Artificial Sequence
  Synthetic DNA
taattcgtctcactgtgg

SEQ ID NO: 26050 - DNA, 18 bp, Artificial Sequence
  Synthetic DNA
taattcgtcttcctatag

SEQ ID NO: 26051 - DNA, 18 bp, Artificial Sequence
  Synthetic DNA
taattctactcactgaag

SEQ ID NO: 26052 - DNA, 18 bp, Artificial Sequence
  Synthetic DNA
taattctagtcattatag

SEQ ID NO: 26053 - DNA, 18 bp, Artificial Sequence
  Synthetic DNA
taattctattcactgtag

SEQ ID NO: 26054 - DNA, 18 bp, Artificial Sequence
  Synthetic DNA
taattggactcactaagg

SEQ ID NO: 26055 - DNA, 18 bp, Artificial Sequence
  Synthetic DNA
tacaacgtctcgctatag

SEQ ID NO: 26056 - DNA, 18 bp, Artificial Sequence
  Synthetic DNA
tactacacctcactattg

SEQ ID NO: 26057 - DNA, 18 bp, Artificial Sequence
  Synthetic DNA
tactacgactcggtaaag

SEQ ID NO: 26058 - DNA, 18 bp, Artificial Sequence
  Synthetic DNA
tacttcgacacaatatag

SEQ ID NO: 26059 - DNA, 18 bp, Artificial Sequence
  Synthetic DNA
tacttcgacgaactatag

SEQ ID NO: 26060 - DNA, 18 bp, Artificial Sequence
  Synthetic DNA
tacttcgactcaatttag

SEQ ID NO: 26061 - DNA, 18 bp, Artificial Sequence
  Synthetic DNA
tacttcgactccttatag

SEQ ID NO: 26062 - DNA, 18 bp, Artificial Sequence
  Synthetic DNA
tacttcgtctaactatag

SEQ ID NO: 26063 - DNA, 18 bp, Artificial Sequence
  Synthetic DNA
tacttcgtctcacaatag

SEQ ID NO: 26064 - DNA, 18 bp, Artificial Sequence
  Synthetic DNA
tagtacaactcactgttg

SEQ ID NO: 26065 - DNA, 18 bp, Artificial Sequence
  Synthetic DNA
tagtacaactcacttttg

SEQ ID NO: 26066 - DNA, 18 bp, Artificial Sequence
  Synthetic DNA
tagtacgactcatcattg

SEQ ID NO: 26067 - DNA, 18 bp, Artificial Sequence
  Synthetic DNA
tagtacgactcgcttcag

SEQ ID NO: 26068 - DNA, 18 bp, Artificial Sequence
  Synthetic DNA
tagtactactcgctctag

SEQ ID NO: 26069 - DNA, 18 bp, Artificial Sequence
  Synthetic DNA
tagttcttctcactatag

SEQ ID NO: 26070 - DNA, 18 bp, Artificial Sequence
  Synthetic DNA
tattacaactcgctagag

SEQ ID NO: 26071 - DNA, 18 bp, Artificial Sequence
  Synthetic DNA
tattacaactgactattg

SEQ ID NO: 26072 - DNA, 18 bp, Artificial Sequence
  Synthetic DNA
tattatgacccactattg

SEQ ID NO: 26073 - DNA, 18 bp, Artificial Sequence
  Synthetic DNA
tattatgactcactcttg

SEQ ID NO: 26074 - DNA, 18 bp, Artificial Sequence
  Synthetic DNA
tattccgactcactgttg

SEQ ID NO: 26075 - DNA, 18 bp, Artificial Sequence
  Synthetic DNA
tatttccattcactatag

SEQ ID NO: 26076 - DNA, 18 bp, Artificial Sequence
  Synthetic DNA
tatttcggctcactctag

SEQ ID NO: 26077 - DNA, 18 bp, Artificial Sequence
  Synthetic DNA
tcatacgattcactcttg

SEQ ID NO: 26078 - DNA, 18 bp, Artificial Sequence
  Synthetic DNA
tcatacgcctcgctttag

SEQ ID NO: 26079 - DNA, 18 bp, Artificial Sequence
  Synthetic DNA
tcatacgtctcgcaatag

SEQ ID NO: 26080 - DNA, 18 bp, Artificial Sequence
  Synthetic DNA
tgatacaacttactattg

SEQ ID NO: 26081 - DNA, 18 bp, Artificial Sequence
  Synthetic DNA
tgatacgactcgcttaag

SEQ ID NO: 26082 - DNA, 18 bp, Artificial Sequence
  Synthetic DNA
tgatacggctctctattg

SEQ ID NO: 26083 - DNA, 18 bp, Artificial Sequence
  Synthetic DNA
tgatacgtctcactaatg

SEQ ID NO: 26084 - DNA, 18 bp, Artificial Sequence
  Synthetic DNA
tgtttcgattcactatag

SEQ ID NO: 26085 - DNA, 18 bp, Artificial Sequence
  Synthetic DNA
ttaatcgacttactatag

SEQ ID NO: 26086 - DNA, 18 bp, Artificial Sequence
  Synthetic DNA
ttatacgactcaaaattg

SEQ ID NO: 26087 - DNA, 18 bp, Artificial Sequence
  Synthetic DNA
ttatacgacttgcaatag

SEQ ID NO: 26088 - DNA, 18 bp, Artificial Sequence
  Synthetic DNA
ttatacgattcgcaatag

SEQ ID NO: 26089 - DNA, 18 bp, Artificial Sequence
  Synthetic DNA
ttatacggctccctattg

SEQ ID NO: 26090 - DNA, 18 bp, Artificial Sequence
  Synthetic DNA
ttatacgtctcaatattg

SEQ ID NO: 26091 - DNA, 18 bp, Artificial Sequence
  Synthetic DNA
ttatatgactcactactg

SEQ ID NO: 26092 - DNA, 18 bp, Artificial Sequence
  Synthetic DNA
ttatatgtctcgctatag

SEQ ID NO: 26093 - DNA, 18 bp, Artificial Sequence
  Synthetic DNA
ttatattactcactattg

SEQ ID NO: 26094 - DNA, 18 bp, Artificial Sequence
  Synthetic DNA
ttatgcgactcactagtg

SEQ ID NO: 26095 - DNA, 18 bp, Artificial Sequence
  Synthetic DNA
ttatgcgtctcgctatag

SEQ ID NO: 26096 - DNA, 18 bp, Artificial Sequence
  Synthetic DNA
ttattcgactctctatcg

SEQ ID NO: 26097 - DNA, 18 bp, Artificial Sequence
  Synthetic DNA
ttcaacgactcactattg

SEQ ID NO: 26098 - DNA, 18 bp, Artificial Sequence
  Synthetic DNA
ttctacgactcattattg

SEQ ID NO: 26099 - DNA, 18 bp, Artificial Sequence
  Synthetic DNA
aaaaaccactcactttag

SEQ ID NO: 26100 - DNA, 18 bp, Artificial Sequence
  Synthetic DNA
aaaaacgactcaccagag

SEQ ID NO: 26101 - DNA, 18 bp, Artificial Sequence
  Synthetic DNA
aaacacgactcaatctag

SEQ ID NO: 26102 - DNA, 18 bp, Artificial Sequence
  Synthetic DNA
aaataagactcacttaag

SEQ ID NO: 26103 - DNA, 18 bp, Artificial Sequence
  Synthetic DNA
aaataagactctgtatag

SEQ ID NO: 26104 - DNA, 18 bp, Artificial Sequence
  Synthetic DNA
aaataagtctctctatag

SEQ ID NO: 26105 - DNA, 18 bp, Artificial Sequence
  Synthetic DNA
aaataccactctcaatag

SEQ ID NO: 26106 - DNA, 18 bp, Artificial Sequence
  Synthetic DNA
aaatacgaatgactatcg

SEQ ID NO: 26107 - DNA, 18 bp, Artificial Sequence
  Synthetic DNA
aaatacgacacaccaaag

SEQ ID NO: 26108 - DNA, 18 bp, Artificial Sequence
  Synthetic DNA
aaatacgacaccctttag

SEQ ID NO: 26109 - DNA, 18 bp, Artificial Sequence
  Synthetic DNA
aaatacgacactctttag

SEQ ID NO: 26110 - DNA, 18 bp, Artificial Sequence
  Synthetic DNA
aaatacgacccattaaag

SEQ ID NO: 26111 - DNA, 18 bp, Artificial Sequence
  Synthetic DNA
aaatacgaccctatatag

SEQ ID NO: 26112 - DNA, 18 bp, Artificial Sequence
  Synthetic DNA
aaatacgactcacgtaag

SEQ ID NO: 26113 - DNA, 18 bp, Artificial Sequence
  Synthetic DNA
aaatacgactcattctgg

SEQ ID NO: 26114 - DNA, 18 bp, Artificial Sequence
  Synthetic DNA
aaatacgactctttgtag

SEQ ID NO: 26115 - DNA, 18 bp, Artificial Sequence
  Synthetic DNA
aaatacgacttacaatgg

SEQ ID NO: 26116 - DNA, 18 bp, Artificial Sequence
  Synthetic DNA
aaatacgacttcctttag

SEQ ID NO: 26117 - DNA, 18 bp, Artificial Sequence
  Synthetic DNA
aaatacgagacactaaag

SEQ ID NO: 26118 - DNA, 18 bp, Artificial Sequence
  Synthetic DNA
aaatacgattcatcatag

SEQ ID NO: 26119 - DNA, 18 bp, Artificial Sequence
  Synthetic DNA
aaatacgtctcaacatag

SEQ ID NO: 26120 - DNA, 18 bp, Artificial Sequence
  Synthetic DNA
aaatactactcaatttag

SEQ ID NO: 26121 - DNA, 18 bp, Artificial Sequence
  Synthetic DNA
aaatagaacacactatag

SEQ ID NO: 26122 - DNA, 18 bp, Artificial Sequence
  Synthetic DNA
aaataggactcattaaag

SEQ ID NO: 26123 - DNA, 18 bp, Artificial Sequence
  Synthetic DNA
aaataggattcaatatag

SEQ ID NO: 26124 - DNA, 18 bp, Artificial Sequence
  Synthetic DNA
aaatatgtttcactatag

SEQ ID NO: 26125 - DNA, 18 bp, Artificial Sequence
  Synthetic DNA
aaatattactcactatgg

SEQ ID NO: 26126 - DNA, 18 bp, Artificial Sequence
  Synthetic DNA
aaatcagaatcactatag

SEQ ID NO: 26127 - DNA, 18 bp, Artificial Sequence
  Synthetic DNA
aaatgcaactcactacag

SEQ ID NO: 26128 - DNA, 18 bp, Artificial Sequence
  Synthetic DNA
aaatgcatctcactatag

SEQ ID NO: 26129 - DNA, 18 bp, Artificial Sequence
  Synthetic DNA
aaatgcgactcaaaatag

SEQ ID NO: 26130 - DNA, 18 bp, Artificial Sequence
  Synthetic DNA
aaatgcgcctcactttag

SEQ ID NO: 26131 - DNA, 18 bp, Artificial Sequence
  Synthetic DNA
aaatgtgtctcactatag

SEQ ID NO: 26132 - DNA, 18 bp, Artificial Sequence
  Synthetic DNA
aactatgactcattatag

SEQ ID NO: 26133 - DNA, 18 bp, Artificial Sequence
  Synthetic DNA
aataacgactgactatag

SEQ ID NO: 26134 - DNA, 18 bp, Artificial Sequence
  Synthetic DNA
aattaccactcactatcg

SEQ ID NO: 26135 - DNA, 18 bp, Artificial Sequence
  Synthetic DNA
aattacgactcagtaaag

SEQ ID NO: 26136 - DNA, 18 bp, Artificial Sequence
  Synthetic DNA
aattacggctctctatag

SEQ ID NO: 26137 - DNA, 18 bp, Artificial Sequence
  Synthetic DNA
aattactactcacgatag

SEQ ID NO: 26138 - DNA, 18 bp, Artificial Sequence
  Synthetic DNA
aattaggactcacaatag

SEQ ID NO: 26139 - DNA, 18 bp, Artificial Sequence
  Synthetic DNA
acatactactcacaatag

SEQ ID NO: 26140 - DNA, 18 bp, Artificial Sequence
  Synthetic DNA
agatacgacttaccatag

SEQ ID NO: 26141 - DNA, 18 bp, Artificial Sequence
  Synthetic DNA
ataaacgactcactatcg

SEQ ID NO: 26142 - DNA, 18 bp, Artificial Sequence
  Synthetic DNA
atacacgactcaatatag

SEQ ID NO: 26143 - DNA, 18 bp, Artificial Sequence
  Synthetic DNA
atagacgactcactaaag

SEQ ID NO: 26144 - DNA, 18 bp, Artificial Sequence
  Synthetic DNA
atataagactaactatag

SEQ ID NO: 26145 - DNA, 18 bp, Artificial Sequence
  Synthetic DNA
atatacaactcagtatag

SEQ ID NO: 26146 - DNA, 18 bp, Artificial Sequence
  Synthetic DNA
atgtacgattcactatag

SEQ ID NO: 26147 - DNA, 18 bp, Artificial Sequence
  Synthetic DNA
atttacgcctcactatag

SEQ ID NO: 26148 - DNA, 18 bp, Artificial Sequence
  Synthetic DNA
caaaacgacaccctatag

SEQ ID NO: 26149 - DNA, 18 bp, Artificial Sequence
  Synthetic DNA
caacacgattaactatag

SEQ ID NO: 26150 - DNA, 18 bp, Artificial Sequence
  Synthetic DNA
caataagtctctctatag

SEQ ID NO: 26151 - DNA, 18 bp, Artificial Sequence
  Synthetic DNA
caatacaacccactctag

SEQ ID NO: 26152 - DNA, 18 bp, Artificial Sequence
  Synthetic DNA
caatacaacgctctatag

SEQ ID NO: 26153 - DNA, 18 bp, Artificial Sequence
  Synthetic DNA
caatacgacttaataaag

SEQ ID NO: 26154 - DNA, 18 bp, Artificial Sequence
  Synthetic DNA
caatacgagttactttag

SEQ ID NO: 26155 - DNA, 18 bp, Artificial Sequence
  Synthetic DNA
caatacgccttactttag

SEQ ID NO: 26156 - DNA, 18 bp, Artificial Sequence
  Synthetic DNA
caatacgtatcactacag

SEQ ID NO: 26157 - DNA, 18 bp, Artificial Sequence
  Synthetic DNA
caatacgtttcattatag

SEQ ID NO: 26158 - DNA, 18 bp, Artificial Sequence
  Synthetic DNA
caataggacttactttag

SEQ ID NO: 26159 - DNA, 18 bp, Artificial Sequence
  Synthetic DNA
caatataacttactatag

SEQ ID NO: 26160 - DNA, 18 bp, Artificial Sequence
  Synthetic DNA
caatatgacacactgtag

SEQ ID NO: 26161 - DNA, 18 bp, Artificial Sequence
  Synthetic DNA
cactacgattcattatag

SEQ ID NO: 26162 - DNA, 18 bp, Artificial Sequence
  Synthetic DNA
cagtacgactcacaaaag

SEQ ID NO: 26163 - DNA, 18 bp, Artificial Sequence
  Synthetic DNA
cctgacgactcactatag

SEQ ID NO: 26164 - DNA, 18 bp, Artificial Sequence
  Synthetic DNA
ctataagacacactatag

SEQ ID NO: 26165 - DNA, 18 bp, Artificial Sequence
  Synthetic DNA
ctatacgactcactaacg

SEQ ID NO: 26166 - DNA, 18 bp, Artificial Sequence
  Synthetic DNA
ctatacgactccatatag

SEQ ID NO: 26167 - DNA, 18 bp, Artificial Sequence
  Synthetic DNA
ctatacggatcactatag

SEQ ID NO: 26168 - DNA, 18 bp, Artificial Sequence
  Synthetic DNA
ctatacgtatcactatag

SEQ ID NO: 26169 - DNA, 18 bp, Artificial Sequence
  Synthetic DNA
gaatacatctcacaatag

SEQ ID NO: 26170 - DNA, 18 bp, Artificial Sequence
  Synthetic DNA
gaatacgacacaaaatag

SEQ ID NO: 26171 - DNA, 18 bp, Artificial Sequence
  Synthetic DNA
gaatatgactcacaacag

SEQ ID NO: 26172 - DNA, 18 bp, Artificial Sequence
  Synthetic DNA
taaaaagacacactgtag

SEQ ID NO: 26173 - DNA, 18 bp, Artificial Sequence
  Synthetic DNA
taaaaagactccctaaag

SEQ ID NO: 26174 - DNA, 18 bp, Artificial Sequence
  Synthetic DNA
taaaaagattcacaatag

SEQ ID NO: 26175 - DNA, 18 bp, Artificial Sequence
  Synthetic DNA
taaaacaacttattatag

SEQ ID NO: 26176 - DNA, 18 bp, Artificial Sequence
  Synthetic DNA
taaaacccctcactagag

SEQ ID NO: 26177 - DNA, 18 bp, Artificial Sequence
  Synthetic DNA
taaaacgacacattagag

SEQ ID NO: 26178 - DNA, 18 bp, Artificial Sequence
  Synthetic DNA
taaaacgacagaccatag

SEQ ID NO: 26179 - DNA, 18 bp, Artificial Sequence
  Synthetic DNA
taaaacgaccccccatag

SEQ ID NO: 26180 - DNA, 18 bp, Artificial Sequence
  Synthetic DNA
taaaacgactcaatcaag

SEQ ID NO: 26181 - DNA, 18 bp, Artificial Sequence
  Synthetic DNA
taaaacgactgacaaaag

SEQ ID NO: 26182 - DNA, 18 bp, Artificial Sequence
  Synthetic DNA
taaaacgacttacgaaag

SEQ ID NO: 26183 - DNA, 18 bp, Artificial Sequence
  Synthetic DNA
taaaacgactttctatgg

SEQ ID NO: 26184 - DNA, 18 bp, Artificial Sequence
  Synthetic DNA
taaaacgcctcactgtcg

SEQ ID NO: 26185 - DNA, 18 bp, Artificial Sequence
  Synthetic DNA
taaaacgcctctctgtag

SEQ ID NO: 26186 - DNA, 18 bp, Artificial Sequence
  Synthetic DNA
taaaacggcacaatatag

SEQ ID NO: 26187 - DNA, 18 bp, Artificial Sequence
  Synthetic DNA
taaaacgtatcactgtag

SEQ ID NO: 26188 - DNA, 18 bp, Artificial Sequence
  Synthetic DNA
taaaacgtctccatatag

SEQ ID NO: 26189 - DNA, 18 bp, Artificial Sequence
  Synthetic DNA
taaaactattcactaaag

SEQ ID NO: 26190 - DNA, 18 bp, Artificial Sequence
  Synthetic DNA
taaaagcactcattatag

SEQ ID NO: 26191 - DNA, 18 bp, Artificial Sequence
  Synthetic DNA
taaaataactcacaatag

SEQ ID NO: 26192 - DNA, 18 bp, Artificial Sequence
  Synthetic DNA
taaaatgacagactatag

SEQ ID NO: 26193 - DNA, 18 bp, Artificial Sequence
  Synthetic DNA
taaaccgactcacgttag

SEQ ID NO: 26194 - DNA, 18 bp, Artificial Sequence
  Synthetic DNA
taaaccgactcacttaag

SEQ ID NO: 26195 - DNA, 18 bp, Artificial Sequence
  Synthetic DNA
taaaccgattcactatcg

SEQ ID NO: 26196 - DNA, 18 bp, Artificial Sequence
  Synthetic DNA
taaaccgattcactctag

SEQ ID NO: 26197 - DNA, 18 bp, Artificial Sequence
  Synthetic DNA
taaaccgatttactatag

SEQ ID NO: 26198 - DNA, 18 bp, Artificial Sequence
  Synthetic DNA
taaacctactcaccatag

SEQ ID NO: 26199 - DNA, 18 bp, Artificial Sequence
  Synthetic DNA
taaaccttctcactatag

SEQ ID NO: 26200 - DNA, 18 bp, Artificial Sequence
  Synthetic DNA
taaagcgtctcactttag

SEQ ID NO: 26201 - DNA, 18 bp, Artificial Sequence
  Synthetic DNA
taacacaactcacttcag

SEQ ID NO: 26202 - DNA, 18 bp, Artificial Sequence
  Synthetic DNA
taacacatcttactatag

SEQ ID NO: 26203 - DNA, 18 bp, Artificial Sequence
  Synthetic DNA
taacacgacccacttaag

SEQ ID NO: 26204 - DNA, 18 bp, Artificial Sequence
  Synthetic DNA
taacacgactaaccatgg

SEQ ID NO: 26205 - DNA, 18 bp, Artificial Sequence
  Synthetic DNA
taacacgactaacttgag

SEQ ID NO: 26206 - DNA, 18 bp, Artificial Sequence
  Synthetic DNA
taacacgattcacaatgg

SEQ ID NO: 26207 - DNA, 18 bp, Artificial Sequence
  Synthetic DNA
taacacgtatcacaatag

SEQ ID NO: 26208 - DNA, 18 bp, Artificial Sequence
  Synthetic DNA
taacacgtctcacaatcg

SEQ ID NO: 26209 - DNA, 18 bp, Artificial Sequence
  Synthetic DNA
taacacgtcttactttag

SEQ ID NO: 26210 - DNA, 18 bp, Artificial Sequence
  Synthetic DNA
taacatgacttacaatag

SEQ ID NO: 26211 - DNA, 18 bp, Artificial Sequence
  Synthetic DNA
taacgcgactctctgtag

SEQ ID NO: 26212 - DNA, 18 bp, Artificial Sequence
  Synthetic DNA
taacgcgattgactatag

SEQ ID NO: 26213 - DNA, 18 bp, Artificial Sequence
  Synthetic DNA
taagaagtctcattatag

SEQ ID NO: 26214 - DNA, 18 bp, Artificial Sequence
  Synthetic DNA
taagacgccacactagag

SEQ ID NO: 26215 - DNA, 18 bp, Artificial Sequence
  Synthetic DNA
taagctgactctctatag

SEQ ID NO: 26216 - DNA, 18 bp, Artificial Sequence
  Synthetic DNA
taataaaacaaactatag

SEQ ID NO: 26217 - DNA, 18 bp, Artificial Sequence
  Synthetic DNA
taataacattcattatag

SEQ ID NO: 26218 - DNA, 18 bp, Artificial Sequence
  Synthetic DNA
taataagactcaataacg

SEQ ID NO: 26219 - DNA, 18 bp, Artificial Sequence
  Synthetic DNA
taataagactcccaaaag

SEQ ID NO: 26220 - DNA, 18 bp, Artificial Sequence
  Synthetic DNA
taataagactctttagag

SEQ ID NO: 26221 - DNA, 18 bp, Artificial Sequence
  Synthetic DNA
taataagacttaatttag

SEQ ID NO: 26222 - DNA, 18 bp, Artificial Sequence
  Synthetic DNA
taataagacttacgttag

SEQ ID NO: 26223 - DNA, 18 bp, Artificial Sequence
  Synthetic DNA
taataagattaactttag

SEQ ID NO: 26224 - DNA, 18 bp, Artificial Sequence
  Synthetic DNA
taataagattccctttag

SEQ ID NO: 26225 - DNA, 18 bp, Artificial Sequence
  Synthetic DNA
taataaggctctcaatag

SEQ ID NO: 26226 - DNA, 18 bp, Artificial Sequence
  Synthetic DNA
taatacaactcagattag

SEQ ID NO: 26227 - DNA, 18 bp, Artificial Sequence
  Synthetic DNA
taatacaactcattttgg

SEQ ID NO: 26228 - DNA, 18 bp, Artificial Sequence
  Synthetic DNA
taatacaactctatttag

SEQ ID NO: 26229 - DNA, 18 bp, Artificial Sequence
  Synthetic DNA
taatacaatagactatag

SEQ ID NO: 26230 - DNA, 18 bp, Artificial Sequence
  Synthetic DNA
taatacaattttctatag

SEQ ID NO: 26231 - DNA, 18 bp, Artificial Sequence
  Synthetic DNA
taatacatatctctatag

SEQ ID NO: 26232 - DNA, 18 bp, Artificial Sequence
  Synthetic DNA
taataccaataaatatag

SEQ ID NO: 26233 - DNA, 18 bp, Artificial Sequence
  Synthetic DNA
taataccacataatatag

SEQ ID NO: 26234 - DNA, 18 bp, Artificial Sequence
  Synthetic DNA
taataccactccatttag

SEQ ID NO: 26235 - DNA, 18 bp, Artificial Sequence
  Synthetic DNA
taataccattaactaaag

SEQ ID NO: 26236 - DNA, 18 bp, Artificial Sequence
  Synthetic DNA
taataccgcactctatag

SEQ ID NO: 26237 - DNA, 18 bp, Artificial Sequence
  Synthetic DNA
taatacctatcactttag

SEQ ID NO: 26238 - DNA, 18 bp, Artificial Sequence
  Synthetic DNA
taatacgaagcaccatgg

SEQ ID NO: 26239 - DNA, 18 bp, Artificial Sequence
  Synthetic DNA
taatacgaatccttttag

SEQ ID NO: 26240 - DNA, 18 bp, Artificial Sequence
  Synthetic DNA
taatacgaattcttatag

SEQ ID NO: 26241 - DNA, 18 bp, Artificial Sequence
  Synthetic DNA
taatacgacaaactgtgg

SEQ ID NO: 26242 - DNA, 18 bp, Artificial Sequence
  Synthetic DNA
taatacgacacacaaacg

SEQ ID NO: 26243 - DNA, 18 bp, Artificial Sequence
  Synthetic DNA
taatacgacacaccttgg

SEQ ID NO: 26244 - DNA, 18 bp, Artificial Sequence
  Synthetic DNA
taatacgacacagtctgg

SEQ ID NO: 26245 - DNA, 18 bp, Artificial Sequence
  Synthetic DNA
taatacgacaccctgaag

SEQ ID NO: 26246 - DNA, 18 bp, Artificial Sequence
  Synthetic DNA
taatacgacattctatgg

SEQ ID NO: 26247 - DNA, 18 bp, Artificial Sequence
  Synthetic DNA
taatacgacccagagtag

SEQ ID NO: 26248 - DNA, 18 bp, Artificial Sequence
  Synthetic DNA
taatacgactatttaaag

SEQ ID NO: 26249 - DNA, 18 bp, Artificial Sequence
  Synthetic DNA
taatacgactctatttcg

SEQ ID NO: 26250 - DNA, 18 bp, Artificial Sequence
  Synthetic DNA
taatacgacttcataaag

SEQ ID NO: 26251 - DNA, 18 bp, Artificial Sequence
  Synthetic DNA
taatacgagacacttaag

SEQ ID NO: 26252 - DNA, 18 bp, Artificial Sequence
  Synthetic DNA
taatacgagtcacttagg

SEQ ID NO: 26253 - DNA, 18 bp, Artificial Sequence
  Synthetic DNA
taatacgagtcatcaaag

SEQ ID NO: 26254 - DNA, 18 bp, Artificial Sequence
  Synthetic DNA
taatacgagttacttaag

SEQ ID NO: 26255 - DNA, 18 bp, Artificial Sequence
  Synthetic DNA
taatacgataaagtatag

SEQ ID NO: 26256 - DNA, 18 bp, Artificial Sequence
  Synthetic DNA
taatacgatcaactctag

SEQ ID NO: 26257 - DNA, 18 bp, Artificial Sequence
  Synthetic DNA
taatacgattctatatcg

SEQ ID NO: 26258 - DNA, 18 bp, Artificial Sequence
  Synthetic DNA
taatacgattctcagtag

SEQ ID NO: 26259 - DNA, 18 bp, Artificial Sequence
  Synthetic DNA
taatacgatttaataaag

SEQ ID NO: 26260 - DNA, 18 bp, Artificial Sequence
  Synthetic DNA
taatacgccacaccaaag

SEQ ID NO: 26261 - DNA, 18 bp, Artificial Sequence
  Synthetic DNA
taatacgcctcaaattag

SEQ ID NO: 26262 - DNA, 18 bp, Artificial Sequence
  Synthetic DNA
taatacggatcacgagag

SEQ ID NO: 26263 - DNA, 18 bp, Artificial Sequence
  Synthetic DNA
taatacggcactttatag

SEQ ID NO: 26264 - DNA, 18 bp, Artificial Sequence
  Synthetic DNA
taatacgggtaacaatag

SEQ ID NO: 26265 - DNA, 18 bp, Artificial Sequence
  Synthetic DNA
taatacgtaacacaatag

SEQ ID NO: 26266 - DNA, 18 bp, Artificial Sequence
  Synthetic DNA
taatacgtatcaataaag

SEQ ID NO: 26267 - DNA, 18 bp, Artificial Sequence
  Synthetic DNA
taatacgtatccgtatag

SEQ ID NO: 26268 - DNA, 18 bp, Artificial Sequence
  Synthetic DNA
taatacgtcgcaacatag

SEQ ID NO: 26269 - DNA, 18 bp, Artificial Sequence
  Synthetic DNA
taatacgtctcacaaacg

SEQ ID NO: 26270 - DNA, 18 bp, Artificial Sequence
  Synthetic DNA
taatacgtctcactcacg

SEQ ID NO: 26271 - DNA, 18 bp, Artificial Sequence
  Synthetic DNA
taatacgtctctcaagag

SEQ ID NO: 26272 - DNA, 18 bp, Artificial Sequence
  Synthetic DNA
taatacgtctgtctttag

SEQ ID NO: 26273 - DNA, 18 bp, Artificial Sequence
  Synthetic DNA
taatacgtgtcacattag

SEQ ID NO: 26274 - DNA, 18 bp, Artificial Sequence
  Synthetic DNA
taatacgtgtcaccaaag

SEQ ID NO: 26275 - DNA, 18 bp, Artificial Sequence
  Synthetic DNA
taatacgtttcacaacag

SEQ ID NO: 26276 - DNA, 18 bp, Artificial Sequence
  Synthetic DNA
taatactacacacgttag

SEQ ID NO: 26277 - DNA, 18 bp, Artificial Sequence
  Synthetic DNA
taatactacagacgatag

SEQ ID NO: 26278 - DNA, 18 bp, Artificial Sequence
  Synthetic DNA
taatactacagactaaag

SEQ ID NO: 26279 - DNA, 18 bp, Artificial Sequence
  Synthetic DNA
taatactacgaactacag

SEQ ID NO: 26280 - DNA, 18 bp, Artificial Sequence
  Synthetic DNA
taatactactcccaatcg

SEQ ID NO: 26281 - DNA, 18 bp, Artificial Sequence
  Synthetic DNA
taatactactctaaatag

SEQ ID NO: 26282 - DNA, 18 bp, Artificial Sequence
  Synthetic DNA
taatactactgataatag

SEQ ID NO: 26283 - DNA, 18 bp, Artificial Sequence
  Synthetic DNA
taatactattaagtatag

SEQ ID NO: 26284 - DNA, 18 bp, Artificial Sequence
  Synthetic DNA
taatactattcaatacag

SEQ ID NO: 26285 - DNA, 18 bp, Artificial Sequence
  Synthetic DNA
taatactgctcagtacag

SEQ ID NO: 26286 - DNA, 18 bp, Artificial Sequence
  Synthetic DNA
taatacttcacacgatag

SEQ ID NO: 26287 - DNA, 18 bp, Artificial Sequence
  Synthetic DNA
taatacttcccactctag

SEQ ID NO: 26288 - DNA, 18 bp, Artificial Sequence
  Synthetic DNA
taatacttctccctctag

SEQ ID NO: 26289 - DNA, 18 bp, Artificial Sequence
  Synthetic DNA
taataggactcacgttcg

SEQ ID NO: 26290 - DNA, 18 bp, Artificial Sequence
  Synthetic DNA
taataggccacactacag

SEQ ID NO: 26291 - DNA, 18 bp, Artificial Sequence
  Synthetic DNA
taatataactgtctatag

SEQ ID NO: 26292 - DNA, 18 bp, Artificial Sequence
  Synthetic DNA
taatataattctctatag

SEQ ID NO: 26293 - DNA, 18 bp, Artificial Sequence
  Synthetic DNA
taatatcattcactaaag

SEQ ID NO: 26294 - DNA, 18 bp, Artificial Sequence
  Synthetic DNA
taatatgacatacgatag

SEQ ID NO: 26295 - DNA, 18 bp, Artificial Sequence
  Synthetic DNA
taatatgactcataatgg

SEQ ID NO: 26296 - DNA, 18 bp, Artificial Sequence
  Synthetic DNA
taatatgactctcattag

SEQ ID NO: 26297 - DNA, 18 bp, Artificial Sequence
  Synthetic DNA
taatatgagacactaaag

SEQ ID NO: 26298 - DNA, 18 bp, Artificial Sequence
  Synthetic DNA
taatatggcttaatatag

SEQ ID NO: 26299 - DNA, 18 bp, Artificial Sequence
  Synthetic DNA
taatatggttcactgtag

SEQ ID NO: 26300 - DNA, 18 bp, Artificial Sequence
  Synthetic DNA
taatatgtctcattatcg

SEQ ID NO: 26301 - DNA, 18 bp, Artificial Sequence
  Synthetic DNA
taatattactaaatatag

SEQ ID NO: 26302 - DNA, 18 bp, Artificial Sequence
  Synthetic DNA
taatattgctaactatag

SEQ ID NO: 26303 - DNA, 18 bp, Artificial Sequence
  Synthetic DNA
taatcagacacaccatag

SEQ ID NO: 26304 - DNA, 18 bp, Artificial Sequence
  Synthetic DNA
taatcaggctcacaatag

SEQ ID NO: 26305 - DNA, 18 bp, Artificial Sequence
  Synthetic DNA
taatccaactaaatatag

SEQ ID NO: 26306 - DNA, 18 bp, Artificial Sequence
  Synthetic DNA
taatccaattcactttag

SEQ ID NO: 26307 - DNA, 18 bp, Artificial Sequence
  Synthetic DNA
taatccgacttaacatag

SEQ ID NO: 26308 - DNA, 18 bp, Artificial Sequence
  Synthetic DNA
taatccgtctctctctag

SEQ ID NO: 26309 - DNA, 18 bp, Artificial Sequence
  Synthetic DNA
taatccgtttcacgatag

SEQ ID NO: 26310 - DNA, 18 bp, Artificial Sequence
  Synthetic DNA
taatcggatttactatag

SEQ ID NO: 26311 - DNA, 18 bp, Artificial Sequence
  Synthetic DNA
taatctgactccctatcg

SEQ ID NO: 26312 - DNA, 18 bp, Artificial Sequence
  Synthetic DNA
taatcttactcacaatag

SEQ ID NO: 26313 - DNA, 18 bp, Artificial Sequence
  Synthetic DNA
taatgcaactcagaatag

SEQ ID NO: 26314 - DNA, 18 bp, Artificial Sequence
  Synthetic DNA
taatgcaagtcattatag

SEQ ID NO: 26315 - DNA, 18 bp, Artificial Sequence
  Synthetic DNA
taatgcgaatcactttcg

SEQ ID NO: 26316 - DNA, 18 bp, Artificial Sequence
  Synthetic DNA
taatgcgactcaattaag

SEQ ID NO: 26317 - DNA, 18 bp, Artificial Sequence
  Synthetic DNA
taatgcgactcacaaacg

SEQ ID NO: 26318 - DNA, 18 bp, Artificial Sequence
  Synthetic DNA
taatgcgactcacatgag

SEQ ID NO: 26319 - DNA, 18 bp, Artificial Sequence
  Synthetic DNA
taatgcgactcccgttag

SEQ ID NO: 26320 - DNA, 18 bp, Artificial Sequence
  Synthetic DNA
taatgcgattcaatctag

SEQ ID NO: 26321 - DNA, 18 bp, Artificial Sequence
  Synthetic DNA
taatgcgattcaccgtag

SEQ ID NO: 26322 - DNA, 18 bp, Artificial Sequence
  Synthetic DNA
taatgcgcctctctatgg

SEQ ID NO: 26323 - DNA, 18 bp, Artificial Sequence
  Synthetic DNA
taatgctacagactatag

SEQ ID NO: 26324 - DNA, 18 bp, Artificial Sequence
  Synthetic DNA
tactaagacacacaatag

SEQ ID NO: 26325 - DNA, 18 bp, Artificial Sequence
  Synthetic DNA
tactaagtcttactatag

SEQ ID NO: 26326 - DNA, 18 bp, Artificial Sequence
  Synthetic DNA
tactacgaatcattgtag

SEQ ID NO: 26327 - DNA, 18 bp, Artificial Sequence
  Synthetic DNA
tactacgacacactaagg

SEQ ID NO: 26328 - DNA, 18 bp, Artificial Sequence
  Synthetic DNA
tactacgacacactaccg

SEQ ID NO: 26329 - DNA, 18 bp, Artificial Sequence
  Synthetic DNA
tactacgaccctatatag

SEQ ID NO: 26330 - DNA, 18 bp, Artificial Sequence
  Synthetic DNA
tactacgactgtatatag

SEQ ID NO: 26331 - DNA, 18 bp, Artificial Sequence
  Synthetic DNA
tactacgatacaccatag

SEQ ID NO: 26332 - DNA, 18 bp, Artificial Sequence
  Synthetic DNA
tactacgcctctctaaag

SEQ ID NO: 26333 - DNA, 18 bp, Artificial Sequence
  Synthetic DNA
tactacgtcacactttag

SEQ ID NO: 26334 - DNA, 18 bp, Artificial Sequence
  Synthetic DNA
tactacgtctgagtatag

SEQ ID NO: 26335 - DNA, 18 bp, Artificial Sequence
  Synthetic DNA
tactatcacttactatag

SEQ ID NO: 26336 - DNA, 18 bp, Artificial Sequence
  Synthetic DNA
tactatgattcactaaag

SEQ ID NO: 26337 - DNA, 18 bp, Artificial Sequence
  Synthetic DNA
tactatgattctctatag

SEQ ID NO: 26338 - DNA, 18 bp, Artificial Sequence
  Synthetic DNA
tactgtgactcactagag

SEQ ID NO: 26339 - DNA, 18 bp, Artificial Sequence
  Synthetic DNA
tagagcgactcactatgg

SEQ ID NO: 26340 - DNA, 18 bp, Artificial Sequence
  Synthetic DNA
tagtaccactcacttaag

SEQ ID NO: 26341 - DNA, 18 bp, Artificial Sequence
  Synthetic DNA
tagtacgaatcaccctag

SEQ ID NO: 26342 - DNA, 18 bp, Artificial Sequence
  Synthetic DNA
tagtacgacaaattatag

SEQ ID NO: 26343 - DNA, 18 bp, Artificial Sequence
  Synthetic DNA
tagtacgactcacattgg

SEQ ID NO: 26344 - DNA, 18 bp, Artificial Sequence
  Synthetic DNA
tagtacgactctccttag

SEQ ID NO: 26345 - DNA, 18 bp, Artificial Sequence
  Synthetic DNA
tagtacgagtcagtacag

SEQ ID NO: 26346 - DNA, 18 bp, Artificial Sequence
  Synthetic DNA
tagtacgatacagtatag

SEQ ID NO: 26347 - DNA, 18 bp, Artificial Sequence
  Synthetic DNA
tagtacgcctcacaaaag

SEQ ID NO: 26348 - DNA, 18 bp, Artificial Sequence
  Synthetic DNA
tagtacgtttcactttag

SEQ ID NO: 26349 - DNA, 18 bp, Artificial Sequence
  Synthetic DNA
tagtactactcataatag

SEQ ID NO: 26350 - DNA, 18 bp, Artificial Sequence
  Synthetic DNA
tagtactactctatatag

SEQ ID NO: 26351 - DNA, 18 bp, Artificial Sequence
  Synthetic DNA
tagtatgtctcactatcg

SEQ ID NO: 26352 - DNA, 18 bp, Artificial Sequence
  Synthetic DNA
tagtctggctcactatag

SEQ ID NO: 26353 - DNA, 18 bp, Artificial Sequence
  Synthetic DNA
tagtgcgactcactcgag

SEQ ID NO: 26354 - DNA, 18 bp, Artificial Sequence
  Synthetic DNA
tagtgcgcctcactatcg

SEQ ID NO: 26355 - DNA, 18 bp, Artificial Sequence
  Synthetic DNA
tataaccactcattatag

SEQ ID NO: 26356 - DNA, 18 bp, Artificial Sequence
  Synthetic DNA
tataacgacagactatag

SEQ ID NO: 26357 - DNA, 18 bp, Artificial Sequence
  Synthetic DNA
tataacgaccaactatag

SEQ ID NO: 26358 - DNA, 18 bp, Artificial Sequence
  Synthetic DNA
tataacgactaactatcg

SEQ ID NO: 26359 - DNA, 18 bp, Artificial Sequence
  Synthetic DNA
tataacgactcactaagg

SEQ ID NO: 26360 - DNA, 18 bp, Artificial Sequence
  Synthetic DNA
tataacgcctcactctag

SEQ ID NO: 26361 - DNA, 18 bp, Artificial Sequence
  Synthetic DNA
tataacgcctcactttag

SEQ ID NO: 26362 - DNA, 18 bp, Artificial Sequence
  Synthetic DNA
tatcacgactcactttcg

SEQ ID NO: 26363 - DNA, 18 bp, Artificial Sequence
  Synthetic DNA
tatcacgactctctaaag

SEQ ID NO: 26364 - DNA, 18 bp, Artificial Sequence
  Synthetic DNA
tatgaccattcactatag

SEQ ID NO: 26365 - DNA, 18 bp, Artificial Sequence
  Synthetic DNA
tatgattactcactatag

SEQ ID NO: 26366 - DNA, 18 bp, Artificial Sequence
  Synthetic DNA
tattaagactcaatttag

SEQ ID NO: 26367 - DNA, 18 bp, Artificial Sequence
  Synthetic DNA
tattaagactcactttcg

SEQ ID NO: 26368 - DNA, 18 bp, Artificial Sequence
  Synthetic DNA
tattaagacttaatatag

SEQ ID NO: 26369 - DNA, 18 bp, Artificial Sequence
  Synthetic DNA
tattaagtctcactatcg

SEQ ID NO: 26370 - DNA, 18 bp, Artificial Sequence
  Synthetic DNA
tattaccacactctatag

SEQ ID NO: 26371 - DNA, 18 bp, Artificial Sequence
  Synthetic DNA
tattaccactctctaaag

SEQ ID NO: 26372 - DNA, 18 bp, Artificial Sequence
  Synthetic DNA
tattacccctcactttag

SEQ ID NO: 26373 - DNA, 18 bp, Artificial Sequence
  Synthetic DNA
tattacgaataactatcg

SEQ ID NO: 26374 - DNA, 18 bp, Artificial Sequence
  Synthetic DNA
tattacgacacattaaag

SEQ ID NO: 26375 - DNA, 18 bp, Artificial Sequence
  Synthetic DNA
tattacgacgcacaaaag

SEQ ID NO: 26376 - DNA, 18 bp, Artificial Sequence
  Synthetic DNA
tattacgactaacaatcg

SEQ ID NO: 26377 - DNA, 18 bp, Artificial Sequence
  Synthetic DNA
tattacgactatctgtag

SEQ ID NO: 26378 - DNA, 18 bp, Artificial Sequence
  Synthetic DNA
tattacgactcaccagcg

SEQ ID NO: 26379 - DNA, 18 bp, Artificial Sequence
  Synthetic DNA
tattacgactctccttag

SEQ ID NO: 26380 - DNA, 18 bp, Artificial Sequence
  Synthetic DNA
tattacgactctctctcg

SEQ ID NO: 26381 - DNA, 18 bp, Artificial Sequence
  Synthetic DNA
tattacgagtcataatag

SEQ ID NO: 26382 - DNA, 18 bp, Artificial Sequence
  Synthetic DNA
tattacgccccactttag

SEQ ID NO: 26383 - DNA, 18 bp, Artificial Sequence
  Synthetic DNA
tattacggcacactagag

SEQ ID NO: 26384 - DNA, 18 bp, Artificial Sequence
  Synthetic DNA
tattacggttcacaatag

SEQ ID NO: 26385 - DNA, 18 bp, Artificial Sequence
  Synthetic DNA
tattacgtatctctatag

SEQ ID NO: 26386 - DNA, 18 bp, Artificial Sequence
  Synthetic DNA
tattactaatcaatatag

SEQ ID NO: 26387 - DNA, 18 bp, Artificial Sequence
  Synthetic DNA
tattacttcccactatag

SEQ ID NO: 26388 - DNA, 18 bp, Artificial Sequence
  Synthetic DNA
tattagaactctctatag

SEQ ID NO: 26389 - DNA, 18 bp, Artificial Sequence
  Synthetic DNA
tattaggactctccatag

SEQ ID NO: 26390 - DNA, 18 bp, Artificial Sequence
  Synthetic DNA
tattagtactctctatag

SEQ ID NO: 26391 - DNA, 18 bp, Artificial Sequence
  Synthetic DNA
tattatggcacactatag

SEQ ID NO: 26392 - DNA, 18 bp, Artificial Sequence
  Synthetic DNA
tattcagactcaccatag

SEQ ID NO: 26393 - DNA, 18 bp, Artificial Sequence
  Synthetic DNA
tattccaactcactttag

SEQ ID NO: 26394 - DNA, 18 bp, Artificial Sequence
  Synthetic DNA
tattccgacttaatatag

SEQ ID NO: 26395 - DNA, 18 bp, Artificial Sequence
  Synthetic DNA
tattccgacttactatgg

SEQ ID NO: 26396 - DNA, 18 bp, Artificial Sequence
  Synthetic DNA
tattgcgactctccatag

SEQ ID NO: 26397 - DNA, 18 bp, Artificial Sequence
  Synthetic DNA
tcaaactactcattatag

SEQ ID NO: 26398 - DNA, 18 bp, Artificial Sequence
  Synthetic DNA
tcatacaactatctatag

SEQ ID NO: 26399 - DNA, 18 bp, Artificial Sequence
  Synthetic DNA
tcatacaactctatatag

SEQ ID NO: 26400 - DNA, 18 bp, Artificial Sequence
  Synthetic DNA
tcatacatctctctatag

SEQ ID NO: 26401 - DNA, 18 bp, Artificial Sequence
  Synthetic DNA
tcatacgaaacacaatag

SEQ ID NO: 26402 - DNA, 18 bp, Artificial Sequence
  Synthetic DNA
tcatacgaatctttatag

SEQ ID NO: 26403 - DNA, 18 bp, Artificial Sequence
  Synthetic DNA
tcatacgacttaccaaag

SEQ ID NO: 26404 - DNA, 18 bp, Artificial Sequence
  Synthetic DNA
tcatacgattcaccttag

SEQ ID NO: 26405 - DNA, 18 bp, Artificial Sequence
  Synthetic DNA
tcatacgcctccctaaag

SEQ ID NO: 26406 - DNA, 18 bp, Artificial Sequence
  Synthetic DNA
tcatacgtcaccctatag

SEQ ID NO: 26407 - DNA, 18 bp, Artificial Sequence
  Synthetic DNA
tcatacgtctaacaatag

SEQ ID NO: 26408 - DNA, 18 bp, Artificial Sequence
  Synthetic DNA
tcatacgtctcaatctag

SEQ ID NO: 26409 - DNA, 18 bp, Artificial Sequence
  Synthetic DNA
tcatattcctcactatag

SEQ ID NO: 26410 - DNA, 18 bp, Artificial Sequence
  Synthetic DNA
tcatccgactctttatag

SEQ ID NO: 26411 - DNA, 18 bp, Artificial Sequence
  Synthetic DNA
tcatgcgacacactatgg

SEQ ID NO: 26412 - DNA, 18 bp, Artificial Sequence
  Synthetic DNA
tcatgcgacccaccatag

SEQ ID NO: 26413 - DNA, 18 bp, Artificial Sequence
  Synthetic DNA
tcatgcgactctctttag

SEQ ID NO: 26414 - DNA, 18 bp, Artificial Sequence
  Synthetic DNA
tcatgctactcactctag

SEQ ID NO: 26415 - DNA, 18 bp, Artificial Sequence
  Synthetic DNA
tcatgcttctcactatag

SEQ ID NO: 26416 - DNA, 18 bp, Artificial Sequence
  Synthetic DNA
tcttaagacttactatag

SEQ ID NO: 26417 - DNA, 18 bp, Artificial Sequence
  Synthetic DNA
tgaaacgattcattatag

SEQ ID NO: 26418 - DNA, 18 bp, Artificial Sequence
  Synthetic DNA
tgacacgactcacttcag

SEQ ID NO: 26419 - DNA, 18 bp, Artificial Sequence
  Synthetic DNA
tgataagagtcacaatag

SEQ ID NO: 26420 - DNA, 18 bp, Artificial Sequence
  Synthetic DNA
tgatacgacacactttcg

SEQ ID NO: 26421 - DNA, 18 bp, Artificial Sequence
  Synthetic DNA
tgatacgccaaactatag

SEQ ID NO: 26422 - DNA, 18 bp, Artificial Sequence
  Synthetic DNA
tgatacggctcaatacag

SEQ ID NO: 26423 - DNA, 18 bp, Artificial Sequence
  Synthetic DNA
tgatacgtctctccatag

SEQ ID NO: 26424 - DNA, 18 bp, Artificial Sequence
  Synthetic DNA
tgatacgtctgattatag

SEQ ID NO: 26425 - DNA, 18 bp, Artificial Sequence
  Synthetic DNA
tgatatgacacactatcg

SEQ ID NO: 26426 - DNA, 18 bp, Artificial Sequence
  Synthetic DNA
tgatatgtctcagtatag

SEQ ID NO: 26427 - DNA, 18 bp, Artificial Sequence
  Synthetic DNA
tgatgagacttactatag

SEQ ID NO: 26428 - DNA, 18 bp, Artificial Sequence
  Synthetic DNA
tgatgcgacacactatgg

SEQ ID NO: 26429 - DNA, 18 bp, Artificial Sequence
  Synthetic DNA
tgatgcgtctcactagag

SEQ ID NO: 26430 - DNA, 18 bp, Artificial Sequence
  Synthetic DNA
tgctaaaactcactatag

SEQ ID NO: 26431 - DNA, 18 bp, Artificial Sequence
  Synthetic DNA
tggtacgagtcactatcg

SEQ ID NO: 26432 - DNA, 18 bp, Artificial Sequence
  Synthetic DNA
tgtaacaactcactatag

SEQ ID NO: 26433 - DNA, 18 bp, Artificial Sequence
  Synthetic DNA
tgtaacgacttactatag

SEQ ID NO: 26434 - DNA, 18 bp, Artificial Sequence
  Synthetic DNA
tgttacgacgcacgatag

SEQ ID NO: 26435 - DNA, 18 bp, Artificial Sequence
  Synthetic DNA
ttaaaccactcactaaag

SEQ ID NO: 26436 - DNA, 18 bp, Artificial Sequence
  Synthetic DNA
ttaaacgaatcagtatag

SEQ ID NO: 26437 - DNA, 18 bp, Artificial Sequence
  Synthetic DNA
ttaaacgaatcattatag

SEQ ID NO: 26438 - DNA, 18 bp, Artificial Sequence
  Synthetic DNA
ttaaacgactgacaatag

SEQ ID NO: 26439 - DNA, 18 bp, Artificial Sequence
  Synthetic DNA
ttaaacgacttattatag

SEQ ID NO: 26440 - DNA, 18 bp, Artificial Sequence
  Synthetic DNA
ttaaaggactctctatag

SEQ ID NO: 26441 - DNA, 18 bp, Artificial Sequence
  Synthetic DNA
ttacacgactcacactag

SEQ ID NO: 26442 - DNA, 18 bp, Artificial Sequence
  Synthetic DNA
ttacactactcaccatag

SEQ ID NO: 26443 - DNA, 18 bp, Artificial Sequence
  Synthetic DNA
ttacactactccctatag

SEQ ID NO: 26444 - DNA, 18 bp, Artificial Sequence
  Synthetic DNA
ttagacgacttactataa

SEQ ID NO: 26445 - DNA, 18 bp, Artificial Sequence
  Synthetic DNA
ttataagattcaatatag

SEQ ID NO: 26446 - DNA, 18 bp, Artificial Sequence
  Synthetic DNA
ttataatactcattatag

SEQ ID NO: 26447 - DNA, 18 bp, Artificial Sequence
  Synthetic DNA
ttataccactaaccatag

SEQ ID NO: 26448 - DNA, 18 bp, Artificial Sequence
  Synthetic DNA
ttatacgaattactaaag

SEQ ID NO: 26449 - DNA, 18 bp, Artificial Sequence
  Synthetic DNA
ttatacgactaactcaag

SEQ ID NO: 26450 - DNA, 18 bp, Artificial Sequence
  Synthetic DNA
ttatacgactatcgatag

SEQ ID NO: 26451 - DNA, 18 bp, Artificial Sequence
  Synthetic DNA
ttatacgactcacagaag

SEQ ID NO: 26452 - DNA, 18 bp, Artificial Sequence
  Synthetic DNA
ttatacgacttcatatag

SEQ ID NO: 26453 - DNA, 18 bp, Artificial Sequence
  Synthetic DNA
ttatacgagtcacttaag

SEQ ID NO: 26454 - DNA, 18 bp, Artificial Sequence
  Synthetic DNA
ttatacgagtctctagag

SEQ ID NO: 26455 - DNA, 18 bp, Artificial Sequence
  Synthetic DNA
ttatacgatcaactatag

SEQ ID NO: 26456 - DNA, 18 bp, Artificial Sequence
  Synthetic DNA
ttatacgattatctatag

SEQ ID NO: 26457 - DNA, 18 bp, Artificial Sequence
  Synthetic DNA
ttatacgattcactaacg

SEQ ID NO: 26458 - DNA, 18 bp, Artificial Sequence
  Synthetic DNA
ttatacgcatcactgtag

SEQ ID NO: 26459 - DNA, 18 bp, Artificial Sequence
  Synthetic DNA
ttatacgtctcacaatgg

SEQ ID NO: 26460 - DNA, 18 bp, Artificial Sequence
  Synthetic DNA
ttatactccttactatag

SEQ ID NO: 26461 - DNA, 18 bp, Artificial Sequence
  Synthetic DNA
ttatacttctgactatag

SEQ ID NO: 26462 - DNA, 18 bp, Artificial Sequence
  Synthetic DNA
ttatagggctcactatcg

SEQ ID NO: 26463 - DNA, 18 bp, Artificial Sequence
  Synthetic DNA
ttatagggcttactatag

SEQ ID NO: 26464 - DNA, 18 bp, Artificial Sequence
  Synthetic DNA
ttatcccactcactaaag

SEQ ID NO: 26465 - DNA, 18 bp, Artificial Sequence
  Synthetic DNA
ttatccccctcactatag

SEQ ID NO: 26466 - DNA, 18 bp, Artificial Sequence
  Synthetic DNA
ttatcctacttactatag

SEQ ID NO: 26467 - DNA, 18 bp, Artificial Sequence
  Synthetic DNA
ttatgcgactccatatag

SEQ ID NO: 26468 - DNA, 18 bp, Artificial Sequence
  Synthetic DNA
ttatgcgtctcactatcg

SEQ ID NO: 26469 - DNA, 18 bp, Artificial Sequence
  Synthetic DNA
ttctatgactcagtatag

SEQ ID NO: 26470 - DNA, 18 bp, Artificial Sequence
  Synthetic DNA
ttgaaagactcactatag

SEQ ID NO: 26471 - DNA, 18 bp, Artificial Sequence
  Synthetic DNA
ttgtaaaactcactatag

SEQ ID NO: 26472 - DNA, 18 bp, Artificial Sequence
  Synthetic DNA
ttgtaagattcactatag

SEQ ID NO: 26473 - DNA, 18 bp, Artificial Sequence
  Synthetic DNA
ttgtacgactatctatag

SEQ ID NO: 26474 - DNA, 18 bp, Artificial Sequence
  Synthetic DNA
ttgtacgattcactctag

SEQ ID NO: 26475 - DNA, 18 bp, Artificial Sequence
  Synthetic DNA
tttaacgactaactatag

SEQ ID NO: 26476 - DNA, 18 bp, Artificial Sequence
  Synthetic DNA
ttttaagactcaatatag

SEQ ID NO: 26477 - DNA, 18 bp, Artificial Sequence
  Synthetic DNA
ttttacaactcactagag

SEQ ID NO: 26478 - DNA, 18 bp, Artificial Sequence
  Synthetic DNA
ttttacaactgactatag

SEQ ID NO: 26479 - DNA, 18 bp, Artificial Sequence
  Synthetic DNA
ttttacgactccctacag

SEQ ID NO: 26480 - DNA, 18 bp, Artificial Sequence
  Synthetic DNA
ttttatgacttactatag

SEQ ID NO: 26481 - DNA, 18 bp, Artificial Sequence
  Synthetic DNA
taacactacacactattg

SEQ ID NO: 26482 - DNA, 18 bp, Artificial Sequence
  Synthetic DNA
taatacatctcattattg

SEQ ID NO: 26483 - DNA, 18 bp, Artificial Sequence
  Synthetic DNA
taatacgatacacaattg

SEQ ID NO: 26484 - DNA, 18 bp, Artificial Sequence
  Synthetic DNA
taatccaactcactaatg

SEQ ID NO: 26485 - DNA, 18 bp, Artificial Sequence
  Synthetic DNA
taattcgaatcacattag

SEQ ID NO: 26486 - DNA, 18 bp, Artificial Sequence
  Synthetic DNA
taattcgtttcactaaag

SEQ ID NO: 26487 - DNA, 18 bp, Artificial Sequence
  Synthetic DNA
tagtacgactgacttttg

SEQ ID NO: 26488 - DNA, 18 bp, Artificial Sequence
  Synthetic DNA
tataacgactcattattg

SEQ ID NO: 26489 - DNA, 18 bp, Artificial Sequence
  Synthetic DNA
tataacgactcgctaaag

SEQ ID NO: 26490 - DNA, 18 bp, Artificial Sequence
  Synthetic DNA
tataacgattcactattg

SEQ ID NO: 26491 - DNA, 18 bp, Artificial Sequence
  Synthetic DNA
tatttcgactcactcaag

SEQ ID NO: 26492 - DNA, 18 bp, Artificial Sequence
  Synthetic DNA
atatactattcactatag

SEQ ID NO: 26493 - DNA, 18 bp, Artificial Sequence
  Synthetic DNA
taatatgacactatatag

SEQ ID NO: 26494 - DNA, 18 bp, Artificial Sequence
  Synthetic DNA
tataacgtttcactatag

SEQ ID NO: 26495 - DNA, 18 bp, Artificial Sequence
  Synthetic DNA
tattaaaactcactaaag

SEQ ID NO: 26496 - DNA, 18 bp, Artificial Sequence
  Synthetic DNA
tattacgtctctcaatag

SEQ ID NO: 26497 - DNA, 18 bp, Artificial Sequence
  Synthetic DNA
tctaacgtctcactatag

SEQ ID NO: 26498 - DNA, 18 bp, Artificial Sequence
  Synthetic DNA
ttatacatctctctatag

SEQ ID NO: 26499 - DNA, 18 bp, Artificial Sequence
  Synthetic DNA
ttatacgaatatctatag

SEQ ID NO: 26500 - DNA, 18 bp, Artificial Sequence
  Synthetic DNA
ttatacgacttacattag

SEQ ID NO: 26501 - DNA, 18 bp, Artificial Sequence
  Synthetic DNA
ttatacgtctcacaatcg

SEQ ID NO: 26502 - DNA, 18 bp, Artificial Sequence
  Synthetic DNA
taatacaactctcaaaag

SEQ ID NO: 26503 - DNA, 18 bp, Artificial Sequence
  Synthetic DNA
tatatcgactcactttag

SEQ ID NO: 26504 - DNA, 18 bp, Artificial Sequence
  Synthetic DNA
taattagtctcacaatag

SEQ ID NO: 26505 - DNA, 18 bp, Artificial Sequence
  Synthetic DNA
tatttcgtctccctatag

SEQ ID NO: 26506 - DNA, 18 bp, Artificial Sequence
  Synthetic DNA
tataacgtctcattatag

SEQ ID NO: 26507 - DNA, 18 bp, Artificial Sequence
  Synthetic DNA
ttatccgtctcactaaag

SEQ ID NO: 26508 - DNA, 18 bp, Artificial Sequence
  Synthetic DNA
aaatacgactctcttttg

SEQ ID NO: 26509 - DNA, 18 bp, Artificial Sequence
  Synthetic DNA
taataggaatcacaattg

SEQ ID NO: 26510 - DNA, 18 bp, Artificial Sequence
  Synthetic DNA
aaatactagtaactatag

SEQ ID NO: 26511 - DNA, 18 bp, Artificial Sequence
  Synthetic DNA
taaaacgtctctctgtag

SEQ ID NO: 26512 - DNA, 18 bp, Artificial Sequence
  Synthetic DNA
taataccactcagttaag

SEQ ID NO: 26513 - DNA, 18 bp, Artificial Sequence
  Synthetic DNA
tataacgactccctaaag

SEQ ID NO: 26514 - DNA, 18 bp, Artificial Sequence
  Synthetic DNA
aaatacgtcccactattg

SEQ ID NO: 26515 - DNA, 18 bp, Artificial Sequence
  Synthetic DNA
taaatcgactcaatttag

SEQ ID NO: 26516 - DNA, 18 bp, Artificial Sequence
  Synthetic DNA
taataaaactcaatattg

SEQ ID NO: 26517 - DNA, 18 bp, Artificial Sequence
  Synthetic DNA
taataaaattcactattg

SEQ ID NO: 26518 - DNA, 18 bp, Artificial Sequence
  Synthetic DNA
taataagactcacttctg

SEQ ID NO: 26519 - DNA, 18 bp, Artificial Sequence
  Synthetic DNA
taataatactcattattg

SEQ ID NO: 26520 - DNA, 18 bp, Artificial Sequence
  Synthetic DNA
taatacgacacatttttg

SEQ ID NO: 26521 - DNA, 18 bp, Artificial Sequence
  Synthetic DNA
taatacgacttacatttg

SEQ ID NO: 26522 - DNA, 18 bp, Artificial Sequence
  Synthetic DNA
taatatgattctctattg

SEQ ID NO: 26523 - DNA, 18 bp, Artificial Sequence
  Synthetic DNA
taatcaaactcactattg

SEQ ID NO: 26524 - DNA, 18 bp, Artificial Sequence
  Synthetic DNA
taattcgaaacactaaag

SEQ ID NO: 26525 - DNA, 18 bp, Artificial Sequence
  Synthetic DNA
taattcgacaaactgtag

SEQ ID NO: 26526 - DNA, 18 bp, Artificial Sequence
  Synthetic DNA
taattcgactaattaaag

SEQ ID NO: 26527 - DNA, 18 bp, Artificial Sequence
  Synthetic DNA
taattctacaccctatag

SEQ ID NO: 26528 - DNA, 18 bp, Artificial Sequence
  Synthetic DNA
taatttctctcactatag

SEQ ID NO: 26529 - DNA, 18 bp, Artificial Sequence
  Synthetic DNA
tattacgactcacagttg

SEQ ID NO: 26530 - DNA, 18 bp, Artificial Sequence
  Synthetic DNA
tatttctactcactaaag

SEQ ID NO: 26531 - DNA, 18 bp, Artificial Sequence
  Synthetic DNA
tattttgactcaatatag

SEQ ID NO: 26532 - DNA, 18 bp, Artificial Sequence
  Synthetic DNA
ttattcgtctaactatag

SEQ ID NO: 26533 - DNA, 18 bp, Artificial Sequence
  Synthetic DNA
ttttactactcactattg

SEQ ID NO: 26534 - DNA, 18 bp, Artificial Sequence
  Synthetic DNA
aaatacgactctctaacg

SEQ ID NO: 26535 - DNA, 18 bp, Artificial Sequence
  Synthetic DNA
aaatacgcatcactaaag

SEQ ID NO: 26536 - DNA, 18 bp, Artificial Sequence
  Synthetic DNA
atataccacacactatag

SEQ ID NO: 26537 - DNA, 18 bp, Artificial Sequence
  Synthetic DNA
atatactactcactctag

SEQ ID NO: 26538 - DNA, 18 bp, Artificial Sequence
  Synthetic DNA
atatatgactctctatag

SEQ ID NO: 26539 - DNA, 18 bp, Artificial Sequence
  Synthetic DNA
taaaacgaatcactccag

SEQ ID NO: 26540 - DNA, 18 bp, Artificial Sequence
  Synthetic DNA
taaaacgacacacttcag

SEQ ID NO: 26541 - DNA, 18 bp, Artificial Sequence
  Synthetic DNA
taaaacgaccaactaaag

SEQ ID NO: 26542 - DNA, 18 bp, Artificial Sequence
  Synthetic DNA
taacacgattcccaatag

SEQ ID NO: 26543 - DNA, 18 bp, Artificial Sequence
  Synthetic DNA
taatacatatcacaatag

SEQ ID NO: 26544 - DNA, 18 bp, Artificial Sequence
  Synthetic DNA
taataccactctcattag

SEQ ID NO: 26545 - DNA, 18 bp, Artificial Sequence
  Synthetic DNA
taatacgaatctcaatcg

SEQ ID NO: 26546 - DNA, 18 bp, Artificial Sequence
  Synthetic DNA
taatacgactcaattacg

SEQ ID NO: 26547 - DNA, 18 bp, Artificial Sequence
  Synthetic DNA
taatacgactgaccgtcg

SEQ ID NO: 26548 - DNA, 18 bp, Artificial Sequence
  Synthetic DNA
taatacgacttatttaag

SEQ ID NO: 26549 - DNA, 18 bp, Artificial Sequence
  Synthetic DNA
taatatctctcacaatag

SEQ ID NO: 26550 - DNA, 18 bp, Artificial Sequence
  Synthetic DNA
taatatgaatctctacag

SEQ ID NO: 26551 - DNA, 18 bp, Artificial Sequence
  Synthetic DNA
taatatgacgtacaatag

SEQ ID NO: 26552 - DNA, 18 bp, Artificial Sequence
  Synthetic DNA
taatgcaacccactaaag

SEQ ID NO: 26553 - DNA, 18 bp, Artificial Sequence
  Synthetic DNA
tacaatgactcacaatag

SEQ ID NO: 26554 - DNA, 18 bp, Artificial Sequence
  Synthetic DNA
tagaacgactcattgtag

SEQ ID NO: 26555 - DNA, 18 bp, Artificial Sequence
  Synthetic DNA
tatgacgattcactaaag

SEQ ID NO: 26556 - DNA, 18 bp, Artificial Sequence
  Synthetic DNA
tattacgactcttaatag

SEQ ID NO: 26557 - DNA, 18 bp, Artificial Sequence
  Synthetic DNA
tattacgcctctatatag

SEQ ID NO: 26558 - DNA, 18 bp, Artificial Sequence
  Synthetic DNA
tattacgtcatactatag

SEQ ID NO: 26559 - DNA, 18 bp, Artificial Sequence
  Synthetic DNA
tattacgtgacactatag

SEQ ID NO: 26560 - DNA, 18 bp, Artificial Sequence
  Synthetic DNA
tattagcactcacaatag

SEQ ID NO: 26561 - DNA, 18 bp, Artificial Sequence
  Synthetic DNA
tattccgattcactaaag

SEQ ID NO: 26562 - DNA, 18 bp, Artificial Sequence
  Synthetic DNA
tgttacgactcagtttag

SEQ ID NO: 26563 - DNA, 18 bp, Artificial Sequence
  Synthetic DNA
ttaaacgacccactttag

SEQ ID NO: 26564 - DNA, 18 bp, Artificial Sequence
  Synthetic DNA
ttatacatctcactatcg

SEQ ID NO: 26565 - DNA, 18 bp, Artificial Sequence
  Synthetic DNA
ttatactactcattatcg

SEQ ID NO: 26566 - DNA, 18 bp, Artificial Sequence
  Synthetic DNA
ttatacttcccactatag

SEQ ID NO: 26567 - DNA, 18 bp, Artificial Sequence
  Synthetic DNA
ttataggactctcaatag

SEQ ID NO: 26568 - DNA, 18 bp, Artificial Sequence
  Synthetic DNA
ttatgcgactaactatgg

SEQ ID NO: 26569 - DNA, 18 bp, Artificial Sequence
  Synthetic DNA
ttctaccactcactagag

SEQ ID NO: 26570 - DNA, 18 bp, Artificial Sequence
  Synthetic DNA
tttaaggactcactatag

SEQ ID NO: 26571 - DNA, 18 bp, Artificial Sequence
  Synthetic DNA
ttttacaacgcactatag

SEQ ID NO: 26572 - DNA, 18 bp, Artificial Sequence
  Synthetic DNA
ttttcctactcactatag

SEQ ID NO: 26573 - DNA, 18 bp, Artificial Sequence
  Synthetic DNA
ttaaacgaatcactaaag

SEQ ID NO: 26574 - DNA, 18 bp, Artificial Sequence
  Synthetic DNA
ttcaacgactcactaaag

SEQ ID NO: 26575 - DNA, 18 bp, Artificial Sequence
  Synthetic DNA
taattcgtctcacaatcg

SEQ ID NO: 26576 - DNA, 18 bp, Artificial Sequence
  Synthetic DNA
ttaaacgactcgcaatag

SEQ ID NO: 26577 - DNA, 18 bp, Artificial Sequence
  Synthetic DNA
ttatacgtctccctattg

SEQ ID NO: 26578 - DNA, 18 bp, Artificial Sequence
  Synthetic DNA
taatatcactctatatag

SEQ ID NO: 26579 - DNA, 18 bp, Artificial Sequence
  Synthetic DNA
tattaatactcactttag

SEQ ID NO: 26580 - DNA, 18 bp, Artificial Sequence
  Synthetic DNA
tattatgtctctctatag

SEQ ID NO: 26581 - DNA, 18 bp, Artificial Sequence
  Synthetic DNA
ttatatgactcataatag

SEQ ID NO: 26582 - DNA, 18 bp, Artificial Sequence
  Synthetic DNA
ttatatgtttcactatag

SEQ ID NO: 26583 - DNA, 18 bp, Artificial Sequence
  Synthetic DNA
aaattcgtctcacaatag

SEQ ID NO: 26584 - DNA, 18 bp, Artificial Sequence
  Synthetic DNA
taaaacttctctctatag

SEQ ID NO: 26585 - DNA, 18 bp, Artificial Sequence
  Synthetic DNA
ttataagactctcaatag

SEQ ID NO: 26586 - DNA, 18 bp, Artificial Sequence
  Synthetic DNA
ttatacgactcaaaatcg

SEQ ID NO: 26587 - DNA, 18 bp, Artificial Sequence
  Synthetic DNA
caatacgtctcacattag

SEQ ID NO: 26588 - DNA, 18 bp, Artificial Sequence
  Synthetic DNA
taaaactactcgctattg

SEQ ID NO: 26589 - DNA, 18 bp, Artificial Sequence
  Synthetic DNA
taattcgaatagctatag

SEQ ID NO: 26590 - DNA, 18 bp, Artificial Sequence
  Synthetic DNA
taattcgacccaatattg

SEQ ID NO: 26591 - DNA, 18 bp, Artificial Sequence
  Synthetic DNA
taattcgacccactgttg

SEQ ID NO: 26592 - DNA, 18 bp, Artificial Sequence
  Synthetic DNA
taattcgactagatatag

SEQ ID NO: 26593 - DNA, 18 bp, Artificial Sequence
  Synthetic DNA
taattcggctcactcttg

SEQ ID NO: 26594 - DNA, 18 bp, Artificial Sequence
  Synthetic DNA
taattcgtctcgccatag

SEQ ID NO: 26595 - DNA, 18 bp, Artificial Sequence
  Synthetic DNA
taattggtctcactattg

SEQ ID NO: 26596 - DNA, 18 bp, Artificial Sequence
  Synthetic DNA
taatttgactcgcgatag

SEQ ID NO: 26597 - DNA, 18 bp, Artificial Sequence
  Synthetic DNA
tagttctactcactattg

SEQ ID NO: 26598 - DNA, 18 bp, Artificial Sequence
  Synthetic DNA
tatttcgactgactattg

SEQ ID NO: 26599 - DNA, 18 bp, Artificial Sequence
  Synthetic DNA
tcaatcgactcgctatag

SEQ ID NO: 26600 - DNA, 18 bp, Artificial Sequence
  Synthetic DNA
tcatttgactcactattg

SEQ ID NO: 26601 - DNA, 18 bp, Artificial Sequence
  Synthetic DNA
aaataagactcgctctag

SEQ ID NO: 26602 - DNA, 18 bp, Artificial Sequence
  Synthetic DNA
aaatacgacacactgttg

SEQ ID NO: 26603 - DNA, 18 bp, Artificial Sequence
  Synthetic DNA
aaatacgactagctctag

SEQ ID NO: 26604 - DNA, 18 bp, Artificial Sequence
  Synthetic DNA
aaatacgactcaattttg

SEQ ID NO: 26605 - DNA, 18 bp, Artificial Sequence
  Synthetic DNA
aaatacgactcacaaatg

SEQ ID NO: 26606 - DNA, 18 bp, Artificial Sequence
  Synthetic DNA
aaatacgtatcgctatag

SEQ ID NO: 26607 - DNA, 18 bp, Artificial Sequence
  Synthetic DNA
aaatatgactcactaatg

SEQ ID NO: 26608 - DNA, 18 bp, Artificial Sequence
  Synthetic DNA
aaatatgactggctatag

SEQ ID NO: 26609 - DNA, 18 bp, Artificial Sequence
  Synthetic DNA
aaatgcgactcacaattg

SEQ ID NO: 26610 - DNA, 18 bp, Artificial Sequence
  Synthetic DNA
aaattagacacactatag

SEQ ID NO: 26611 - DNA, 18 bp, Artificial Sequence
  Synthetic DNA
aaattcaactaactatag

SEQ ID NO: 26612 - DNA, 18 bp, Artificial Sequence
  Synthetic DNA
aaattccactcaccatag

SEQ ID NO: 26613 - DNA, 18 bp, Artificial Sequence
  Synthetic DNA
aaattcgaaacactatag

SEQ ID NO: 26614 - DNA, 18 bp, Artificial Sequence
  Synthetic DNA
acatacgactaactattg

SEQ ID NO: 26615 - DNA, 18 bp, Artificial Sequence
  Synthetic DNA
agattagactcactatag

SEQ ID NO: 26616 - DNA, 18 bp, Artificial Sequence
  Synthetic DNA
aggtacgactcactattg

SEQ ID NO: 26617 - DNA, 18 bp, Artificial Sequence
  Synthetic DNA
atttacgactcgctatag

SEQ ID NO: 26618 - DNA, 18 bp, Artificial Sequence
  Synthetic DNA
caatacgaataactattg

SEQ ID NO: 26619 - DNA, 18 bp, Artificial Sequence
  Synthetic DNA
caatacgacacattattg

SEQ ID NO: 26620 - DNA, 18 bp, Artificial Sequence
  Synthetic DNA
caatacgtcacgctatag

SEQ ID NO: 26621 - DNA, 18 bp, Artificial Sequence
  Synthetic DNA
caatccgacttactattg

SEQ ID NO: 26622 - DNA, 18 bp, Artificial Sequence
  Synthetic DNA
caattagactcacaatag

SEQ ID NO: 26623 - DNA, 18 bp, Artificial Sequence
  Synthetic DNA
catttcgactcactatcg

SEQ ID NO: 26624 - DNA, 18 bp, Artificial Sequence
  Synthetic DNA
gaatacgactaattattg

SEQ ID NO: 26625 - DNA, 18 bp, Artificial Sequence
  Synthetic DNA
gaatactactcaccattg

SEQ ID NO: 26626 - DNA, 18 bp, Artificial Sequence
  Synthetic DNA
gaatgcgtctcactattg

SEQ ID NO: 26627 - DNA, 18 bp, Artificial Sequence
  Synthetic DNA
gaattcgactcaccttag

SEQ ID NO: 26628 - DNA, 18 bp, Artificial Sequence
  Synthetic DNA
gatttcaactcactatag

SEQ ID NO: 26629 - DNA, 18 bp, Artificial Sequence
  Synthetic DNA
taaaaagactcgctaaag

SEQ ID NO: 26630 - DNA, 18 bp, Artificial Sequence
  Synthetic DNA
taaaaatactcactattg

SEQ ID NO: 26631 - DNA, 18 bp, Artificial Sequence
  Synthetic DNA
taaaacgacttaccattg

SEQ ID NO: 26632 - DNA, 18 bp, Artificial Sequence
  Synthetic DNA
taaaacgacttcctattg

SEQ ID NO: 26633 - DNA, 18 bp, Artificial Sequence
  Synthetic DNA
taaaacgattaactattg

SEQ ID NO: 26634 - DNA, 18 bp, Artificial Sequence
  Synthetic DNA
taaaacgatttactattg

SEQ ID NO: 26635 - DNA, 18 bp, Artificial Sequence
  Synthetic DNA
taaaaggactcgctttag

SEQ ID NO: 26636 - DNA, 18 bp, Artificial Sequence
  Synthetic DNA
taaatcgacacactagag

SEQ ID NO: 26637 - DNA, 18 bp, Artificial Sequence
  Synthetic DNA
taaatcgactcacttgag

SEQ ID NO: 26638 - DNA, 18 bp, Artificial Sequence
  Synthetic DNA
taaatcgattcactctag

SEQ ID NO: 26639 - DNA, 18 bp, Artificial Sequence
  Synthetic DNA
taaatcggctctctatag

SEQ ID NO: 26640 - DNA, 18 bp, Artificial Sequence
  Synthetic DNA
taaattgacttactatag

SEQ ID NO: 26641 - DNA, 18 bp, Artificial Sequence
  Synthetic DNA
taacactactcaatattg

SEQ ID NO: 26642 - DNA, 18 bp, Artificial Sequence
  Synthetic DNA
taactcgacttcctatag

SEQ ID NO: 26643 - DNA, 18 bp, Artificial Sequence
  Synthetic DNA
taactcgtctccctatag

SEQ ID NO: 26644 - DNA, 18 bp, Artificial Sequence
  Synthetic DNA
taactctattcactatag

SEQ ID NO: 26645 - DNA, 18 bp, Artificial Sequence
  Synthetic DNA
taagacgactaaatattg

SEQ ID NO: 26646 - DNA, 18 bp, Artificial Sequence
  Synthetic DNA
taataaaactcactatta

SEQ ID NO: 26647 - DNA, 18 bp, Artificial Sequence
  Synthetic DNA
taataacacacactattg

SEQ ID NO: 26648 - DNA, 18 bp, Artificial Sequence
  Synthetic DNA
taataacacttactattg

SEQ ID NO: 26649 - DNA, 18 bp, Artificial Sequence
  Synthetic DNA
taataagactagctagag

SEQ ID NO: 26650 - DNA, 18 bp, Artificial Sequence
  Synthetic DNA
taataagcctcgccatag

SEQ ID NO: 26651 - DNA, 18 bp, Artificial Sequence
  Synthetic DNA
taataagtctcgctttag

SEQ ID NO: 26652 - DNA, 18 bp, Artificial Sequence
  Synthetic DNA
taataagtttcactattg

SEQ ID NO: 26653 - DNA, 18 bp, Artificial Sequence
  Synthetic DNA
taataatactcacttttg

SEQ ID NO: 26654 - DNA, 18 bp, Artificial Sequence
  Synthetic DNA
taatacaaatcactcttg

SEQ ID NO: 26655 - DNA, 18 bp, Artificial Sequence
  Synthetic DNA
taataccactcgatttag

SEQ ID NO: 26656 - DNA, 18 bp, Artificial Sequence
  Synthetic DNA
taatacctctcaatattg

SEQ ID NO: 26657 - DNA, 18 bp, Artificial Sequence
  Synthetic DNA
taatacgaatcactgatg

SEQ ID NO: 26658 - DNA, 18 bp, Artificial Sequence
  Synthetic DNA
taatacgaatcacttgtg

SEQ ID NO: 26659 - DNA, 18 bp, Artificial Sequence
  Synthetic DNA
taatacgaatctttattg

SEQ ID NO: 26660 - DNA, 18 bp, Artificial Sequence
  Synthetic DNA
taatacgacacacccttg

SEQ ID NO: 26661 - DNA, 18 bp, Artificial Sequence
  Synthetic DNA
taatacgacacgctaagg

SEQ ID NO: 26662 - DNA, 18 bp, Artificial Sequence
  Synthetic DNA
taatacgacatgcaatag

SEQ ID NO: 26663 - DNA, 18 bp, Artificial Sequence
  Synthetic DNA
taatacgacattctattg

SEQ ID NO: 26664 - DNA, 18 bp, Artificial Sequence
  Synthetic DNA
taatacgactaacaactg

SEQ ID NO: 26665 - DNA, 18 bp, Artificial Sequence
  Synthetic DNA
taatacgactatctgttg

SEQ ID NO: 26666 - DNA, 18 bp, Artificial Sequence
  Synthetic DNA
taatacgactctatcttg

SEQ ID NO: 26667 - DNA, 18 bp, Artificial Sequence
  Synthetic DNA
taatacgagtctttattg

SEQ ID NO: 26668 - DNA, 18 bp, Artificial Sequence
  Synthetic DNA
taatacgattcacttgtg

SEQ ID NO: 26669 - DNA, 18 bp, Artificial Sequence
  Synthetic DNA
taatacgccacgctgtag

SEQ ID NO: 26670 - DNA, 18 bp, Artificial Sequence
  Synthetic DNA
taatacgcctcagtaatg

SEQ ID NO: 26671 - DNA, 18 bp, Artificial Sequence
  Synthetic DNA
taatacggattactattg

SEQ ID NO: 26672 - DNA, 18 bp, Artificial Sequence
  Synthetic DNA
taatactaatcagtattg

SEQ ID NO: 26673 - DNA, 18 bp, Artificial Sequence
  Synthetic DNA
taatactaatcgttatag

SEQ ID NO: 26674 - DNA, 18 bp, Artificial Sequence
  Synthetic DNA
taatactacttagtattg

SEQ ID NO: 26675 - DNA, 18 bp, Artificial Sequence
  Synthetic DNA
taatagatctcgctatag

SEQ ID NO: 26676 - DNA, 18 bp, Artificial Sequence
  Synthetic DNA
taataggattcaccattg

SEQ ID NO: 26677 - DNA, 18 bp, Artificial Sequence
  Synthetic DNA
taatatgaatcattattg

SEQ ID NO: 26678 - DNA, 18 bp, Artificial Sequence
  Synthetic DNA
taatatgacgcgcaatag

SEQ ID NO: 26679 - DNA, 18 bp, Artificial Sequence
  Synthetic DNA
taatatgactcaagattg

SEQ ID NO: 26680 - DNA, 18 bp, Artificial Sequence
  Synthetic DNA
taatatgactcactttta

SEQ ID NO: 26681 - DNA, 18 bp, Artificial Sequence
  Synthetic DNA
taatatgagtctctattg

SEQ ID NO: 26682 - DNA, 18 bp, Artificial Sequence
  Synthetic DNA
taatccaactcactagtg

SEQ ID NO: 26683 - DNA, 18 bp, Artificial Sequence
  Synthetic DNA
taatccgagtctctattg

SEQ ID NO: 26684 - DNA, 18 bp, Artificial Sequence
  Synthetic DNA
taatccgcctcaccattg

SEQ ID NO: 26685 - DNA, 18 bp, Artificial Sequence
  Synthetic DNA
taatgagactcactaatg

SEQ ID NO: 26686 - DNA, 18 bp, Artificial Sequence
  Synthetic DNA
taatgcgacacacaattg

SEQ ID NO: 26687 - DNA, 18 bp, Artificial Sequence
  Synthetic DNA
taatgcgacccactcttg

SEQ ID NO: 26688 - DNA, 18 bp, Artificial Sequence
  Synthetic DNA
taatgcgactaaatattg

SEQ ID NO: 26689 - DNA, 18 bp, Artificial Sequence
  Synthetic DNA
taatgcgacttactactg

SEQ ID NO: 26690 - DNA, 18 bp, Artificial Sequence
  Synthetic DNA
taatgcgcctcgctatgg

SEQ ID NO: 26691 - DNA, 18 bp, Artificial Sequence
  Synthetic DNA
taattagactctcaatag

SEQ ID NO: 26692 - DNA, 18 bp, Artificial Sequence
  Synthetic DNA
taattagcctcactgtag

SEQ ID NO: 26693 - DNA, 18 bp, Artificial Sequence
  Synthetic DNA
taattaggctcactaaag

SEQ ID NO: 26694 - DNA, 18 bp, Artificial Sequence
  Synthetic DNA
taattcaattccctatag

SEQ ID NO: 26695 - DNA, 18 bp, Artificial Sequence
  Synthetic DNA
taattcagctcattatag

SEQ ID NO: 26696 - DNA, 18 bp, Artificial Sequence
  Synthetic DNA
taattcatcccactatag

SEQ ID NO: 26697 - DNA, 18 bp, Artificial Sequence
  Synthetic DNA
taattcatctcacgatag

SEQ ID NO: 26698 - DNA, 18 bp, Artificial Sequence
  Synthetic DNA
taattcgaatcacaatgg

SEQ ID NO: 26699 - DNA, 18 bp, Artificial Sequence
  Synthetic DNA
taattcgaatcattatcg

SEQ ID NO: 26700 - DNA, 18 bp, Artificial Sequence
  Synthetic DNA
taattcgacacaacatag

SEQ ID NO: 26701 - DNA, 18 bp, Artificial Sequence
  Synthetic DNA
taattcgactatctttag

SEQ ID NO: 26702 - DNA, 18 bp, Artificial Sequence
  Synthetic DNA
taattcgactcaatttcg

SEQ ID NO: 26703 - DNA, 18 bp, Artificial Sequence
  Synthetic DNA
taattcgactcacattac

SEQ ID NO: 26704 - DNA, 18 bp, Artificial Sequence
  Synthetic DNA
taattcgactgtatatag

SEQ ID NO: 26705 - DNA, 18 bp, Artificial Sequence
  Synthetic DNA
taattcgccacaatatag

SEQ ID NO: 26706 - DNA, 18 bp, Artificial Sequence
  Synthetic DNA
taattcgcctcacaacag

SEQ ID NO: 26707 - DNA, 18 bp, Artificial Sequence
  Synthetic DNA
taattcggctcacaaaag

SEQ ID NO: 26708 - DNA, 18 bp, Artificial Sequence
  Synthetic DNA
taattcgtctgactttag

SEQ ID NO: 26709 - DNA, 18 bp, Artificial Sequence
  Synthetic DNA
taattctactcactcaag

SEQ ID NO: 26710 - DNA, 18 bp, Artificial Sequence
  Synthetic DNA
taattctactgactatgg

SEQ ID NO: 26711 - DNA, 18 bp, Artificial Sequence
  Synthetic DNA
taattctatgcactatag

SEQ ID NO: 26712 - DNA, 18 bp, Artificial Sequence
  Synthetic DNA
taatttgaatcattatag

SEQ ID NO: 26713 - DNA, 18 bp, Artificial Sequence
  Synthetic DNA
tactacaactcagtattg

SEQ ID NO: 26714 - DNA, 18 bp, Artificial Sequence
  Synthetic DNA
tactacgaatcacaattg

SEQ ID NO: 26715 - DNA, 18 bp, Artificial Sequence
  Synthetic DNA
tactactactcacaattg

SEQ ID NO: 26716 - DNA, 18 bp, Artificial Sequence
  Synthetic DNA
tacttcgactcacaagag

SEQ ID NO: 26717 - DNA, 18 bp, Artificial Sequence
  Synthetic DNA
tacttcgactcccaatag

SEQ ID NO: 26718 - DNA, 18 bp, Artificial Sequence
  Synthetic DNA
tagatcgactcactaaag

SEQ ID NO: 26719 - DNA, 18 bp, Artificial Sequence
  Synthetic DNA
tagtacgtctcactaatg

SEQ ID NO: 26720 - DNA, 18 bp, Artificial Sequence
  Synthetic DNA
tagtccgacacactattg

SEQ ID NO: 26721 - DNA, 18 bp, Artificial Sequence
  Synthetic DNA
tagttcgtctaactatag

SEQ ID NO: 26722 - DNA, 18 bp, Artificial Sequence
  Synthetic DNA
tatatcgactcaatatag

SEQ ID NO: 26723 - DNA, 18 bp, Artificial Sequence
  Synthetic DNA
tatatcgactcactatgg

SEQ ID NO: 26724 - DNA, 18 bp, Artificial Sequence
  Synthetic DNA
tatgtccactcactatag

SEQ ID NO: 26725 - DNA, 18 bp, Artificial Sequence
  Synthetic DNA
tattaagactcggtatag

SEQ ID NO: 26726 - DNA, 18 bp, Artificial Sequence
  Synthetic DNA
tattacaactcactatta

SEQ ID NO: 26727 - DNA, 18 bp, Artificial Sequence
  Synthetic DNA
tattacgactccctaatg

SEQ ID NO: 26728 - DNA, 18 bp, Artificial Sequence
  Synthetic DNA
tattacggctctctattg

SEQ ID NO: 26729 - DNA, 18 bp, Artificial Sequence
  Synthetic DNA
tattgcgactctctattg

SEQ ID NO: 26730 - DNA, 18 bp, Artificial Sequence
  Synthetic DNA
tatttcacctcactatag

SEQ ID NO: 26731 - DNA, 18 bp, Artificial Sequence
  Synthetic DNA
tatttcgaaccactatag

SEQ ID NO: 26732 - DNA, 18 bp, Artificial Sequence
  Synthetic DNA
tatttcgacacactatcg

SEQ ID NO: 26733 - DNA, 18 bp, Artificial Sequence
  Synthetic DNA
tatttcgactcaccctag

SEQ ID NO: 26734 - DNA, 18 bp, Artificial Sequence
  Synthetic DNA
tatttcgactccctttag

SEQ ID NO: 26735 - DNA, 18 bp, Artificial Sequence
  Synthetic DNA
tatttggtctcactatag

SEQ ID NO: 26736 - DNA, 18 bp, Artificial Sequence
  Synthetic DNA
tcaaacgcctcgctatag

SEQ ID NO: 26737 - DNA, 18 bp, Artificial Sequence
  Synthetic DNA
tcaatcgactcactctag

SEQ ID NO: 26738 - DNA, 18 bp, Artificial Sequence
  Synthetic DNA
tcaattgactcactatag

SEQ ID NO: 26739 - DNA, 18 bp, Artificial Sequence
  Synthetic DNA
tcatacgacaccctattg

SEQ ID NO: 26740 - DNA, 18 bp, Artificial Sequence
  Synthetic DNA
tcatacgactctttattg

SEQ ID NO: 26741 - DNA, 18 bp, Artificial Sequence
  Synthetic DNA
tcatacgtctcactatta

SEQ ID NO: 26742 - DNA, 18 bp, Artificial Sequence
  Synthetic DNA
tcatactgctcactattg

SEQ ID NO: 26743 - DNA, 18 bp, Artificial Sequence
  Synthetic DNA
tcataggacacactattg

SEQ ID NO: 26744 - DNA, 18 bp, Artificial Sequence
  Synthetic DNA
tcattcgtctcaccatag

SEQ ID NO: 26745 - DNA, 18 bp, Artificial Sequence
  Synthetic DNA
tcgtacgactcagtattg

SEQ ID NO: 26746 - DNA, 18 bp, Artificial Sequence
  Synthetic DNA
tcttacgactcaatattg

SEQ ID NO: 26747 - DNA, 18 bp, Artificial Sequence
  Synthetic DNA
tgaaacgactcactagtg

SEQ ID NO: 26748 - DNA, 18 bp, Artificial Sequence
  Synthetic DNA
tgaatcgactaactatag

SEQ ID NO: 26749 - DNA, 18 bp, Artificial Sequence
  Synthetic DNA
tgacacgattcactattg

SEQ ID NO: 26750 - DNA, 18 bp, Artificial Sequence
  Synthetic DNA
tgattagacacactatag

SEQ ID NO: 26751 - DNA, 18 bp, Artificial Sequence
  Synthetic DNA
tgattcctctcactatag

SEQ ID NO: 26752 - DNA, 18 bp, Artificial Sequence
  Synthetic DNA
tgttacgattcactattg

SEQ ID NO: 26753 - DNA, 18 bp, Artificial Sequence
  Synthetic DNA
ttaaacgactaactattg

SEQ ID NO: 26754 - DNA, 18 bp, Artificial Sequence
  Synthetic DNA
ttaatccactcactatag

SEQ ID NO: 26755 - DNA, 18 bp, Artificial Sequence
  Synthetic DNA
ttacacgacttactattg

SEQ ID NO: 26756 - DNA, 18 bp, Artificial Sequence
  Synthetic DNA
ttagacgactcattattg

SEQ ID NO: 26757 - DNA, 18 bp, Artificial Sequence
  Synthetic DNA
ttatacaactcgttatag

SEQ ID NO: 26758 - DNA, 18 bp, Artificial Sequence
  Synthetic DNA
ttatacgaattactattg

SEQ ID NO: 26759 - DNA, 18 bp, Artificial Sequence
  Synthetic DNA
ttatacgactcagcattg

SEQ ID NO: 26760 - DNA, 18 bp, Artificial Sequence
  Synthetic DNA
ttatacgagtcaatattg

SEQ ID NO: 26761 - DNA, 18 bp, Artificial Sequence
  Synthetic DNA
ttataggacccactattg

SEQ ID NO: 26762 - DNA, 18 bp, Artificial Sequence
  Synthetic DNA
ttattcgacccactaaag

SEQ ID NO: 26763 - DNA, 18 bp, Artificial Sequence
  Synthetic DNA
ttattcgatacactatag

SEQ ID NO: 26764 - DNA, 18 bp, Artificial Sequence
  Synthetic DNA
ttattgggctcactatag

SEQ ID NO: 26765 - DNA, 18 bp, Artificial Sequence
  Synthetic DNA
ttgttcgaatcactatag

SEQ ID NO: 26766 - DNA, 18 bp, Artificial Sequence
  Synthetic DNA
ttttacgattcgctatag

SEQ ID NO: 26767 - DNA, 18 bp, Artificial Sequence
  Synthetic DNA
ttttccgactcgctatag

SEQ ID NO: 26768 - DNA, 18 bp, Artificial Sequence
  Synthetic DNA
tttttcgactctctatag

SEQ ID NO: 26769 - DNA, 18 bp, Artificial Sequence
  Synthetic DNA
aaaaacgaccaactatag

SEQ ID NO: 26770 - DNA, 18 bp, Artificial Sequence
  Synthetic DNA
aaaaacgactaactgtag

SEQ ID NO: 26771 - DNA, 18 bp, Artificial Sequence
  Synthetic DNA
aaaagcgtctcactatag

SEQ ID NO: 26772 - DNA, 18 bp, Artificial Sequence
  Synthetic DNA
aaacacgactccttatag

SEQ ID NO: 26773 - DNA, 18 bp, Artificial Sequence
  Synthetic DNA
aaacacgacttcctatag

SEQ ID NO: 26774 - DNA, 18 bp, Artificial Sequence
  Synthetic DNA
aaacatgactcaatatag

SEQ ID NO: 26775 - DNA, 18 bp, Artificial Sequence
  Synthetic DNA
aaagacgactcactgtcg

SEQ ID NO: 26776 - DNA, 18 bp, Artificial Sequence
  Synthetic DNA
aaataaacctcactatag

SEQ ID NO: 26777 - DNA, 18 bp, Artificial Sequence
  Synthetic DNA
aaatacaactcacactag

SEQ ID NO: 26778 - DNA, 18 bp, Artificial Sequence
  Synthetic DNA
aaatacatctcacgatag

SEQ ID NO: 26779 - DNA, 18 bp, Artificial Sequence
  Synthetic DNA
aaataccactatctatag

SEQ ID NO: 26780 - DNA, 18 bp, Artificial Sequence
  Synthetic DNA
aaataccacttacaatag

SEQ ID NO: 26781 - DNA, 18 bp, Artificial Sequence
  Synthetic DNA
aaatacgaaccaatatag

SEQ ID NO: 26782 - DNA, 18 bp, Artificial Sequence
  Synthetic DNA
aaatacgacaaagtatag

SEQ ID NO: 26783 - DNA, 18 bp, Artificial Sequence
  Synthetic DNA
aaatacgactacctttag

SEQ ID NO: 26784 - DNA, 18 bp, Artificial Sequence
  Synthetic DNA
aaatacgacttaatttag

SEQ ID NO: 26785 - DNA, 18 bp, Artificial Sequence
  Synthetic DNA
aaatacgattctcaatag

SEQ ID NO: 26786 - DNA, 18 bp, Artificial Sequence
  Synthetic DNA
aaatacgcctccctatcg

SEQ ID NO: 26787 - DNA, 18 bp, Artificial Sequence
  Synthetic DNA
aaatacgtcacactatgg

SEQ ID NO: 26788 - DNA, 18 bp, Artificial Sequence
  Synthetic DNA
aaatacgtcctactatag

SEQ ID NO: 26789 - DNA, 18 bp, Artificial Sequence
  Synthetic DNA
aaatacgtctaacgatag

SEQ ID NO: 26790 - DNA, 18 bp, Artificial Sequence
  Synthetic DNA
aaatacgtctcactgaag

SEQ ID NO: 26791 - DNA, 18 bp, Artificial Sequence
  Synthetic DNA
aaatacgtctcagtttag

SEQ ID NO: 26792 - DNA, 18 bp, Artificial Sequence
  Synthetic DNA
aaatacgtgtcacaatag

SEQ ID NO: 26793 - DNA, 18 bp, Artificial Sequence
  Synthetic DNA
aaatactactcaccagag

SEQ ID NO: 26794 - DNA, 18 bp, Artificial Sequence
  Synthetic DNA
aaatactactgacaatag

SEQ ID NO: 26795 - DNA, 18 bp, Artificial Sequence
  Synthetic DNA
aaatacttctaactatag

SEQ ID NO: 26796 - DNA, 18 bp, Artificial Sequence
  Synthetic DNA
aaataggacacactacag

SEQ ID NO: 26797 - DNA, 18 bp, Artificial Sequence
  Synthetic DNA
aaatatatctcactatag

SEQ ID NO: 26798 - DNA, 18 bp, Artificial Sequence
  Synthetic DNA
aaatatgcctcactaaag

SEQ ID NO: 26799 - DNA, 18 bp, Artificial Sequence
  Synthetic DNA
aaatccatctcactatag

SEQ ID NO: 26800 - DNA, 18 bp, Artificial Sequence
  Synthetic DNA
aaatccgactcactagcg

SEQ ID NO: 26801 - DNA, 18 bp, Artificial Sequence
  Synthetic DNA
aaatccgactcacttcag

SEQ ID NO: 26802 - DNA, 18 bp, Artificial Sequence
  Synthetic DNA
aaatgcgacacactatcg

SEQ ID NO: 26803 - DNA, 18 bp, Artificial Sequence
  Synthetic DNA
aaatgcgactcacttaag

SEQ ID NO: 26804 - DNA, 18 bp, Artificial Sequence
  Synthetic DNA
aacaacgacccactatag

SEQ ID NO: 26805 - DNA, 18 bp, Artificial Sequence
  Synthetic DNA
aactacgacacactaaag

SEQ ID NO: 26806 - DNA, 18 bp, Artificial Sequence
  Synthetic DNA
aactacgactcaatacag

SEQ ID NO: 26807 - DNA, 18 bp, Artificial Sequence
  Synthetic DNA
aactacgcatcactatag

SEQ ID NO: 26808 - DNA, 18 bp, Artificial Sequence
  Synthetic DNA
aactacgtctcactctag

SEQ ID NO: 26809 - DNA, 18 bp, Artificial Sequence
  Synthetic DNA
aactgcgactcacaatag

SEQ ID NO: 26810 - DNA, 18 bp, Artificial Sequence
  Synthetic DNA
aagtacggctcacaatag

SEQ ID NO: 26811 - DNA, 18 bp, Artificial Sequence
  Synthetic DNA
aataacaactcactatag

SEQ ID NO: 26812 - DNA, 18 bp, Artificial Sequence
  Synthetic DNA
aattacgattcacgatag

SEQ ID NO: 26813 - DNA, 18 bp, Artificial Sequence
  Synthetic DNA
aattacgattcactatgg

SEQ ID NO: 26814 - DNA, 18 bp, Artificial Sequence
  Synthetic DNA
aattcctactcactatag

SEQ ID NO: 26815 - DNA, 18 bp, Artificial Sequence
  Synthetic DNA
acatacgacgcattatag

SEQ ID NO: 26816 - DNA, 18 bp, Artificial Sequence
  Synthetic DNA
acatactaatcactatag

SEQ ID NO: 26817 - DNA, 18 bp, Artificial Sequence
  Synthetic DNA
acatataactcactatag

SEQ ID NO: 26818 - DNA, 18 bp, Artificial Sequence
  Synthetic DNA
agaaacgactcactttag

SEQ ID NO: 26819 - DNA, 18 bp, Artificial Sequence
  Synthetic DNA
agataagactcaccatag

SEQ ID NO: 26820 - DNA, 18 bp, Artificial Sequence
  Synthetic DNA
agatacgactcaataaag

SEQ ID NO: 26821 - DNA, 18 bp, Artificial Sequence
  Synthetic DNA
agatacgactcccaatag

SEQ ID NO: 26822 - DNA, 18 bp, Artificial Sequence
  Synthetic DNA
atataatactcactatag

SEQ ID NO: 26823 - DNA, 18 bp, Artificial Sequence
  Synthetic DNA
atataccactcattatag

SEQ ID NO: 26824 - DNA, 18 bp, Artificial Sequence
  Synthetic DNA
atatacgactcaatctag

SEQ ID NO: 26825 - DNA, 18 bp, Artificial Sequence
  Synthetic DNA
atatacgagtcactttag

SEQ ID NO: 26826 - DNA, 18 bp, Artificial Sequence
  Synthetic DNA
atatgcggctcactatag

SEQ ID NO: 26827 - DNA, 18 bp, Artificial Sequence
  Synthetic DNA
caaaacgactgaccatag

SEQ ID NO: 26828 - DNA, 18 bp, Artificial Sequence
  Synthetic DNA
caaaacgtctcactatgg

SEQ ID NO: 26829 - DNA, 18 bp, Artificial Sequence
  Synthetic DNA
caataagacatactatag

SEQ ID NO: 26830 - DNA, 18 bp, Artificial Sequence
  Synthetic DNA
caatacaagacactatag

SEQ ID NO: 26831 - DNA, 18 bp, Artificial Sequence
  Synthetic DNA
caatacgacacactcaag

SEQ ID NO: 26832 - DNA, 18 bp, Artificial Sequence
  Synthetic DNA
caatacgacacattatgg

SEQ ID NO: 26833 - DNA, 18 bp, Artificial Sequence
  Synthetic DNA
caatacgactctcagtag

SEQ ID NO: 26834 - DNA, 18 bp, Artificial Sequence
  Synthetic DNA
caatacggctctctatcg

SEQ ID NO: 26835 - DNA, 18 bp, Artificial Sequence
  Synthetic DNA
caatactacagactatag

SEQ ID NO: 26836 - DNA, 18 bp, Artificial Sequence
  Synthetic DNA
caatactattcaatatag

SEQ ID NO: 26837 - DNA, 18 bp, Artificial Sequence
  Synthetic DNA
caatactccccactatag

SEQ ID NO: 26838 - DNA, 18 bp, Artificial Sequence
  Synthetic DNA
caatatgactgacaatag

SEQ ID NO: 26839 - DNA, 18 bp, Artificial Sequence
  Synthetic DNA
caatatgacttacaatag

SEQ ID NO: 26840 - DNA, 18 bp, Artificial Sequence
  Synthetic DNA
cactaagactaactatag

SEQ ID NO: 26841 - DNA, 18 bp, Artificial Sequence
  Synthetic DNA
cattacgactccctacag

SEQ ID NO: 26842 - DNA, 18 bp, Artificial Sequence
  Synthetic DNA
cattacgcctctctatag

SEQ ID NO: 26843 - DNA, 18 bp, Artificial Sequence
  Synthetic DNA
cattacgtgtcactatag

SEQ ID NO: 26844 - DNA, 18 bp, Artificial Sequence
  Synthetic DNA
cattactagtcactatag

SEQ ID NO: 26845 - DNA, 18 bp, Artificial Sequence
  Synthetic DNA
cgatacgacagactatag

SEQ ID NO: 26846 - DNA, 18 bp, Artificial Sequence
  Synthetic DNA
ctaaacgactcagtatag

SEQ ID NO: 26847 - DNA, 18 bp, Artificial Sequence
  Synthetic DNA
ctagaccactcactatag

SEQ ID NO: 26848 - DNA, 18 bp, Artificial Sequence
  Synthetic DNA
ctgtacaactcactatag

SEQ ID NO: 26849 - DNA, 18 bp, Artificial Sequence
  Synthetic DNA
ctttacaactcactatag

SEQ ID NO: 26850 - DNA, 18 bp, Artificial Sequence
  Synthetic DNA
ctttacgactcattatag

SEQ ID NO: 26851 - DNA, 18 bp, Artificial Sequence
  Synthetic DNA
gaaaacgtctcacaatag

SEQ ID NO: 26852 - DNA, 18 bp, Artificial Sequence
  Synthetic DNA
gaacacagctcactatag

SEQ ID NO: 26853 - DNA, 18 bp, Artificial Sequence
  Synthetic DNA
gcatacgacacacaatag

SEQ ID NO: 26854 - DNA, 18 bp, Artificial Sequence
  Synthetic DNA
gtataccactcacaatag

SEQ ID NO: 26855 - DNA, 18 bp, Artificial Sequence
  Synthetic DNA
gtatatgattcactatag

SEQ ID NO: 26856 - DNA, 18 bp, Artificial Sequence
  Synthetic DNA
taaaaacactaactatag

SEQ ID NO: 26857 - DNA, 18 bp, Artificial Sequence
  Synthetic DNA
taaaaagattaactatag

SEQ ID NO: 26858 - DNA, 18 bp, Artificial Sequence
  Synthetic DNA
taaaacaaatcactttag

SEQ ID NO: 26859 - DNA, 18 bp, Artificial Sequence
  Synthetic DNA
taaaaccactcactgaag

SEQ ID NO: 26860 - DNA, 18 bp, Artificial Sequence
  Synthetic DNA
taaaacgaatcacaagag

SEQ ID NO: 26861 - DNA, 18 bp, Artificial Sequence
  Synthetic DNA
taaaacgactcagaatgg

SEQ ID NO: 26862 - DNA, 18 bp, Artificial Sequence
  Synthetic DNA
taaaacgatacactaaag

SEQ ID NO: 26863 - DNA, 18 bp, Artificial Sequence
  Synthetic DNA
taaaacgatactctatag

SEQ ID NO: 26864 - DNA, 18 bp, Artificial Sequence
  Synthetic DNA
taaaacgtaacactatag

SEQ ID NO: 26865 - DNA, 18 bp, Artificial Sequence
  Synthetic DNA
taaaacgtcgcactaaag

SEQ ID NO: 26866 - DNA, 18 bp, Artificial Sequence
  Synthetic DNA
taaaacgtctcactaagg

SEQ ID NO: 26867 - DNA, 18 bp, Artificial Sequence
  Synthetic DNA
taaaactactaacaatag

SEQ ID NO: 26868 - DNA, 18 bp, Artificial Sequence
  Synthetic DNA
taaaatgtgtcactatag

SEQ ID NO: 26869 - DNA, 18 bp, Artificial Sequence
  Synthetic DNA
taaacccattcactatag

SEQ ID NO: 26870 - DNA, 18 bp, Artificial Sequence
  Synthetic DNA
taaaccgactcacattag

SEQ ID NO: 26871 - DNA, 18 bp, Artificial Sequence
  Synthetic DNA
taaaccgactctctatgg

SEQ ID NO: 26872 - DNA, 18 bp, Artificial Sequence
  Synthetic DNA
taaaccgtatcactatag

SEQ ID NO: 26873 - DNA, 18 bp, Artificial Sequence
  Synthetic DNA
taaagcgactcagtctag

SEQ ID NO: 26874 - DNA, 18 bp, Artificial Sequence
  Synthetic DNA
taaagcgtctcactatcg

SEQ ID NO: 26875 - DNA, 18 bp, Artificial Sequence
  Synthetic DNA
taacaatactcactatgg

SEQ ID NO: 26876 - DNA, 18 bp, Artificial Sequence
  Synthetic DNA
taacacgacacactttcg

SEQ ID NO: 26877 - DNA, 18 bp, Artificial Sequence
  Synthetic DNA
taacacgattctctatgg

SEQ ID NO: 26878 - DNA, 18 bp, Artificial Sequence
  Synthetic DNA
taacacgatttagtatag

SEQ ID NO: 26879 - DNA, 18 bp, Artificial Sequence
  Synthetic DNA
taacacgtatcactctag

SEQ ID NO: 26880 - DNA, 18 bp, Artificial Sequence
  Synthetic DNA
taacacgtctcactaacg

SEQ ID NO: 26881 - DNA, 18 bp, Artificial Sequence
  Synthetic DNA
taacacgtctctctacag

SEQ ID NO: 26882 - DNA, 18 bp, Artificial Sequence
  Synthetic DNA
taacacgtttccctatag

SEQ ID NO: 26883 - DNA, 18 bp, Artificial Sequence
  Synthetic DNA
taacaggatccactatag

SEQ ID NO: 26884 - DNA, 18 bp, Artificial Sequence
  Synthetic DNA
taacccgactcattaaag

SEQ ID NO: 26885 - DNA, 18 bp, Artificial Sequence
  Synthetic DNA
taacccgactctctagag

SEQ ID NO: 26886 - DNA, 18 bp, Artificial Sequence
  Synthetic DNA
taagacgtctcaccaaag

SEQ ID NO: 26887 - DNA, 18 bp, Artificial Sequence
  Synthetic DNA
taagactactctctttag

SEQ ID NO: 26888 - DNA, 18 bp, Artificial Sequence
  Synthetic DNA
taataaaatacactatag

SEQ ID NO: 26889 - DNA, 18 bp, Artificial Sequence
  Synthetic DNA
taataagacacacattag

SEQ ID NO: 26890 - DNA, 18 bp, Artificial Sequence
  Synthetic DNA
taataagacagtctatag

SEQ ID NO: 26891 - DNA, 18 bp, Artificial Sequence
  Synthetic DNA
taataagacatattatag

SEQ ID NO: 26892 - DNA, 18 bp, Artificial Sequence
  Synthetic DNA
taataagactcatactag

SEQ ID NO: 26893 - DNA, 18 bp, Artificial Sequence
  Synthetic DNA
taataagactcccaacag

SEQ ID NO: 26894 - DNA, 18 bp, Artificial Sequence
  Synthetic DNA
taataagatacacaatag

SEQ ID NO: 26895 - DNA, 18 bp, Artificial Sequence
  Synthetic DNA
taataagattatctatag

SEQ ID NO: 26896 - DNA, 18 bp, Artificial Sequence
  Synthetic DNA
taataagattctctagag

SEQ ID NO: 26897 - DNA, 18 bp, Artificial Sequence
  Synthetic DNA
taataagtccccctatag

SEQ ID NO: 26898 - DNA, 18 bp, Artificial Sequence
  Synthetic DNA
taataatacttactatgg

SEQ ID NO: 26899 - DNA, 18 bp, Artificial Sequence
  Synthetic DNA
taatacaaaacactacag

SEQ ID NO: 26900 - DNA, 18 bp, Artificial Sequence
  Synthetic DNA
taatacaaatcattaaag

SEQ ID NO: 26901 - DNA, 18 bp, Artificial Sequence
  Synthetic DNA
taatacaactcacaaacg

SEQ ID NO: 26902 - DNA, 18 bp, Artificial Sequence
  Synthetic DNA
taatacaatacactatcg

SEQ ID NO: 26903 - DNA, 18 bp, Artificial Sequence
  Synthetic DNA
taatacaattaaatatag

SEQ ID NO: 26904 - DNA, 18 bp, Artificial Sequence
  Synthetic DNA
taatacatgacactatag

SEQ ID NO: 26905 - DNA, 18 bp, Artificial Sequence
  Synthetic DNA
taataccacacattttag

SEQ ID NO: 26906 - DNA, 18 bp, Artificial Sequence
  Synthetic DNA
taataccacactttatag

SEQ ID NO: 26907 - DNA, 18 bp, Artificial Sequence
  Synthetic DNA
taataccacataccatag

SEQ ID NO: 26908 - DNA, 18 bp, Artificial Sequence
  Synthetic DNA
taataccactctctgaag

SEQ ID NO: 26909 - DNA, 18 bp, Artificial Sequence
  Synthetic DNA
taataccactctgaatag

SEQ ID NO: 26910 - DNA, 18 bp, Artificial Sequence
  Synthetic DNA
taataccacttactcaag

SEQ ID NO: 26911 - DNA, 18 bp, Artificial Sequence
  Synthetic DNA
taatacctcaaactatag

SEQ ID NO: 26912 - DNA, 18 bp, Artificial Sequence
  Synthetic DNA
taatacgaaacattgtag

SEQ ID NO: 26913 - DNA, 18 bp, Artificial Sequence
  Synthetic DNA
taatacgaatcacattcg

SEQ ID NO: 26914 - DNA, 18 bp, Artificial Sequence
  Synthetic DNA
taatacgacacacatcag

SEQ ID NO: 26915 - DNA, 18 bp, Artificial Sequence
  Synthetic DNA
taatacgacacactgtcc

SEQ ID NO: 26916 - DNA, 18 bp, Artificial Sequence
  Synthetic DNA
taatacgacactttaaag

SEQ ID NO: 26917 - DNA, 18 bp, Artificial Sequence
  Synthetic DNA
taatacgaccatctatgg

SEQ ID NO: 26918 - DNA, 18 bp, Artificial Sequence
  Synthetic DNA
taatacgactaaattgag

SEQ ID NO: 26919 - DNA, 18 bp, Artificial Sequence
  Synthetic DNA
taatacgactaagaatcg

SEQ ID NO: 26920 - DNA, 18 bp, Artificial Sequence
  Synthetic DNA
taatacgactatcttaag

SEQ ID NO: 26921 - DNA, 18 bp, Artificial Sequence
  Synthetic DNA
taatacgactcagttacg

SEQ ID NO: 26922 - DNA, 18 bp, Artificial Sequence
  Synthetic DNA
taatacgactcccagaag

SEQ ID NO: 26923 - DNA, 18 bp, Artificial Sequence
  Synthetic DNA
taatacgactcctcaaag

SEQ ID NO: 26924 - DNA, 18 bp, Artificial Sequence
  Synthetic DNA
taatacgactctcagcag

SEQ ID NO: 26925 - DNA, 18 bp, Artificial Sequence
  Synthetic DNA
taatacgactctttttcg

SEQ ID NO: 26926 - DNA, 18 bp, Artificial Sequence
  Synthetic DNA
taatacgactgattctcg

SEQ ID NO: 26927 - DNA, 18 bp, Artificial Sequence
  Synthetic DNA
taatacgactgtccttag

SEQ ID NO: 26928 - DNA, 18 bp, Artificial Sequence
  Synthetic DNA
taatacgagactttatag

SEQ ID NO: 26929 - DNA, 18 bp, Artificial Sequence
  Synthetic DNA
taatacgagcctttatag

SEQ ID NO: 26930 - DNA, 18 bp, Artificial Sequence
  Synthetic DNA
taatacgagtcatgaaag

SEQ ID NO: 26931 - DNA, 18 bp, Artificial Sequence
  Synthetic DNA
taatacgagtctcttgag

SEQ ID NO: 26932 - DNA, 18 bp, Artificial Sequence
  Synthetic DNA
taatacgatacagaatag

SEQ ID NO: 26933 - DNA, 18 bp, Artificial Sequence
  Synthetic DNA
taatacgatgcataatag

SEQ ID NO: 26934 - DNA, 18 bp, Artificial Sequence
  Synthetic DNA
taatacgattcacaccag

SEQ ID NO: 26935 - DNA, 18 bp, Artificial Sequence
  Synthetic DNA
taatacgattgacaacag

SEQ ID NO: 26936 - DNA, 18 bp, Artificial Sequence
  Synthetic DNA
taatacgcctaattaaag

SEQ ID NO: 26937 - DNA, 18 bp, Artificial Sequence
  Synthetic DNA
taatacgcctcacagaag

SEQ ID NO: 26938 - DNA, 18 bp, Artificial Sequence
  Synthetic DNA
taatacgcctcagtttcg

SEQ ID NO: 26939 - DNA, 18 bp, Artificial Sequence
  Synthetic DNA
taatacgtattactgtag

SEQ ID NO: 26940 - DNA, 18 bp, Artificial Sequence
  Synthetic DNA
taatacgtctcacctcag

SEQ ID NO: 26941 - DNA, 18 bp, Artificial Sequence
  Synthetic DNA
taatacgtctcagtgtcg

SEQ ID NO: 26942 - DNA, 18 bp, Artificial Sequence
  Synthetic DNA
taatacgtctgacaacag

SEQ ID NO: 26943 - DNA, 18 bp, Artificial Sequence
  Synthetic DNA
taatacgtctgactttgg

SEQ ID NO: 26944 - DNA, 18 bp, Artificial Sequence
  Synthetic DNA
taatacgtcttacagtag

SEQ ID NO: 26945 - DNA, 18 bp, Artificial Sequence
  Synthetic DNA
taatacgtcttagtttag

SEQ ID NO: 26946 - DNA, 18 bp, Artificial Sequence
  Synthetic DNA
taatacgtttaactatcg

SEQ ID NO: 26947 - DNA, 18 bp, Artificial Sequence
  Synthetic DNA
taatactaatcaataaag

SEQ ID NO: 26948 - DNA, 18 bp, Artificial Sequence
  Synthetic DNA
taatactaattactaaag

SEQ ID NO: 26949 - DNA, 18 bp, Artificial Sequence
  Synthetic DNA
taatactacacaatacag

SEQ ID NO: 26950 - DNA, 18 bp, Artificial Sequence
  Synthetic DNA
taatactacgtaccatag

SEQ ID NO: 26951 - DNA, 18 bp, Artificial Sequence
  Synthetic DNA
taatactacgtactctag

SEQ ID NO: 26952 - DNA, 18 bp, Artificial Sequence
  Synthetic DNA
taatactgcacactgtag

SEQ ID NO: 26953 - DNA, 18 bp, Artificial Sequence
  Synthetic DNA
taatacttctcactttgg

SEQ ID NO: 26954 - DNA, 18 bp, Artificial Sequence
  Synthetic DNA
taatagatctcactaaag

SEQ ID NO: 26955 - DNA, 18 bp, Artificial Sequence
  Synthetic DNA
taataggaatttctatag

SEQ ID NO: 26956 - DNA, 18 bp, Artificial Sequence
  Synthetic DNA
taataggactcatttcag

SEQ ID NO: 26957 - DNA, 18 bp, Artificial Sequence
  Synthetic DNA
taataggactctctgaag

SEQ ID NO: 26958 - DNA, 18 bp, Artificial Sequence
  Synthetic DNA
taataggacttaataaag

SEQ ID NO: 26959 - DNA, 18 bp, Artificial Sequence
  Synthetic DNA
taataggatacattatag

SEQ ID NO: 26960 - DNA, 18 bp, Artificial Sequence
  Synthetic DNA
taatagttttcactatag

SEQ ID NO: 26961 - DNA, 18 bp, Artificial Sequence
  Synthetic DNA
taatatgaatcactacgg

SEQ ID NO: 26962 - DNA, 18 bp, Artificial Sequence
  Synthetic DNA
taatatgaatctcaatag

SEQ ID NO: 26963 - DNA, 18 bp, Artificial Sequence
  Synthetic DNA
taatatgacaaactacag

SEQ ID NO: 26964 - DNA, 18 bp, Artificial Sequence
  Synthetic DNA
taatatgacattctatag

SEQ ID NO: 26965 - DNA, 18 bp, Artificial Sequence
  Synthetic DNA
taatatgacccacattag

SEQ ID NO: 26966 - DNA, 18 bp, Artificial Sequence
  Synthetic DNA
taatatgactcacttacg

SEQ ID NO: 26967 - DNA, 18 bp, Artificial Sequence
  Synthetic DNA
taatatgactcatactag

SEQ ID NO: 26968 - DNA, 18 bp, Artificial Sequence
  Synthetic DNA
taatatgactcattttcg

SEQ ID NO: 26969 - DNA, 18 bp, Artificial Sequence
  Synthetic DNA
taatatgacttaatagag

SEQ ID NO: 26970 - DNA, 18 bp, Artificial Sequence
  Synthetic DNA
taatatgatacactacag

SEQ ID NO: 26971 - DNA, 18 bp, Artificial Sequence
  Synthetic DNA
taatatggcgcactttag

SEQ ID NO: 26972 - DNA, 18 bp, Artificial Sequence
  Synthetic DNA
taatatgtatctctatag

SEQ ID NO: 26973 - DNA, 18 bp, Artificial Sequence
  Synthetic DNA
taatatgtctcaatttag

SEQ ID NO: 26974 - DNA, 18 bp, Artificial Sequence
  Synthetic DNA
taatatttcccactatag

SEQ ID NO: 26975 - DNA, 18 bp, Artificial Sequence
  Synthetic DNA
taatcagacttcctatag

SEQ ID NO: 26976 - DNA, 18 bp, Artificial Sequence
  Synthetic DNA
taatcagattcaatatag

SEQ ID NO: 26977 - DNA, 18 bp, Artificial Sequence
  Synthetic DNA
taatcccacacactaaag

SEQ ID NO: 26978 - DNA, 18 bp, Artificial Sequence
  Synthetic DNA
taatccgacacaccatgg

SEQ ID NO: 26979 - DNA, 18 bp, Artificial Sequence
  Synthetic DNA
taatccgacgctcaatag

SEQ ID NO: 26980 - DNA, 18 bp, Artificial Sequence
  Synthetic DNA
taatccgactaaatttag

SEQ ID NO: 26981 - DNA, 18 bp, Artificial Sequence
  Synthetic DNA
taatccgactctcaagag

SEQ ID NO: 26982 - DNA, 18 bp, Artificial Sequence
  Synthetic DNA
taatccgcctatctatag

SEQ ID NO: 26983 - DNA, 18 bp, Artificial Sequence
  Synthetic DNA
taatccgtaccactatag

SEQ ID NO: 26984 - DNA, 18 bp, Artificial Sequence
  Synthetic DNA
taatccgtctcactttcg

SEQ ID NO: 26985 - DNA, 18 bp, Artificial Sequence
  Synthetic DNA
taatccgtttcacaatag

SEQ ID NO: 26986 - DNA, 18 bp, Artificial Sequence
  Synthetic DNA
taatctgaatcaatatag

SEQ ID NO: 26987 - DNA, 18 bp, Artificial Sequence
  Synthetic DNA
taatgcgacacacgaaag

SEQ ID NO: 26988 - DNA, 18 bp, Artificial Sequence
  Synthetic DNA
taatgcgactcaatttgg

SEQ ID NO: 26989 - DNA, 18 bp, Artificial Sequence
  Synthetic DNA
taatgcgactctcaagag

SEQ ID NO: 26990 - DNA, 18 bp, Artificial Sequence
  Synthetic DNA
taatgcgactgtctatgg

SEQ ID NO: 26991 - DNA, 18 bp, Artificial Sequence
  Synthetic DNA
taatgcgagtcactttcg

SEQ ID NO: 26992 - DNA, 18 bp, Artificial Sequence
  Synthetic DNA
taatgcgtattactatag

SEQ ID NO: 26993 - DNA, 18 bp, Artificial Sequence
  Synthetic DNA
taatgcgtctttctatag

SEQ ID NO: 26994 - DNA, 18 bp, Artificial Sequence
  Synthetic DNA
taatgggactcacaatcg

SEQ ID NO: 26995 - DNA, 18 bp, Artificial Sequence
  Synthetic DNA
taatgtgactctcgatag

SEQ ID NO: 26996 - DNA, 18 bp, Artificial Sequence
  Synthetic DNA
taatgtgattcactacag

SEQ ID NO: 26997 - DNA, 18 bp, Artificial Sequence
  Synthetic DNA
taatgtgtctcaccatag

SEQ ID NO: 26998 - DNA, 18 bp, Artificial Sequence
  Synthetic DNA
tacaacgactcattctag

SEQ ID NO: 26999 - DNA, 18 bp, Artificial Sequence
  Synthetic DNA
tacaacgactctctttag

SEQ ID NO: 27000 - DNA, 18 bp, Artificial Sequence
  Synthetic DNA
tacaacgcttcactatag

SEQ ID NO: 27001 - DNA, 18 bp, Artificial Sequence
  Synthetic DNA
tacaatgactcactatcg

SEQ ID NO: 27002 - DNA, 18 bp, Artificial Sequence
  Synthetic DNA
taccgcgactcactaaag

SEQ ID NO: 27003 - DNA, 18 bp, Artificial Sequence
  Synthetic DNA
tacgacaactcactaaag

SEQ ID NO: 27004 - DNA, 18 bp, Artificial Sequence
  Synthetic DNA
tactacgaatcaccttag

SEQ ID NO: 27005 - DNA, 18 bp, Artificial Sequence
  Synthetic DNA
tactacgactcacttccg

SEQ ID NO: 27006 - DNA, 18 bp, Artificial Sequence
  Synthetic DNA
tactacggctacctatag

SEQ ID NO: 27007 - DNA, 18 bp, Artificial Sequence
  Synthetic DNA
tactacgtctcagcatag

SEQ ID NO: 27008 - DNA, 18 bp, Artificial Sequence
  Synthetic DNA
tactacgtctcattttag

SEQ ID NO: 27009 - DNA, 18 bp, Artificial Sequence
  Synthetic DNA
tactactattctctatag

SEQ ID NO: 27010 - DNA, 18 bp, Artificial Sequence
  Synthetic DNA
tactaggactcactttcg

SEQ ID NO: 27011 - DNA, 18 bp, Artificial Sequence
  Synthetic DNA
tagaacgactcattatgg

SEQ ID NO: 27012 - DNA, 18 bp, Artificial Sequence
  Synthetic DNA
tagaacgactctttatag

SEQ ID NO: 27013 - DNA, 18 bp, Artificial Sequence
  Synthetic DNA
tagaacgacttactatgg

SEQ ID NO: 27014 - DNA, 18 bp, Artificial Sequence
  Synthetic DNA
tagaacgactttctatag

SEQ ID NO: 27015 - DNA, 18 bp, Artificial Sequence
  Synthetic DNA
tagagcggctcactatag

SEQ ID NO: 27016 - DNA, 18 bp, Artificial Sequence
  Synthetic DNA
tagcacgattcaatatag

SEQ ID NO: 27017 - DNA, 18 bp, Artificial Sequence
  Synthetic DNA
tagtacaactaactttag

SEQ ID NO: 27018 - DNA, 18 bp, Artificial Sequence
  Synthetic DNA
tagtacacctgactatag

SEQ ID NO: 27019 - DNA, 18 bp, Artificial Sequence
  Synthetic DNA
tagtacgactaaccaaag

SEQ ID NO: 27020 - DNA, 18 bp, Artificial Sequence
  Synthetic DNA
tagtacgactctacatag

SEQ ID NO: 27021 - DNA, 18 bp, Artificial Sequence
  Synthetic DNA
tagtacgtctcaccctag

SEQ ID NO: 27022 - DNA, 18 bp, Artificial Sequence
  Synthetic DNA
tagtacgtttcactacag

SEQ ID NO: 27023 - DNA, 18 bp, Artificial Sequence
  Synthetic DNA
tagtacttctcactaaag

SEQ ID NO: 27024 - DNA, 18 bp, Artificial Sequence
  Synthetic DNA
tagtaggtctcactttag

SEQ ID NO: 27025 - DNA, 18 bp, Artificial Sequence
  Synthetic DNA
tagtatgacactctatag

SEQ ID NO: 27026 - DNA, 18 bp, Artificial Sequence
  Synthetic DNA
tagtatgacatactatag

SEQ ID NO: 27027 - DNA, 18 bp, Artificial Sequence
  Synthetic DNA
tagtattacacactatag

SEQ ID NO: 27028 - DNA, 18 bp, Artificial Sequence
  Synthetic DNA
tagtccgagtcactagag

SEQ ID NO: 27029 - DNA, 18 bp, Artificial Sequence
  Synthetic DNA
tagtgcatctcactatag

SEQ ID NO: 27030 - DNA, 18 bp, Artificial Sequence
  Synthetic DNA
tagtgcgtttcactatag

SEQ ID NO: 27031 - DNA, 18 bp, Artificial Sequence
  Synthetic DNA
tataacaactcactacag

SEQ ID NO: 27032 - DNA, 18 bp, Artificial Sequence
  Synthetic DNA
tataacaactcagtatag

SEQ ID NO: 27033 - DNA, 18 bp, Artificial Sequence
  Synthetic DNA
tataacgattccctatag

SEQ ID NO: 27034 - DNA, 18 bp, Artificial Sequence
  Synthetic DNA
tataatgactcactagag

SEQ ID NO: 27035 - DNA, 18 bp, Artificial Sequence
  Synthetic DNA
tatagagactcactatag

SEQ ID NO: 27036 - DNA, 18 bp, Artificial Sequence
  Synthetic DNA
tatcaagacttactatag

SEQ ID NO: 27037 - DNA, 18 bp, Artificial Sequence
  Synthetic DNA
tatcacgactaacaatag

SEQ ID NO: 27038 - DNA, 18 bp, Artificial Sequence
  Synthetic DNA
tatcacgactttctatag

SEQ ID NO: 27039 - DNA, 18 bp, Artificial Sequence
  Synthetic DNA
tatcacgccttactatag

SEQ ID NO: 27040 - DNA, 18 bp, Artificial Sequence
  Synthetic DNA
tatcactaatcactatag

SEQ ID NO: 27041 - DNA, 18 bp, Artificial Sequence
  Synthetic DNA
tatgacgtctaactatag

SEQ ID NO: 27042 - DNA, 18 bp, Artificial Sequence
  Synthetic DNA
tattaagacccattatag

SEQ ID NO: 27043 - DNA, 18 bp, Artificial Sequence
  Synthetic DNA
tattaagactcattaaag

SEQ ID NO: 27044 - DNA, 18 bp, Artificial Sequence
  Synthetic DNA
tattaagacttacaatag

SEQ ID NO: 27045 - DNA, 18 bp, Artificial Sequence
  Synthetic DNA
tattacaacttactttag

SEQ ID NO: 27046 - DNA, 18 bp, Artificial Sequence
  Synthetic DNA
tattacaacttcctatag

SEQ ID NO: 27047 - DNA, 18 bp, Artificial Sequence
  Synthetic DNA
tattacagctgactatag

SEQ ID NO: 27048 - DNA, 18 bp, Artificial Sequence
  Synthetic DNA
tattaccactcattaaag

SEQ ID NO: 27049 - DNA, 18 bp, Artificial Sequence
  Synthetic DNA
tattacgaatcaatttag

SEQ ID NO: 27050 - DNA, 18 bp, Artificial Sequence
  Synthetic DNA
tattacgaatcattatcg

SEQ ID NO: 27051 - DNA, 18 bp, Artificial Sequence
  Synthetic DNA
tattacgaatgaccatag

SEQ ID NO: 27052 - DNA, 18 bp, Artificial Sequence
  Synthetic DNA
tattacgacaaactatcg

SEQ ID NO: 27053 - DNA, 18 bp, Artificial Sequence
  Synthetic DNA
tattacgacacacaagag

SEQ ID NO: 27054 - DNA, 18 bp, Artificial Sequence
  Synthetic DNA
tattacgactcagtttcg

SEQ ID NO: 27055 - DNA, 18 bp, Artificial Sequence
  Synthetic DNA
tattacgactctcaagag

SEQ ID NO: 27056 - DNA, 18 bp, Artificial Sequence
  Synthetic DNA
tattacgattaactaaag

SEQ ID NO: 27057 - DNA, 18 bp, Artificial Sequence
  Synthetic DNA
tattacgattcaatacag

SEQ ID NO: 27058 - DNA, 18 bp, Artificial Sequence
  Synthetic DNA
tattacgccttactaaag

SEQ ID NO: 27059 - DNA, 18 bp, Artificial Sequence
  Synthetic DNA
tattacgcttcactatgg

SEQ ID NO: 27060 - DNA, 18 bp, Artificial Sequence
  Synthetic DNA
tattacgtataactatag

SEQ ID NO: 27061 - DNA, 18 bp, Artificial Sequence
  Synthetic DNA
tattacgtcaccctatag

SEQ ID NO: 27062 - DNA, 18 bp, Artificial Sequence
  Synthetic DNA
tattactcctcacaatag

SEQ ID NO: 27063 - DNA, 18 bp, Artificial Sequence
  Synthetic DNA
tattaggacccacgatag

SEQ ID NO: 27064 - DNA, 18 bp, Artificial Sequence
  Synthetic DNA
tattatctctcactatag

SEQ ID NO: 27065 - DNA, 18 bp, Artificial Sequence
  Synthetic DNA
tattatgactcaatttag

SEQ ID NO: 27066 - DNA, 18 bp, Artificial Sequence
  Synthetic DNA
tattatgtctaactatag

SEQ ID NO: 27067 - DNA, 18 bp, Artificial Sequence
  Synthetic DNA
tattccgactgattatag

SEQ ID NO: 27068 - DNA, 18 bp, Artificial Sequence
  Synthetic DNA
tattccgattcattatag

SEQ ID NO: 27069 - DNA, 18 bp, Artificial Sequence
  Synthetic DNA
tattccgtcttactatag

SEQ ID NO: 27070 - DNA, 18 bp, Artificial Sequence
  Synthetic DNA
tattcctactccctatag

SEQ ID NO: 27071 - DNA, 18 bp, Artificial Sequence
  Synthetic DNA
tattctgactcaatatag

SEQ ID NO: 27072 - DNA, 18 bp, Artificial Sequence
  Synthetic DNA
tattgtgattcactatag

SEQ ID NO: 27073 - DNA, 18 bp, Artificial Sequence
  Synthetic DNA
tcaaactactcactaaag

SEQ ID NO: 27074 - DNA, 18 bp, Artificial Sequence
  Synthetic DNA
tcaaatgtctcactatag

SEQ ID NO: 27075 - DNA, 18 bp, Artificial Sequence
  Synthetic DNA
tcaaccgacacactatag

SEQ ID NO: 27076 - DNA, 18 bp, Artificial Sequence
  Synthetic DNA
tcacacgactctcaatag

SEQ ID NO: 27077 - DNA, 18 bp, Artificial Sequence
  Synthetic DNA
tcataagacttactttag

SEQ ID NO: 27078 - DNA, 18 bp, Artificial Sequence
  Synthetic DNA
tcatacaacacacaatag

SEQ ID NO: 27079 - DNA, 18 bp, Artificial Sequence
  Synthetic DNA
tcatacagctcacaatag

SEQ ID NO: 27080 - DNA, 18 bp, Artificial Sequence
  Synthetic DNA
tcatacgaatcattgtag

SEQ ID NO: 27081 - DNA, 18 bp, Artificial Sequence
  Synthetic DNA
tcatacggctgactgtag

SEQ ID NO: 27082 - DNA, 18 bp, Artificial Sequence
  Synthetic DNA
tcatacgtcacactctag

SEQ ID NO: 27083 - DNA, 18 bp, Artificial Sequence
  Synthetic DNA
tcatacgtttcactgtag

SEQ ID NO: 27084 - DNA, 18 bp, Artificial Sequence
  Synthetic DNA
tcatacttatcactatag

SEQ ID NO: 27085 - DNA, 18 bp, Artificial Sequence
  Synthetic DNA
tcatatgactcaatttag

SEQ ID NO: 27086 - DNA, 18 bp, Artificial Sequence
  Synthetic DNA
tcatatgactcactttgg

SEQ ID NO: 27087 - DNA, 18 bp, Artificial Sequence
  Synthetic DNA
tcatatgactgcctatag

SEQ ID NO: 27088 - DNA, 18 bp, Artificial Sequence
  Synthetic DNA
tcatccgacacactatcg

SEQ ID NO: 27089 - DNA, 18 bp, Artificial Sequence
  Synthetic DNA
tcatccgacccactatgg

SEQ ID NO: 27090 - DNA, 18 bp, Artificial Sequence
  Synthetic DNA
tcatgcaactccctatag

SEQ ID NO: 27091 - DNA, 18 bp, Artificial Sequence
  Synthetic DNA
tcttacaacacactatag

SEQ ID NO: 27092 - DNA, 18 bp, Artificial Sequence
  Synthetic DNA
tcttacaactcactaaag

SEQ ID NO: 27093 - DNA, 18 bp, Artificial Sequence
  Synthetic DNA
tcttagaactcactatag

SEQ ID NO: 27094 - DNA, 18 bp, Artificial Sequence
  Synthetic DNA
tcttaggactcactttag

SEQ ID NO: 27095 - DNA, 18 bp, Artificial Sequence
  Synthetic DNA
tcttcctactcactatag

SEQ ID NO: 27096 - DNA, 18 bp, Artificial Sequence
  Synthetic DNA
tgaaaaaactcactatag

SEQ ID NO: 27097 - DNA, 18 bp, Artificial Sequence
  Synthetic DNA
tgaaatgactcactttag

SEQ ID NO: 27098 - DNA, 18 bp, Artificial Sequence
  Synthetic DNA
tgataaaactcactaaag

SEQ ID NO: 27099 - DNA, 18 bp, Artificial Sequence
  Synthetic DNA
tgataagactcacaaaag

SEQ ID NO: 27100 - DNA, 18 bp, Artificial Sequence
  Synthetic DNA
tgataatactcattatag

SEQ ID NO: 27101 - DNA, 18 bp, Artificial Sequence
  Synthetic DNA
tgatacaactcagaatag

SEQ ID NO: 27102 - DNA, 18 bp, Artificial Sequence
  Synthetic DNA
tgatacgactaactctcg

SEQ ID NO: 27103 - DNA, 18 bp, Artificial Sequence
  Synthetic DNA
tgatacggcccagtatag

SEQ ID NO: 27104 - DNA, 18 bp, Artificial Sequence
  Synthetic DNA
tgatacggcttactttag

SEQ ID NO: 27105 - DNA, 18 bp, Artificial Sequence
  Synthetic DNA
tgatactaatcactttag

SEQ ID NO: 27106 - DNA, 18 bp, Artificial Sequence
  Synthetic DNA
tgatgcgtctcaccatag

SEQ ID NO: 27107 - DNA, 18 bp, Artificial Sequence
  Synthetic DNA
tggtacgacactctatag

SEQ ID NO: 27108 - DNA, 18 bp, Artificial Sequence
  Synthetic DNA
tgttacgactcacgaaag

SEQ ID NO: 27109 - DNA, 18 bp, Artificial Sequence
  Synthetic DNA
tgttacgtctgactatag

SEQ ID NO: 27110 - DNA, 18 bp, Artificial Sequence
  Synthetic DNA
tgttactactcactttag

SEQ ID NO: 27111 - DNA, 18 bp, Artificial Sequence
  Synthetic DNA
ttaaaagactcaccatag

SEQ ID NO: 27112 - DNA, 18 bp, Artificial Sequence
  Synthetic DNA
ttaaacaactcactatcg

SEQ ID NO: 27113 - DNA, 18 bp, Artificial Sequence
  Synthetic DNA
ttacaagacacactatag

SEQ ID NO: 27114 - DNA, 18 bp, Artificial Sequence
  Synthetic DNA
ttacacgattcactttag

SEQ ID NO: 27115 - DNA, 18 bp, Artificial Sequence
  Synthetic DNA
ttagaagacttactatag

SEQ ID NO: 27116 - DNA, 18 bp, Artificial Sequence
  Synthetic DNA
ttagaccactcactaaag

SEQ ID NO: 27117 - DNA, 18 bp, Artificial Sequence
  Synthetic DNA
ttagacgattcactatcg

SEQ ID NO: 27118 - DNA, 18 bp, Artificial Sequence
  Synthetic DNA
ttataagacacactatcg

SEQ ID NO: 27119 - DNA, 18 bp, Artificial Sequence
  Synthetic DNA
ttataagactatctatag

SEQ ID NO: 27120 - DNA, 18 bp, Artificial Sequence
  Synthetic DNA
ttataagactcaatatcg

SEQ ID NO: 27121 - DNA, 18 bp, Artificial Sequence
  Synthetic DNA
ttatacaaccaactatag

SEQ ID NO: 27122 - DNA, 18 bp, Artificial Sequence
  Synthetic DNA
ttatacaattcagtatag

SEQ ID NO: 27123 - DNA, 18 bp, Artificial Sequence
  Synthetic DNA
ttatacgaaacattatag

SEQ ID NO: 27124 - DNA, 18 bp, Artificial Sequence
  Synthetic DNA
ttatacgaaaccctatag

SEQ ID NO: 27125 - DNA, 18 bp, Artificial Sequence
  Synthetic DNA
ttatacgaaccacaatag

SEQ ID NO: 27126 - DNA, 18 bp, Artificial Sequence
  Synthetic DNA
ttatacgacatactgtag

SEQ ID NO: 27127 - DNA, 18 bp, Artificial Sequence
  Synthetic DNA
ttatacgactcacctaag

SEQ ID NO: 27128 - DNA, 18 bp, Artificial Sequence
  Synthetic DNA
ttatacgactcccaatcg

SEQ ID NO: 27129 - DNA, 18 bp, Artificial Sequence
  Synthetic DNA
ttatacgactctccatcg

SEQ ID NO: 27130 - DNA, 18 bp, Artificial Sequence
  Synthetic DNA
ttatacgagacactacag

SEQ ID NO: 27131 - DNA, 18 bp, Artificial Sequence
  Synthetic DNA
ttatacgagactctatag

SEQ ID NO: 27132 - DNA, 18 bp, Artificial Sequence
  Synthetic DNA
ttatacgattcaacatag

SEQ ID NO: 27133 - DNA, 18 bp, Artificial Sequence
  Synthetic DNA
ttatacgcctcactaagg

SEQ ID NO: 27134 - DNA, 18 bp, Artificial Sequence
  Synthetic DNA
ttatacgcctcataatag

SEQ ID NO: 27135 - DNA, 18 bp, Artificial Sequence
  Synthetic DNA
ttatacgtctttctatag

SEQ ID NO: 27136 - DNA, 18 bp, Artificial Sequence
  Synthetic DNA
ttatactacacagtatag

SEQ ID NO: 27137 - DNA, 18 bp, Artificial Sequence
  Synthetic DNA
ttatactgctcaccatag

SEQ ID NO: 27138 - DNA, 18 bp, Artificial Sequence
  Synthetic DNA
ttataggactttctatag

SEQ ID NO: 27139 - DNA, 18 bp, Artificial Sequence
  Synthetic DNA
ttatatcactcaatatag

SEQ ID NO: 27140 - DNA, 18 bp, Artificial Sequence
  Synthetic DNA
ttatatcactcactgtag

SEQ ID NO: 27141 - DNA, 18 bp, Artificial Sequence
  Synthetic DNA
ttatatgacacactacag

SEQ ID NO: 27142 - DNA, 18 bp, Artificial Sequence
  Synthetic DNA
ttatatgacttactaaag

SEQ ID NO: 27143 - DNA, 18 bp, Artificial Sequence
  Synthetic DNA
ttatatggctcacaatag

SEQ ID NO: 27144 - DNA, 18 bp, Artificial Sequence
  Synthetic DNA
ttatctgactcagtatag

SEQ ID NO: 27145 - DNA, 18 bp, Artificial Sequence
  Synthetic DNA
ttatgagactcactaaag

SEQ ID NO: 27146 - DNA, 18 bp, Artificial Sequence
  Synthetic DNA
ttatgcgactcactacaa

SEQ ID NO: 27147 - DNA, 18 bp, Artificial Sequence
  Synthetic DNA
ttcaacgactcagtatag

SEQ ID NO: 27148 - DNA, 18 bp, Artificial Sequence
  Synthetic DNA
ttctacgtatcactatag

SEQ ID NO: 27149 - DNA, 18 bp, Artificial Sequence
  Synthetic DNA
ttctactactcactttag

SEQ ID NO: 27150 - DNA, 18 bp, Artificial Sequence
  Synthetic DNA
ttgaaccactcactatag

SEQ ID NO: 27151 - DNA, 18 bp, Artificial Sequence
  Synthetic DNA
ttgtacgccacactatag

SEQ ID NO: 27152 - DNA, 18 bp, Artificial Sequence
  Synthetic DNA
ttttacccctcactatag

SEQ ID NO: 27153 - DNA, 18 bp, Artificial Sequence
  Synthetic DNA
ttttacgactcactggag

SEQ ID NO: 27154 - DNA, 18 bp, Artificial Sequence
  Synthetic DNA
ttttacgcctcacaatag

SEQ ID NO: 27155 - DNA, 18 bp, Artificial Sequence
  Synthetic DNA
tattacgacacactaatg

SEQ ID NO: 27156 - DNA, 18 bp, Artificial Sequence
  Synthetic DNA
taatacgtttctctaaag

SEQ ID NO: 27157 - DNA, 18 bp, Artificial Sequence
  Synthetic DNA
tattacgtctcagtattg

SEQ ID NO: 27158 - DNA, 18 bp, Artificial Sequence
  Synthetic DNA
taatacgtctcacataag

SEQ ID NO: 27159 - DNA, 18 bp, Artificial Sequence
  Synthetic DNA
aaatacgactaacttttg

SEQ ID NO: 27160 - DNA, 18 bp, Artificial Sequence
  Synthetic DNA
caaatcgactctctatag

SEQ ID NO: 27161 - DNA, 18 bp, Artificial Sequence
  Synthetic DNA
taatatgactcatttttg

SEQ ID NO: 27162 - DNA, 18 bp, Artificial Sequence
  Synthetic DNA
taattcaaatctctatag

SEQ ID NO: 27163 - DNA, 18 bp, Artificial Sequence
  Synthetic DNA
taatttgtctcactttag

SEQ ID NO: 27164 - DNA, 18 bp, Artificial Sequence
  Synthetic DNA
tatatccactcactatag

SEQ ID NO: 27165 - DNA, 18 bp, Artificial Sequence
  Synthetic DNA
tattacgacttactaatg

SEQ ID NO: 27166 - DNA, 18 bp, Artificial Sequence
  Synthetic DNA
caatacgtctcacaaaag

SEQ ID NO: 27167 - DNA, 18 bp, Artificial Sequence
  Synthetic DNA
taaaatgtctcacaatag

SEQ ID NO: 27168 - DNA, 18 bp, Artificial Sequence
  Synthetic DNA
tattgcgactaacaatag

SEQ ID NO: 27169 - DNA, 18 bp, Artificial Sequence
  Synthetic DNA
tattgcgactcacaaaag

SEQ ID NO: 27170 - DNA, 18 bp, Artificial Sequence
  Synthetic DNA
ttatattactcacaatag

SEQ ID NO: 27171 - DNA, 18 bp, Artificial Sequence
  Synthetic DNA
ttattcgtcacactatag

SEQ ID NO: 27172 - DNA, 18 bp, Artificial Sequence
  Synthetic DNA
ttatttgactcactttag

SEQ ID NO: 27173 - DNA, 18 bp, Artificial Sequence
  Synthetic DNA
taattcgactaacttttg

SEQ ID NO: 27174 - DNA, 18 bp, Artificial Sequence
  Synthetic DNA
taattcggctcaatattg

SEQ ID NO: 27175 - DNA, 18 bp, Artificial Sequence
  Synthetic DNA
tatttcgacttactattg

SEQ ID NO: 27176 - DNA, 18 bp, Artificial Sequence
  Synthetic DNA
tcattcgactcactgttg

SEQ ID NO: 27177 - DNA, 18 bp, Artificial Sequence
  Synthetic DNA
aaatacgactcacttatg

SEQ ID NO: 27178 - DNA, 18 bp, Artificial Sequence
  Synthetic DNA
aaattcgacccaatatag

SEQ ID NO: 27179 - DNA, 18 bp, Artificial Sequence
  Synthetic DNA
caaaaagactcactattg

SEQ ID NO: 27180 - DNA, 18 bp, Artificial Sequence
  Synthetic DNA
catttagactcactatag

SEQ ID NO: 27181 - DNA, 18 bp, Artificial Sequence
  Synthetic DNA
taatacgaaccgcaatag

SEQ ID NO: 27182 - DNA, 18 bp, Artificial Sequence
  Synthetic DNA
taatacgactaatttttg

SEQ ID NO: 27183 - DNA, 18 bp, Artificial Sequence
  Synthetic DNA
taatacgactcccttatg

SEQ ID NO: 27184 - DNA, 18 bp, Artificial Sequence
  Synthetic DNA
taatacgtcttattattg

SEQ ID NO: 27185 - DNA, 18 bp, Artificial Sequence
  Synthetic DNA
taatactattcacaattg

SEQ ID NO: 27186 - DNA, 18 bp, Artificial Sequence
  Synthetic DNA
taatgcgactctctaatg

SEQ ID NO: 27187 - DNA, 18 bp, Artificial Sequence
  Synthetic DNA
taattcagctaactatag

SEQ ID NO: 27188 - DNA, 18 bp, Artificial Sequence
  Synthetic DNA
taattcgacacacaaaag

SEQ ID NO: 27189 - DNA, 18 bp, Artificial Sequence
  Synthetic DNA
taattcgacttcctagag

SEQ ID NO: 27190 - DNA, 18 bp, Artificial Sequence
  Synthetic DNA
taattcgagtcaatttag

SEQ ID NO: 27191 - DNA, 18 bp, Artificial Sequence
  Synthetic DNA
taattcgtctcactaacg

SEQ ID NO: 27192 - DNA, 18 bp, Artificial Sequence
  Synthetic DNA
taattctacacacaatag

SEQ ID NO: 27193 - DNA, 18 bp, Artificial Sequence
  Synthetic DNA
taattctactctttatag

SEQ ID NO: 27194 - DNA, 18 bp, Artificial Sequence
  Synthetic DNA
tacttctactctctatag

SEQ ID NO: 27195 - DNA, 18 bp, Artificial Sequence
  Synthetic DNA
ttatacaacccactattg

SEQ ID NO: 27196 - DNA, 18 bp, Artificial Sequence
  Synthetic DNA
aaatacgatttattatag

SEQ ID NO: 27197 - DNA, 18 bp, Artificial Sequence
  Synthetic DNA
aaatactcctcactttag

SEQ ID NO: 27198 - DNA, 18 bp, Artificial Sequence
  Synthetic DNA
aattacgacttaatatag

SEQ ID NO: 27199 - DNA, 18 bp, Artificial Sequence
  Synthetic DNA
atacacgactcactaaag

SEQ ID NO: 27200 - DNA, 18 bp, Artificial Sequence
  Synthetic DNA
atatacgattcagtatag

SEQ ID NO: 27201 - DNA, 18 bp, Artificial Sequence
  Synthetic DNA
atataggactcactaaag

SEQ ID NO: 27202 - DNA, 18 bp, Artificial Sequence
  Synthetic DNA
taaaacgactctccaaag

SEQ ID NO: 27203 - DNA, 18 bp, Artificial Sequence
  Synthetic DNA
taaaacgactttctctag

SEQ ID NO: 27204 - DNA, 18 bp, Artificial Sequence
  Synthetic DNA
taaaacgtctatctatag

SEQ ID NO: 27205 - DNA, 18 bp, Artificial Sequence
  Synthetic DNA
taataagaaacactttag

SEQ ID NO: 27206 - DNA, 18 bp, Artificial Sequence
  Synthetic DNA
taataatacacactttag

SEQ ID NO: 27207 - DNA, 18 bp, Artificial Sequence
  Synthetic DNA
taatacgaaactctaaag

SEQ ID NO: 27208 - DNA, 18 bp, Artificial Sequence
  Synthetic DNA
taatactattcacaaaag

SEQ ID NO: 27209 - DNA, 18 bp, Artificial Sequence
  Synthetic DNA
taataggtctcacttaag

SEQ ID NO: 27210 - DNA, 18 bp, Artificial Sequence
  Synthetic DNA
taatatgagactctatag

SEQ ID NO: 27211 - DNA, 18 bp, Artificial Sequence
  Synthetic DNA
taatatgatacactaaag

SEQ ID NO: 27212 - DNA, 18 bp, Artificial Sequence
  Synthetic DNA
taatgcgcctctcaatag

SEQ ID NO: 27213 - DNA, 18 bp, Artificial Sequence
  Synthetic DNA
tagtacgactcacataag

SEQ ID NO: 27214 - DNA, 18 bp, Artificial Sequence
  Synthetic DNA
tataacgaccctctatag

SEQ ID NO: 27215 - DNA, 18 bp, Artificial Sequence
  Synthetic DNA
tattacaactcacaatgg

SEQ ID NO: 27216 - DNA, 18 bp, Artificial Sequence
  Synthetic DNA
tattatgaatcactttag

SEQ ID NO: 27217 - DNA, 18 bp, Artificial Sequence
  Synthetic DNA
tcatactactcactaacg

SEQ ID NO: 27218 - DNA, 18 bp, Artificial Sequence
  Synthetic DNA
tcatatgactttctatag

SEQ ID NO: 27219 - DNA, 18 bp, Artificial Sequence
  Synthetic DNA
tgataagtctcactaaag

SEQ ID NO: 27220 - DNA, 18 bp, Artificial Sequence
  Synthetic DNA
ttataccactgacaatag

SEQ ID NO: 27221 - DNA, 18 bp, Artificial Sequence
  Synthetic DNA
ttatacgaattactttag

SEQ ID NO: 27222 - DNA, 18 bp, Artificial Sequence
  Synthetic DNA
ttatactacccactaaag

SEQ ID NO: 27223 - DNA, 18 bp, Artificial Sequence
  Synthetic DNA
ttatatgactcaaaatag

SEQ ID NO: 27224 - DNA, 18 bp, Artificial Sequence
  Synthetic DNA
ttatgtgacttactatag

SEQ ID NO: 27225 - DNA, 18 bp, Artificial Sequence
  Synthetic DNA
ttcaacgactcactctag

SEQ ID NO: 27226 - DNA, 18 bp, Artificial Sequence
  Synthetic DNA
ttctacgacatactatag

SEQ ID NO: 27227 - DNA, 18 bp, Artificial Sequence
  Synthetic DNA
ttgtacgacttactctag

SEQ ID NO: 27228 - DNA, 18 bp, Artificial Sequence
  Synthetic DNA
tttcacgactcattatag

SEQ ID NO: 27229 - DNA, 18 bp, Artificial Sequence
  Synthetic DNA
tttcacgactctctatag

SEQ ID NO: 27230 - DNA, 18 bp, Artificial Sequence
  Synthetic DNA
ttttacgattcaccatag

SEQ ID NO: 27231 - DNA, 18 bp, Artificial Sequence
  Synthetic DNA
ttatacgacacactaatg

SEQ ID NO: 27232 - DNA, 18 bp, Artificial Sequence
  Synthetic DNA
ttaaacaactcacaatag

SEQ ID NO: 27233 - DNA, 18 bp, Artificial Sequence
  Synthetic DNA
taattcgtctcacaattg

SEQ ID NO: 27234 - DNA, 18 bp, Artificial Sequence
  Synthetic DNA
taatacaactcattaatg

SEQ ID NO: 27235 - DNA, 18 bp, Artificial Sequence
  Synthetic DNA
taatacgtctcaccaatg

SEQ ID NO: 27236 - DNA, 18 bp, Artificial Sequence
  Synthetic DNA
taattagactctctttag

SEQ ID NO: 27237 - DNA, 18 bp, Artificial Sequence
  Synthetic DNA
tataacgcctcgctatag

SEQ ID NO: 27238 - DNA, 18 bp, Artificial Sequence
  Synthetic DNA
taatacgtttctctttag

SEQ ID NO: 27239 - DNA, 18 bp, Artificial Sequence
  Synthetic DNA
ttatacgtctctatatag

SEQ ID NO: 27240 - DNA, 18 bp, Artificial Sequence
  Synthetic DNA
ttcaacgactctctatag

SEQ ID NO: 27241 - DNA, 18 bp, Artificial Sequence
  Synthetic DNA
ttttacgacttactttag

SEQ ID NO: 27242 - DNA, 18 bp, Artificial Sequence
  Synthetic DNA
taattcttctcacaatag

SEQ ID NO: 27243 - DNA, 18 bp, Artificial Sequence
  Synthetic DNA
caattggactcactattg

SEQ ID NO: 27244 - DNA, 18 bp, Artificial Sequence
  Synthetic DNA
gaattcaactcactattg

SEQ ID NO: 27245 - DNA, 18 bp, Artificial Sequence
  Synthetic DNA
taatacgacttgcaattg

SEQ ID NO: 27246 - DNA, 18 bp, Artificial Sequence
  Synthetic DNA
taattagactcagtattg

SEQ ID NO: 27247 - DNA, 18 bp, Artificial Sequence
  Synthetic DNA
taattccacacgctatag

SEQ ID NO: 27248 - DNA, 18 bp, Artificial Sequence
  Synthetic DNA
taattcgaatctctattg

SEQ ID NO: 27249 - DNA, 18 bp, Artificial Sequence
  Synthetic DNA
taattcgacacactagtg

SEQ ID NO: 27250 - DNA, 18 bp, Artificial Sequence
  Synthetic DNA
taattcgactcacctttg

SEQ ID NO: 27251 - DNA, 18 bp, Artificial Sequence
  Synthetic DNA
taattcgacttgctttag

SEQ ID NO: 27252 - DNA, 18 bp, Artificial Sequence
  Synthetic DNA
taattcgagttgctatag

SEQ ID NO: 27253 - DNA, 18 bp, Artificial Sequence
  Synthetic DNA
taattcgtctcactagtg

SEQ ID NO: 27254 - DNA, 18 bp, Artificial Sequence
  Synthetic DNA
taattctactcaatattg

SEQ ID NO: 27255 - DNA, 18 bp, Artificial Sequence
  Synthetic DNA
taattggactctctattg

SEQ ID NO: 27256 - DNA, 18 bp, Artificial Sequence
  Synthetic DNA
tacttcgactcactaatg

SEQ ID NO: 27257 - DNA, 18 bp, Artificial Sequence
  Synthetic DNA
tatttcgactcactactg

SEQ ID NO: 27258 - DNA, 18 bp, Artificial Sequence
  Synthetic DNA
ttatacgacttgctattg

SEQ ID NO: 27259 - DNA, 18 bp, Artificial Sequence
  Synthetic DNA
aaaaacgactctctattg

SEQ ID NO: 27260 - DNA, 18 bp, Artificial Sequence
  Synthetic DNA
aaaaactactcactattg

SEQ ID NO: 27261 - DNA, 18 bp, Artificial Sequence
  Synthetic DNA
aaaatcgactcaccatag

SEQ ID NO: 27262 - DNA, 18 bp, Artificial Sequence
  Synthetic DNA
aaacactactcactattg

SEQ ID NO: 27263 - DNA, 18 bp, Artificial Sequence
  Synthetic DNA
aaactcgacttactatag

SEQ ID NO: 27264 - DNA, 18 bp, Artificial Sequence
  Synthetic DNA
aaagaggactcactattg

SEQ ID NO: 27265 - DNA, 18 bp, Artificial Sequence
  Synthetic DNA
aaataagactcactcttg

SEQ ID NO: 27266 - DNA, 18 bp, Artificial Sequence
  Synthetic DNA
aaataggactcaatattg

SEQ ID NO: 27267 - DNA, 18 bp, Artificial Sequence
  Synthetic DNA
aaatatgactcgctaaag

SEQ ID NO: 27268 - DNA, 18 bp, Artificial Sequence
  Synthetic DNA
aaatatgtctcgctatag

SEQ ID NO: 27269 - DNA, 18 bp, Artificial Sequence
  Synthetic DNA
aaatgcgactaactattg

SEQ ID NO: 27270 - DNA, 18 bp, Artificial Sequence
  Synthetic DNA
aaattcaactcactagag

SEQ ID NO: 27271 - DNA, 18 bp, Artificial Sequence
  Synthetic DNA
aacttcgactcacaatag

SEQ ID NO: 27272 - DNA, 18 bp, Artificial Sequence
  Synthetic DNA
aattaagactcactattg

SEQ ID NO: 27273 - DNA, 18 bp, Artificial Sequence
  Synthetic DNA
agattcgactcactaaag

SEQ ID NO: 27274 - DNA, 18 bp, Artificial Sequence
  Synthetic DNA
caaaacgactaactattg

SEQ ID NO: 27275 - DNA, 18 bp, Artificial Sequence
  Synthetic DNA
caatacgactcacaaatg

SEQ ID NO: 27276 - DNA, 18 bp, Artificial Sequence
  Synthetic DNA
caatacgattaactattg

SEQ ID NO: 27277 - DNA, 18 bp, Artificial Sequence
  Synthetic DNA
caatacgtctcgcaatag

SEQ ID NO: 27278 - DNA, 18 bp, Artificial Sequence
  Synthetic DNA
caattcgacactctatag

SEQ ID NO: 27279 - DNA, 18 bp, Artificial Sequence
  Synthetic DNA
caattcgacttaatatag

SEQ ID NO: 27280 - DNA, 18 bp, Artificial Sequence
  Synthetic DNA
caatttgactctctatag

SEQ ID NO: 27281 - DNA, 18 bp, Artificial Sequence
  Synthetic DNA
ccatacgactcagtattg

SEQ ID NO: 27282 - DNA, 18 bp, Artificial Sequence
  Synthetic DNA
ctattcgagtcactatag

SEQ ID NO: 27283 - DNA, 18 bp, Artificial Sequence
  Synthetic DNA
gaatacgactctctaatg

SEQ ID NO: 27284 - DNA, 18 bp, Artificial Sequence
  Synthetic DNA
taaaaagactcgttatag

SEQ ID NO: 27285 - DNA, 18 bp, Artificial Sequence
  Synthetic DNA
taaaacaactcaatattg

SEQ ID NO: 27286 - DNA, 18 bp, Artificial Sequence
  Synthetic DNA
taaaacgacgcgctacag

SEQ ID NO: 27287 - DNA, 18 bp, Artificial Sequence
  Synthetic DNA
taaaacgagtctctattg

SEQ ID NO: 27288 - DNA, 18 bp, Artificial Sequence
  Synthetic DNA
taaaacgtcgcactattg

SEQ ID NO: 27289 - DNA, 18 bp, Artificial Sequence
  Synthetic DNA
taaaacgtctcgccatag

SEQ ID NO: 27290 - DNA, 18 bp, Artificial Sequence
  Synthetic DNA
taaaccgacacactattg

SEQ ID NO: 27291 - DNA, 18 bp, Artificial Sequence
  Synthetic DNA
taaaccgacacgctatag

SEQ ID NO: 27292 - DNA, 18 bp, Artificial Sequence
  Synthetic DNA
taaagcgactcattattg

SEQ ID NO: 27293 - DNA, 18 bp, Artificial Sequence
  Synthetic DNA
taaatcaactctctatag

SEQ ID NO: 27294 - DNA, 18 bp, Artificial Sequence
  Synthetic DNA
taaatcgacgcagtatag

SEQ ID NO: 27295 - DNA, 18 bp, Artificial Sequence
  Synthetic DNA
taaatcgactcataatag

SEQ ID NO: 27296 - DNA, 18 bp, Artificial Sequence
  Synthetic DNA
taacaccactcacaattg

SEQ ID NO: 27297 - DNA, 18 bp, Artificial Sequence
  Synthetic DNA
taacacgactcgttttag

SEQ ID NO: 27298 - DNA, 18 bp, Artificial Sequence
  Synthetic DNA
taacacgagacactattg

SEQ ID NO: 27299 - DNA, 18 bp, Artificial Sequence
  Synthetic DNA
taacacgtatcactattg

SEQ ID NO: 27300 - DNA, 18 bp, Artificial Sequence
  Synthetic DNA
taacacgtctcattattg

SEQ ID NO: 27301 - DNA, 18 bp, Artificial Sequence
  Synthetic DNA
taacccgactcactaatg

SEQ ID NO: 27302 - DNA, 18 bp, Artificial Sequence
  Synthetic DNA
taactagactcactagag

SEQ ID NO: 27303 - DNA, 18 bp, Artificial Sequence
  Synthetic DNA
taactcgagtctctatag

SEQ ID NO: 27304 - DNA, 18 bp, Artificial Sequence
  Synthetic DNA
taataagactgacttttg

SEQ ID NO: 27305 - DNA, 18 bp, Artificial Sequence
  Synthetic DNA
taatacaacacacttttg

SEQ ID NO: 27306 - DNA, 18 bp, Artificial Sequence
  Synthetic DNA
taatacaatttactattg

SEQ ID NO: 27307 - DNA, 18 bp, Artificial Sequence
  Synthetic DNA
taataccacttattattg

SEQ ID NO: 27308 - DNA, 18 bp, Artificial Sequence
  Synthetic DNA
taatacctctcacaattg

SEQ ID NO: 27309 - DNA, 18 bp, Artificial Sequence
  Synthetic DNA
taatacgaataattattg

SEQ ID NO: 27310 - DNA, 18 bp, Artificial Sequence
  Synthetic DNA
taatacgaatcattaatg

SEQ ID NO: 27311 - DNA, 18 bp, Artificial Sequence
  Synthetic DNA
taatacgaatctgtattg

SEQ ID NO: 27312 - DNA, 18 bp, Artificial Sequence
  Synthetic DNA
taatacgactctttactg

SEQ ID NO: 27313 - DNA, 18 bp, Artificial Sequence
  Synthetic DNA
taatacgatcctctattg

SEQ ID NO: 27314 - DNA, 18 bp, Artificial Sequence
  Synthetic DNA
taatacgatctactattg

SEQ ID NO: 27315 - DNA, 18 bp, Artificial Sequence
  Synthetic DNA
taatacgtatcaatattg

SEQ ID NO: 27316 - DNA, 18 bp, Artificial Sequence
  Synthetic DNA
taatacgtatcgctctag

SEQ ID NO: 27317 - DNA, 18 bp, Artificial Sequence
  Synthetic DNA
taatacgtctaactgttg

SEQ ID NO: 27318 - DNA, 18 bp, Artificial Sequence
  Synthetic DNA
taatacgtctcattgttg

SEQ ID NO: 27319 - DNA, 18 bp, Artificial Sequence
  Synthetic DNA
taatactacacgctatgg

SEQ ID NO: 27320 - DNA, 18 bp, Artificial Sequence
  Synthetic DNA
taatactactgacttttg

SEQ ID NO: 27321 - DNA, 18 bp, Artificial Sequence
  Synthetic DNA
taatactacttaatattg

SEQ ID NO: 27322 - DNA, 18 bp, Artificial Sequence
  Synthetic DNA
taataggactcgctttcg

SEQ ID NO: 27323 - DNA, 18 bp, Artificial Sequence
  Synthetic DNA
taatatcactcggtatag

SEQ ID NO: 27324 - DNA, 18 bp, Artificial Sequence
  Synthetic DNA
taatccgattcaatattg

SEQ ID NO: 27325 - DNA, 18 bp, Artificial Sequence
  Synthetic DNA
taatccgattcaccattg

SEQ ID NO: 27326 - DNA, 18 bp, Artificial Sequence
  Synthetic DNA
taatgcgacttgctctag

SEQ ID NO: 27327 - DNA, 18 bp, Artificial Sequence
  Synthetic DNA
taatgcgtatcactattg

SEQ ID NO: 27328 - DNA, 18 bp, Artificial Sequence
  Synthetic DNA
taattcaactgactatcg

SEQ ID NO: 27329 - DNA, 18 bp, Artificial Sequence
  Synthetic DNA
taattcaacttagtatag

SEQ ID NO: 27330 - DNA, 18 bp, Artificial Sequence
  Synthetic DNA
taattcacctcacaatag

SEQ ID NO: 27331 - DNA, 18 bp, Artificial Sequence
  Synthetic DNA
taattccaataactatag

SEQ ID NO: 27332 - DNA, 18 bp, Artificial Sequence
  Synthetic DNA
taattccaatccctatag

SEQ ID NO: 27333 - DNA, 18 bp, Artificial Sequence
  Synthetic DNA
taattccacttcctatag

SEQ ID NO: 27334 - DNA, 18 bp, Artificial Sequence
  Synthetic DNA
taattcgaattactaaag

SEQ ID NO: 27335 - DNA, 18 bp, Artificial Sequence
  Synthetic DNA
taattcgacactctagag

SEQ ID NO: 27336 - DNA, 18 bp, Artificial Sequence
  Synthetic DNA
taattcgacagaatatag

SEQ ID NO: 27337 - DNA, 18 bp, Artificial Sequence
  Synthetic DNA
taattcgactcattacgg

SEQ ID NO: 27338 - DNA, 18 bp, Artificial Sequence
  Synthetic DNA
taattcgactcccattag

SEQ ID NO: 27339 - DNA, 18 bp, Artificial Sequence
  Synthetic DNA
taattcgactgtctttag

SEQ ID NO: 27340 - DNA, 18 bp, Artificial Sequence
  Synthetic DNA
taattcgatacacgatag

SEQ ID NO: 27341 - DNA, 18 bp, Artificial Sequence
  Synthetic DNA
taattcgtcacacgatag

SEQ ID NO: 27342 - DNA, 18 bp, Artificial Sequence
  Synthetic DNA
taattcgtcccactatcg

SEQ ID NO: 27343 - DNA, 18 bp, Artificial Sequence
  Synthetic DNA
taattcgtctacctatag

SEQ ID NO: 27344 - DNA, 18 bp, Artificial Sequence
  Synthetic DNA
taattcgtctcattatgg

SEQ ID NO: 27345 - DNA, 18 bp, Artificial Sequence
  Synthetic DNA
taattcgtttctctatag

SEQ ID NO: 27346 - DNA, 18 bp, Artificial Sequence
  Synthetic DNA
taattctattcactaaag

SEQ ID NO: 27347 - DNA, 18 bp, Artificial Sequence
  Synthetic DNA
taattggactctcaatag

SEQ ID NO: 27348 - DNA, 18 bp, Artificial Sequence
  Synthetic DNA
taattgtactcactatcg

SEQ ID NO: 27349 - DNA, 18 bp, Artificial Sequence
  Synthetic DNA
taatttgacacaatatag

SEQ ID NO: 27350 - DNA, 18 bp, Artificial Sequence
  Synthetic DNA
taatttgactctccatag

SEQ ID NO: 27351 - DNA, 18 bp, Artificial Sequence
  Synthetic DNA
tactaggactcacaattg

SEQ ID NO: 27352 - DNA, 18 bp, Artificial Sequence
  Synthetic DNA
tacttcgactcattatcg

SEQ ID NO: 27353 - DNA, 18 bp, Artificial Sequence
  Synthetic DNA
tacttcgtctcactaaag

SEQ ID NO: 27354 - DNA, 18 bp, Artificial Sequence
  Synthetic DNA
tagaacgacacactattg

SEQ ID NO: 27355 - DNA, 18 bp, Artificial Sequence
  Synthetic DNA
tagtacaactctctattg

SEQ ID NO: 27356 - DNA, 18 bp, Artificial Sequence
  Synthetic DNA
tagtacgaatcactaatg

SEQ ID NO: 27357 - DNA, 18 bp, Artificial Sequence
  Synthetic DNA
tagtacgactatctattg

SEQ ID NO: 27358 - DNA, 18 bp, Artificial Sequence
  Synthetic DNA
tagtacgactcatttttg

SEQ ID NO: 27359 - DNA, 18 bp, Artificial Sequence
  Synthetic DNA
tagttggactcaatatag

SEQ ID NO: 27360 - DNA, 18 bp, Artificial Sequence
  Synthetic DNA
tataacgactaactattg

SEQ ID NO: 27361 - DNA, 18 bp, Artificial Sequence
  Synthetic DNA
tatatcgtctcactatag

SEQ ID NO: 27362 - DNA, 18 bp, Artificial Sequence
  Synthetic DNA
tattaagaatcactattg

SEQ ID NO: 27363 - DNA, 18 bp, Artificial Sequence
  Synthetic DNA
tattacgactcgttaaag

SEQ ID NO: 27364 - DNA, 18 bp, Artificial Sequence
  Synthetic DNA
tattacgtctcgatatag

SEQ ID NO: 27365 - DNA, 18 bp, Artificial Sequence
  Synthetic DNA
tatttcggcttactatag

SEQ ID NO: 27366 - DNA, 18 bp, Artificial Sequence
  Synthetic DNA
tatttcgtctgactatag

SEQ ID NO: 27367 - DNA, 18 bp, Artificial Sequence
  Synthetic DNA
tattttcactcactatag

SEQ ID NO: 27368 - DNA, 18 bp, Artificial Sequence
  Synthetic DNA
tattttgacacactatag

SEQ ID NO: 27369 - DNA, 18 bp, Artificial Sequence
  Synthetic DNA
tattttgactcacaatag

SEQ ID NO: 27370 - DNA, 18 bp, Artificial Sequence
  Synthetic DNA
tattttgactcattatag

SEQ ID NO: 27371 - DNA, 18 bp, Artificial Sequence
  Synthetic DNA
tcaaacgactcactgttg

SEQ ID NO: 27372 - DNA, 18 bp, Artificial Sequence
  Synthetic DNA
tcattagaatcactatag

SEQ ID NO: 27373 - DNA, 18 bp, Artificial Sequence
  Synthetic DNA
tcttccgactcactattg

SEQ ID NO: 27374 - DNA, 18 bp, Artificial Sequence
  Synthetic DNA
tgaaatgactcgctatag

SEQ ID NO: 27375 - DNA, 18 bp, Artificial Sequence
  Synthetic DNA
tgatacaactccctattg

SEQ ID NO: 27376 - DNA, 18 bp, Artificial Sequence
  Synthetic DNA
tgatacgacatactattg

SEQ ID NO: 27377 - DNA, 18 bp, Artificial Sequence
  Synthetic DNA
tgatacgactctctaatg

SEQ ID NO: 27378 - DNA, 18 bp, Artificial Sequence
  Synthetic DNA
tgattcgacagactatag

SEQ ID NO: 27379 - DNA, 18 bp, Artificial Sequence
  Synthetic DNA
tgattcgactaaatatag

SEQ ID NO: 27380 - DNA, 18 bp, Artificial Sequence
  Synthetic DNA
tgattcgactctctaaag

SEQ ID NO: 27381 - DNA, 18 bp, Artificial Sequence
  Synthetic DNA
tgattctattcactatag

SEQ ID NO: 27382 - DNA, 18 bp, Artificial Sequence
  Synthetic DNA
ttaaacgactcagtattg

SEQ ID NO: 27383 - DNA, 18 bp, Artificial Sequence
  Synthetic DNA
ttatacgaatcaatattg

SEQ ID NO: 27384 - DNA, 18 bp, Artificial Sequence
  Synthetic DNA
ttatacgacacgctttag

SEQ ID NO: 27385 - DNA, 18 bp, Artificial Sequence
  Synthetic DNA
ttatacgactcgctcgag

SEQ ID NO: 27386 - DNA, 18 bp, Artificial Sequence
  Synthetic DNA
ttattcaacttactatag

SEQ ID NO: 27387 - DNA, 18 bp, Artificial Sequence
  Synthetic DNA
ttatttgactcactgtag

SEQ ID NO: 27388 - DNA, 18 bp, Artificial Sequence
  Synthetic DNA
ttcttcgactctctatag

SEQ ID NO: 27389 - DNA, 18 bp, Artificial Sequence
  Synthetic DNA
ttgtacgactagctatag

SEQ ID NO: 27390 - DNA, 18 bp, Artificial Sequence
  Synthetic DNA
aaaaacaactcactttag

SEQ ID NO: 27391 - DNA, 18 bp, Artificial Sequence
  Synthetic DNA
aaaaacgaatcattatag

SEQ ID NO: 27392 - DNA, 18 bp, Artificial Sequence
  Synthetic DNA
aaaaacgacaaactatag

SEQ ID NO: 27393 - DNA, 18 bp, Artificial Sequence
  Synthetic DNA
aaaaacgactatctatag

SEQ ID NO: 27394 - DNA, 18 bp, Artificial Sequence
  Synthetic DNA
aaaaacgcctcactaaag

SEQ ID NO: 27395 - DNA, 18 bp, Artificial Sequence
  Synthetic DNA
aaacacgacacactttag

SEQ ID NO: 27396 - DNA, 18 bp, Artificial Sequence
  Synthetic DNA
aaacacgtctctctatag

SEQ ID NO: 27397 - DNA, 18 bp, Artificial Sequence
  Synthetic DNA
aaataagactaaccatag

SEQ ID NO: 27398 - DNA, 18 bp, Artificial Sequence
  Synthetic DNA
aaataagactaactacag

SEQ ID NO: 27399 - DNA, 18 bp, Artificial Sequence
  Synthetic DNA
aaataagactcattaaag

SEQ ID NO: 27400 - DNA, 18 bp, Artificial Sequence
  Synthetic DNA
aaatacatctaactatag

SEQ ID NO: 27401 - DNA, 18 bp, Artificial Sequence
  Synthetic DNA
aaatacgaatcacttcag

SEQ ID NO: 27402 - DNA, 18 bp, Artificial Sequence
  Synthetic DNA
aaatacgaatttctatag

SEQ ID NO: 27403 - DNA, 18 bp, Artificial Sequence
  Synthetic DNA
aaatacgactatatatag

SEQ ID NO: 27404 - DNA, 18 bp, Artificial Sequence
  Synthetic DNA
aaatacgccccactttag

SEQ ID NO: 27405 - DNA, 18 bp, Artificial Sequence
  Synthetic DNA
aaatacgtcacattatag

SEQ ID NO: 27406 - DNA, 18 bp, Artificial Sequence
  Synthetic DNA
aaatacgtctcaccgtag

SEQ ID NO: 27407 - DNA, 18 bp, Artificial Sequence
  Synthetic DNA
aaatacgtctgacaatag

SEQ ID NO: 27408 - DNA, 18 bp, Artificial Sequence
  Synthetic DNA
aaatactactacctatag

SEQ ID NO: 27409 - DNA, 18 bp, Artificial Sequence
  Synthetic DNA
aaataggacacactatgg

SEQ ID NO: 27410 - DNA, 18 bp, Artificial Sequence
  Synthetic DNA
aaatatgaatctctatag

SEQ ID NO: 27411 - DNA, 18 bp, Artificial Sequence
  Synthetic DNA
aaatgcgactcactaggg

SEQ ID NO: 27412 - DNA, 18 bp, Artificial Sequence
  Synthetic DNA
aaatgcgactcattaaag

SEQ ID NO: 27413 - DNA, 18 bp, Artificial Sequence
  Synthetic DNA
aactacgactctctctag

SEQ ID NO: 27414 - DNA, 18 bp, Artificial Sequence
  Synthetic DNA
aagtaccactcacaatag

SEQ ID NO: 27415 - DNA, 18 bp, Artificial Sequence
  Synthetic DNA
aagtaccactcattatag

SEQ ID NO: 27416 - DNA, 18 bp, Artificial Sequence
  Synthetic DNA
aagtacgactctgtatag

SEQ ID NO: 27417 - DNA, 18 bp, Artificial Sequence
  Synthetic DNA
aagtacgtctctctatag

SEQ ID NO: 27418 - DNA, 18 bp, Artificial Sequence
  Synthetic DNA
aatgacgactcactaaag

SEQ ID NO: 27419 - DNA, 18 bp, Artificial Sequence
  Synthetic DNA
aattacgaatcactatgg

SEQ ID NO: 27420 - DNA, 18 bp, Artificial Sequence
  Synthetic DNA
aattacgactctctacag

SEQ ID NO: 27421 - DNA, 18 bp, Artificial Sequence
  Synthetic DNA
aattacgccacactatag

SEQ ID NO: 27422 - DNA, 18 bp, Artificial Sequence
  Synthetic DNA
acaaacgactcactgtag

SEQ ID NO: 27423 - DNA, 18 bp, Artificial Sequence
  Synthetic DNA
acatacaactcattatag

SEQ ID NO: 27424 - DNA, 18 bp, Artificial Sequence
  Synthetic DNA
acatactagtcactatag

SEQ ID NO: 27425 - DNA, 18 bp, Artificial Sequence
  Synthetic DNA
acataggactcactaaag

SEQ ID NO: 27426 - DNA, 18 bp, Artificial Sequence
  Synthetic DNA
agaaacgactcattatag

SEQ ID NO: 27427 - DNA, 18 bp, Artificial Sequence
  Synthetic DNA
agatacatctcactatag

SEQ ID NO: 27428 - DNA, 18 bp, Artificial Sequence
  Synthetic DNA
agatacgactcacagtag

SEQ ID NO: 27429 - DNA, 18 bp, Artificial Sequence
  Synthetic DNA
ataaatgactcactatag

SEQ ID NO: 27430 - DNA, 18 bp, Artificial Sequence
  Synthetic DNA
atacgcgactcactatag

SEQ ID NO: 27431 - DNA, 18 bp, Artificial Sequence
  Synthetic DNA
atatacgactcaccagag

SEQ ID NO: 27432 - DNA, 18 bp, Artificial Sequence
  Synthetic DNA
atatacgagtcaatatag

SEQ ID NO: 27433 - DNA, 18 bp, Artificial Sequence
  Synthetic DNA
atatacgtctcagtatag

SEQ ID NO: 27434 - DNA, 18 bp, Artificial Sequence
  Synthetic DNA
atatatgactcactctag

SEQ ID NO: 27435 - DNA, 18 bp, Artificial Sequence
  Synthetic DNA
atatgcgacacactatag

SEQ ID NO: 27436 - DNA, 18 bp, Artificial Sequence
  Synthetic DNA
atatgcgactcattatag

SEQ ID NO: 27437 - DNA, 18 bp, Artificial Sequence
  Synthetic DNA
atctacgtctcactatag

SEQ ID NO: 27438 - DNA, 18 bp, Artificial Sequence
  Synthetic DNA
atgtacgacttactatag

SEQ ID NO: 27439 - DNA, 18 bp, Artificial Sequence
  Synthetic DNA
caaaacgtctcactttag

SEQ ID NO: 27440 - DNA, 18 bp, Artificial Sequence
  Synthetic DNA
caatacgaaacacaatag

SEQ ID NO: 27441 - DNA, 18 bp, Artificial Sequence
  Synthetic DNA
caatacgacacacttcag

SEQ ID NO: 27442 - DNA, 18 bp, Artificial Sequence
  Synthetic DNA
caatacgactaaatctag

SEQ ID NO: 27443 - DNA, 18 bp, Artificial Sequence
  Synthetic DNA
caatacgactccgtaaag

SEQ ID NO: 27444 - DNA, 18 bp, Artificial Sequence
  Synthetic DNA
caatacgactttctaaag

SEQ ID NO: 27445 - DNA, 18 bp, Artificial Sequence
  Synthetic DNA
caatacgagacacaatag

SEQ ID NO: 27446 - DNA, 18 bp, Artificial Sequence
  Synthetic DNA
caatacgattcacaacag

SEQ ID NO: 27447 - DNA, 18 bp, Artificial Sequence
  Synthetic DNA
caatacggcacactatgg

SEQ ID NO: 27448 - DNA, 18 bp, Artificial Sequence
  Synthetic DNA
caatacggctcacttaag

SEQ ID NO: 27449 - DNA, 18 bp, Artificial Sequence
  Synthetic DNA
caatacgtatcactttag

SEQ ID NO: 27450 - DNA, 18 bp, Artificial Sequence
  Synthetic DNA
caatacgtcgcaatatag

SEQ ID NO: 27451 - DNA, 18 bp, Artificial Sequence
  Synthetic DNA
caatactcatcactatag

SEQ ID NO: 27452 - DNA, 18 bp, Artificial Sequence
  Synthetic DNA
cagaacgacacactatag

SEQ ID NO: 27453 - DNA, 18 bp, Artificial Sequence
  Synthetic DNA
cataactactcactatag

SEQ ID NO: 27454 - DNA, 18 bp, Artificial Sequence
  Synthetic DNA
cattacgactcactttgg

SEQ ID NO: 27455 - DNA, 18 bp, Artificial Sequence
  Synthetic DNA
cattatgactcactatcg

SEQ ID NO: 27456 - DNA, 18 bp, Artificial Sequence
  Synthetic DNA
ccataccaatcactatag

SEQ ID NO: 27457 - DNA, 18 bp, Artificial Sequence
  Synthetic DNA
ctatacaactcattatag

SEQ ID NO: 27458 - DNA, 18 bp, Artificial Sequence
  Synthetic DNA
ctatacgagtaactatag

SEQ ID NO: 27459 - DNA, 18 bp, Artificial Sequence
  Synthetic DNA
ctttacgactcactatgg

SEQ ID NO: 27460 - DNA, 18 bp, Artificial Sequence
  Synthetic DNA
gaatacgaatcattacag

SEQ ID NO: 27461 - DNA, 18 bp, Artificial Sequence
  Synthetic DNA
gaatactacatactatag

SEQ ID NO: 27462 - DNA, 18 bp, Artificial Sequence
  Synthetic DNA
gacaacgactaactatag

SEQ ID NO: 27463 - DNA, 18 bp, Artificial Sequence
  Synthetic DNA
gagaacgactcactacag

SEQ ID NO: 27464 - DNA, 18 bp, Artificial Sequence
  Synthetic DNA
ggttacgactcactaaag

SEQ ID NO: 27465 - DNA, 18 bp, Artificial Sequence
  Synthetic DNA
taaaaacactcactttag

SEQ ID NO: 27466 - DNA, 18 bp, Artificial Sequence
  Synthetic DNA
taaaaagcctcactaaag

SEQ ID NO: 27467 - DNA, 18 bp, Artificial Sequence
  Synthetic DNA
taaaacaattgactatag

SEQ ID NO: 27468 - DNA, 18 bp, Artificial Sequence
  Synthetic DNA
taaaaccacttacaatag

SEQ ID NO: 27469 - DNA, 18 bp, Artificial Sequence
  Synthetic DNA
taaaacgaaccactaaag

SEQ ID NO: 27470 - DNA, 18 bp, Artificial Sequence
  Synthetic DNA
taaaacgacaaagtatag

SEQ ID NO: 27471 - DNA, 18 bp, Artificial Sequence
  Synthetic DNA
taaaacgacacaataaag

SEQ ID NO: 27472 - DNA, 18 bp, Artificial Sequence
  Synthetic DNA
taaaacgacactctaaag

SEQ ID NO: 27473 - DNA, 18 bp, Artificial Sequence
  Synthetic DNA
taaaacgactaaatacag

SEQ ID NO: 27474 - DNA, 18 bp, Artificial Sequence
  Synthetic DNA
taaaacgactacctatcg

SEQ ID NO: 27475 - DNA, 18 bp, Artificial Sequence
  Synthetic DNA
taaaacgactcagaaaag

SEQ ID NO: 27476 - DNA, 18 bp, Artificial Sequence
  Synthetic DNA
taaaacgactcatagtag

SEQ ID NO: 27477 - DNA, 18 bp, Artificial Sequence
  Synthetic DNA
taaaacgactctagatag

SEQ ID NO: 27478 - DNA, 18 bp, Artificial Sequence
  Synthetic DNA
taaaacgactctcaacag

SEQ ID NO: 27479 - DNA, 18 bp, Artificial Sequence
  Synthetic DNA
taaaacgagttattatag

SEQ ID NO: 27480 - DNA, 18 bp, Artificial Sequence
  Synthetic DNA
taaaacggcttactaaag

SEQ ID NO: 27481 - DNA, 18 bp, Artificial Sequence
  Synthetic DNA
taaaacgtcccactttag

SEQ ID NO: 27482 - DNA, 18 bp, Artificial Sequence
  Synthetic DNA
taaaacgtccgactatag

SEQ ID NO: 27483 - DNA, 18 bp, Artificial Sequence
  Synthetic DNA
taaaacgtttaactatag

SEQ ID NO: 27484 - DNA, 18 bp, Artificial Sequence
  Synthetic DNA
taaaactattcacaatag

SEQ ID NO: 27485 - DNA, 18 bp, Artificial Sequence
  Synthetic DNA
taaaatcacacactatag

SEQ ID NO: 27486 - DNA, 18 bp, Artificial Sequence
  Synthetic DNA
taaaccatctcactatag

SEQ ID NO: 27487 - DNA, 18 bp, Artificial Sequence
  Synthetic DNA
taacaagacttactaaag

SEQ ID NO: 27488 - DNA, 18 bp, Artificial Sequence
  Synthetic DNA
taacacgacttaccttag

SEQ ID NO: 27489 - DNA, 18 bp, Artificial Sequence
  Synthetic DNA
taacacgagacaccatag

SEQ ID NO: 27490 - DNA, 18 bp, Artificial Sequence
  Synthetic DNA
taacacgattcacagtag

SEQ ID NO: 27491 - DNA, 18 bp, Artificial Sequence
  Synthetic DNA
taacactactcactaccg

SEQ ID NO: 27492 - DNA, 18 bp, Artificial Sequence
  Synthetic DNA
taacactactcattaaag

SEQ ID NO: 27493 - DNA, 18 bp, Artificial Sequence
  Synthetic DNA
taacactactctttatag

SEQ ID NO: 27494 - DNA, 18 bp, Artificial Sequence
  Synthetic DNA
taacactattcattatag

SEQ ID NO: 27495 - DNA, 18 bp, Artificial Sequence
  Synthetic DNA
taacaggtatcactatag

SEQ ID NO: 27496 - DNA, 18 bp, Artificial Sequence
  Synthetic DNA
taacatgatacactatag

SEQ ID NO: 27497 - DNA, 18 bp, Artificial Sequence
  Synthetic DNA
taacatggttcactatag

SEQ ID NO: 27498 - DNA, 18 bp, Artificial Sequence
  Synthetic DNA
taacgcgacccactaaag

SEQ ID NO: 27499 - DNA, 18 bp, Artificial Sequence
  Synthetic DNA
taacgcgtctcactttag

SEQ ID NO: 27500 - DNA, 18 bp, Artificial Sequence
  Synthetic DNA
taagacggttctctatag

SEQ ID NO: 27501 - DNA, 18 bp, Artificial Sequence
  Synthetic DNA
taagcctactcactaaag

SEQ ID NO: 27502 - DNA, 18 bp, Artificial Sequence
  Synthetic DNA
taataaaactcaaaatag

SEQ ID NO: 27503 - DNA, 18 bp, Artificial Sequence
  Synthetic DNA
taataaaactccctttag

SEQ ID NO: 27504 - DNA, 18 bp, Artificial Sequence
  Synthetic DNA
taataagaatcagaatag

SEQ ID NO: 27505 - DNA, 18 bp, Artificial Sequence
  Synthetic DNA
taataagacacaccacag

SEQ ID NO: 27506 - DNA, 18 bp, Artificial Sequence
  Synthetic DNA
taataagacacaccatgg

SEQ ID NO: 27507 - DNA, 18 bp, Artificial Sequence
  Synthetic DNA
taataagagtcacttcag

SEQ ID NO: 27508 - DNA, 18 bp, Artificial Sequence
  Synthetic DNA
taataagatacactttag

SEQ ID NO: 27509 - DNA, 18 bp, Artificial Sequence
  Synthetic DNA
taataagatttactttag

SEQ ID NO: 27510 - DNA, 18 bp, Artificial Sequence
  Synthetic DNA
taataaggctctctttag

SEQ ID NO: 27511 - DNA, 18 bp, Artificial Sequence
  Synthetic DNA
taataagtatcattatag

SEQ ID NO: 27512 - DNA, 18 bp, Artificial Sequence
  Synthetic DNA
taataatactctctctag

SEQ ID NO: 27513 - DNA, 18 bp, Artificial Sequence
  Synthetic DNA
taataattttcactatag

SEQ ID NO: 27514 - DNA, 18 bp, Artificial Sequence
  Synthetic DNA
taatacaaatcactttgg

SEQ ID NO: 27515 - DNA, 18 bp, Artificial Sequence
  Synthetic DNA
taatacaacacaatgtag

SEQ ID NO: 27516 - DNA, 18 bp, Artificial Sequence
  Synthetic DNA
taatacaacactatatag

SEQ ID NO: 27517 - DNA, 18 bp, Artificial Sequence
  Synthetic DNA
taatacaaccaaccatag

SEQ ID NO: 27518 - DNA, 18 bp, Artificial Sequence
  Synthetic DNA
taatacaactatctgtag

SEQ ID NO: 27519 - DNA, 18 bp, Artificial Sequence
  Synthetic DNA
taatacaactcagtttgg

SEQ ID NO: 27520 - DNA, 18 bp, Artificial Sequence
  Synthetic DNA
taatacaactccataaag

SEQ ID NO: 27521 - DNA, 18 bp, Artificial Sequence
  Synthetic DNA
taatacaactttctctag

SEQ ID NO: 27522 - DNA, 18 bp, Artificial Sequence
  Synthetic DNA
taatacaagtcaacatag

SEQ ID NO: 27523 - DNA, 18 bp, Artificial Sequence
  Synthetic DNA
taatacatatccctatag

SEQ ID NO: 27524 - DNA, 18 bp, Artificial Sequence
  Synthetic DNA
taatacatctcactgaag

SEQ ID NO: 27525 - DNA, 18 bp, Artificial Sequence
  Synthetic DNA
taatacatttcactctag

SEQ ID NO: 27526 - DNA, 18 bp, Artificial Sequence
  Synthetic DNA
taataccagttaatatag

SEQ ID NO: 27527 - DNA, 18 bp, Artificial Sequence
  Synthetic DNA
taataccgctaactaaag

SEQ ID NO: 27528 - DNA, 18 bp, Artificial Sequence
  Synthetic DNA
taatacctctctctacag

SEQ ID NO: 27529 - DNA, 18 bp, Artificial Sequence
  Synthetic DNA
taatacgaaactctacag

SEQ ID NO: 27530 - DNA, 18 bp, Artificial Sequence
  Synthetic DNA
taatacgaaccattaaag

SEQ ID NO: 27531 - DNA, 18 bp, Artificial Sequence
  Synthetic DNA
taatacgacacagattag

SEQ ID NO: 27532 - DNA, 18 bp, Artificial Sequence
  Synthetic DNA
taatacgacacagtcaag

SEQ ID NO: 27533 - DNA, 18 bp, Artificial Sequence
  Synthetic DNA
taatacgacattatatag

SEQ ID NO: 27534 - DNA, 18 bp, Artificial Sequence
  Synthetic DNA
taatacgaccaacttgag

SEQ ID NO: 27535 - DNA, 18 bp, Artificial Sequence
  Synthetic DNA
taatacgacgatcaatag

SEQ ID NO: 27536 - DNA, 18 bp, Artificial Sequence
  Synthetic DNA
taatacgacgctataaag

SEQ ID NO: 27537 - DNA, 18 bp, Artificial Sequence
  Synthetic DNA
taatacgactaccattag

SEQ ID NO: 27538 - DNA, 18 bp, Artificial Sequence
  Synthetic DNA
taatacgactatcttcag

SEQ ID NO: 27539 - DNA, 18 bp, Artificial Sequence
  Synthetic DNA
taatacgactcaaacaag

SEQ ID NO: 27540 - DNA, 18 bp, Artificial Sequence
  Synthetic DNA
taatacgactctacctag

SEQ ID NO: 27541 - DNA, 18 bp, Artificial Sequence
  Synthetic DNA
taatacgactctccgaag

SEQ ID NO: 27542 - DNA, 18 bp, Artificial Sequence
  Synthetic DNA
taatacgactgcataaag

SEQ ID NO: 27543 - DNA, 18 bp, Artificial Sequence
  Synthetic DNA
taatacgactttctttcg

SEQ ID NO: 27544 - DNA, 18 bp, Artificial Sequence
  Synthetic DNA
taatacgagactctacag

SEQ ID NO: 27545 - DNA, 18 bp, Artificial Sequence
  Synthetic DNA
taatacgagatattatag

SEQ ID NO: 27546 - DNA, 18 bp, Artificial Sequence
  Synthetic DNA
taatacgatacaccttag

SEQ ID NO: 27547 - DNA, 18 bp, Artificial Sequence
  Synthetic DNA
taatacgattcaatgcag

SEQ ID NO: 27548 - DNA, 18 bp, Artificial Sequence
  Synthetic DNA
taatacgattctctgtgg

SEQ ID NO: 27549 - DNA, 18 bp, Artificial Sequence
  Synthetic DNA
taatacgcatcaaaatag

SEQ ID NO: 27550 - DNA, 18 bp, Artificial Sequence
  Synthetic DNA
taatacgccaaactttag

SEQ ID NO: 27551 - DNA, 18 bp, Artificial Sequence
  Synthetic DNA
taatacgcctatcaatag

SEQ ID NO: 27552 - DNA, 18 bp, Artificial Sequence
  Synthetic DNA
taatacgcctatctttag

SEQ ID NO: 27553 - DNA, 18 bp, Artificial Sequence
  Synthetic DNA
taatacgcctttctatcg

SEQ ID NO: 27554 - DNA, 18 bp, Artificial Sequence
  Synthetic DNA
taatacgtagtactatag

SEQ ID NO: 27555 - DNA, 18 bp, Artificial Sequence
  Synthetic DNA
taatacgtatcacttcag

SEQ ID NO: 27556 - DNA, 18 bp, Artificial Sequence
  Synthetic DNA
taatacgtattacaatag

SEQ ID NO: 27557 - DNA, 18 bp, Artificial Sequence
  Synthetic DNA
taatacgtcaaaatatag

SEQ ID NO: 27558 - DNA, 18 bp, Artificial Sequence
  Synthetic DNA
taatacgtcatactacag

SEQ ID NO: 27559 - DNA, 18 bp, Artificial Sequence
  Synthetic DNA
taatacgtcctactaaag

SEQ ID NO: 27560 - DNA, 18 bp, Artificial Sequence
  Synthetic DNA
taatacgtctatgtatag

SEQ ID NO: 27561 - DNA, 18 bp, Artificial Sequence
  Synthetic DNA
taatacgtctcaataacg

SEQ ID NO: 27562 - DNA, 18 bp, Artificial Sequence
  Synthetic DNA
taatacgtctcacatgag

SEQ ID NO: 27563 - DNA, 18 bp, Artificial Sequence
  Synthetic DNA
taatacgtctgtatatag

SEQ ID NO: 27564 - DNA, 18 bp, Artificial Sequence
  Synthetic DNA
taatacgtggcactatgg

SEQ ID NO: 27565 - DNA, 18 bp, Artificial Sequence
  Synthetic DNA
taatactaatcataatag

SEQ ID NO: 27566 - DNA, 18 bp, Artificial Sequence
  Synthetic DNA
taatactacacacgaaag

SEQ ID NO: 27567 - DNA, 18 bp, Artificial Sequence
  Synthetic DNA
taatactacacataatag

SEQ ID NO: 27568 - DNA, 18 bp, Artificial Sequence
  Synthetic DNA
taatactacactctacag

SEQ ID NO: 27569 - DNA, 18 bp, Artificial Sequence
  Synthetic DNA
taatactacctacaatag

SEQ ID NO: 27570 - DNA, 18 bp, Artificial Sequence
  Synthetic DNA
taatactactatctatgg

SEQ ID NO: 27571 - DNA, 18 bp, Artificial Sequence
  Synthetic DNA
taatactactcactcacg

SEQ ID NO: 27572 - DNA, 18 bp, Artificial Sequence
  Synthetic DNA
taatactactcaggaaag

SEQ ID NO: 27573 - DNA, 18 bp, Artificial Sequence
  Synthetic DNA
taatactactctatctag

SEQ ID NO: 27574 - DNA, 18 bp, Artificial Sequence
  Synthetic DNA
taatactacttacaacag

SEQ ID NO: 27575 - DNA, 18 bp, Artificial Sequence
  Synthetic DNA
taatactacttactacgg

SEQ ID NO: 27576 - DNA, 18 bp, Artificial Sequence
  Synthetic DNA
taatactaggcaatatag

SEQ ID NO: 27577 - DNA, 18 bp, Artificial Sequence
  Synthetic DNA
taatactattcaatatcg

SEQ ID NO: 27578 - DNA, 18 bp, Artificial Sequence
  Synthetic DNA
taatactcctctatatag

SEQ ID NO: 27579 - DNA, 18 bp, Artificial Sequence
  Synthetic DNA
taatacttgtaactatag

SEQ ID NO: 27580 - DNA, 18 bp, Artificial Sequence
  Synthetic DNA
taatagaactctcaatag

SEQ ID NO: 27581 - DNA, 18 bp, Artificial Sequence
  Synthetic DNA
taatagatcacactatag

SEQ ID NO: 27582 - DNA, 18 bp, Artificial Sequence
  Synthetic DNA
taatagatctcaccatag

SEQ ID NO: 27583 - DNA, 18 bp, Artificial Sequence
  Synthetic DNA
taataggactaaccttag

SEQ ID NO: 27584 - DNA, 18 bp, Artificial Sequence
  Synthetic DNA
taatagtacccacaatag

SEQ ID NO: 27585 - DNA, 18 bp, Artificial Sequence
  Synthetic DNA
taatagtactccctaaag

SEQ ID NO: 27586 - DNA, 18 bp, Artificial Sequence
  Synthetic DNA
taatataacacactatgg

SEQ ID NO: 27587 - DNA, 18 bp, Artificial Sequence
  Synthetic DNA
taatataattcattatag

SEQ ID NO: 27588 - DNA, 18 bp, Artificial Sequence
  Synthetic DNA
taatatctctcactttag

SEQ ID NO: 27589 - DNA, 18 bp, Artificial Sequence
  Synthetic DNA
taatatgacacaaaatag

SEQ ID NO: 27590 - DNA, 18 bp, Artificial Sequence
  Synthetic DNA
taatatgacacacgaaag

SEQ ID NO: 27591 - DNA, 18 bp, Artificial Sequence
  Synthetic DNA
taatatgacacataatag

SEQ ID NO: 27592 - DNA, 18 bp, Artificial Sequence
  Synthetic DNA
taatatgacagactctag

SEQ ID NO: 27593 - DNA, 18 bp, Artificial Sequence
  Synthetic DNA
taatatgaccctctctag

SEQ ID NO: 27594 - DNA, 18 bp, Artificial Sequence
  Synthetic DNA
taatatgacgaactttag

SEQ ID NO: 27595 - DNA, 18 bp, Artificial Sequence
  Synthetic DNA
taatatgactacctaaag

SEQ ID NO: 27596 - DNA, 18 bp, Artificial Sequence
  Synthetic DNA
taatatgactcagaaaag

SEQ ID NO: 27597 - DNA, 18 bp, Artificial Sequence
  Synthetic DNA
taatatgatacacaatag

SEQ ID NO: 27598 - DNA, 18 bp, Artificial Sequence
  Synthetic DNA
taatatgatgcactctag

SEQ ID NO: 27599 - DNA, 18 bp, Artificial Sequence
  Synthetic DNA
taatatgattcaccctag

SEQ ID NO: 27600 - DNA, 18 bp, Artificial Sequence
  Synthetic DNA
taatatgcctgactttag

SEQ ID NO: 27601 - DNA, 18 bp, Artificial Sequence
  Synthetic DNA
taatatggcacacaatag

SEQ ID NO: 27602 - DNA, 18 bp, Artificial Sequence
  Synthetic DNA
taatatggtccactatag

SEQ ID NO: 27603 - DNA, 18 bp, Artificial Sequence
  Synthetic DNA
taatattacacactacag

SEQ ID NO: 27604 - DNA, 18 bp, Artificial Sequence
  Synthetic DNA
taatattactcaaaatag

SEQ ID NO: 27605 - DNA, 18 bp, Artificial Sequence
  Synthetic DNA
taatattactctctacag

SEQ ID NO: 27606 - DNA, 18 bp, Artificial Sequence
  Synthetic DNA
taatattattcactaaag

SEQ ID NO: 27607 - DNA, 18 bp, Artificial Sequence
  Synthetic DNA
taatcccactcaatttag

SEQ ID NO: 27608 - DNA, 18 bp, Artificial Sequence
  Synthetic DNA
taatccgaatcattttag

SEQ ID NO: 27609 - DNA, 18 bp, Artificial Sequence
  Synthetic DNA
taatccgactcacctcag

SEQ ID NO: 27610 - DNA, 18 bp, Artificial Sequence
  Synthetic DNA
taatccgactctatatcg

SEQ ID NO: 27611 - DNA, 18 bp, Artificial Sequence
  Synthetic DNA
taatccgcctcacaaaag

SEQ ID NO: 27612 - DNA, 18 bp, Artificial Sequence
  Synthetic DNA
taatccggctcattctag

SEQ ID NO: 27613 - DNA, 18 bp, Artificial Sequence
  Synthetic DNA
taatccgtcttacaatag

SEQ ID NO: 27614 - DNA, 18 bp, Artificial Sequence
  Synthetic DNA
taatccgtttccctatag

SEQ ID NO: 27615 - DNA, 18 bp, Artificial Sequence
  Synthetic DNA
taatcctacccactctag

SEQ ID NO: 27616 - DNA, 18 bp, Artificial Sequence
  Synthetic DNA
taatctaacttactatag

SEQ ID NO: 27617 - DNA, 18 bp, Artificial Sequence
  Synthetic DNA
taatctgactctctttag

SEQ ID NO: 27618 - DNA, 18 bp, Artificial Sequence
  Synthetic DNA
taatgcaactaaccatag

SEQ ID NO: 27619 - DNA, 18 bp, Artificial Sequence
  Synthetic DNA
taatgccactcactgaag

SEQ ID NO: 27620 - DNA, 18 bp, Artificial Sequence
  Synthetic DNA
taatgcgactaataatag

SEQ ID NO: 27621 - DNA, 18 bp, Artificial Sequence
  Synthetic DNA
taatgcgattatctatag

SEQ ID NO: 27622 - DNA, 18 bp, Artificial Sequence
  Synthetic DNA
taatgcgatttacaatag

SEQ ID NO: 27623 - DNA, 18 bp, Artificial Sequence
  Synthetic DNA
taatgcgtccctctatag

SEQ ID NO: 27624 - DNA, 18 bp, Artificial Sequence
  Synthetic DNA
taatgcgtctaactatgg

SEQ ID NO: 27625 - DNA, 18 bp, Artificial Sequence
  Synthetic DNA
taatgcgtctcatcatag

SEQ ID NO: 27626 - DNA, 18 bp, Artificial Sequence
  Synthetic DNA
taatgctactccctaaag

SEQ ID NO: 27627 - DNA, 18 bp, Artificial Sequence
  Synthetic DNA
taatgcttctcattatag

SEQ ID NO: 27628 - DNA, 18 bp, Artificial Sequence
  Synthetic DNA
taatgtgacacacaatag

SEQ ID NO: 27629 - DNA, 18 bp, Artificial Sequence
  Synthetic DNA
taatgtgattcactttag

SEQ ID NO: 27630 - DNA, 18 bp, Artificial Sequence
  Synthetic DNA
tacaacgacgcattatag

SEQ ID NO: 27631 - DNA, 18 bp, Artificial Sequence
  Synthetic DNA
tacaacgactcaatacag

SEQ ID NO: 27632 - DNA, 18 bp, Artificial Sequence
  Synthetic DNA
tacaacgactcactcaag

SEQ ID NO: 27633 - DNA, 18 bp, Artificial Sequence
  Synthetic DNA
tactacaaatcactgtag

SEQ ID NO: 27634 - DNA, 18 bp, Artificial Sequence
  Synthetic DNA
tactacaacttactatcg

SEQ ID NO: 27635 - DNA, 18 bp, Artificial Sequence
  Synthetic DNA
tactacacctcactaaag

SEQ ID NO: 27636 - DNA, 18 bp, Artificial Sequence
  Synthetic DNA
tactacgacttacaacag

SEQ ID NO: 27637 - DNA, 18 bp, Artificial Sequence
  Synthetic DNA
tactacggatcactttag

SEQ ID NO: 27638 - DNA, 18 bp, Artificial Sequence
  Synthetic DNA
tactacgtatcactacag

SEQ ID NO: 27639 - DNA, 18 bp, Artificial Sequence
  Synthetic DNA
tactactactaactaaag

SEQ ID NO: 27640 - DNA, 18 bp, Artificial Sequence
  Synthetic DNA
tactaggccttactatag

SEQ ID NO: 27641 - DNA, 18 bp, Artificial Sequence
  Synthetic DNA
tagaacgactctccatag

SEQ ID NO: 27642 - DNA, 18 bp, Artificial Sequence
  Synthetic DNA
tagcacgacttactatcg

SEQ ID NO: 27643 - DNA, 18 bp, Artificial Sequence
  Synthetic DNA
tagtaaaactcaccatag

SEQ ID NO: 27644 - DNA, 18 bp, Artificial Sequence
  Synthetic DNA
tagtacaacttactatgg

SEQ ID NO: 27645 - DNA, 18 bp, Artificial Sequence
  Synthetic DNA
tagtacgactctcaatgg

SEQ ID NO: 27646 - DNA, 18 bp, Artificial Sequence
  Synthetic DNA
tagtacgactctgtttag

SEQ ID NO: 27647 - DNA, 18 bp, Artificial Sequence
  Synthetic DNA
tagtacgacttacaaaag

SEQ ID NO: 27648 - DNA, 18 bp, Artificial Sequence
  Synthetic DNA
tagtacgactttctacag

SEQ ID NO: 27649 - DNA, 18 bp, Artificial Sequence
  Synthetic DNA
tagtacgtcccactgtag

SEQ ID NO: 27650 - DNA, 18 bp, Artificial Sequence
  Synthetic DNA
tagtatgacacactaaag

SEQ ID NO: 27651 - DNA, 18 bp, Artificial Sequence
  Synthetic DNA
tagtgcgactcacttaag

SEQ ID NO: 27652 - DNA, 18 bp, Artificial Sequence
  Synthetic DNA
tataacgactcaccgtag

SEQ ID NO: 27653 - DNA, 18 bp, Artificial Sequence
  Synthetic DNA
tataacgactcactccag

SEQ ID NO: 27654 - DNA, 18 bp, Artificial Sequence
  Synthetic DNA
tataacgacttcctatag

SEQ ID NO: 27655 - DNA, 18 bp, Artificial Sequence
  Synthetic DNA
tatagcgagtcactatag

SEQ ID NO: 27656 - DNA, 18 bp, Artificial Sequence
  Synthetic DNA
tattaacactctctatag

SEQ ID NO: 27657 - DNA, 18 bp, Artificial Sequence
  Synthetic DNA
tattaagactcaatacag

SEQ ID NO: 27658 - DNA, 18 bp, Artificial Sequence
  Synthetic DNA
tattaagactcacattag

SEQ ID NO: 27659 - DNA, 18 bp, Artificial Sequence
  Synthetic DNA
tattaagcatcactatag

SEQ ID NO: 27660 - DNA, 18 bp, Artificial Sequence
  Synthetic DNA
tattacaactctctgtag

SEQ ID NO: 27661 - DNA, 18 bp, Artificial Sequence
  Synthetic DNA
tattacaattcaatatag

SEQ ID NO: 27662 - DNA, 18 bp, Artificial Sequence
  Synthetic DNA
tattaccaatccctatag

SEQ ID NO: 27663 - DNA, 18 bp, Artificial Sequence
  Synthetic DNA
tattacgaattactttag

SEQ ID NO: 27664 - DNA, 18 bp, Artificial Sequence
  Synthetic DNA
tattacgacacacaacag

SEQ ID NO: 27665 - DNA, 18 bp, Artificial Sequence
  Synthetic DNA
tattacgactctctttcg

SEQ ID NO: 27666 - DNA, 18 bp, Artificial Sequence
  Synthetic DNA
tattacgactctctttgg

SEQ ID NO: 27667 - DNA, 18 bp, Artificial Sequence
  Synthetic DNA
tattacgcctcaataaag

SEQ ID NO: 27668 - DNA, 18 bp, Artificial Sequence
  Synthetic DNA
tattacggttcactaaag

SEQ ID NO: 27669 - DNA, 18 bp, Artificial Sequence
  Synthetic DNA
tattacgtctaattatag

SEQ ID NO: 27670 - DNA, 18 bp, Artificial Sequence
  Synthetic DNA
tattacgtctcattatcg

SEQ ID NO: 27671 - DNA, 18 bp, Artificial Sequence
  Synthetic DNA
tattacgtcttactctag

SEQ ID NO: 27672 - DNA, 18 bp, Artificial Sequence
  Synthetic DNA
tattactacacagtatag

SEQ ID NO: 27673 - DNA, 18 bp, Artificial Sequence
  Synthetic DNA
tattactactcaatatcg

SEQ ID NO: 27674 - DNA, 18 bp, Artificial Sequence
  Synthetic DNA
tattactactcacttcag

SEQ ID NO: 27675 - DNA, 18 bp, Artificial Sequence
  Synthetic DNA
tattactactcagtacag

SEQ ID NO: 27676 - DNA, 18 bp, Artificial Sequence
  Synthetic DNA
tattactacttattatag

SEQ ID NO: 27677 - DNA, 18 bp, Artificial Sequence
  Synthetic DNA
tattactattcactctag

SEQ ID NO: 27678 - DNA, 18 bp, Artificial Sequence
  Synthetic DNA
tattactattcattatag

SEQ ID NO: 27679 - DNA, 18 bp, Artificial Sequence
  Synthetic DNA
tattactcctcactctag

SEQ ID NO: 27680 - DNA, 18 bp, Artificial Sequence
  Synthetic DNA
tattactgcacactatag

SEQ ID NO: 27681 - DNA, 18 bp, Artificial Sequence
  Synthetic DNA
tattaggacacattatag

SEQ ID NO: 27682 - DNA, 18 bp, Artificial Sequence
  Synthetic DNA
tattagtactcacaatag

SEQ ID NO: 27683 - DNA, 18 bp, Artificial Sequence
  Synthetic DNA
tattatgactcattttag

SEQ ID NO: 27684 - DNA, 18 bp, Artificial Sequence
  Synthetic DNA
tattatgattcacaatag

SEQ ID NO: 27685 - DNA, 18 bp, Artificial Sequence
  Synthetic DNA
tattatgtctcattatag

SEQ ID NO: 27686 - DNA, 18 bp, Artificial Sequence
  Synthetic DNA
tattatgtcttactatag

SEQ ID NO: 27687 - DNA, 18 bp, Artificial Sequence
  Synthetic DNA
tattccgattcacaatag

SEQ ID NO: 27688 - DNA, 18 bp, Artificial Sequence
  Synthetic DNA
tattgagactcacaatag

SEQ ID NO: 27689 - DNA, 18 bp, Artificial Sequence
  Synthetic DNA
tattgcgactatctatag

SEQ ID NO: 27690 - DNA, 18 bp, Artificial Sequence
  Synthetic DNA
tcaaacgactctctaaag

SEQ ID NO: 27691 - DNA, 18 bp, Artificial Sequence
  Synthetic DNA
tcatacgacacaccacag

SEQ ID NO: 27692 - DNA, 18 bp, Artificial Sequence
  Synthetic DNA
tcatacgacactatatag

SEQ ID NO: 27693 - DNA, 18 bp, Artificial Sequence
  Synthetic DNA
tcatacgacatagtatag

SEQ ID NO: 27694 - DNA, 18 bp, Artificial Sequence
  Synthetic DNA
tcatacgactcattaagg

SEQ ID NO: 27695 - DNA, 18 bp, Artificial Sequence
  Synthetic DNA
tcatacgacttacaatgg

SEQ ID NO: 27696 - DNA, 18 bp, Artificial Sequence
  Synthetic DNA
tcatacgagtcacttaag

SEQ ID NO: 27697 - DNA, 18 bp, Artificial Sequence
  Synthetic DNA
tcatacgattcaacatag

SEQ ID NO: 27698 - DNA, 18 bp, Artificial Sequence
  Synthetic DNA
tcatacgtgtctctatag

SEQ ID NO: 27699 - DNA, 18 bp, Artificial Sequence
  Synthetic DNA
tcatactaatcactctag

SEQ ID NO: 27700 - DNA, 18 bp, Artificial Sequence
  Synthetic DNA
tcatactacacactaaag

SEQ ID NO: 27701 - DNA, 18 bp, Artificial Sequence
  Synthetic DNA
tcatactacacactttag

SEQ ID NO: 27702 - DNA, 18 bp, Artificial Sequence
  Synthetic DNA
tcatactactaactttag

SEQ ID NO: 27703 - DNA, 18 bp, Artificial Sequence
  Synthetic DNA
tcatactactctctacag

SEQ ID NO: 27704 - DNA, 18 bp, Artificial Sequence
  Synthetic DNA
tcataggcctcactctag

SEQ ID NO: 27705 - DNA, 18 bp, Artificial Sequence
  Synthetic DNA
tcatatgacactctatag

SEQ ID NO: 27706 - DNA, 18 bp, Artificial Sequence
  Synthetic DNA
tcatgcgaatcactaaag

SEQ ID NO: 27707 - DNA, 18 bp, Artificial Sequence
  Synthetic DNA
tcctacgacttactaaag

SEQ ID NO: 27708 - DNA, 18 bp, Artificial Sequence
  Synthetic DNA
tcgtacgtcacactatag

SEQ ID NO: 27709 - DNA, 18 bp, Artificial Sequence
  Synthetic DNA
tcttacgacaaactatag

SEQ ID NO: 27710 - DNA, 18 bp, Artificial Sequence
  Synthetic DNA
tcttacgactcaatttag

SEQ ID NO: 27711 - DNA, 18 bp, Artificial Sequence
  Synthetic DNA
tcttacgactccctaaag

SEQ ID NO: 27712 - DNA, 18 bp, Artificial Sequence
  Synthetic DNA
tcttccgactcactttag

SEQ ID NO: 27713 - DNA, 18 bp, Artificial Sequence
  Synthetic DNA
tgaaacgattctctatag

SEQ ID NO: 27714 - DNA, 18 bp, Artificial Sequence
  Synthetic DNA
tgatacgacactctatcg

SEQ ID NO: 27715 - DNA, 18 bp, Artificial Sequence
  Synthetic DNA
tgatacgactctctaacg

SEQ ID NO: 27716 - DNA, 18 bp, Artificial Sequence
  Synthetic DNA
tgatacgattcaccatgg

SEQ ID NO: 27717 - DNA, 18 bp, Artificial Sequence
  Synthetic DNA
tgatacgtcttactaaag

SEQ ID NO: 27718 - DNA, 18 bp, Artificial Sequence
  Synthetic DNA
tgatactgctcactttag

SEQ ID NO: 27719 - DNA, 18 bp, Artificial Sequence
  Synthetic DNA
tgatatgactgattatag

SEQ ID NO: 27720 - DNA, 18 bp, Artificial Sequence
  Synthetic DNA
tgatgcgactctatatag

SEQ ID NO: 27721 - DNA, 18 bp, Artificial Sequence
  Synthetic DNA
tgctacgactgactttag

SEQ ID NO: 27722 - DNA, 18 bp, Artificial Sequence
  Synthetic DNA
tggtacgactctgtatag

SEQ ID NO: 27723 - DNA, 18 bp, Artificial Sequence
  Synthetic DNA
tgttacgtcccactatag

SEQ ID NO: 27724 - DNA, 18 bp, Artificial Sequence
  Synthetic DNA
ttaaacgtctcactacag

SEQ ID NO: 27725 - DNA, 18 bp, Artificial Sequence
  Synthetic DNA
ttacaccactcaatatag

SEQ ID NO: 27726 - DNA, 18 bp, Artificial Sequence
  Synthetic DNA
ttacacgactcactttcg

SEQ ID NO: 27727 - DNA, 18 bp, Artificial Sequence
  Synthetic DNA
ttacatgactcactaaag

SEQ ID NO: 27728 - DNA, 18 bp, Artificial Sequence
  Synthetic DNA
ttataagactccccatag

SEQ ID NO: 27729 - DNA, 18 bp, Artificial Sequence
  Synthetic DNA
ttatacaactcaatacag

SEQ ID NO: 27730 - DNA, 18 bp, Artificial Sequence
  Synthetic DNA
ttatacaactcactctcg

SEQ ID NO: 27731 - DNA, 18 bp, Artificial Sequence
  Synthetic DNA
ttatacaactcactttgg

SEQ ID NO: 27732 - DNA, 18 bp, Artificial Sequence
  Synthetic DNA
ttatacaactcattacag

SEQ ID NO: 27733 - DNA, 18 bp, Artificial Sequence
  Synthetic DNA
ttatacgaataacaatag

SEQ ID NO: 27734 - DNA, 18 bp, Artificial Sequence
  Synthetic DNA
ttatacgacacaccttag

SEQ ID NO: 27735 - DNA, 18 bp, Artificial Sequence
  Synthetic DNA
ttatacgaccctctctag

SEQ ID NO: 27736 - DNA, 18 bp, Artificial Sequence
  Synthetic DNA
ttatacgactcagttgag

SEQ ID NO: 27737 - DNA, 18 bp, Artificial Sequence
  Synthetic DNA
ttatacgactcattttcg

SEQ ID NO: 27738 - DNA, 18 bp, Artificial Sequence
  Synthetic DNA
ttatacgacttaccttag

SEQ ID NO: 27739 - DNA, 18 bp, Artificial Sequence
  Synthetic DNA
ttatacgacttactaagg

SEQ ID NO: 27740 - DNA, 18 bp, Artificial Sequence
  Synthetic DNA
ttatacgacttattaaag

SEQ ID NO: 27741 - DNA, 18 bp, Artificial Sequence
  Synthetic DNA
ttatacgatttaatatag

SEQ ID NO: 27742 - DNA, 18 bp, Artificial Sequence
  Synthetic DNA
ttatacgcctcattgtag

SEQ ID NO: 27743 - DNA, 18 bp, Artificial Sequence
  Synthetic DNA
ttatacggctcactcgag

SEQ ID NO: 27744 - DNA, 18 bp, Artificial Sequence
  Synthetic DNA
ttatacgtctcacttcag

SEQ ID NO: 27745 - DNA, 18 bp, Artificial Sequence
  Synthetic DNA
ttatactacgctctatag

SEQ ID NO: 27746 - DNA, 18 bp, Artificial Sequence
  Synthetic DNA
ttatactactccccatag

SEQ ID NO: 27747 - DNA, 18 bp, Artificial Sequence
  Synthetic DNA
ttatactacttagtatag

SEQ ID NO: 27748 - DNA, 18 bp, Artificial Sequence
  Synthetic DNA
ttatatgaatcactatcg

SEQ ID NO: 27749 - DNA, 18 bp, Artificial Sequence
  Synthetic DNA
ttatattactcattatag

SEQ ID NO: 27750 - DNA, 18 bp, Artificial Sequence
  Synthetic DNA
ttatcagactcactttag

SEQ ID NO: 27751 - DNA, 18 bp, Artificial Sequence
  Synthetic DNA
ttatccgacgccctatag

SEQ ID NO: 27752 - DNA, 18 bp, Artificial Sequence
  Synthetic DNA
ttatccgactcactctcg

SEQ ID NO: 27753 - DNA, 18 bp, Artificial Sequence
  Synthetic DNA
ttatccgactctttatag

SEQ ID NO: 27754 - DNA, 18 bp, Artificial Sequence
  Synthetic DNA
ttatccgtctcattatag

SEQ ID NO: 27755 - DNA, 18 bp, Artificial Sequence
  Synthetic DNA
ttatcggactcactttag

SEQ ID NO: 27756 - DNA, 18 bp, Artificial Sequence
  Synthetic DNA
ttatgctactctctatag

SEQ ID NO: 27757 - DNA, 18 bp, Artificial Sequence
  Synthetic DNA
ttctaaaactcactatag

SEQ ID NO: 27758 - DNA, 18 bp, Artificial Sequence
  Synthetic DNA
ttctatgacacactatag

SEQ ID NO: 27759 - DNA, 18 bp, Artificial Sequence
  Synthetic DNA
ttgtacgacacactagag

SEQ ID NO: 27760 - DNA, 18 bp, Artificial Sequence
  Synthetic DNA
ttgtacgactcacaagag

SEQ ID NO: 27761 - DNA, 18 bp, Artificial Sequence
  Synthetic DNA
tttgacgactcacaatag

SEQ ID NO: 27762 - DNA, 18 bp, Artificial Sequence
  Synthetic DNA
ttttaccacttactatag

SEQ ID NO: 27763 - DNA, 18 bp, Artificial Sequence
  Synthetic DNA
ttttacgaatcactttag

SEQ ID NO: 27764 - DNA, 18 bp, Artificial Sequence
  Synthetic DNA
ttttacgacacactacag

SEQ ID NO: 27765 - DNA, 18 bp, Artificial Sequence
  Synthetic DNA
ttttacgcctaactatag

SEQ ID NO: 27766 - DNA, 18 bp, Artificial Sequence
  Synthetic DNA
ttttactactctctatag

SEQ ID NO: 27767 - DNA, 18 bp, Artificial Sequence
  Synthetic DNA
ttattcgactctctattg

SEQ ID NO: 27768 - DNA, 18 bp, Artificial Sequence
  Synthetic DNA
tattacatctcacaatag

SEQ ID NO: 27769 - DNA, 18 bp, Artificial Sequence
  Synthetic DNA
taattcaactctctattg

SEQ ID NO: 27770 - DNA, 18 bp, Artificial Sequence
  Synthetic DNA
ttattcgactcacaacag

SEQ ID NO: 27771 - DNA, 18 bp, Artificial Sequence
  Synthetic DNA
ttatacgactctataaag

SEQ ID NO: 27772 - DNA, 18 bp, Artificial Sequence
  Synthetic DNA
ttatactactcacttcag

SEQ ID NO: 27773 - DNA, 18 bp, Artificial Sequence
  Synthetic DNA
tataacgactcacttaag

SEQ ID NO: 27774 - DNA, 18 bp, Artificial Sequence
  Synthetic DNA
taatacgactccttaatg

SEQ ID NO: 27775 - DNA, 18 bp, Artificial Sequence
  Synthetic DNA
taatactactctatattg

SEQ ID NO: 27776 - DNA, 18 bp, Artificial Sequence
  Synthetic DNA
taatatgacacacttttg

SEQ ID NO: 27777 - DNA, 18 bp, Artificial Sequence
  Synthetic DNA
taatatgtcacactattg

SEQ ID NO: 27778 - DNA, 18 bp, Artificial Sequence
  Synthetic DNA
tatttcaactcacaatag

SEQ ID NO: 27779 - DNA, 18 bp, Artificial Sequence
  Synthetic DNA
atatacgtctcacaatag

SEQ ID NO: 27780 - DNA, 18 bp, Artificial Sequence
  Synthetic DNA
caatacatctcactttag

SEQ ID NO: 27781 - DNA, 18 bp, Artificial Sequence
  Synthetic DNA
taaaaagtctcactaaag

SEQ ID NO: 27782 - DNA, 18 bp, Artificial Sequence
  Synthetic DNA
taatatttcacactatag

SEQ ID NO: 27783 - DNA, 18 bp, Artificial Sequence
  Synthetic DNA
tattacgtatcactttag

SEQ ID NO: 27784 - DNA, 18 bp, Artificial Sequence
  Synthetic DNA
ttatactattcactattg

SEQ ID NO: 27785 - DNA, 18 bp, Artificial Sequence
  Synthetic DNA
atattcgactctctatag

SEQ ID NO: 27786 - DNA, 18 bp, Artificial Sequence
  Synthetic DNA
caattcaactcactttag

SEQ ID NO: 27787 - DNA, 18 bp, Artificial Sequence
  Synthetic DNA
ctatacaactcactattg

SEQ ID NO: 27788 - DNA, 18 bp, Artificial Sequence
  Synthetic DNA
taaatcgactcaatgtag

SEQ ID NO: 27789 - DNA, 18 bp, Artificial Sequence
  Synthetic DNA
taaatcgactcattttag

SEQ ID NO: 27790 - DNA, 18 bp, Artificial Sequence
  Synthetic DNA
taatacgacatattattg

SEQ ID NO: 27791 - DNA, 18 bp, Artificial Sequence
  Synthetic DNA
taatatgactccctaatg

SEQ ID NO: 27792 - DNA, 18 bp, Artificial Sequence
  Synthetic DNA
taatatgtctcactactg

SEQ ID NO: 27793 - DNA, 18 bp, Artificial Sequence
  Synthetic DNA
taattcaattcattatag

SEQ ID NO: 27794 - DNA, 18 bp, Artificial Sequence
  Synthetic DNA
taattcgactctcaaaag

SEQ ID NO: 27795 - DNA, 18 bp, Artificial Sequence
  Synthetic DNA
tactacgacactctattg

SEQ ID NO: 27796 - DNA, 18 bp, Artificial Sequence
  Synthetic DNA
tattacgacactctattg

SEQ ID NO: 27797 - DNA, 18 bp, Artificial Sequence
  Synthetic DNA
tattatgacttgctatag

SEQ ID NO: 27798 - DNA, 18 bp, Artificial Sequence
  Synthetic DNA
ttacacgaatcactattg

SEQ ID NO: 27799 - DNA, 18 bp, Artificial Sequence
  Synthetic DNA
ttactcgactcactacag

SEQ ID NO: 27800 - DNA, 18 bp, Artificial Sequence
  Synthetic DNA
ttatacgatttactattg

SEQ ID NO: 27801 - DNA, 18 bp, Artificial Sequence
  Synthetic DNA
ttattcaactcactatcg

SEQ ID NO: 27802 - DNA, 18 bp, Artificial Sequence
  Synthetic DNA
aaatacgacactccatag

SEQ ID NO: 27803 - DNA, 18 bp, Artificial Sequence
  Synthetic DNA
aaatacgattatctatag

SEQ ID NO: 27804 - DNA, 18 bp, Artificial Sequence
  Synthetic DNA
aaatacgtctctccatag

SEQ ID NO: 27805 - DNA, 18 bp, Artificial Sequence
  Synthetic DNA
aaatactattctctatag

SEQ ID NO: 27806 - DNA, 18 bp, Artificial Sequence
  Synthetic DNA
aaatatgtcttactatag

SEQ ID NO: 27807 - DNA, 18 bp, Artificial Sequence
  Synthetic DNA
taaaacaaaacactatag

SEQ ID NO: 27808 - DNA, 18 bp, Artificial Sequence
  Synthetic DNA
taaaactacttcctatag

SEQ ID NO: 27809 - DNA, 18 bp, Artificial Sequence
  Synthetic DNA
taaaatgacacactttag

SEQ ID NO: 27810 - DNA, 18 bp, Artificial Sequence
  Synthetic DNA
taaagcgtctctctatag

SEQ ID NO: 27811 - DNA, 18 bp, Artificial Sequence
  Synthetic DNA
taataaaacttacaatag

SEQ ID NO: 27812 - DNA, 18 bp, Artificial Sequence
  Synthetic DNA
taataatactctatatag

SEQ ID NO: 27813 - DNA, 18 bp, Artificial Sequence
  Synthetic DNA
taatacaactgtctaaag

SEQ ID NO: 27814 - DNA, 18 bp, Artificial Sequence
  Synthetic DNA
taatacacctctctaaag

SEQ ID NO: 27815 - DNA, 18 bp, Artificial Sequence
  Synthetic DNA
taatacgattctcttaag

SEQ ID NO: 27816 - DNA, 18 bp, Artificial Sequence
  Synthetic DNA
taatacggttcacattag

SEQ ID NO: 27817 - DNA, 18 bp, Artificial Sequence
  Synthetic DNA
taatacgtctctctcaag

SEQ ID NO: 27818 - DNA, 18 bp, Artificial Sequence
  Synthetic DNA
tactactacttactacag

SEQ ID NO: 27819 - DNA, 18 bp, Artificial Sequence
  Synthetic DNA
tagtatgtctcattatag

SEQ ID NO: 27820 - DNA, 18 bp, Artificial Sequence
  Synthetic DNA
tatcacgtctcacaatag

SEQ ID NO: 27821 - DNA, 18 bp, Artificial Sequence
  Synthetic DNA
tattacacctcactaaag

SEQ ID NO: 27822 - DNA, 18 bp, Artificial Sequence
  Synthetic DNA
tattacgactcaataagg

SEQ ID NO: 27823 - DNA, 18 bp, Artificial Sequence
  Synthetic DNA
tattacgatttactaaag

SEQ ID NO: 27824 - DNA, 18 bp, Artificial Sequence
  Synthetic DNA
tattactacactctatag

SEQ ID NO: 27825 - DNA, 18 bp, Artificial Sequence
  Synthetic DNA
tattaggactctcaatag

SEQ ID NO: 27826 - DNA, 18 bp, Artificial Sequence
  Synthetic DNA
tattatgtctgactatag

SEQ ID NO: 27827 - DNA, 18 bp, Artificial Sequence
  Synthetic DNA
tcatccgaatcacaatag

SEQ ID NO: 27828 - DNA, 18 bp, Artificial Sequence
  Synthetic DNA
tcttaccactaactatag

SEQ ID NO: 27829 - DNA, 18 bp, Artificial Sequence
  Synthetic DNA
tgatatggctcacaatag

SEQ ID NO: 27830 - DNA, 18 bp, Artificial Sequence
  Synthetic DNA
ttaaacgactaactctag

SEQ ID NO: 27831 - DNA, 18 bp, Artificial Sequence
  Synthetic DNA
ttatacgacaaattatag

SEQ ID NO: 27832 - DNA, 18 bp, Artificial Sequence
  Synthetic DNA
ttatacgacacagtatcg

SEQ ID NO: 27833 - DNA, 18 bp, Artificial Sequence
  Synthetic DNA
ttatacgcctcacaaaag

SEQ ID NO: 27834 - DNA, 18 bp, Artificial Sequence
  Synthetic DNA
ttatacgtatcactgtag

SEQ ID NO: 27835 - DNA, 18 bp, Artificial Sequence
  Synthetic DNA
ttatacgtatcattatag

SEQ ID NO: 27836 - DNA, 18 bp, Artificial Sequence
  Synthetic DNA
ttatacgtctcaccatcg

SEQ ID NO: 27837 - DNA, 18 bp, Artificial Sequence
  Synthetic DNA
ttttaccactcacaatag

SEQ ID NO: 27838 - DNA, 18 bp, Artificial Sequence
  Synthetic DNA
ttttacgactctctttag

SEQ ID NO: 27839 - DNA, 18 bp, Artificial Sequence
  Synthetic DNA
ttttacgtctccctatag

SEQ ID NO: 27840 - DNA, 18 bp, Artificial Sequence
  Synthetic DNA
ttattcaactcactattg

SEQ ID NO: 27841 - DNA, 18 bp, Artificial Sequence
  Synthetic DNA
taatacgtcacgctattg

SEQ ID NO: 27842 - DNA, 18 bp, Artificial Sequence
  Synthetic DNA
taattcgactctctaatg

SEQ ID NO: 27843 - DNA, 18 bp, Artificial Sequence
  Synthetic DNA
aaatacgactcaatactg

SEQ ID NO: 27844 - DNA, 18 bp, Artificial Sequence
  Synthetic DNA
taatacgattctttattg

SEQ ID NO: 27845 - DNA, 18 bp, Artificial Sequence
  Synthetic DNA
atttacgacacactatag

SEQ ID NO: 27846 - DNA, 18 bp, Artificial Sequence
  Synthetic DNA
taatacaatacacaatag

SEQ ID NO: 27847 - DNA, 18 bp, Artificial Sequence
  Synthetic DNA
taatacgactcaaataag

SEQ ID NO: 27848 - DNA, 18 bp, Artificial Sequence
  Synthetic DNA
taatacttctaactttag

SEQ ID NO: 27849 - DNA, 18 bp, Artificial Sequence
  Synthetic DNA
ttcaacgactcactttag

SEQ ID NO: 27850 - DNA, 18 bp, Artificial Sequence
  Synthetic DNA
taatactacactccatag

SEQ ID NO: 27851 - DNA, 18 bp, Artificial Sequence
  Synthetic DNA
ttttacgactcacaaaag

SEQ ID NO: 27852 - DNA, 18 bp, Artificial Sequence
  Synthetic DNA
taaattgacacactatag

SEQ ID NO: 27853 - DNA, 18 bp, Artificial Sequence
  Synthetic DNA
taattagtttcactatag

SEQ ID NO: 27854 - DNA, 18 bp, Artificial Sequence
  Synthetic DNA
taattcgacatactttag

SEQ ID NO: 27855 - DNA, 18 bp, Artificial Sequence
  Synthetic DNA
tataacgactcacaattg

SEQ ID NO: 27856 - DNA, 18 bp, Artificial Sequence
  Synthetic DNA
ttatacgactcaattttg

SEQ ID NO: 27857 - DNA, 18 bp, Artificial Sequence
  Synthetic DNA
aaaaacgaatcactttag

SEQ ID NO: 27858 - DNA, 18 bp, Artificial Sequence
  Synthetic DNA
taaaacatctcactttag

SEQ ID NO: 27859 - DNA, 18 bp, Artificial Sequence
  Synthetic DNA
taatgcgactctcaaaag

SEQ ID NO: 27860 - DNA, 18 bp, Artificial Sequence
  Synthetic DNA
tattacgtcacactttag

SEQ ID NO: 27861 - DNA, 18 bp, Artificial Sequence
  Synthetic DNA
ttatacgacacattttag

SEQ ID NO: 27862 - DNA, 18 bp, Artificial Sequence
  Synthetic DNA
aaattcgactcgatatag

SEQ ID NO: 27863 - DNA, 18 bp, Artificial Sequence
  Synthetic DNA
agattcgactcactattg

SEQ ID NO: 27864 - DNA, 18 bp, Artificial Sequence
  Synthetic DNA
taactcgactcacttttg

SEQ ID NO: 27865 - DNA, 18 bp, Artificial Sequence
  Synthetic DNA
taatacgactcggcattg

SEQ ID NO: 27866 - DNA, 18 bp, Artificial Sequence
  Synthetic DNA
taatatgactcgatattg

SEQ ID NO: 27867 - DNA, 18 bp, Artificial Sequence
  Synthetic DNA
taattagactcaccattg

SEQ ID NO: 27868 - DNA, 18 bp, Artificial Sequence
  Synthetic DNA
taattcgacacgatatag

SEQ ID NO: 27869 - DNA, 18 bp, Artificial Sequence
  Synthetic DNA
taatttgactcactgttg

SEQ ID NO: 27870 - DNA, 18 bp, Artificial Sequence
  Synthetic DNA
aaaaacgagtcgctatag

SEQ ID NO: 27871 - DNA, 18 bp, Artificial Sequence
  Synthetic DNA
aaaatcgacttactatag

SEQ ID NO: 27872 - DNA, 18 bp, Artificial Sequence
  Synthetic DNA
aaacacgactcactaatg

SEQ ID NO: 27873 - DNA, 18 bp, Artificial Sequence
  Synthetic DNA
aaatacgagtcattattg

SEQ ID NO: 27874 - DNA, 18 bp, Artificial Sequence
  Synthetic DNA
aaatactactaactattg

SEQ ID NO: 27875 - DNA, 18 bp, Artificial Sequence
  Synthetic DNA
aaattcaactcaatatag

SEQ ID NO: 27876 - DNA, 18 bp, Artificial Sequence
  Synthetic DNA
aaattcgaattactatag

SEQ ID NO: 27877 - DNA, 18 bp, Artificial Sequence
  Synthetic DNA
aaattcgactcacgttag

SEQ ID NO: 27878 - DNA, 18 bp, Artificial Sequence
  Synthetic DNA
aaattcggctcactaaag

SEQ ID NO: 27879 - DNA, 18 bp, Artificial Sequence
  Synthetic DNA
aaatttaactcactatag

SEQ ID NO: 27880 - DNA, 18 bp, Artificial Sequence
  Synthetic DNA
aacttcgactcactttag

SEQ ID NO: 27881 - DNA, 18 bp, Artificial Sequence
  Synthetic DNA
aatttccactcactatag

SEQ ID NO: 27882 - DNA, 18 bp, Artificial Sequence
  Synthetic DNA
aatttcgactcactctag

SEQ ID NO: 27883 - DNA, 18 bp, Artificial Sequence
  Synthetic DNA
agattcgcctcactatag

SEQ ID NO: 27884 - DNA, 18 bp, Artificial Sequence
  Synthetic DNA
caaaacgactcaccattg

SEQ ID NO: 27885 - DNA, 18 bp, Artificial Sequence
  Synthetic DNA
caataagattcactattg

SEQ ID NO: 27886 - DNA, 18 bp, Artificial Sequence
  Synthetic DNA
caatacgactcacttatg

SEQ ID NO: 27887 - DNA, 18 bp, Artificial Sequence
  Synthetic DNA
caattcaacttactatag

SEQ ID NO: 27888 - DNA, 18 bp, Artificial Sequence
  Synthetic DNA
caattcctctcactatag

SEQ ID NO: 27889 - DNA, 18 bp, Artificial Sequence
  Synthetic DNA
caattcgacacactatcg

SEQ ID NO: 27890 - DNA, 18 bp, Artificial Sequence
  Synthetic DNA
caattcgactcacaaaag

SEQ ID NO: 27891 - DNA, 18 bp, Artificial Sequence
  Synthetic DNA
caattcgacttacaatag

SEQ ID NO: 27892 - DNA, 18 bp, Artificial Sequence
  Synthetic DNA
ccatacgtctcactattg

SEQ ID NO: 27893 - DNA, 18 bp, Artificial Sequence
  Synthetic DNA
gaatacgactcacaaatg

SEQ ID NO: 27894 - DNA, 18 bp, Artificial Sequence
  Synthetic DNA
taaaaagacccactattg

SEQ ID NO: 27895 - DNA, 18 bp, Artificial Sequence
  Synthetic DNA
taaaacgactcgaaatag

SEQ ID NO: 27896 - DNA, 18 bp, Artificial Sequence
  Synthetic DNA
taaaacgtcttactattg

SEQ ID NO: 27897 - DNA, 18 bp, Artificial Sequence
  Synthetic DNA
taaatcaactcaatatag

SEQ ID NO: 27898 - DNA, 18 bp, Artificial Sequence
  Synthetic DNA
taaatcgactatctatag

SEQ ID NO: 27899 - DNA, 18 bp, Artificial Sequence
  Synthetic DNA
taaatcgattcaccatag

SEQ ID NO: 27900 - DNA, 18 bp, Artificial Sequence
  Synthetic DNA
taaatctactcacaatag

SEQ ID NO: 27901 - DNA, 18 bp, Artificial Sequence
  Synthetic DNA
taacacaactcactactg

SEQ ID NO: 27902 - DNA, 18 bp, Artificial Sequence
  Synthetic DNA
taacaccgctcactattg

SEQ ID NO: 27903 - DNA, 18 bp, Artificial Sequence
  Synthetic DNA
taacacgattcattattg

SEQ ID NO: 27904 - DNA, 18 bp, Artificial Sequence
  Synthetic DNA
taactcgactcactaacg

SEQ ID NO: 27905 - DNA, 18 bp, Artificial Sequence
  Synthetic DNA
taactcgactcacttgag

SEQ ID NO: 27906 - DNA, 18 bp, Artificial Sequence
  Synthetic DNA
taagtagactaactatag

SEQ ID NO: 27907 - DNA, 18 bp, Artificial Sequence
  Synthetic DNA
taataagcctcactaatg

SEQ ID NO: 27908 - DNA, 18 bp, Artificial Sequence
  Synthetic DNA
taataagtctcgctacag

SEQ ID NO: 27909 - DNA, 18 bp, Artificial Sequence
  Synthetic DNA
taataatactcacaattg

SEQ ID NO: 27910 - DNA, 18 bp, Artificial Sequence
  Synthetic DNA
taatacaactcgcaaaag

SEQ ID NO: 27911 - DNA, 18 bp, Artificial Sequence
  Synthetic DNA
taatacaacttgctttag

SEQ ID NO: 27912 - DNA, 18 bp, Artificial Sequence
  Synthetic DNA
taatacatctaactattg

SEQ ID NO: 27913 - DNA, 18 bp, Artificial Sequence
  Synthetic DNA
taatacatcttgctatag

SEQ ID NO: 27914 - DNA, 18 bp, Artificial Sequence
  Synthetic DNA
taatacgacacacgtttg

SEQ ID NO: 27915 - DNA, 18 bp, Artificial Sequence
  Synthetic DNA
taatacgacactcaattg

SEQ ID NO: 27916 - DNA, 18 bp, Artificial Sequence
  Synthetic DNA
taatacgactccattttg

SEQ ID NO: 27917 - DNA, 18 bp, Artificial Sequence
  Synthetic DNA
taatacgagttacaattg

SEQ ID NO: 27918 - DNA, 18 bp, Artificial Sequence
  Synthetic DNA
taatacgattaaccattg

SEQ ID NO: 27919 - DNA, 18 bp, Artificial Sequence
  Synthetic DNA
taatacgattcagaattg

SEQ ID NO: 27920 - DNA, 18 bp, Artificial Sequence
  Synthetic DNA
taatacgattcattactg

SEQ ID NO: 27921 - DNA, 18 bp, Artificial Sequence
  Synthetic DNA
taatacgattcattcttg

SEQ ID NO: 27922 - DNA, 18 bp, Artificial Sequence
  Synthetic DNA
taatacggctcacaaatg

SEQ ID NO: 27923 - DNA, 18 bp, Artificial Sequence
  Synthetic DNA
taatactaatgactattg

SEQ ID NO: 27924 - DNA, 18 bp, Artificial Sequence
  Synthetic DNA
taatatgactcgctttcg

SEQ ID NO: 27925 - DNA, 18 bp, Artificial Sequence
  Synthetic DNA
taatatgagtcacaattg

SEQ ID NO: 27926 - DNA, 18 bp, Artificial Sequence
  Synthetic DNA
taatattacttgctatag

SEQ ID NO: 27927 - DNA, 18 bp, Artificial Sequence
  Synthetic DNA
taatccgactcccaattg

SEQ ID NO: 27928 - DNA, 18 bp, Artificial Sequence
  Synthetic DNA
taatccgtctcgctttag

SEQ ID NO: 27929 - DNA, 18 bp, Artificial Sequence
  Synthetic DNA
taatgcatctcactattg

SEQ ID NO: 27930 - DNA, 18 bp, Artificial Sequence
  Synthetic DNA
taatgcgacttacaattg

SEQ ID NO: 27931 - DNA, 18 bp, Artificial Sequence
  Synthetic DNA
taattaaactcaatatag

SEQ ID NO: 27932 - DNA, 18 bp, Artificial Sequence
  Synthetic DNA
taattcaaaacactatag

SEQ ID NO: 27933 - DNA, 18 bp, Artificial Sequence
  Synthetic DNA
taattcaacccacaatag

SEQ ID NO: 27934 - DNA, 18 bp, Artificial Sequence
  Synthetic DNA
taattcaactaactttag

SEQ ID NO: 27935 - DNA, 18 bp, Artificial Sequence
  Synthetic DNA
taattcaactaattatag

SEQ ID NO: 27936 - DNA, 18 bp, Artificial Sequence
  Synthetic DNA
taattcaactcactttcg

SEQ ID NO: 27937 - DNA, 18 bp, Artificial Sequence
  Synthetic DNA
taattcctatcactatag

SEQ ID NO: 27938 - DNA, 18 bp, Artificial Sequence
  Synthetic DNA
taattcgaaacactatcg

SEQ ID NO: 27939 - DNA, 18 bp, Artificial Sequence
  Synthetic DNA
taattcgacacactttgg

SEQ ID NO: 27940 - DNA, 18 bp, Artificial Sequence
  Synthetic DNA
taattcgacatagtatag

SEQ ID NO: 27941 - DNA, 18 bp, Artificial Sequence
  Synthetic DNA
taattcgactaataatag

SEQ ID NO: 27942 - DNA, 18 bp, Artificial Sequence
  Synthetic DNA
taattcgactcacgtaag

SEQ ID NO: 27943 - DNA, 18 bp, Artificial Sequence
  Synthetic DNA
taattcgacttagtatcg

SEQ ID NO: 27944 - DNA, 18 bp, Artificial Sequence
  Synthetic DNA
taattcgattcactaacg

SEQ ID NO: 27945 - DNA, 18 bp, Artificial Sequence
  Synthetic DNA
taattcgattgtctatag

SEQ ID NO: 27946 - DNA, 18 bp, Artificial Sequence
  Synthetic DNA
taattctaccccctatag

SEQ ID NO: 27947 - DNA, 18 bp, Artificial Sequence
  Synthetic DNA
taattctactcattgtag

SEQ ID NO: 27948 - DNA, 18 bp, Artificial Sequence
  Synthetic DNA
taattgaactcactaaag

SEQ ID NO: 27949 - DNA, 18 bp, Artificial Sequence
  Synthetic DNA
taatttgtctcattatag

SEQ ID NO: 27950 - DNA, 18 bp, Artificial Sequence
  Synthetic DNA
taattttactcaatatag

SEQ ID NO: 27951 - DNA, 18 bp, Artificial Sequence
  Synthetic DNA
tacaccgactcactattg

SEQ ID NO: 27952 - DNA, 18 bp, Artificial Sequence
  Synthetic DNA
tactaccactcacttttg

SEQ ID NO: 27953 - DNA, 18 bp, Artificial Sequence
  Synthetic DNA
tacttcgaatccctatag

SEQ ID NO: 27954 - DNA, 18 bp, Artificial Sequence
  Synthetic DNA
tagttcgacatactatag

SEQ ID NO: 27955 - DNA, 18 bp, Artificial Sequence
  Synthetic DNA
tagttcgacttagtatag

SEQ ID NO: 27956 - DNA, 18 bp, Artificial Sequence
  Synthetic DNA
tatttagactcattatag

SEQ ID NO: 27957 - DNA, 18 bp, Artificial Sequence
  Synthetic DNA
tatttcgacagactatag

SEQ ID NO: 27958 - DNA, 18 bp, Artificial Sequence
  Synthetic DNA
tatttcgaccccctatag

SEQ ID NO: 27959 - DNA, 18 bp, Artificial Sequence
  Synthetic DNA
tatttcgactttctatag

SEQ ID NO: 27960 - DNA, 18 bp, Artificial Sequence
  Synthetic DNA
tatttcgagtctctatag

SEQ ID NO: 27961 - DNA, 18 bp, Artificial Sequence
  Synthetic DNA
tatttcgcttcactatag

SEQ ID NO: 27962 - DNA, 18 bp, Artificial Sequence
  Synthetic DNA
tatttcggctcattatag

SEQ ID NO: 27963 - DNA, 18 bp, Artificial Sequence
  Synthetic DNA
tatttctgctcactatag

SEQ ID NO: 27964 - DNA, 18 bp, Artificial Sequence
  Synthetic DNA
tcactcgactcactaaag

SEQ ID NO: 27965 - DNA, 18 bp, Artificial Sequence
  Synthetic DNA
tcataagaatcactattg

SEQ ID NO: 27966 - DNA, 18 bp, Artificial Sequence
  Synthetic DNA
tcatacgacacaatattg

SEQ ID NO: 27967 - DNA, 18 bp, Artificial Sequence
  Synthetic DNA
tcatacgacacactaatg

SEQ ID NO: 27968 - DNA, 18 bp, Artificial Sequence
  Synthetic DNA
tcatacgactcatcattg

SEQ ID NO: 27969 - DNA, 18 bp, Artificial Sequence
  Synthetic DNA
tcattagacccactatag

SEQ ID NO: 27970 - DNA, 18 bp, Artificial Sequence
  Synthetic DNA
tcattcgattcactatgg

SEQ ID NO: 27971 - DNA, 18 bp, Artificial Sequence
  Synthetic DNA
tgaaacgactaactattg

SEQ ID NO: 27972 - DNA, 18 bp, Artificial Sequence
  Synthetic DNA
tgactcgactcactttag

SEQ ID NO: 27973 - DNA, 18 bp, Artificial Sequence
  Synthetic DNA
tgatactacacactattg

SEQ ID NO: 27974 - DNA, 18 bp, Artificial Sequence
  Synthetic DNA
tgatactactcattattg

SEQ ID NO: 27975 - DNA, 18 bp, Artificial Sequence
  Synthetic DNA
tgattcgactctatatag

SEQ ID NO: 27976 - DNA, 18 bp, Artificial Sequence
  Synthetic DNA
tgattcgactctctgtag

SEQ ID NO: 27977 - DNA, 18 bp, Artificial Sequence
  Synthetic DNA
tgattcgcctctctatag

SEQ ID NO: 27978 - DNA, 18 bp, Artificial Sequence
  Synthetic DNA
ttaaacgactcactactg

SEQ ID NO: 27979 - DNA, 18 bp, Artificial Sequence
  Synthetic DNA
ttaatcgactcactatgg

SEQ ID NO: 27980 - DNA, 18 bp, Artificial Sequence
  Synthetic DNA
ttactcgtctcactatag

SEQ ID NO: 27981 - DNA, 18 bp, Artificial Sequence
  Synthetic DNA
ttataccactcaatattg

SEQ ID NO: 27982 - DNA, 18 bp, Artificial Sequence
  Synthetic DNA
ttatacgacttcctattg

SEQ ID NO: 27983 - DNA, 18 bp, Artificial Sequence
  Synthetic DNA
ttatatgactcaccattg

SEQ ID NO: 27984 - DNA, 18 bp, Artificial Sequence
  Synthetic DNA
ttattcaactcattatag

SEQ ID NO: 27985 - DNA, 18 bp, Artificial Sequence
  Synthetic DNA
ttattcgattcaccatag

SEQ ID NO: 27986 - DNA, 18 bp, Artificial Sequence
  Synthetic DNA
ttgtacgagtcactattg

SEQ ID NO: 27987 - DNA, 18 bp, Artificial Sequence
  Synthetic DNA
ttttacaactcactattg

SEQ ID NO: 27988 - DNA, 18 bp, Artificial Sequence
  Synthetic DNA
ttttacgactccctattg

SEQ ID NO: 27989 - DNA, 18 bp, Artificial Sequence
  Synthetic DNA
tttttcgaatcactatag

SEQ ID NO: 27990 - DNA, 18 bp, Artificial Sequence
  Synthetic DNA
aaaaacgaatcacaatag

SEQ ID NO: 27991 - DNA, 18 bp, Artificial Sequence
  Synthetic DNA
aaaaacgccacactatag

SEQ ID NO: 27992 - DNA, 18 bp, Artificial Sequence
  Synthetic DNA
aaaaacgcctcaccatag

SEQ ID NO: 27993 - DNA, 18 bp, Artificial Sequence
  Synthetic DNA
aaacaagactctctatag

SEQ ID NO: 27994 - DNA, 18 bp, Artificial Sequence
  Synthetic DNA
aaataaaaatcactatag

SEQ ID NO: 27995 - DNA, 18 bp, Artificial Sequence
  Synthetic DNA
aaataagactcattttag

SEQ ID NO: 27996 - DNA, 18 bp, Artificial Sequence
  Synthetic DNA
aaatacaacccactaaag

SEQ ID NO: 27997 - DNA, 18 bp, Artificial Sequence
  Synthetic DNA
aaatacaagtcactatcg

SEQ ID NO: 27998 - DNA, 18 bp, Artificial Sequence
  Synthetic DNA
aaatacccctcactatcg

SEQ ID NO: 27999 - DNA, 18 bp, Artificial Sequence
  Synthetic DNA
aaatacctctcactacag

SEQ ID NO: 28000 - DNA, 18 bp, Artificial Sequence
  Synthetic DNA
aaatacctctcattatag

SEQ ID NO: 28001 - DNA, 18 bp, Artificial Sequence
  Synthetic DNA
aaatacgaattactttag

SEQ ID NO: 28002 - DNA, 18 bp, Artificial Sequence
  Synthetic DNA
aaatacgactatctatgg

SEQ ID NO: 28003 - DNA, 18 bp, Artificial Sequence
  Synthetic DNA
aaatatgactaacaatag

SEQ ID NO: 28004 - DNA, 18 bp, Artificial Sequence
  Synthetic DNA
aaatatgactccctataa

SEQ ID NO: 28005 - DNA, 18 bp, Artificial Sequence
  Synthetic DNA
aaatatgattcaccatag

SEQ ID NO: 28006 - DNA, 18 bp, Artificial Sequence
  Synthetic DNA
aaatatgattctctatag

SEQ ID NO: 28007 - DNA, 18 bp, Artificial Sequence
  Synthetic DNA
aaatccgactctgtatag

SEQ ID NO: 28008 - DNA, 18 bp, Artificial Sequence
  Synthetic DNA
aaatcctactaactatag

SEQ ID NO: 28009 - DNA, 18 bp, Artificial Sequence
  Synthetic DNA
aaatgagactcactatcg

SEQ ID NO: 28010 - DNA, 18 bp, Artificial Sequence
  Synthetic DNA
aacaacgactcactgtag

SEQ ID NO: 28011 - DNA, 18 bp, Artificial Sequence
  Synthetic DNA
aagaacgacacactatag

SEQ ID NO: 28012 - DNA, 18 bp, Artificial Sequence
  Synthetic DNA
aagcacgactcacaatag

SEQ ID NO: 28013 - DNA, 18 bp, Artificial Sequence
  Synthetic DNA
aattacgacaccctatag

SEQ ID NO: 28014 - DNA, 18 bp, Artificial Sequence
  Synthetic DNA
aattacgactcagtctag

SEQ ID NO: 28015 - DNA, 18 bp, Artificial Sequence
  Synthetic DNA
aattacgattgactatag

SEQ ID NO: 28016 - DNA, 18 bp, Artificial Sequence
  Synthetic DNA
aattactactcacaatag

SEQ ID NO: 28017 - DNA, 18 bp, Artificial Sequence
  Synthetic DNA
aattataactcactatag

SEQ ID NO: 28018 - DNA, 18 bp, Artificial Sequence
  Synthetic DNA
acatacgattcactaaag

SEQ ID NO: 28019 - DNA, 18 bp, Artificial Sequence
  Synthetic DNA
acatacgattctctatag

SEQ ID NO: 28020 - DNA, 18 bp, Artificial Sequence
  Synthetic DNA
acatacgtcccactatag

SEQ ID NO: 28021 - DNA, 18 bp, Artificial Sequence
  Synthetic DNA
agatacgattcactaaag

SEQ ID NO: 28022 - DNA, 18 bp, Artificial Sequence
  Synthetic DNA
aggtacgcctcactatag

SEQ ID NO: 28023 - DNA, 18 bp, Artificial Sequence
  Synthetic DNA
atatacgaatcactgtag

SEQ ID NO: 28024 - DNA, 18 bp, Artificial Sequence
  Synthetic DNA
atatacggctcacaatag

SEQ ID NO: 28025 - DNA, 18 bp, Artificial Sequence
  Synthetic DNA
atatacgtgtcactatag

SEQ ID NO: 28026 - DNA, 18 bp, Artificial Sequence
  Synthetic DNA
atatccgacccactatag

SEQ ID NO: 28027 - DNA, 18 bp, Artificial Sequence
  Synthetic DNA
atatgcgactcacaatag

SEQ ID NO: 28028 - DNA, 18 bp, Artificial Sequence
  Synthetic DNA
atctacgcctcactatag

SEQ ID NO: 28029 - DNA, 18 bp, Artificial Sequence
  Synthetic DNA
caaaaagacttactatag

SEQ ID NO: 28030 - DNA, 18 bp, Artificial Sequence
  Synthetic DNA
caatacaaatcactatcg

SEQ ID NO: 28031 - DNA, 18 bp, Artificial Sequence
  Synthetic DNA
caatacaactcacaaaag

SEQ ID NO: 28032 - DNA, 18 bp, Artificial Sequence
  Synthetic DNA
caatacaatacactatag

SEQ ID NO: 28033 - DNA, 18 bp, Artificial Sequence
  Synthetic DNA
caataccactctcaatag

SEQ ID NO: 28034 - DNA, 18 bp, Artificial Sequence
  Synthetic DNA
caatacgatacattatag

SEQ ID NO: 28035 - DNA, 18 bp, Artificial Sequence
  Synthetic DNA
caatactaatcactatcg

SEQ ID NO: 28036 - DNA, 18 bp, Artificial Sequence
  Synthetic DNA
caatatgactctctttag

SEQ ID NO: 28037 - DNA, 18 bp, Artificial Sequence
  Synthetic DNA
caatccgactcacaaaag

SEQ ID NO: 28038 - DNA, 18 bp, Artificial Sequence
  Synthetic DNA
caatccgactctctttag

SEQ ID NO: 28039 - DNA, 18 bp, Artificial Sequence
  Synthetic DNA
cattaagactcacaatag

SEQ ID NO: 28040 - DNA, 18 bp, Artificial Sequence
  Synthetic DNA
cattacaacacactatag

SEQ ID NO: 28041 - DNA, 18 bp, Artificial Sequence
  Synthetic DNA
cattacaactcactgtag

SEQ ID NO: 28042 - DNA, 18 bp, Artificial Sequence
  Synthetic DNA
ccatacgactcataatag

SEQ ID NO: 28043 - DNA, 18 bp, Artificial Sequence
  Synthetic DNA
ctatacgactcactcaag

SEQ ID NO: 28044 - DNA, 18 bp, Artificial Sequence
  Synthetic DNA
ctatacgtctcactatcg

SEQ ID NO: 28045 - DNA, 18 bp, Artificial Sequence
  Synthetic DNA
gaatatgactcaatctag

SEQ ID NO: 28046 - DNA, 18 bp, Artificial Sequence
  Synthetic DNA
taaaaagactaactaaag

SEQ ID NO: 28047 - DNA, 18 bp, Artificial Sequence
  Synthetic DNA
taaaacctctcacaatag

SEQ ID NO: 28048 - DNA, 18 bp, Artificial Sequence
  Synthetic DNA
taaaacgaagcactttag

SEQ ID NO: 28049 - DNA, 18 bp, Artificial Sequence
  Synthetic DNA
taaaacgactcagttgag

SEQ ID NO: 28050 - DNA, 18 bp, Artificial Sequence
  Synthetic DNA
taaaacgactcattaacg

SEQ ID NO: 28051 - DNA, 18 bp, Artificial Sequence
  Synthetic DNA
taaaacgatacactctag

SEQ ID NO: 28052 - DNA, 18 bp, Artificial Sequence
  Synthetic DNA
taaaacgatccaatatag

SEQ ID NO: 28053 - DNA, 18 bp, Artificial Sequence
  Synthetic DNA
taaaacgattcactctcg

SEQ ID NO: 28054 - DNA, 18 bp, Artificial Sequence
  Synthetic DNA
taaaacgccacactaaag

SEQ ID NO: 28055 - DNA, 18 bp, Artificial Sequence
  Synthetic DNA
taaaacggatctctatag

SEQ ID NO: 28056 - DNA, 18 bp, Artificial Sequence
  Synthetic DNA
taaaacgtctcactcgag

SEQ ID NO: 28057 - DNA, 18 bp, Artificial Sequence
  Synthetic DNA
taaaacgtctccctttag

SEQ ID NO: 28058 - DNA, 18 bp, Artificial Sequence
  Synthetic DNA
taaaacgtctgattatag

SEQ ID NO: 28059 - DNA, 18 bp, Artificial Sequence
  Synthetic DNA
taaaactacatactatag

SEQ ID NO: 28060 - DNA, 18 bp, Artificial Sequence
  Synthetic DNA
taaaactactcaccaaag

SEQ ID NO: 28061 - DNA, 18 bp, Artificial Sequence
  Synthetic DNA
taaaagaactaactatag

SEQ ID NO: 28062 - DNA, 18 bp, Artificial Sequence
  Synthetic DNA
taaaaggagtctctatag

SEQ ID NO: 28063 - DNA, 18 bp, Artificial Sequence
  Synthetic DNA
taaaagggctcaatatag

SEQ ID NO: 28064 - DNA, 18 bp, Artificial Sequence
  Synthetic DNA
taaaatgaatcattatag

SEQ ID NO: 28065 - DNA, 18 bp, Artificial Sequence
  Synthetic DNA
taaaatgacacacaatag

SEQ ID NO: 28066 - DNA, 18 bp, Artificial Sequence
  Synthetic DNA
taaaatgactcaataaag

SEQ ID NO: 28067 - DNA, 18 bp, Artificial Sequence
  Synthetic DNA
taaacagactcactttag

SEQ ID NO: 28068 - DNA, 18 bp, Artificial Sequence
  Synthetic DNA
taaaccgactctgtatag

SEQ ID NO: 28069 - DNA, 18 bp, Artificial Sequence
  Synthetic DNA
taaagcgtcttactatag

SEQ ID NO: 28070 - DNA, 18 bp, Artificial Sequence
  Synthetic DNA
taacaagactcacattag

SEQ ID NO: 28071 - DNA, 18 bp, Artificial Sequence
  Synthetic DNA
taacaagtctcactctag

SEQ ID NO: 28072 - DNA, 18 bp, Artificial Sequence
  Synthetic DNA
taacaccactcactctcg

SEQ ID NO: 28073 - DNA, 18 bp, Artificial Sequence
  Synthetic DNA
taacacgacccacaaaag

SEQ ID NO: 28074 - DNA, 18 bp, Artificial Sequence
  Synthetic DNA
taacacgaccctatatag

SEQ ID NO: 28075 - DNA, 18 bp, Artificial Sequence
  Synthetic DNA
taacacgactcatttcag

SEQ ID NO: 28076 - DNA, 18 bp, Artificial Sequence
  Synthetic DNA
taacacgattgattatag

SEQ ID NO: 28077 - DNA, 18 bp, Artificial Sequence
  Synthetic DNA
taacacgtatccctatag

SEQ ID NO: 28078 - DNA, 18 bp, Artificial Sequence
  Synthetic DNA
taacacgtctctttatag

SEQ ID NO: 28079 - DNA, 18 bp, Artificial Sequence
  Synthetic DNA
taacacttctcactctag

SEQ ID NO: 28080 - DNA, 18 bp, Artificial Sequence
  Synthetic DNA
taagaagacttaatatag

SEQ ID NO: 28081 - DNA, 18 bp, Artificial Sequence
  Synthetic DNA
taagacaaatcaccatag

SEQ ID NO: 28082 - DNA, 18 bp, Artificial Sequence
  Synthetic DNA
taagacgactttctctag

SEQ ID NO: 28083 - DNA, 18 bp, Artificial Sequence
  Synthetic DNA
taagactactaactttag

SEQ ID NO: 28084 - DNA, 18 bp, Artificial Sequence
  Synthetic DNA
taataacactcattaaag

SEQ ID NO: 28085 - DNA, 18 bp, Artificial Sequence
  Synthetic DNA
taataacattcaatatag

SEQ ID NO: 28086 - DNA, 18 bp, Artificial Sequence
  Synthetic DNA
taataagaatcacaacag

SEQ ID NO: 28087 - DNA, 18 bp, Artificial Sequence
  Synthetic DNA
taataagactaactaagg

SEQ ID NO: 28088 - DNA, 18 bp, Artificial Sequence
  Synthetic DNA
taataagagacactaaag

SEQ ID NO: 28089 - DNA, 18 bp, Artificial Sequence
  Synthetic DNA
taataagattcactcaag

SEQ ID NO: 28090 - DNA, 18 bp, Artificial Sequence
  Synthetic DNA
taataagtcagactatag

SEQ ID NO: 28091 - DNA, 18 bp, Artificial Sequence
  Synthetic DNA
taataagtctcaatttag

SEQ ID NO: 28092 - DNA, 18 bp, Artificial Sequence
  Synthetic DNA
taataatactctctaaag

SEQ ID NO: 28093 - DNA, 18 bp, Artificial Sequence
  Synthetic DNA
taatacaaatcagaatag

SEQ ID NO: 28094 - DNA, 18 bp, Artificial Sequence
  Synthetic DNA
taatacaacgtactttag

SEQ ID NO: 28095 - DNA, 18 bp, Artificial Sequence
  Synthetic DNA
taatacaactcatttcag

SEQ ID NO: 28096 - DNA, 18 bp, Artificial Sequence
  Synthetic DNA
taatacaactgtctagag

SEQ ID NO: 28097 - DNA, 18 bp, Artificial Sequence
  Synthetic DNA
taatacaagacactgtag

SEQ ID NO: 28098 - DNA, 18 bp, Artificial Sequence
  Synthetic DNA
taatacaagtcacaaaag

SEQ ID NO: 28099 - DNA, 18 bp, Artificial Sequence
  Synthetic DNA
taatacatctccctttag

SEQ ID NO: 28100 - DNA, 18 bp, Artificial Sequence
  Synthetic DNA
taataccaatcactttgg

SEQ ID NO: 28101 - DNA, 18 bp, Artificial Sequence
  Synthetic DNA
taataccacactatatag

SEQ ID NO: 28102 - DNA, 18 bp, Artificial Sequence
  Synthetic DNA
taataccactaaataaag

SEQ ID NO: 28103 - DNA, 18 bp, Artificial Sequence
  Synthetic DNA
taataccactcaatctcg

SEQ ID NO: 28104 - DNA, 18 bp, Artificial Sequence
  Synthetic DNA
taataccactcataatcg

SEQ ID NO: 28105 - DNA, 18 bp, Artificial Sequence
  Synthetic DNA
taataccatgcaatatag

SEQ ID NO: 28106 - DNA, 18 bp, Artificial Sequence
  Synthetic DNA
taatacgaatttccatag

SEQ ID NO: 28107 - DNA, 18 bp, Artificial Sequence
  Synthetic DNA
taatacgacagactttcg

SEQ ID NO: 28108 - DNA, 18 bp, Artificial Sequence
  Synthetic DNA
taatacgacccccttaag

SEQ ID NO: 28109 - DNA, 18 bp, Artificial Sequence
  Synthetic DNA
taatacgactaacgtaag

SEQ ID NO: 28110 - DNA, 18 bp, Artificial Sequence
  Synthetic DNA
taatacgactacatctag

SEQ ID NO: 28111 - DNA, 18 bp, Artificial Sequence
  Synthetic DNA
taatacgactttccatcg

SEQ ID NO: 28112 - DNA, 18 bp, Artificial Sequence
  Synthetic DNA
taatacgagacacaatgg

SEQ ID NO: 28113 - DNA, 18 bp, Artificial Sequence
  Synthetic DNA
taatacgagtcattctgg

SEQ ID NO: 28114 - DNA, 18 bp, Artificial Sequence
  Synthetic DNA
taatacgatacaatatgg

SEQ ID NO: 28115 - DNA, 18 bp, Artificial Sequence
  Synthetic DNA
taatacgattaccaatag

SEQ ID NO: 28116 - DNA, 18 bp, Artificial Sequence
  Synthetic DNA
taatacgattcagtttgg

SEQ ID NO: 28117 - DNA, 18 bp, Artificial Sequence
  Synthetic DNA
taatacgattcatcaaag

SEQ ID NO: 28118 - DNA, 18 bp, Artificial Sequence
  Synthetic DNA
taatacgattctttttag

SEQ ID NO: 28119 - DNA, 18 bp, Artificial Sequence
  Synthetic DNA
taatacgatttacaatcg

SEQ ID NO: 28120 - DNA, 18 bp, Artificial Sequence
  Synthetic DNA
taatacgcatctttatag

SEQ ID NO: 28121 - DNA, 18 bp, Artificial Sequence
  Synthetic DNA
taatacgccttacattag

SEQ ID NO: 28122 - DNA, 18 bp, Artificial Sequence
  Synthetic DNA
taatacgctacactttag

SEQ ID NO: 28123 - DNA, 18 bp, Artificial Sequence
  Synthetic DNA
taatacgcttcacttaag

SEQ ID NO: 28124 - DNA, 18 bp, Artificial Sequence
  Synthetic DNA
taatacggctaacttcag

SEQ ID NO: 28125 - DNA, 18 bp, Artificial Sequence
  Synthetic DNA
taatacggctctccaaag

SEQ ID NO: 28126 - DNA, 18 bp, Artificial Sequence
  Synthetic DNA
taatacggctgattttag

SEQ ID NO: 28127 - DNA, 18 bp, Artificial Sequence
  Synthetic DNA
taatacgtatcacttgag

SEQ ID NO: 28128 - DNA, 18 bp, Artificial Sequence
  Synthetic DNA
taatacgtattagtatag

SEQ ID NO: 28129 - DNA, 18 bp, Artificial Sequence
  Synthetic DNA
taatacgtcactctgtag

SEQ ID NO: 28130 - DNA, 18 bp, Artificial Sequence
  Synthetic DNA
taatacgtcatactatcg

SEQ ID NO: 28131 - DNA, 18 bp, Artificial Sequence
  Synthetic DNA
taatacgtctcacgtgag

SEQ ID NO: 28132 - DNA, 18 bp, Artificial Sequence
  Synthetic DNA
taatacgtctcactgacg

SEQ ID NO: 28133 - DNA, 18 bp, Artificial Sequence
  Synthetic DNA
taatacgtctccctgtcg

SEQ ID NO: 28134 - DNA, 18 bp, Artificial Sequence
  Synthetic DNA
taatacgtctctcagtag

SEQ ID NO: 28135 - DNA, 18 bp, Artificial Sequence
  Synthetic DNA
taatacgtcttattatgg

SEQ ID NO: 28136 - DNA, 18 bp, Artificial Sequence
  Synthetic DNA
taatacgtttgagtatag

SEQ ID NO: 28137 - DNA, 18 bp, Artificial Sequence
  Synthetic DNA
taatactaatgacaatag

SEQ ID NO: 28138 - DNA, 18 bp, Artificial Sequence
  Synthetic DNA
taatactacacactcaag

SEQ ID NO: 28139 - DNA, 18 bp, Artificial Sequence
  Synthetic DNA
taatactacacccaatag

SEQ ID NO: 28140 - DNA, 18 bp, Artificial Sequence
  Synthetic DNA
taatactattcagtttag

SEQ ID NO: 28141 - DNA, 18 bp, Artificial Sequence
  Synthetic DNA
taatacttctaactctag

SEQ ID NO: 28142 - DNA, 18 bp, Artificial Sequence
  Synthetic DNA
taataggaatcaaaatag

SEQ ID NO: 28143 - DNA, 18 bp, Artificial Sequence
  Synthetic DNA
taataggacacacattag

SEQ ID NO: 28144 - DNA, 18 bp, Artificial Sequence
  Synthetic DNA
taataggagccattatag

SEQ ID NO: 28145 - DNA, 18 bp, Artificial Sequence
  Synthetic DNA
taataggtctcaataaag

SEQ ID NO: 28146 - DNA, 18 bp, Artificial Sequence
  Synthetic DNA
taatataactcattaaag

SEQ ID NO: 28147 - DNA, 18 bp, Artificial Sequence
  Synthetic DNA
taatatgaattattatag

SEQ ID NO: 28148 - DNA, 18 bp, Artificial Sequence
  Synthetic DNA
taatatgacacattaaag

SEQ ID NO: 28149 - DNA, 18 bp, Artificial Sequence
  Synthetic DNA
taatatgactcaccaagg

SEQ ID NO: 28150 - DNA, 18 bp, Artificial Sequence
  Synthetic DNA
taatatgactgtcaatag

SEQ ID NO: 28151 - DNA, 18 bp, Artificial Sequence
  Synthetic DNA
taatatgattcaatagag

SEQ ID NO: 28152 - DNA, 18 bp, Artificial Sequence
  Synthetic DNA
taatatgtctacctatag

SEQ ID NO: 28153 - DNA, 18 bp, Artificial Sequence
  Synthetic DNA
taatatgtctcactaacg

SEQ ID NO: 28154 - DNA, 18 bp, Artificial Sequence
  Synthetic DNA
taatatgtctccctatcg

SEQ ID NO: 28155 - DNA, 18 bp, Artificial Sequence
  Synthetic DNA
taatattaatcactctag

SEQ ID NO: 28156 - DNA, 18 bp, Artificial Sequence
  Synthetic DNA
taatattacacactaaag

SEQ ID NO: 28157 - DNA, 18 bp, Artificial Sequence
  Synthetic DNA
taatatttttcactatag

SEQ ID NO: 28158 - DNA, 18 bp, Artificial Sequence
  Synthetic DNA
taatccgactccctgtcg

SEQ ID NO: 28159 - DNA, 18 bp, Artificial Sequence
  Synthetic DNA
taatccgactctataaag

SEQ ID NO: 28160 - DNA, 18 bp, Artificial Sequence
  Synthetic DNA
taatccgactttcaatag

SEQ ID NO: 28161 - DNA, 18 bp, Artificial Sequence
  Synthetic DNA
taatccgagtctctaaag

SEQ ID NO: 28162 - DNA, 18 bp, Artificial Sequence
  Synthetic DNA
taatccgattcattaaag

SEQ ID NO: 28163 - DNA, 18 bp, Artificial Sequence
  Synthetic DNA
taatccgtcaaactatag

SEQ ID NO: 28164 - DNA, 18 bp, Artificial Sequence
  Synthetic DNA
taatccgtctcactcaag

SEQ ID NO: 28165 - DNA, 18 bp, Artificial Sequence
  Synthetic DNA
taatccgtgtctctatag

SEQ ID NO: 28166 - DNA, 18 bp, Artificial Sequence
  Synthetic DNA
taatcctacaaactatag

SEQ ID NO: 28167 - DNA, 18 bp, Artificial Sequence
  Synthetic DNA
taatcctactctctttag

SEQ ID NO: 28168 - DNA, 18 bp, Artificial Sequence
  Synthetic DNA
taatctggctctctatag

SEQ ID NO: 28169 - DNA, 18 bp, Artificial Sequence
  Synthetic DNA
taatgagactcactttcg

SEQ ID NO: 28170 - DNA, 18 bp, Artificial Sequence
  Synthetic DNA
taatgcgaattcctatag

SEQ ID NO: 28171 - DNA, 18 bp, Artificial Sequence
  Synthetic DNA
taatgcgacacacagtag

SEQ ID NO: 28172 - DNA, 18 bp, Artificial Sequence
  Synthetic DNA
taatgcgacaccctttag

SEQ ID NO: 28173 - DNA, 18 bp, Artificial Sequence
  Synthetic DNA
taatgcgactcacactcg

SEQ ID NO: 28174 - DNA, 18 bp, Artificial Sequence
  Synthetic DNA
taatgctacacactttag

SEQ ID NO: 28175 - DNA, 18 bp, Artificial Sequence
  Synthetic DNA
tacaacgatccactatag

SEQ ID NO: 28176 - DNA, 18 bp, Artificial Sequence
  Synthetic DNA
tacaacggctctctatag

SEQ ID NO: 28177 - DNA, 18 bp, Artificial Sequence
  Synthetic DNA
tacaacgtttcactatag

SEQ ID NO: 28178 - DNA, 18 bp, Artificial Sequence
  Synthetic DNA
tacaaggactcacaatag

SEQ ID NO: 28179 - DNA, 18 bp, Artificial Sequence
  Synthetic DNA
tacaatgactgactatag

SEQ ID NO: 28180 - DNA, 18 bp, Artificial Sequence
  Synthetic DNA
taccacgactaactaaag

SEQ ID NO: 28181 - DNA, 18 bp, Artificial Sequence
  Synthetic DNA
taccacgactcattttag

SEQ ID NO: 28182 - DNA, 18 bp, Artificial Sequence
  Synthetic DNA
tactacgaatcacattag

SEQ ID NO: 28183 - DNA, 18 bp, Artificial Sequence
  Synthetic DNA
tactacgacacccaatag

SEQ ID NO: 28184 - DNA, 18 bp, Artificial Sequence
  Synthetic DNA
tactacgactctttagag

SEQ ID NO: 28185 - DNA, 18 bp, Artificial Sequence
  Synthetic DNA
tactacgatccactttag

SEQ ID NO: 28186 - DNA, 18 bp, Artificial Sequence
  Synthetic DNA
tactacgtaacactatag

SEQ ID NO: 28187 - DNA, 18 bp, Artificial Sequence
  Synthetic DNA
tactacgtctctctctag

SEQ ID NO: 28188 - DNA, 18 bp, Artificial Sequence
  Synthetic DNA
tactactaatcacaatag

SEQ ID NO: 28189 - DNA, 18 bp, Artificial Sequence
  Synthetic DNA
tactactattcagtatag

SEQ ID NO: 28190 - DNA, 18 bp, Artificial Sequence
  Synthetic DNA
tactataactcaatatag

SEQ ID NO: 28191 - DNA, 18 bp, Artificial Sequence
  Synthetic DNA
tactgcgacttactttag

SEQ ID NO: 28192 - DNA, 18 bp, Artificial Sequence
  Synthetic DNA
tagaaagactcacgatag

SEQ ID NO: 28193 - DNA, 18 bp, Artificial Sequence
  Synthetic DNA
tagaacgactatctatag

SEQ ID NO: 28194 - DNA, 18 bp, Artificial Sequence
  Synthetic DNA
tagaacgactcaatatcg

SEQ ID NO: 28195 - DNA, 18 bp, Artificial Sequence
  Synthetic DNA
tagtaagtcttactatag

SEQ ID NO: 28196 - DNA, 18 bp, Artificial Sequence
  Synthetic DNA
tagtacaattcactacag

SEQ ID NO: 28197 - DNA, 18 bp, Artificial Sequence
  Synthetic DNA
tagtacgacacacgacag

SEQ ID NO: 28198 - DNA, 18 bp, Artificial Sequence
  Synthetic DNA
tagtccgattcactttag

SEQ ID NO: 28199 - DNA, 18 bp, Artificial Sequence
  Synthetic DNA
tataacgacacactagag

SEQ ID NO: 28200 - DNA, 18 bp, Artificial Sequence
  Synthetic DNA
tatagctactcactatag

SEQ ID NO: 28201 - DNA, 18 bp, Artificial Sequence
  Synthetic DNA
tatgaccgctcactatag

SEQ ID NO: 28202 - DNA, 18 bp, Artificial Sequence
  Synthetic DNA
tattaagactcatcatag

SEQ ID NO: 28203 - DNA, 18 bp, Artificial Sequence
  Synthetic DNA
tattaagcctcactaaag

SEQ ID NO: 28204 - DNA, 18 bp, Artificial Sequence
  Synthetic DNA
tattaagcctcactctag

SEQ ID NO: 28205 - DNA, 18 bp, Artificial Sequence
  Synthetic DNA
tattaatactcattatag

SEQ ID NO: 28206 - DNA, 18 bp, Artificial Sequence
  Synthetic DNA
tattacacctctctatag

SEQ ID NO: 28207 - DNA, 18 bp, Artificial Sequence
  Synthetic DNA
tattaccacatactatag

SEQ ID NO: 28208 - DNA, 18 bp, Artificial Sequence
  Synthetic DNA
tattaccactcacaatgg

SEQ ID NO: 28209 - DNA, 18 bp, Artificial Sequence
  Synthetic DNA
tattaccactcactaacg

SEQ ID NO: 28210 - DNA, 18 bp, Artificial Sequence
  Synthetic DNA
tattacgaagcactctag

SEQ ID NO: 28211 - DNA, 18 bp, Artificial Sequence
  Synthetic DNA
tattacgaataacaatag

SEQ ID NO: 28212 - DNA, 18 bp, Artificial Sequence
  Synthetic DNA
tattacgactcaccacgg

SEQ ID NO: 28213 - DNA, 18 bp, Artificial Sequence
  Synthetic DNA
tattacgactcattaggg

SEQ ID NO: 28214 - DNA, 18 bp, Artificial Sequence
  Synthetic DNA
tattacgagtaactgtag

SEQ ID NO: 28215 - DNA, 18 bp, Artificial Sequence
  Synthetic DNA
tattacgattaattatag

SEQ ID NO: 28216 - DNA, 18 bp, Artificial Sequence
  Synthetic DNA
tattacgattgacgatag

SEQ ID NO: 28217 - DNA, 18 bp, Artificial Sequence
  Synthetic DNA
tattacgtctcagtatcg

SEQ ID NO: 28218 - DNA, 18 bp, Artificial Sequence
  Synthetic DNA
tattactaattactatag

SEQ ID NO: 28219 - DNA, 18 bp, Artificial Sequence
  Synthetic DNA
tattactactaactaaag

SEQ ID NO: 28220 - DNA, 18 bp, Artificial Sequence
  Synthetic DNA
tattatgaatcacaatag

SEQ ID NO: 28221 - DNA, 18 bp, Artificial Sequence
  Synthetic DNA
tattatgactcacttgag

SEQ ID NO: 28222 - DNA, 18 bp, Artificial Sequence
  Synthetic DNA
tattccgacccattatag

SEQ ID NO: 28223 - DNA, 18 bp, Artificial Sequence
  Synthetic DNA
tattccgacttactaaag

SEQ ID NO: 28224 - DNA, 18 bp, Artificial Sequence
  Synthetic DNA
tattgcgacttactttag

SEQ ID NO: 28225 - DNA, 18 bp, Artificial Sequence
  Synthetic DNA
tcaaacgactaactttag

SEQ ID NO: 28226 - DNA, 18 bp, Artificial Sequence
  Synthetic DNA
tcaagcgactcacaatag

SEQ ID NO: 28227 - DNA, 18 bp, Artificial Sequence
  Synthetic DNA
tcatacgacccacttaag

SEQ ID NO: 28228 - DNA, 18 bp, Artificial Sequence
  Synthetic DNA
tcatacgagtcactaagg

SEQ ID NO: 28229 - DNA, 18 bp, Artificial Sequence
  Synthetic DNA
tcatacgtctcacaatcg

SEQ ID NO: 28230 - DNA, 18 bp, Artificial Sequence
  Synthetic DNA
tcatacgtctcattatgg

SEQ ID NO: 28231 - DNA, 18 bp, Artificial Sequence
  Synthetic DNA
tcatactagtcaatatag

SEQ ID NO: 28232 - DNA, 18 bp, Artificial Sequence
  Synthetic DNA
tcataggattcactaaag

SEQ ID NO: 28233 - DNA, 18 bp, Artificial Sequence
  Synthetic DNA
tcatatgaaacactatag

SEQ ID NO: 28234 - DNA, 18 bp, Artificial Sequence
  Synthetic DNA
tcatatgactcattttag

SEQ ID NO: 28235 - DNA, 18 bp, Artificial Sequence
  Synthetic DNA
tcatatgactctctaaag

SEQ ID NO: 28236 - DNA, 18 bp, Artificial Sequence
  Synthetic DNA
tcatcacactcactatag

SEQ ID NO: 28237 - DNA, 18 bp, Artificial Sequence
  Synthetic DNA
tcatccgaatcactaaag

SEQ ID NO: 28238 - DNA, 18 bp, Artificial Sequence
  Synthetic DNA
tcatccgtcacactatag

SEQ ID NO: 28239 - DNA, 18 bp, Artificial Sequence
  Synthetic DNA
tcatgcgactcacattag

SEQ ID NO: 28240 - DNA, 18 bp, Artificial Sequence
  Synthetic DNA
tcgtaggactcactaaag

SEQ ID NO: 28241 - DNA, 18 bp, Artificial Sequence
  Synthetic DNA
tcttaccacgcactatag

SEQ ID NO: 28242 - DNA, 18 bp, Artificial Sequence
  Synthetic DNA
tcttacggcccactatag

SEQ ID NO: 28243 - DNA, 18 bp, Artificial Sequence
  Synthetic DNA
tcttgcgattcactatag

SEQ ID NO: 28244 - DNA, 18 bp, Artificial Sequence
  Synthetic DNA
tgaaacaacacactatag

SEQ ID NO: 28245 - DNA, 18 bp, Artificial Sequence
  Synthetic DNA
tgataagacactctatag

SEQ ID NO: 28246 - DNA, 18 bp, Artificial Sequence
  Synthetic DNA
tgataagactctcaatag

SEQ ID NO: 28247 - DNA, 18 bp, Artificial Sequence
  Synthetic DNA
tgatacaacgccctatag

SEQ ID NO: 28248 - DNA, 18 bp, Artificial Sequence
  Synthetic DNA
tgatacgactatcaatag

SEQ ID NO: 28249 - DNA, 18 bp, Artificial Sequence
  Synthetic DNA
tgatacgtatcactaaag

SEQ ID NO: 28250 - DNA, 18 bp, Artificial Sequence
  Synthetic DNA
tgatccatctcactatag

SEQ ID NO: 28251 - DNA, 18 bp, Artificial Sequence
  Synthetic DNA
tgttaccactcactaaag

SEQ ID NO: 28252 - DNA, 18 bp, Artificial Sequence
  Synthetic DNA
tgttacgatacactatag

SEQ ID NO: 28253 - DNA, 18 bp, Artificial Sequence
  Synthetic DNA
ttaaaccactcaatatag

SEQ ID NO: 28254 - DNA, 18 bp, Artificial Sequence
  Synthetic DNA
ttaaatgattcactatag

SEQ ID NO: 28255 - DNA, 18 bp, Artificial Sequence
  Synthetic DNA
ttacacgacacaccatag

SEQ ID NO: 28256 - DNA, 18 bp, Artificial Sequence
  Synthetic DNA
ttacactactaactatag

SEQ ID NO: 28257 - DNA, 18 bp, Artificial Sequence
  Synthetic DNA
ttacactactcactatgg

SEQ ID NO: 28258 - DNA, 18 bp, Artificial Sequence
  Synthetic DNA
ttacactactctctatag

SEQ ID NO: 28259 - DNA, 18 bp, Artificial Sequence
  Synthetic DNA
ttagacgtctcactctag

SEQ ID NO: 28260 - DNA, 18 bp, Artificial Sequence
  Synthetic DNA
ttataagacactctatag

SEQ ID NO: 28261 - DNA, 18 bp, Artificial Sequence
  Synthetic DNA
ttatacaacatactatag

SEQ ID NO: 28262 - DNA, 18 bp, Artificial Sequence
  Synthetic DNA
ttatacaagtcactgtag

SEQ ID NO: 28263 - DNA, 18 bp, Artificial Sequence
  Synthetic DNA
ttataccaatcactaaag

SEQ ID NO: 28264 - DNA, 18 bp, Artificial Sequence
  Synthetic DNA
ttataccactcaataaag

SEQ ID NO: 28265 - DNA, 18 bp, Artificial Sequence
  Synthetic DNA
ttataccactcagcatag

SEQ ID NO: 28266 - DNA, 18 bp, Artificial Sequence
  Synthetic DNA
ttataccattcacaatag

SEQ ID NO: 28267 - DNA, 18 bp, Artificial Sequence
  Synthetic DNA
ttatacgacacacattag

SEQ ID NO: 28268 - DNA, 18 bp, Artificial Sequence
  Synthetic DNA
ttatacgacaccctaaag

SEQ ID NO: 28269 - DNA, 18 bp, Artificial Sequence
  Synthetic DNA
ttatacgacgcaatacag

SEQ ID NO: 28270 - DNA, 18 bp, Artificial Sequence
  Synthetic DNA
ttatacgactgtctaaag

SEQ ID NO: 28271 - DNA, 18 bp, Artificial Sequence
  Synthetic DNA
ttatacgagtctctaaag

SEQ ID NO: 28272 - DNA, 18 bp, Artificial Sequence
  Synthetic DNA
ttatacgcattactatag

SEQ ID NO: 28273 - DNA, 18 bp, Artificial Sequence
  Synthetic DNA
ttatacgcctaactatgg

SEQ ID NO: 28274 - DNA, 18 bp, Artificial Sequence
  Synthetic DNA
ttatacgtaccactatag

SEQ ID NO: 28275 - DNA, 18 bp, Artificial Sequence
  Synthetic DNA
ttatactactctctatcg

SEQ ID NO: 28276 - DNA, 18 bp, Artificial Sequence
  Synthetic DNA
ttatactacttactatcg

SEQ ID NO: 28277 - DNA, 18 bp, Artificial Sequence
  Synthetic DNA
ttatactgctcaatatag

SEQ ID NO: 28278 - DNA, 18 bp, Artificial Sequence
  Synthetic DNA
ttatactgctctctatag

SEQ ID NO: 28279 - DNA, 18 bp, Artificial Sequence
  Synthetic DNA
ttataggtctcattatag

SEQ ID NO: 28280 - DNA, 18 bp, Artificial Sequence
  Synthetic DNA
ttatatgactcactaagg

SEQ ID NO: 28281 - DNA, 18 bp, Artificial Sequence
  Synthetic DNA
ttatcccgctcactatag

SEQ ID NO: 28282 - DNA, 18 bp, Artificial Sequence
  Synthetic DNA
ttatgccactcactatgg

SEQ ID NO: 28283 - DNA, 18 bp, Artificial Sequence
  Synthetic DNA
ttatgccgctcactatag

SEQ ID NO: 28284 - DNA, 18 bp, Artificial Sequence
  Synthetic DNA
ttatgcgactgaccatag

SEQ ID NO: 28285 - DNA, 18 bp, Artificial Sequence
  Synthetic DNA
ttctactactctctatag

SEQ ID NO: 28286 - DNA, 18 bp, Artificial Sequence
  Synthetic DNA
ttctaggaatcactatag

SEQ ID NO: 28287 - DNA, 18 bp, Artificial Sequence
  Synthetic DNA
ttgtaggactcacaatag

SEQ ID NO: 28288 - DNA, 18 bp, Artificial Sequence
  Synthetic DNA
tttgacgactaactatag

SEQ ID NO: 28289 - DNA, 18 bp, Artificial Sequence
  Synthetic DNA
ttttaccagtcactatag

SEQ ID NO: 28290 - DNA, 18 bp, Artificial Sequence
  Synthetic DNA
ttttacgaatctctatag

SEQ ID NO: 28291 - DNA, 18 bp, Artificial Sequence
  Synthetic DNA
ttttacgactgaatatag

SEQ ID NO: 28292 - DNA, 18 bp, Artificial Sequence
  Synthetic DNA
atttacgactcactttag

SEQ ID NO: 28293 - DNA, 18 bp, Artificial Sequence
  Synthetic DNA
tatttcgactctctttag

SEQ ID NO: 28294 - DNA, 18 bp, Artificial Sequence
  Synthetic DNA
ttaatcgactcactaaag

SEQ ID NO: 28295 - DNA, 18 bp, Artificial Sequence
  Synthetic DNA
aaattcaactcactattg

SEQ ID NO: 28296 - DNA, 18 bp, Artificial Sequence
  Synthetic DNA
ttaatcgtctcactatag

SEQ ID NO: 28297 - DNA, 18 bp, Artificial Sequence
  Synthetic DNA
ttaaacgtctcactttag

SEQ ID NO: 28298 - DNA, 18 bp, Artificial Sequence
  Synthetic DNA
ttatacgacacacaaaag

SEQ ID NO: 28299 - DNA, 18 bp, Artificial Sequence
  Synthetic DNA
taattcaactcaccattg

SEQ ID NO: 28300 - DNA, 18 bp, Artificial Sequence
  Synthetic DNA
tattacgacttgctattg

SEQ ID NO: 28301 - DNA, 18 bp, Artificial Sequence
  Synthetic DNA
aaatacgacacactaatg

SEQ ID NO: 28302 - DNA, 18 bp, Artificial Sequence
  Synthetic DNA
taaatctactcactttag

SEQ ID NO: 28303 - DNA, 18 bp, Artificial Sequence
  Synthetic DNA
taataagaatcactaatg

SEQ ID NO: 28304 - DNA, 18 bp, Artificial Sequence
  Synthetic DNA
taataggtcacactttag

SEQ ID NO: 28305 - DNA, 18 bp, Artificial Sequence
  Synthetic DNA
taattcggctcacttttg

SEQ ID NO: 28306 - DNA, 18 bp, Artificial Sequence
  Synthetic DNA
taatttgaatcactattg

SEQ ID NO: 28307 - DNA, 18 bp, Artificial Sequence
  Synthetic DNA
aaattagactcactatcg

SEQ ID NO: 28308 - DNA, 18 bp, Artificial Sequence
  Synthetic DNA
taaatcgacaaactatag

SEQ ID NO: 28309 - DNA, 18 bp, Artificial Sequence
  Synthetic DNA
taataagattctctattg

SEQ ID NO: 28310 - DNA, 18 bp, Artificial Sequence
  Synthetic DNA
taatacgacatacaattg

SEQ ID NO: 28311 - DNA, 18 bp, Artificial Sequence
  Synthetic DNA
taatacgactcagatttg

SEQ ID NO: 28312 - DNA, 18 bp, Artificial Sequence
  Synthetic DNA
taatatgattcattattg

SEQ ID NO: 28313 - DNA, 18 bp, Artificial Sequence
  Synthetic DNA
taattagactttctatag

SEQ ID NO: 28314 - DNA, 18 bp, Artificial Sequence
  Synthetic DNA
taattcaattcaatatag

SEQ ID NO: 28315 - DNA, 18 bp, Artificial Sequence
  Synthetic DNA
taattcgacacactaagg

SEQ ID NO: 28316 - DNA, 18 bp, Artificial Sequence
  Synthetic DNA
taattcgacactttatag

SEQ ID NO: 28317 - DNA, 18 bp, Artificial Sequence
  Synthetic DNA
tacttcgtctcactttag

SEQ ID NO: 28318 - DNA, 18 bp, Artificial Sequence
  Synthetic DNA
tatttcgcgtcactatag

SEQ ID NO: 28319 - DNA, 18 bp, Artificial Sequence
  Synthetic DNA
tcatacgcctctctattg

SEQ ID NO: 28320 - DNA, 18 bp, Artificial Sequence
  Synthetic DNA
tgattcgactcaatacag

SEQ ID NO: 28321 - DNA, 18 bp, Artificial Sequence
  Synthetic DNA
ttacacgactcacttttg

SEQ ID NO: 28322 - DNA, 18 bp, Artificial Sequence
  Synthetic DNA
ttttacgaatcactattg

SEQ ID NO: 28323 - DNA, 18 bp, Artificial Sequence
  Synthetic DNA
aaatataactcactaaag

SEQ ID NO: 28324 - DNA, 18 bp, Artificial Sequence
  Synthetic DNA
atataccactcaatatag

SEQ ID NO: 28325 - DNA, 18 bp, Artificial Sequence
  Synthetic DNA
atatacgactctatatag

SEQ ID NO: 28326 - DNA, 18 bp, Artificial Sequence
  Synthetic DNA
caataaaaatcactatag

SEQ ID NO: 28327 - DNA, 18 bp, Artificial Sequence
  Synthetic DNA
caatacgaatctctaaag

SEQ ID NO: 28328 - DNA, 18 bp, Artificial Sequence
  Synthetic DNA
caatacgtctaacaatag

SEQ ID NO: 28329 - DNA, 18 bp, Artificial Sequence
  Synthetic DNA
taaaacgattcacaatgg

SEQ ID NO: 28330 - DNA, 18 bp, Artificial Sequence
  Synthetic DNA
taacacgactctttttag

SEQ ID NO: 28331 - DNA, 18 bp, Artificial Sequence
  Synthetic DNA
taacacgtcttactaaag

SEQ ID NO: 28332 - DNA, 18 bp, Artificial Sequence
  Synthetic DNA
taatatgacacacaacag

SEQ ID NO: 28333 - DNA, 18 bp, Artificial Sequence
  Synthetic DNA
taatccgacatacaatag

SEQ ID NO: 28334 - DNA, 18 bp, Artificial Sequence
  Synthetic DNA
taatctgactctctaaag

SEQ ID NO: 28335 - DNA, 18 bp, Artificial Sequence
  Synthetic DNA
taatgcgattcacaaaag

SEQ ID NO: 28336 - DNA, 18 bp, Artificial Sequence
  Synthetic DNA
tacaaagactcactaaag

SEQ ID NO: 28337 - DNA, 18 bp, Artificial Sequence
  Synthetic DNA
tactactacacactaaag

SEQ ID NO: 28338 - DNA, 18 bp, Artificial Sequence
  Synthetic DNA
tagtacgattctcaatag

SEQ ID NO: 28339 - DNA, 18 bp, Artificial Sequence
  Synthetic DNA
tagtacgtcacactttag

SEQ ID NO: 28340 - DNA, 18 bp, Artificial Sequence
  Synthetic DNA
tattaatactcaccatag

SEQ ID NO: 28341 - DNA, 18 bp, Artificial Sequence
  Synthetic DNA
tattacgactgtctaaag

SEQ ID NO: 28342 - DNA, 18 bp, Artificial Sequence
  Synthetic DNA
tattacgtcagactatag

SEQ ID NO: 28343 - DNA, 18 bp, Artificial Sequence
  Synthetic DNA
tattattactcacaatag

SEQ ID NO: 28344 - DNA, 18 bp, Artificial Sequence
  Synthetic DNA
tattctgtctcactatag

SEQ ID NO: 28345 - DNA, 18 bp, Artificial Sequence
  Synthetic DNA
tgttacgaatcacaatag

SEQ ID NO: 28346 - DNA, 18 bp, Artificial Sequence
  Synthetic DNA
ttaaactactcaatatag

SEQ ID NO: 28347 - DNA, 18 bp, Artificial Sequence
  Synthetic DNA
ttacacgaatcacaatag

SEQ ID NO: 28348 - DNA, 18 bp, Artificial Sequence
  Synthetic DNA
ttatacatctcaatatag

SEQ ID NO: 28349 - DNA, 18 bp, Artificial Sequence
  Synthetic DNA
ttatataactcactatcg

SEQ ID NO: 28350 - DNA, 18 bp, Artificial Sequence
  Synthetic DNA
atataagactcactttag

SEQ ID NO: 28351 - DNA, 18 bp, Artificial Sequence
  Synthetic DNA
aaattctactcactattg

SEQ ID NO: 28352 - DNA, 18 bp, Artificial Sequence
  Synthetic DNA
taattctgctcactattg

SEQ ID NO: 28353 - DNA, 18 bp, Artificial Sequence
  Synthetic DNA
taattcgacactatatag

SEQ ID NO: 28354 - DNA, 18 bp, Artificial Sequence
  Synthetic DNA
aataacgtctcactatag

SEQ ID NO: 28355 - DNA, 18 bp, Artificial Sequence
  Synthetic DNA
ttatacatctcactacag

SEQ ID NO: 28356 - DNA, 18 bp, Artificial Sequence
  Synthetic DNA
ttattcgacatactatag

SEQ ID NO: 28357 - DNA, 18 bp, Artificial Sequence
  Synthetic DNA
aaatacgactcgctaatg

SEQ ID NO: 28358 - DNA, 18 bp, Artificial Sequence
  Synthetic DNA
taaatcgactcgcaatag

SEQ ID NO: 28359 - DNA, 18 bp, Artificial Sequence
  Synthetic DNA
taatacaactagctattg

SEQ ID NO: 28360 - DNA, 18 bp, Artificial Sequence
  Synthetic DNA
taatacaactcgcttttg

SEQ ID NO: 28361 - DNA, 18 bp, Artificial Sequence
  Synthetic DNA
taattcaattcgctatag

SEQ ID NO: 28362 - DNA, 18 bp, Artificial Sequence
  Synthetic DNA
taattccactaactattg

SEQ ID NO: 28363 - DNA, 18 bp, Artificial Sequence
  Synthetic DNA
taattcgactatctattg

SEQ ID NO: 28364 - DNA, 18 bp, Artificial Sequence
  Synthetic DNA
taattcgacttacaattg

SEQ ID NO: 28365 - DNA, 18 bp, Artificial Sequence
  Synthetic DNA
taattcgagtcgcaatag

SEQ ID NO: 28366 - DNA, 18 bp, Artificial Sequence
  Synthetic DNA
taattcgattcactgttg

SEQ ID NO: 28367 - DNA, 18 bp, Artificial Sequence
  Synthetic DNA
taatttgactcaccattg

SEQ ID NO: 28368 - DNA, 18 bp, Artificial Sequence
  Synthetic DNA
taatttgactcattattg

SEQ ID NO: 28369 - DNA, 18 bp, Artificial Sequence
  Synthetic DNA
tattacgacccgctattg

SEQ ID NO: 28370 - DNA, 18 bp, Artificial Sequence
  Synthetic DNA
tgattcgattcactattg

SEQ ID NO: 28371 - DNA, 18 bp, Artificial Sequence
  Synthetic DNA
aaaaacgactaactattg

SEQ ID NO: 28372 - DNA, 18 bp, Artificial Sequence
  Synthetic DNA
aaatacgactcagaattg

SEQ ID NO: 28373 - DNA, 18 bp, Artificial Sequence
  Synthetic DNA
aaatacgtctcgatatag

SEQ ID NO: 28374 - DNA, 18 bp, Artificial Sequence
  Synthetic DNA
aaatactacccgctatag

SEQ ID NO: 28375 - DNA, 18 bp, Artificial Sequence
  Synthetic DNA
aaattcgacacactatgg

SEQ ID NO: 28376 - DNA, 18 bp, Artificial Sequence
  Synthetic DNA
aaattcgactcactaacg

SEQ ID NO: 28377 - DNA, 18 bp, Artificial Sequence
  Synthetic DNA
aaattctactcactacag

SEQ ID NO: 28378 - DNA, 18 bp, Artificial Sequence
  Synthetic DNA
aactacggctcactattg

SEQ ID NO: 28379 - DNA, 18 bp, Artificial Sequence
  Synthetic DNA
aattacgactcgctctag

SEQ ID NO: 28380 - DNA, 18 bp, Artificial Sequence
  Synthetic DNA
caaaacgattcactattg

SEQ ID NO: 28381 - DNA, 18 bp, Artificial Sequence
  Synthetic DNA
caataagactcacttttg

SEQ ID NO: 28382 - DNA, 18 bp, Artificial Sequence
  Synthetic DNA
caattagactcactctag

SEQ ID NO: 28383 - DNA, 18 bp, Artificial Sequence
  Synthetic DNA
caattcgagtctctatag

SEQ ID NO: 28384 - DNA, 18 bp, Artificial Sequence
  Synthetic DNA
caattcgtctcactgtag

SEQ ID NO: 28385 - DNA, 18 bp, Artificial Sequence
  Synthetic DNA
caattctcctcactatag

SEQ ID NO: 28386 - DNA, 18 bp, Artificial Sequence
  Synthetic DNA
caatttgacttactatag

SEQ ID NO: 28387 - DNA, 18 bp, Artificial Sequence
  Synthetic DNA
catttcgacttactatag

SEQ ID NO: 28388 - DNA, 18 bp, Artificial Sequence
  Synthetic DNA
gaatctgactcactattg

SEQ ID NO: 28389 - DNA, 18 bp, Artificial Sequence
  Synthetic DNA
gtatacgactcgctacag

SEQ ID NO: 28390 - DNA, 18 bp, Artificial Sequence
  Synthetic DNA
taaaaagacacactattg

SEQ ID NO: 28391 - DNA, 18 bp, Artificial Sequence
  Synthetic DNA
taaaaagtctcactattg

SEQ ID NO: 28392 - DNA, 18 bp, Artificial Sequence
  Synthetic DNA
taaaacgacccactactg

SEQ ID NO: 28393 - DNA, 18 bp, Artificial Sequence
  Synthetic DNA
taaaacgactcactgatg

SEQ ID NO: 28394 - DNA, 18 bp, Artificial Sequence
  Synthetic DNA
taaaacgactctatattg

SEQ ID NO: 28395 - DNA, 18 bp, Artificial Sequence
  Synthetic DNA
taaaacgtctcgctaaag

SEQ ID NO: 28396 - DNA, 18 bp, Artificial Sequence
  Synthetic DNA
taaaaggactcacgattg

SEQ ID NO: 28397 - DNA, 18 bp, Artificial Sequence
  Synthetic DNA
taaaatgacccactattg

SEQ ID NO: 28398 - DNA, 18 bp, Artificial Sequence
  Synthetic DNA
taaatccacttactatag

SEQ ID NO: 28399 - DNA, 18 bp, Artificial Sequence
  Synthetic DNA
taaatcgactaactatgg

SEQ ID NO: 28400 - DNA, 18 bp, Artificial Sequence
  Synthetic DNA
taaatcgactcactctgg

SEQ ID NO: 28401 - DNA, 18 bp, Artificial Sequence
  Synthetic DNA
taaatcggctcactaaag

SEQ ID NO: 28402 - DNA, 18 bp, Artificial Sequence
  Synthetic DNA
taaatctactcactacag

SEQ ID NO: 28403 - DNA, 18 bp, Artificial Sequence
  Synthetic DNA
taactcgatttactatag

SEQ ID NO: 28404 - DNA, 18 bp, Artificial Sequence
  Synthetic DNA
taagacgactcacaaatg

SEQ ID NO: 28405 - DNA, 18 bp, Artificial Sequence
  Synthetic DNA
taataactctcactattg

SEQ ID NO: 28406 - DNA, 18 bp, Artificial Sequence
  Synthetic DNA
taataagacttacaattg

SEQ ID NO: 28407 - DNA, 18 bp, Artificial Sequence
  Synthetic DNA
taatacaacccactaatg

SEQ ID NO: 28408 - DNA, 18 bp, Artificial Sequence
  Synthetic DNA
taatacaacgcactaatg

SEQ ID NO: 28409 - DNA, 18 bp, Artificial Sequence
  Synthetic DNA
taatacaacttgcaatag

SEQ ID NO: 28410 - DNA, 18 bp, Artificial Sequence
  Synthetic DNA
taataccactaaatattg

SEQ ID NO: 28411 - DNA, 18 bp, Artificial Sequence
  Synthetic DNA
taatacgactctataatg

SEQ ID NO: 28412 - DNA, 18 bp, Artificial Sequence
  Synthetic DNA
taatacgacttaaaattg

SEQ ID NO: 28413 - DNA, 18 bp, Artificial Sequence
  Synthetic DNA
taatacgagccaccattg

SEQ ID NO: 28414 - DNA, 18 bp, Artificial Sequence
  Synthetic DNA
taatacgcctcaattttg

SEQ ID NO: 28415 - DNA, 18 bp, Artificial Sequence
  Synthetic DNA
taatacgcttcgctaaag

SEQ ID NO: 28416 - DNA, 18 bp, Artificial Sequence
  Synthetic DNA
taatacgtctcataattg

SEQ ID NO: 28417 - DNA, 18 bp, Artificial Sequence
  Synthetic DNA
taatacgtctctctagtg

SEQ ID NO: 28418 - DNA, 18 bp, Artificial Sequence
  Synthetic DNA
taatacgtctctctcttg

SEQ ID NO: 28419 - DNA, 18 bp, Artificial Sequence
  Synthetic DNA
taatacgtcttcctattg

SEQ ID NO: 28420 - DNA, 18 bp, Artificial Sequence
  Synthetic DNA
taatacgtgtcattattg

SEQ ID NO: 28421 - DNA, 18 bp, Artificial Sequence
  Synthetic DNA
taatactacttactaatg

SEQ ID NO: 28422 - DNA, 18 bp, Artificial Sequence
  Synthetic DNA
taataggacttactaatg

SEQ ID NO: 28423 - DNA, 18 bp, Artificial Sequence
  Synthetic DNA
taatataactaactattg

SEQ ID NO: 28424 - DNA, 18 bp, Artificial Sequence
  Synthetic DNA
taatataattcactattg

SEQ ID NO: 28425 - DNA, 18 bp, Artificial Sequence
  Synthetic DNA
taatatgactcaccaatg

SEQ ID NO: 28426 - DNA, 18 bp, Artificial Sequence
  Synthetic DNA
taatatgactcacttatg

SEQ ID NO: 28427 - DNA, 18 bp, Artificial Sequence
  Synthetic DNA
taatatgattccctattg

SEQ ID NO: 28428 - DNA, 18 bp, Artificial Sequence
  Synthetic DNA
taatattacttactattg

SEQ ID NO: 28429 - DNA, 18 bp, Artificial Sequence
  Synthetic DNA
taatcccactcactaatg

SEQ ID NO: 28430 - DNA, 18 bp, Artificial Sequence
  Synthetic DNA
taatccgactcgaaatag

SEQ ID NO: 28431 - DNA, 18 bp, Artificial Sequence
  Synthetic DNA
taatccgactgattattg

SEQ ID NO: 28432 - DNA, 18 bp, Artificial Sequence
  Synthetic DNA
taatgcgtctcattattg

SEQ ID NO: 28433 - DNA, 18 bp, Artificial Sequence
  Synthetic DNA
taattagacacactgtag

SEQ ID NO: 28434 - DNA, 18 bp, Artificial Sequence
  Synthetic DNA
taattagacttactgtag

SEQ ID NO: 28435 - DNA, 18 bp, Artificial Sequence
  Synthetic DNA
taattagcctcacaatag

SEQ ID NO: 28436 - DNA, 18 bp, Artificial Sequence
  Synthetic DNA
taattcaaatcactacag

SEQ ID NO: 28437 - DNA, 18 bp, Artificial Sequence
  Synthetic DNA
taattcaactcacactag

SEQ ID NO: 28438 - DNA, 18 bp, Artificial Sequence
  Synthetic DNA
taattcaacttactttag

SEQ ID NO: 28439 - DNA, 18 bp, Artificial Sequence
  Synthetic DNA
taattccactcactcaag

SEQ ID NO: 28440 - DNA, 18 bp, Artificial Sequence
  Synthetic DNA
taattccactcataatag

SEQ ID NO: 28441 - DNA, 18 bp, Artificial Sequence
  Synthetic DNA
taattccattcactacag

SEQ ID NO: 28442 - DNA, 18 bp, Artificial Sequence
  Synthetic DNA
taattcctctcactatgg

SEQ ID NO: 28443 - DNA, 18 bp, Artificial Sequence
  Synthetic DNA
taattcgaatcaccaaag

SEQ ID NO: 28444 - DNA, 18 bp, Artificial Sequence
  Synthetic DNA
taattcgaatttctatag

SEQ ID NO: 28445 - DNA, 18 bp, Artificial Sequence
  Synthetic DNA
taattcgaccaacaatag

SEQ ID NO: 28446 - DNA, 18 bp, Artificial Sequence
  Synthetic DNA
taattcgaccgaatatag

SEQ ID NO: 28447 - DNA, 18 bp, Artificial Sequence
  Synthetic DNA
taattcgatactctatag

SEQ ID NO: 28448 - DNA, 18 bp, Artificial Sequence
  Synthetic DNA
taattcggttcacaatag

SEQ ID NO: 28449 - DNA, 18 bp, Artificial Sequence
  Synthetic DNA
taattcgtctccctaaag

SEQ ID NO: 28450 - DNA, 18 bp, Artificial Sequence
  Synthetic DNA
taattcgtctccctttag

SEQ ID NO: 28451 - DNA, 18 bp, Artificial Sequence
  Synthetic DNA
taattcgtttcactgtag

SEQ ID NO: 28452 - DNA, 18 bp, Artificial Sequence
  Synthetic DNA
taattctacacactacag

SEQ ID NO: 28453 - DNA, 18 bp, Artificial Sequence
  Synthetic DNA
taatttgactaattatag

SEQ ID NO: 28454 - DNA, 18 bp, Artificial Sequence
  Synthetic DNA
taatttgacttacaatag

SEQ ID NO: 28455 - DNA, 18 bp, Artificial Sequence
  Synthetic DNA
tactaagactgactattg

SEQ ID NO: 28456 - DNA, 18 bp, Artificial Sequence
  Synthetic DNA
tactatgattcactattg

SEQ ID NO: 28457 - DNA, 18 bp, Artificial Sequence
  Synthetic DNA
tagatcgactaactatag

SEQ ID NO: 28458 - DNA, 18 bp, Artificial Sequence
  Synthetic DNA
tagttcgaatcattatag

SEQ ID NO: 28459 - DNA, 18 bp, Artificial Sequence
  Synthetic DNA
tagttcgactctctttag

SEQ ID NO: 28460 - DNA, 18 bp, Artificial Sequence
  Synthetic DNA
tagttcgattcactttag

SEQ ID NO: 28461 - DNA, 18 bp, Artificial Sequence
  Synthetic DNA
tatatcgacgcactatag

SEQ ID NO: 28462 - DNA, 18 bp, Artificial Sequence
  Synthetic DNA
tattacgacttaatattg

SEQ ID NO: 28463 - DNA, 18 bp, Artificial Sequence
  Synthetic DNA
tattacgatccgctatag

SEQ ID NO: 28464 - DNA, 18 bp, Artificial Sequence
  Synthetic DNA
tatttcgactaaatatag

SEQ ID NO: 28465 - DNA, 18 bp, Artificial Sequence
  Synthetic DNA
tatttcgtcccactatag

SEQ ID NO: 28466 - DNA, 18 bp, Artificial Sequence
  Synthetic DNA
tcataagacttactattg

SEQ ID NO: 28467 - DNA, 18 bp, Artificial Sequence
  Synthetic DNA
tcatacgaattactattg

SEQ ID NO: 28468 - DNA, 18 bp, Artificial Sequence
  Synthetic DNA
tcattccaatcactatag

SEQ ID NO: 28469 - DNA, 18 bp, Artificial Sequence
  Synthetic DNA
tcattccagtcactatag

SEQ ID NO: 28470 - DNA, 18 bp, Artificial Sequence
  Synthetic DNA
tcattcgaatcactaaag

SEQ ID NO: 28471 - DNA, 18 bp, Artificial Sequence
  Synthetic DNA
tcattcgacaaactatag

SEQ ID NO: 28472 - DNA, 18 bp, Artificial Sequence
  Synthetic DNA
tgaaacgactcacttttg

SEQ ID NO: 28473 - DNA, 18 bp, Artificial Sequence
  Synthetic DNA
tgactcgactaactatag

SEQ ID NO: 28474 - DNA, 18 bp, Artificial Sequence
  Synthetic DNA
tgatactactcgctacag

SEQ ID NO: 28475 - DNA, 18 bp, Artificial Sequence
  Synthetic DNA
tgatatcactcactattg

SEQ ID NO: 28476 - DNA, 18 bp, Artificial Sequence
  Synthetic DNA
tgattcgactcaatttag

SEQ ID NO: 28477 - DNA, 18 bp, Artificial Sequence
  Synthetic DNA
tgattggattcactatag

SEQ ID NO: 28478 - DNA, 18 bp, Artificial Sequence
  Synthetic DNA
ttacacgactctctattg

SEQ ID NO: 28479 - DNA, 18 bp, Artificial Sequence
  Synthetic DNA
ttactcgaatcactatag

SEQ ID NO: 28480 - DNA, 18 bp, Artificial Sequence
  Synthetic DNA
ttagacgactcactaatg

SEQ ID NO: 28481 - DNA, 18 bp, Artificial Sequence
  Synthetic DNA
ttatacaaatcactattg

SEQ ID NO: 28482 - DNA, 18 bp, Artificial Sequence
  Synthetic DNA
ttataccacttactattg

SEQ ID NO: 28483 - DNA, 18 bp, Artificial Sequence
  Synthetic DNA
ttatacgaatcactcttg

SEQ ID NO: 28484 - DNA, 18 bp, Artificial Sequence
  Synthetic DNA
ttatacgactaaatattg

SEQ ID NO: 28485 - DNA, 18 bp, Artificial Sequence
  Synthetic DNA
ttatacgagtcaccattg

SEQ ID NO: 28486 - DNA, 18 bp, Artificial Sequence
  Synthetic DNA
ttatacgatttgctatag

SEQ ID NO: 28487 - DNA, 18 bp, Artificial Sequence
  Synthetic DNA
ttatccgactcactaatg

SEQ ID NO: 28488 - DNA, 18 bp, Artificial Sequence
  Synthetic DNA
ttatccggctcactattg

SEQ ID NO: 28489 - DNA, 18 bp, Artificial Sequence
  Synthetic DNA
ttattccagtcactatag

SEQ ID NO: 28490 - DNA, 18 bp, Artificial Sequence
  Synthetic DNA
ttattcgtctcagtatag

SEQ ID NO: 28491 - DNA, 18 bp, Artificial Sequence
  Synthetic DNA
ttattctaatcactatag

SEQ ID NO: 28492 - DNA, 18 bp, Artificial Sequence
  Synthetic DNA
ttattggactcacaatag

SEQ ID NO: 28493 - DNA, 18 bp, Artificial Sequence
  Synthetic DNA
ttatttgactcattatag

SEQ ID NO: 28494 - DNA, 18 bp, Artificial Sequence
  Synthetic DNA
ttttacgactcggtatag

SEQ ID NO: 28495 - DNA, 18 bp, Artificial Sequence
  Synthetic DNA
aaaaacgactaattatag

SEQ ID NO: 28496 - DNA, 18 bp, Artificial Sequence
  Synthetic DNA
aaaaacgactcacttaag

SEQ ID NO: 28497 - DNA, 18 bp, Artificial Sequence
  Synthetic DNA
aaacacgactcagaatag

SEQ ID NO: 28498 - DNA, 18 bp, Artificial Sequence
  Synthetic DNA
aaacacgccacactatag

SEQ ID NO: 28499 - DNA, 18 bp, Artificial Sequence
  Synthetic DNA
aaacacgtatcactatag

SEQ ID NO: 28500 - DNA, 18 bp, Artificial Sequence
  Synthetic DNA
aaacactactcacaatag

SEQ ID NO: 28501 - DNA, 18 bp, Artificial Sequence
  Synthetic DNA
aaataagacacactatgg

SEQ ID NO: 28502 - DNA, 18 bp, Artificial Sequence
  Synthetic DNA
aaatacatctcaccatag

SEQ ID NO: 28503 - DNA, 18 bp, Artificial Sequence
  Synthetic DNA
aaataccactgaccatag

SEQ ID NO: 28504 - DNA, 18 bp, Artificial Sequence
  Synthetic DNA
aaatacgaatcacttaag

SEQ ID NO: 28505 - DNA, 18 bp, Artificial Sequence
  Synthetic DNA
aaatacgacacacgaaag

SEQ ID NO: 28506 - DNA, 18 bp, Artificial Sequence
  Synthetic DNA
aaatacgacacattaaag

SEQ ID NO: 28507 - DNA, 18 bp, Artificial Sequence
  Synthetic DNA
aaatacgaccctccatag

SEQ ID NO: 28508 - DNA, 18 bp, Artificial Sequence
  Synthetic DNA
aaatacgactatctctag

SEQ ID NO: 28509 - DNA, 18 bp, Artificial Sequence
  Synthetic DNA
aaatacgactcaaaagag

SEQ ID NO: 28510 - DNA, 18 bp, Artificial Sequence
  Synthetic DNA
aaatacgactcaaattag

SEQ ID NO: 28511 - DNA, 18 bp, Artificial Sequence
  Synthetic DNA
aaatacgactcaacgtag

SEQ ID NO: 28512 - DNA, 18 bp, Artificial Sequence
  Synthetic DNA
aaatacgactcattgaag

SEQ ID NO: 28513 - DNA, 18 bp, Artificial Sequence
  Synthetic DNA
aaatacgatacactatcg

SEQ ID NO: 28514 - DNA, 18 bp, Artificial Sequence
  Synthetic DNA
aaatacgatacactgtag

SEQ ID NO: 28515 - DNA, 18 bp, Artificial Sequence
  Synthetic DNA
aaatacgtcacaatatag

SEQ ID NO: 28516 - DNA, 18 bp, Artificial Sequence
  Synthetic DNA
aaatacgtcacactaaag

SEQ ID NO: 28517 - DNA, 18 bp, Artificial Sequence
  Synthetic DNA
aaatacgtctcaccttag

SEQ ID NO: 28518 - DNA, 18 bp, Artificial Sequence
  Synthetic DNA
aaatacgtcttacaatag

SEQ ID NO: 28519 - DNA, 18 bp, Artificial Sequence
  Synthetic DNA
aaatactactcactgcag

SEQ ID NO: 28520 - DNA, 18 bp, Artificial Sequence
  Synthetic DNA
aaatactagtcactatcg

SEQ ID NO: 28521 - DNA, 18 bp, Artificial Sequence
  Synthetic DNA
aaatatgaatcactacag

SEQ ID NO: 28522 - DNA, 18 bp, Artificial Sequence
  Synthetic DNA
aaatccgacacacaatag

SEQ ID NO: 28523 - DNA, 18 bp, Artificial Sequence
  Synthetic DNA
aaatccgtatcactatag

SEQ ID NO: 28524 - DNA, 18 bp, Artificial Sequence
  Synthetic DNA
aaatgaaactcactatag

SEQ ID NO: 28525 - DNA, 18 bp, Artificial Sequence
  Synthetic DNA
aaatgcaactcactaaag

SEQ ID NO: 28526 - DNA, 18 bp, Artificial Sequence
  Synthetic DNA
aaatgcgtctcactttag

SEQ ID NO: 28527 - DNA, 18 bp, Artificial Sequence
  Synthetic DNA
aaccacgactcacgatag

SEQ ID NO: 28528 - DNA, 18 bp, Artificial Sequence
  Synthetic DNA
aagaacgacccactatag

SEQ ID NO: 28529 - DNA, 18 bp, Artificial Sequence
  Synthetic DNA
aagtacgtcttactatag

SEQ ID NO: 28530 - DNA, 18 bp, Artificial Sequence
  Synthetic DNA
aagtactacttactatag

SEQ ID NO: 28531 - DNA, 18 bp, Artificial Sequence
  Synthetic DNA
aattacaactaactatag

SEQ ID NO: 28532 - DNA, 18 bp, Artificial Sequence
  Synthetic DNA
aattaccactctctatag

SEQ ID NO: 28533 - DNA, 18 bp, Artificial Sequence
  Synthetic DNA
aattacgactcataatag

SEQ ID NO: 28534 - DNA, 18 bp, Artificial Sequence
  Synthetic DNA
aattccgtctcactatag

SEQ ID NO: 28535 - DNA, 18 bp, Artificial Sequence
  Synthetic DNA
aattgcgactcacaatag

SEQ ID NO: 28536 - DNA, 18 bp, Artificial Sequence
  Synthetic DNA
acataagtctcactatag

SEQ ID NO: 28537 - DNA, 18 bp, Artificial Sequence
  Synthetic DNA
acatacaactctctatag

SEQ ID NO: 28538 - DNA, 18 bp, Artificial Sequence
  Synthetic DNA
acatacgactccctagag

SEQ ID NO: 28539 - DNA, 18 bp, Artificial Sequence
  Synthetic DNA
acatacgattcactgtag

SEQ ID NO: 28540 - DNA, 18 bp, Artificial Sequence
  Synthetic DNA
acatgcgactcacaatag

SEQ ID NO: 28541 - DNA, 18 bp, Artificial Sequence
  Synthetic DNA
acttactactcactatag

SEQ ID NO: 28542 - DNA, 18 bp, Artificial Sequence
  Synthetic DNA
atagccgactcactatag

SEQ ID NO: 28543 - DNA, 18 bp, Artificial Sequence
  Synthetic DNA
atatacaactctctatag

SEQ ID NO: 28544 - DNA, 18 bp, Artificial Sequence
  Synthetic DNA
atatacgaatcactacag

SEQ ID NO: 28545 - DNA, 18 bp, Artificial Sequence
  Synthetic DNA
atatgcgactaactatag

SEQ ID NO: 28546 - DNA, 18 bp, Artificial Sequence
  Synthetic DNA
atttacgactaactatag

SEQ ID NO: 28547 - DNA, 18 bp, Artificial Sequence
  Synthetic DNA
atttacggctcactatag

SEQ ID NO: 28548 - DNA, 18 bp, Artificial Sequence
  Synthetic DNA
caataagtcacactatag

SEQ ID NO: 28549 - DNA, 18 bp, Artificial Sequence
  Synthetic DNA
caataatacacactatag

SEQ ID NO: 28550 - DNA, 18 bp, Artificial Sequence
  Synthetic DNA
caatacaaatcactttag

SEQ ID NO: 28551 - DNA, 18 bp, Artificial Sequence
  Synthetic DNA
caatacaacatactatag

SEQ ID NO: 28552 - DNA, 18 bp, Artificial Sequence
  Synthetic DNA
caatacgactctcttaag

SEQ ID NO: 28553 - DNA, 18 bp, Artificial Sequence
  Synthetic DNA
caatacgacttactaacg

SEQ ID NO: 28554 - DNA, 18 bp, Artificial Sequence
  Synthetic DNA
caatacgcctcaccaaag

SEQ ID NO: 28555 - DNA, 18 bp, Artificial Sequence
  Synthetic DNA
caatacgtctcactaacg

SEQ ID NO: 28556 - DNA, 18 bp, Artificial Sequence
  Synthetic DNA
caatatgtctcactaaag

SEQ ID NO: 28557 - DNA, 18 bp, Artificial Sequence
  Synthetic DNA
caatgagactcactaaag

SEQ ID NO: 28558 - DNA, 18 bp, Artificial Sequence
  Synthetic DNA
caatgcgagtcactatgg

SEQ ID NO: 28559 - DNA, 18 bp, Artificial Sequence
  Synthetic DNA
caatgcgattcaccatag

SEQ ID NO: 28560 - DNA, 18 bp, Artificial Sequence
  Synthetic DNA
cactacgacttactttag

SEQ ID NO: 28561 - DNA, 18 bp, Artificial Sequence
  Synthetic DNA
cagtacgaatcactttag

SEQ ID NO: 28562 - DNA, 18 bp, Artificial Sequence
  Synthetic DNA
cattacgacttattatag

SEQ ID NO: 28563 - DNA, 18 bp, Artificial Sequence
  Synthetic DNA
cattaggactctctatag

SEQ ID NO: 28564 - DNA, 18 bp, Artificial Sequence
  Synthetic DNA
cattaggtctcactatag

SEQ ID NO: 28565 - DNA, 18 bp, Artificial Sequence
  Synthetic DNA
ccatacgactaactaaag

SEQ ID NO: 28566 - DNA, 18 bp, Artificial Sequence
  Synthetic DNA
ctataagtctcactatag

SEQ ID NO: 28567 - DNA, 18 bp, Artificial Sequence
  Synthetic DNA
ctatacgcttcactatag

SEQ ID NO: 28568 - DNA, 18 bp, Artificial Sequence
  Synthetic DNA
gaaaacgactcatgatag

SEQ ID NO: 28569 - DNA, 18 bp, Artificial Sequence
  Synthetic DNA
gaatacgacactctttag

SEQ ID NO: 28570 - DNA, 18 bp, Artificial Sequence
  Synthetic DNA
gaatactacttactaaag

SEQ ID NO: 28571 - DNA, 18 bp, Artificial Sequence
  Synthetic DNA
gagtaagtctcactatag

SEQ ID NO: 28572 - DNA, 18 bp, Artificial Sequence
  Synthetic DNA
gtatacgattcattatag

SEQ ID NO: 28573 - DNA, 18 bp, Artificial Sequence
  Synthetic DNA
taaaaagacccattatag

SEQ ID NO: 28574 - DNA, 18 bp, Artificial Sequence
  Synthetic DNA
taaaacatcacactatag

SEQ ID NO: 28575 - DNA, 18 bp, Artificial Sequence
  Synthetic DNA
taaaacgaaacactctag

SEQ ID NO: 28576 - DNA, 18 bp, Artificial Sequence
  Synthetic DNA
taaaacgacacattatgg

SEQ ID NO: 28577 - DNA, 18 bp, Artificial Sequence
  Synthetic DNA
taaaacgaccctctatcg

SEQ ID NO: 28578 - DNA, 18 bp, Artificial Sequence
  Synthetic DNA
taaaacgactcaaattag

SEQ ID NO: 28579 - DNA, 18 bp, Artificial Sequence
  Synthetic DNA
taaaacgactccatacag

SEQ ID NO: 28580 - DNA, 18 bp, Artificial Sequence
  Synthetic DNA
taaaacgactccgtttag

SEQ ID NO: 28581 - DNA, 18 bp, Artificial Sequence
  Synthetic DNA
taaaacgactctctaacg

SEQ ID NO: 28582 - DNA, 18 bp, Artificial Sequence
  Synthetic DNA
taaaacgactttctgtag

SEQ ID NO: 28583 - DNA, 18 bp, Artificial Sequence
  Synthetic DNA
taaaacgatccacaatag

SEQ ID NO: 28584 - DNA, 18 bp, Artificial Sequence
  Synthetic DNA
taaaacgatgcactacag

SEQ ID NO: 28585 - DNA, 18 bp, Artificial Sequence
  Synthetic DNA
taaaacgattctccatag

SEQ ID NO: 28586 - DNA, 18 bp, Artificial Sequence
  Synthetic DNA
taaaacgcctcattgtag

SEQ ID NO: 28587 - DNA, 18 bp, Artificial Sequence
  Synthetic DNA
taaaacgcctccctatgg

SEQ ID NO: 28588 - DNA, 18 bp, Artificial Sequence
  Synthetic DNA
taaaacggctacctatag

SEQ ID NO: 28589 - DNA, 18 bp, Artificial Sequence
  Synthetic DNA
taaaacggttcaccatag

SEQ ID NO: 28590 - DNA, 18 bp, Artificial Sequence
  Synthetic DNA
taaaactactcacaacag

SEQ ID NO: 28591 - DNA, 18 bp, Artificial Sequence
  Synthetic DNA
taaaactactcaccacag

SEQ ID NO: 28592 - DNA, 18 bp, Artificial Sequence
  Synthetic DNA
taaaactactctctgtag

SEQ ID NO: 28593 - DNA, 18 bp, Artificial Sequence
  Synthetic DNA
taaaactacttaatatag

SEQ ID NO: 28594 - DNA, 18 bp, Artificial Sequence
  Synthetic DNA
taaaaggactcattttag

SEQ ID NO: 28595 - DNA, 18 bp, Artificial Sequence
  Synthetic DNA
taaaaggagtcactttag

SEQ ID NO: 28596 - DNA, 18 bp, Artificial Sequence
  Synthetic DNA
taaaagtactaactatag

SEQ ID NO: 28597 - DNA, 18 bp, Artificial Sequence
  Synthetic DNA
taaaatgactctctttag

SEQ ID NO: 28598 - DNA, 18 bp, Artificial Sequence
  Synthetic DNA
taaaccgactcataatag

SEQ ID NO: 28599 - DNA, 18 bp, Artificial Sequence
  Synthetic DNA
taaaccgtcacactatag

SEQ ID NO: 28600 - DNA, 18 bp, Artificial Sequence
  Synthetic DNA
taaagccactcactaaag

SEQ ID NO: 28601 - DNA, 18 bp, Artificial Sequence
  Synthetic DNA
taaagcgactcaataaag

SEQ ID NO: 28602 - DNA, 18 bp, Artificial Sequence
  Synthetic DNA
taaagtgactcactacag

SEQ ID NO: 28603 - DNA, 18 bp, Artificial Sequence
  Synthetic DNA
taaagtgactcactttag

SEQ ID NO: 28604 - DNA, 18 bp, Artificial Sequence
  Synthetic DNA
taacaccactccatatag

SEQ ID NO: 28605 - DNA, 18 bp, Artificial Sequence
  Synthetic DNA
taacacgactcattaacg

SEQ ID NO: 28606 - DNA, 18 bp, Artificial Sequence
  Synthetic DNA
taacacgtctcactgaag

SEQ ID NO: 28607 - DNA, 18 bp, Artificial Sequence
  Synthetic DNA
taacattactctctatag

SEQ ID NO: 28608 - DNA, 18 bp, Artificial Sequence
  Synthetic DNA
taagacgacttataatag

SEQ ID NO: 28609 - DNA, 18 bp, Artificial Sequence
  Synthetic DNA
taataaaacacattatag

SEQ ID NO: 28610 - DNA, 18 bp, Artificial Sequence
  Synthetic DNA
taataaaacccactttag

SEQ ID NO: 28611 - DNA, 18 bp, Artificial Sequence
  Synthetic DNA
taataaacctcactaaag

SEQ ID NO: 28612 - DNA, 18 bp, Artificial Sequence
  Synthetic DNA
taataagaatctctaaag

SEQ ID NO: 28613 - DNA, 18 bp, Artificial Sequence
  Synthetic DNA
taataagacacactaccg

SEQ ID NO: 28614 - DNA, 18 bp, Artificial Sequence
  Synthetic DNA
taataagactgtatatag

SEQ ID NO: 28615 - DNA, 18 bp, Artificial Sequence
  Synthetic DNA
taataagagtaactaaag

SEQ ID NO: 28616 - DNA, 18 bp, Artificial Sequence
  Synthetic DNA
taataagtcactctatag

SEQ ID NO: 28617 - DNA, 18 bp, Artificial Sequence
  Synthetic DNA
taataagtcttcctatag

SEQ ID NO: 28618 - DNA, 18 bp, Artificial Sequence
  Synthetic DNA
taataagtgacactatag

SEQ ID NO: 28619 - DNA, 18 bp, Artificial Sequence
  Synthetic DNA
taataagtgtaactatag

SEQ ID NO: 28620 - DNA, 18 bp, Artificial Sequence
  Synthetic DNA
taatacaactctctgaag

SEQ ID NO: 28621 - DNA, 18 bp, Artificial Sequence
  Synthetic DNA
taatacaattcaaaatag

SEQ ID NO: 28622 - DNA, 18 bp, Artificial Sequence
  Synthetic DNA
taatacaatttactttag

SEQ ID NO: 28623 - DNA, 18 bp, Artificial Sequence
  Synthetic DNA
taatacagcttagtatag

SEQ ID NO: 28624 - DNA, 18 bp, Artificial Sequence
  Synthetic DNA
taatacatctcattttag

SEQ ID NO: 28625 - DNA, 18 bp, Artificial Sequence
  Synthetic DNA
taataccaattactttag

SEQ ID NO: 28626 - DNA, 18 bp, Artificial Sequence
  Synthetic DNA
taataccactctcaaaag

SEQ ID NO: 28627 - DNA, 18 bp, Artificial Sequence
  Synthetic DNA
taataccactctttaaag

SEQ ID NO: 28628 - DNA, 18 bp, Artificial Sequence
  Synthetic DNA
taatacctatcacaatag

SEQ ID NO: 28629 - DNA, 18 bp, Artificial Sequence
  Synthetic DNA
taatacctcagactatag

SEQ ID NO: 28630 - DNA, 18 bp, Artificial Sequence
  Synthetic DNA
taatacctttaactatag

SEQ ID NO: 28631 - DNA, 18 bp, Artificial Sequence
  Synthetic DNA
taatacgaatcacctaag

SEQ ID NO: 28632 - DNA, 18 bp, Artificial Sequence
  Synthetic DNA
taatacgaatcataacag

SEQ ID NO: 28633 - DNA, 18 bp, Artificial Sequence
  Synthetic DNA
taatacgaatcattgaag

SEQ ID NO: 28634 - DNA, 18 bp, Artificial Sequence
  Synthetic DNA
taatacgacaaactttcg

SEQ ID NO: 28635 - DNA, 18 bp, Artificial Sequence
  Synthetic DNA
taatacgacaatctaaag

SEQ ID NO: 28636 - DNA, 18 bp, Artificial Sequence
  Synthetic DNA
taatacgacacaattaag

SEQ ID NO: 28637 - DNA, 18 bp, Artificial Sequence
  Synthetic DNA
taatacgacagaatagag

SEQ ID NO: 28638 - DNA, 18 bp, Artificial Sequence
  Synthetic DNA
taatacgacctacttaag

SEQ ID NO: 28639 - DNA, 18 bp, Artificial Sequence
  Synthetic DNA
taatacgactcaattgcg

SEQ ID NO: 28640 - DNA, 18 bp, Artificial Sequence
  Synthetic DNA
taatacgactcacacagg

SEQ ID NO: 28641 - DNA, 18 bp, Artificial Sequence
  Synthetic DNA
taatacgactcatacaag

SEQ ID NO: 28642 - DNA, 18 bp, Artificial Sequence
  Synthetic DNA
taatacgactgtttatgg

SEQ ID NO: 28643 - DNA, 18 bp, Artificial Sequence
  Synthetic DNA
taatacgactttttatcg

SEQ ID NO: 28644 - DNA, 18 bp, Artificial Sequence
  Synthetic DNA
taatacgaggctctaaag

SEQ ID NO: 28645 - DNA, 18 bp, Artificial Sequence
  Synthetic DNA
taatacgagtctctttcg

SEQ ID NO: 28646 - DNA, 18 bp, Artificial Sequence
  Synthetic DNA
taatacgatacacttaag

SEQ ID NO: 28647 - DNA, 18 bp, Artificial Sequence
  Synthetic DNA
taatacgattccatctag

SEQ ID NO: 28648 - DNA, 18 bp, Artificial Sequence
  Synthetic DNA
taatacgattctatctag

SEQ ID NO: 28649 - DNA, 18 bp, Artificial Sequence
  Synthetic DNA
taatacgcattaatatag

SEQ ID NO: 28650 - DNA, 18 bp, Artificial Sequence
  Synthetic DNA
taatacgtcacattaaag

SEQ ID NO: 28651 - DNA, 18 bp, Artificial Sequence
  Synthetic DNA
taatacgtcactcgatag

SEQ ID NO: 28652 - DNA, 18 bp, Artificial Sequence
  Synthetic DNA
taatacgtccctttatag

SEQ ID NO: 28653 - DNA, 18 bp, Artificial Sequence
  Synthetic DNA
taatacgtccgactttag

SEQ ID NO: 28654 - DNA, 18 bp, Artificial Sequence
  Synthetic DNA
taatacgtctaacaatcg

SEQ ID NO: 28655 - DNA, 18 bp, Artificial Sequence
  Synthetic DNA
taatacgtctcattaacg

SEQ ID NO: 28656 - DNA, 18 bp, Artificial Sequence
  Synthetic DNA
taatacgtgagactatag

SEQ ID NO: 28657 - DNA, 18 bp, Artificial Sequence
  Synthetic DNA
taatacgtgtacctatag

SEQ ID NO: 28658 - DNA, 18 bp, Artificial Sequence
  Synthetic DNA
taatacgtgtcacgttag

SEQ ID NO: 28659 - DNA, 18 bp, Artificial Sequence
  Synthetic DNA
taatacgttttacaatag

SEQ ID NO: 28660 - DNA, 18 bp, Artificial Sequence
  Synthetic DNA
taatactaatctctatgg

SEQ ID NO: 28661 - DNA, 18 bp, Artificial Sequence
  Synthetic DNA
taatactacccacactag

SEQ ID NO: 28662 - DNA, 18 bp, Artificial Sequence
  Synthetic DNA
taatactactcacttacg

SEQ ID NO: 28663 - DNA, 18 bp, Artificial Sequence
  Synthetic DNA
taatactactcattcgag

SEQ ID NO: 28664 - DNA, 18 bp, Artificial Sequence
  Synthetic DNA
taatactactctttacag

SEQ ID NO: 28665 - DNA, 18 bp, Artificial Sequence
  Synthetic DNA
taatactacttagtttag

SEQ ID NO: 28666 - DNA, 18 bp, Artificial Sequence
  Synthetic DNA
taatactattcacgaaag

SEQ ID NO: 28667 - DNA, 18 bp, Artificial Sequence
  Synthetic DNA
taatacttataactatag

SEQ ID NO: 28668 - DNA, 18 bp, Artificial Sequence
  Synthetic DNA
taatacttatcactaaag

SEQ ID NO: 28669 - DNA, 18 bp, Artificial Sequence
  Synthetic DNA
taataggattcattttag

SEQ ID NO: 28670 - DNA, 18 bp, Artificial Sequence
  Synthetic DNA
taatagtacacactacag

SEQ ID NO: 28671 - DNA, 18 bp, Artificial Sequence
  Synthetic DNA
taatagtacatactatag

SEQ ID NO: 28672 - DNA, 18 bp, Artificial Sequence
  Synthetic DNA
taatagtactcattaaag

SEQ ID NO: 28673 - DNA, 18 bp, Artificial Sequence
  Synthetic DNA
taatagttctcattatag

SEQ ID NO: 28674 - DNA, 18 bp, Artificial Sequence
  Synthetic DNA
taatataacaaactatag

SEQ ID NO: 28675 - DNA, 18 bp, Artificial Sequence
  Synthetic DNA
taatatcactcacaaaag

SEQ ID NO: 28676 - DNA, 18 bp, Artificial Sequence
  Synthetic DNA
taatatctctcaatatag

SEQ ID NO: 28677 - DNA, 18 bp, Artificial Sequence
  Synthetic DNA
taatatgaatcactttgg

SEQ ID NO: 28678 - DNA, 18 bp, Artificial Sequence
  Synthetic DNA
taatatgacacaccaaag

SEQ ID NO: 28679 - DNA, 18 bp, Artificial Sequence
  Synthetic DNA
taatatgactaacattag

SEQ ID NO: 28680 - DNA, 18 bp, Artificial Sequence
  Synthetic DNA
taatatgacttactttcg

SEQ ID NO: 28681 - DNA, 18 bp, Artificial Sequence
  Synthetic DNA
taatatgagtcacattag

SEQ ID NO: 28682 - DNA, 18 bp, Artificial Sequence
  Synthetic DNA
taatatttctgactatag

SEQ ID NO: 28683 - DNA, 18 bp, Artificial Sequence
  Synthetic DNA
taatcagacactctatag

SEQ ID NO: 28684 - DNA, 18 bp, Artificial Sequence
  Synthetic DNA
taatccaactctctagag

SEQ ID NO: 28685 - DNA, 18 bp, Artificial Sequence
  Synthetic DNA
taatcccactcaccttag

SEQ ID NO: 28686 - DNA, 18 bp, Artificial Sequence
  Synthetic DNA
taatccgactgataatag

SEQ ID NO: 28687 - DNA, 18 bp, Artificial Sequence
  Synthetic DNA
taatccgtctctctgtag

SEQ ID NO: 28688 - DNA, 18 bp, Artificial Sequence
  Synthetic DNA
taatcctacttactttag

SEQ ID NO: 28689 - DNA, 18 bp, Artificial Sequence
  Synthetic DNA
taatgcgaatctccatag

SEQ ID NO: 28690 - DNA, 18 bp, Artificial Sequence
  Synthetic DNA
taatgcgacactatatag

SEQ ID NO: 28691 - DNA, 18 bp, Artificial Sequence
  Synthetic DNA
taatgcgactccctcaag

SEQ ID NO: 28692 - DNA, 18 bp, Artificial Sequence
  Synthetic DNA
taatgcgtcacactttag

SEQ ID NO: 28693 - DNA, 18 bp, Artificial Sequence
  Synthetic DNA
taatgcttatcactatag

SEQ ID NO: 28694 - DNA, 18 bp, Artificial Sequence
  Synthetic DNA
taatgtgaatctctatag

SEQ ID NO: 28695 - DNA, 18 bp, Artificial Sequence
  Synthetic DNA
tactaagactcattaaag

SEQ ID NO: 28696 - DNA, 18 bp, Artificial Sequence
  Synthetic DNA
tactacctctcactttag

SEQ ID NO: 28697 - DNA, 18 bp, Artificial Sequence
  Synthetic DNA
tactacgactctagatag

SEQ ID NO: 28698 - DNA, 18 bp, Artificial Sequence
  Synthetic DNA
tactacgactttctaaag

SEQ ID NO: 28699 - DNA, 18 bp, Artificial Sequence
  Synthetic DNA
tactacgtcccactttag

SEQ ID NO: 28700 - DNA, 18 bp, Artificial Sequence
  Synthetic DNA
tactactcctaactatag

SEQ ID NO: 28701 - DNA, 18 bp, Artificial Sequence
  Synthetic DNA
tactccgattaactatag

SEQ ID NO: 28702 - DNA, 18 bp, Artificial Sequence
  Synthetic DNA
tactgcgacactctatag

SEQ ID NO: 28703 - DNA, 18 bp, Artificial Sequence
  Synthetic DNA
tagaaagacacactatag

SEQ ID NO: 28704 - DNA, 18 bp, Artificial Sequence
  Synthetic DNA
tagaacttctcactatag

SEQ ID NO: 28705 - DNA, 18 bp, Artificial Sequence
  Synthetic DNA
tagcatgactaactatag

SEQ ID NO: 28706 - DNA, 18 bp, Artificial Sequence
  Synthetic DNA
tagtacgacttcctgtag

SEQ ID NO: 28707 - DNA, 18 bp, Artificial Sequence
  Synthetic DNA
tagtacgtcatactatag

SEQ ID NO: 28708 - DNA, 18 bp, Artificial Sequence
  Synthetic DNA
tagtacgtctaagtatag

SEQ ID NO: 28709 - DNA, 18 bp, Artificial Sequence
  Synthetic DNA
tagtacgtctctatatag

SEQ ID NO: 28710 - DNA, 18 bp, Artificial Sequence
  Synthetic DNA
tagtacgtgttactatag

SEQ ID NO: 28711 - DNA, 18 bp, Artificial Sequence
  Synthetic DNA
tagtactattcactctag

SEQ ID NO: 28712 - DNA, 18 bp, Artificial Sequence
  Synthetic DNA
tagtactccacactatag

SEQ ID NO: 28713 - DNA, 18 bp, Artificial Sequence
  Synthetic DNA
tagtataactcactatgg

SEQ ID NO: 28714 - DNA, 18 bp, Artificial Sequence
  Synthetic DNA
tataaagactcactctag

SEQ ID NO: 28715 - DNA, 18 bp, Artificial Sequence
  Synthetic DNA
tataaagactcactttag

SEQ ID NO: 28716 - DNA, 18 bp, Artificial Sequence
  Synthetic DNA
tataacaagtcactatag

SEQ ID NO: 28717 - DNA, 18 bp, Artificial Sequence
  Synthetic DNA
tataacgacccactttag

SEQ ID NO: 28718 - DNA, 18 bp, Artificial Sequence
  Synthetic DNA
tataacgactcagcatag

SEQ ID NO: 28719 - DNA, 18 bp, Artificial Sequence
  Synthetic DNA
tataacgattcactatcg

SEQ ID NO: 28720 - DNA, 18 bp, Artificial Sequence
  Synthetic DNA
tataccgactaactatag

SEQ ID NO: 28721 - DNA, 18 bp, Artificial Sequence
  Synthetic DNA
tatagcgactcactttag

SEQ ID NO: 28722 - DNA, 18 bp, Artificial Sequence
  Synthetic DNA
tatagcgactctctatag

SEQ ID NO: 28723 - DNA, 18 bp, Artificial Sequence
  Synthetic DNA
tatcacggcttactatag

SEQ ID NO: 28724 - DNA, 18 bp, Artificial Sequence
  Synthetic DNA
tatcatgactctctatag

SEQ ID NO: 28725 - DNA, 18 bp, Artificial Sequence
  Synthetic DNA
tatgacgactaaatatag

SEQ ID NO: 28726 - DNA, 18 bp, Artificial Sequence
  Synthetic DNA
tattaagaatcaatatag

SEQ ID NO: 28727 - DNA, 18 bp, Artificial Sequence
  Synthetic DNA
tattaagactcacaacag

SEQ ID NO: 28728 - DNA, 18 bp, Artificial Sequence
  Synthetic DNA
tattaagactcactcaag

SEQ ID NO: 28729 - DNA, 18 bp, Artificial Sequence
  Synthetic DNA
tattaagactcacttcag

SEQ ID NO: 28730 - DNA, 18 bp, Artificial Sequence
  Synthetic DNA
tattacaacagactatag

SEQ ID NO: 28731 - DNA, 18 bp, Artificial Sequence
  Synthetic DNA
tattacaactatctatag

SEQ ID NO: 28732 - DNA, 18 bp, Artificial Sequence
  Synthetic DNA
tattacaacttactacag

SEQ ID NO: 28733 - DNA, 18 bp, Artificial Sequence
  Synthetic DNA
tattacaagtcaccatag

SEQ ID NO: 28734 - DNA, 18 bp, Artificial Sequence
  Synthetic DNA
tattacacctcaatatag

SEQ ID NO: 28735 - DNA, 18 bp, Artificial Sequence
  Synthetic DNA
tattacgactatctacag

SEQ ID NO: 28736 - DNA, 18 bp, Artificial Sequence
  Synthetic DNA
tattacgagtctcaatag

SEQ ID NO: 28737 - DNA, 18 bp, Artificial Sequence
  Synthetic DNA
tattacgattcacaaaag

SEQ ID NO: 28738 - DNA, 18 bp, Artificial Sequence
  Synthetic DNA
tattacgccacactatcg

SEQ ID NO: 28739 - DNA, 18 bp, Artificial Sequence
  Synthetic DNA
tattacgcctttctatag

SEQ ID NO: 28740 - DNA, 18 bp, Artificial Sequence
  Synthetic DNA
tattacgtctgaatatag

SEQ ID NO: 28741 - DNA, 18 bp, Artificial Sequence
  Synthetic DNA
tattacgtgttactatag

SEQ ID NO: 28742 - DNA, 18 bp, Artificial Sequence
  Synthetic DNA
tattactaatcaccatag

SEQ ID NO: 28743 - DNA, 18 bp, Artificial Sequence
  Synthetic DNA
tattactacacactagag

SEQ ID NO: 28744 - DNA, 18 bp, Artificial Sequence
  Synthetic DNA
tattactactcacaatcg

SEQ ID NO: 28745 - DNA, 18 bp, Artificial Sequence
  Synthetic DNA
tattactattgactatag

SEQ ID NO: 28746 - DNA, 18 bp, Artificial Sequence
  Synthetic DNA
tattacttctcactctag

SEQ ID NO: 28747 - DNA, 18 bp, Artificial Sequence
  Synthetic DNA
tattcccattcactatag

SEQ ID NO: 28748 - DNA, 18 bp, Artificial Sequence
  Synthetic DNA
tattccgactcattacag

SEQ ID NO: 28749 - DNA, 18 bp, Artificial Sequence
  Synthetic DNA
tattcctactcacaatag

SEQ ID NO: 28750 - DNA, 18 bp, Artificial Sequence
  Synthetic DNA
tattgcgactcataatag

SEQ ID NO: 28751 - DNA, 18 bp, Artificial Sequence
  Synthetic DNA
tcaaacgactctctttag

SEQ ID NO: 28752 - DNA, 18 bp, Artificial Sequence
  Synthetic DNA
tcaaacgtcacactatag

SEQ ID NO: 28753 - DNA, 18 bp, Artificial Sequence
  Synthetic DNA
tcaaactactcactacag

SEQ ID NO: 28754 - DNA, 18 bp, Artificial Sequence
  Synthetic DNA
tcataagattcactttag

SEQ ID NO: 28755 - DNA, 18 bp, Artificial Sequence
  Synthetic DNA
tcatacaactcaataaag

SEQ ID NO: 28756 - DNA, 18 bp, Artificial Sequence
  Synthetic DNA
tcatacgacaatctatag

SEQ ID NO: 28757 - DNA, 18 bp, Artificial Sequence
  Synthetic DNA
tcatacgaccaactttag

SEQ ID NO: 28758 - DNA, 18 bp, Artificial Sequence
  Synthetic DNA
tcatacgaccgacaatag

SEQ ID NO: 28759 - DNA, 18 bp, Artificial Sequence
  Synthetic DNA
tcatacgacttaaaatag

SEQ ID NO: 28760 - DNA, 18 bp, Artificial Sequence
  Synthetic DNA
tcatacgacttattacag

SEQ ID NO: 28761 - DNA, 18 bp, Artificial Sequence
  Synthetic DNA
tcatacgattcattttag

SEQ ID NO: 28762 - DNA, 18 bp, Artificial Sequence
  Synthetic DNA
tcatatgactcacaacag

SEQ ID NO: 28763 - DNA, 18 bp, Artificial Sequence
  Synthetic DNA
tcatccatctcactatag

SEQ ID NO: 28764 - DNA, 18 bp, Artificial Sequence
  Synthetic DNA
tcttacgactcacttaag

SEQ ID NO: 28765 - DNA, 18 bp, Artificial Sequence
  Synthetic DNA
tgaaacaactcattatag

SEQ ID NO: 28766 - DNA, 18 bp, Artificial Sequence
  Synthetic DNA
tgaaacaactctctatag

SEQ ID NO: 28767 - DNA, 18 bp, Artificial Sequence
  Synthetic DNA
tgaaacgactcactaccg

SEQ ID NO: 28768 - DNA, 18 bp, Artificial Sequence
  Synthetic DNA
tgaaacgccccactatag

SEQ ID NO: 28769 - DNA, 18 bp, Artificial Sequence
  Synthetic DNA
tgagacgactcagcatag

SEQ ID NO: 28770 - DNA, 18 bp, Artificial Sequence
  Synthetic DNA
tgataagtttcactatag

SEQ ID NO: 28771 - DNA, 18 bp, Artificial Sequence
  Synthetic DNA
tgatacaacacaatatag

SEQ ID NO: 28772 - DNA, 18 bp, Artificial Sequence
  Synthetic DNA
tgatacaactcactttcg

SEQ ID NO: 28773 - DNA, 18 bp, Artificial Sequence
  Synthetic DNA
tgatacatctctctatag

SEQ ID NO: 28774 - DNA, 18 bp, Artificial Sequence
  Synthetic DNA
tgatacgcttcactaaag

SEQ ID NO: 28775 - DNA, 18 bp, Artificial Sequence
  Synthetic DNA
tgatacttctcactttag

SEQ ID NO: 28776 - DNA, 18 bp, Artificial Sequence
  Synthetic DNA
tgatccgacttactaaag

SEQ ID NO: 28777 - DNA, 18 bp, Artificial Sequence
  Synthetic DNA
tgtaactactcactatag

SEQ ID NO: 28778 - DNA, 18 bp, Artificial Sequence
  Synthetic DNA
tgttacgactaactctag

SEQ ID NO: 28779 - DNA, 18 bp, Artificial Sequence
  Synthetic DNA
tgttccgactcactatgg

SEQ ID NO: 28780 - DNA, 18 bp, Artificial Sequence
  Synthetic DNA
ttaaacgacaaactatag

SEQ ID NO: 28781 - DNA, 18 bp, Artificial Sequence
  Synthetic DNA
ttaaacgtcgcactatag

SEQ ID NO: 28782 - DNA, 18 bp, Artificial Sequence
  Synthetic DNA
ttaaaggactcactgtag

SEQ ID NO: 28783 - DNA, 18 bp, Artificial Sequence
  Synthetic DNA
ttacacaactctctatag

SEQ ID NO: 28784 - DNA, 18 bp, Artificial Sequence
  Synthetic DNA
ttacacgactccctttag

SEQ ID NO: 28785 - DNA, 18 bp, Artificial Sequence
  Synthetic DNA
ttacacgtcacactatag

SEQ ID NO: 28786 - DNA, 18 bp, Artificial Sequence
  Synthetic DNA
ttacacgtctcactagag

SEQ ID NO: 28787 - DNA, 18 bp, Artificial Sequence
  Synthetic DNA
ttacatgcctcactatag

SEQ ID NO: 28788 - DNA, 18 bp, Artificial Sequence
  Synthetic DNA
ttaggcgactaactatag

SEQ ID NO: 28789 - DNA, 18 bp, Artificial Sequence
  Synthetic DNA
ttataaacctcactatag

SEQ ID NO: 28790 - DNA, 18 bp, Artificial Sequence
  Synthetic DNA
ttataagactgattatag

SEQ ID NO: 28791 - DNA, 18 bp, Artificial Sequence
  Synthetic DNA
ttatacaaatcactttag

SEQ ID NO: 28792 - DNA, 18 bp, Artificial Sequence
  Synthetic DNA
ttatacaacttaatatag

SEQ ID NO: 28793 - DNA, 18 bp, Artificial Sequence
  Synthetic DNA
ttataccacacaatatag

SEQ ID NO: 28794 - DNA, 18 bp, Artificial Sequence
  Synthetic DNA
ttataccacctactatag

SEQ ID NO: 28795 - DNA, 18 bp, Artificial Sequence
  Synthetic DNA
ttatacgaatcattatcg

SEQ ID NO: 28796 - DNA, 18 bp, Artificial Sequence
  Synthetic DNA
ttatacgaatgactacag

SEQ ID NO: 28797 - DNA, 18 bp, Artificial Sequence
  Synthetic DNA
ttatacgacgaaatatag

SEQ ID NO: 28798 - DNA, 18 bp, Artificial Sequence
  Synthetic DNA
ttatacgattccccatag

SEQ ID NO: 28799 - DNA, 18 bp, Artificial Sequence
  Synthetic DNA
ttatacgattctctaaag

SEQ ID NO: 28800 - DNA, 18 bp, Artificial Sequence
  Synthetic DNA
ttatacggctcactccag

SEQ ID NO: 28801 - DNA, 18 bp, Artificial Sequence
  Synthetic DNA
ttatacggctccttatag

SEQ ID NO: 28802 - DNA, 18 bp, Artificial Sequence
  Synthetic DNA
ttatacgtatcactatgg

SEQ ID NO: 28803 - DNA, 18 bp, Artificial Sequence
  Synthetic DNA
ttatacgtctaaccatag

SEQ ID NO: 28804 - DNA, 18 bp, Artificial Sequence
  Synthetic DNA
ttatacgtctgactatcg

SEQ ID NO: 28805 - DNA, 18 bp, Artificial Sequence
  Synthetic DNA
ttatacgtttcactatcg

SEQ ID NO: 28806 - DNA, 18 bp, Artificial Sequence
  Synthetic DNA
ttatactccacactatag

SEQ ID NO: 28807 - DNA, 18 bp, Artificial Sequence
  Synthetic DNA
ttatacttctaactatag

SEQ ID NO: 28808 - DNA, 18 bp, Artificial Sequence
  Synthetic DNA
ttataggactcactccag

SEQ ID NO: 28809 - DNA, 18 bp, Artificial Sequence
  Synthetic DNA
ttatagggctcacaatag

SEQ ID NO: 28810 - DNA, 18 bp, Artificial Sequence
  Synthetic DNA
ttatatcactctctatag

SEQ ID NO: 28811 - DNA, 18 bp, Artificial Sequence
  Synthetic DNA
ttatatctctcactatag

SEQ ID NO: 28812 - DNA, 18 bp, Artificial Sequence
  Synthetic DNA
ttatatgactcactctcg

SEQ ID NO: 28813 - DNA, 18 bp, Artificial Sequence
  Synthetic DNA
ttatatgacttactatcg

SEQ ID NO: 28814 - DNA, 18 bp, Artificial Sequence
  Synthetic DNA
ttatatgtctcactctag

SEQ ID NO: 28815 - DNA, 18 bp, Artificial Sequence
  Synthetic DNA
ttatccgcctcactacag

SEQ ID NO: 28816 - DNA, 18 bp, Artificial Sequence
  Synthetic DNA
ttatccggctcactaaag

SEQ ID NO: 28817 - DNA, 18 bp, Artificial Sequence
  Synthetic DNA
ttatccggctcactttag

SEQ ID NO: 28818 - DNA, 18 bp, Artificial Sequence
  Synthetic DNA
ttatccgtctaactatag

SEQ ID NO: 28819 - DNA, 18 bp, Artificial Sequence
  Synthetic DNA
ttatgcgactctccatag

SEQ ID NO: 28820 - DNA, 18 bp, Artificial Sequence
  Synthetic DNA
ttcaatgactcactatag

SEQ ID NO: 28821 - DNA, 18 bp, Artificial Sequence
  Synthetic DNA
ttgtacgaatcactttag

SEQ ID NO: 28822 - DNA, 18 bp, Artificial Sequence
  Synthetic DNA
ttgtacgactcacaatcg

SEQ ID NO: 28823 - DNA, 18 bp, Artificial Sequence
  Synthetic DNA
ttttaacactcactatag

SEQ ID NO: 28824 - DNA, 18 bp, Artificial Sequence
  Synthetic DNA
ttttacgactgacaatag

SEQ ID NO: 28825 - DNA, 18 bp, Artificial Sequence
  Synthetic DNA
ttttacgacttacaatag

SEQ ID NO: 28826 - DNA, 18 bp, Artificial Sequence
  Synthetic DNA
ttttacgcctccctatag

SEQ ID NO: 28827 - DNA, 18 bp, Artificial Sequence
  Synthetic DNA
ttttacgtcccactatag

SEQ ID NO: 28828 - DNA, 18 bp, Artificial Sequence
  Synthetic DNA
ttttgccactcactatag

SEQ ID NO: 28829 - DNA, 18 bp, Artificial Sequence
  Synthetic DNA
taattcgactcacttatg

SEQ ID NO: 28830 - DNA, 18 bp, Artificial Sequence
  Synthetic DNA
tatttcaactctctatag

SEQ ID NO: 28831 - DNA, 18 bp, Artificial Sequence
  Synthetic DNA
taataagactcacttatg

SEQ ID NO: 28832 - DNA, 18 bp, Artificial Sequence
  Synthetic DNA
taattcttctcactttag

SEQ ID NO: 28833 - DNA, 18 bp, Artificial Sequence
  Synthetic DNA
ttatacgactctttattg

SEQ ID NO: 28834 - DNA, 18 bp, Artificial Sequence
  Synthetic DNA
tttaacgactcactattg

SEQ ID NO: 28835 - DNA, 18 bp, Artificial Sequence
  Synthetic DNA
taatacaactcacaaatg

SEQ ID NO: 28836 - DNA, 18 bp, Artificial Sequence
  Synthetic DNA
tattacgactctcttttg

SEQ ID NO: 28837 - DNA, 18 bp, Artificial Sequence
  Synthetic DNA
aaaaacgactcacaacag

SEQ ID NO: 28838 - DNA, 18 bp, Artificial Sequence
  Synthetic DNA
ataaacgactctctatag

SEQ ID NO: 28839 - DNA, 18 bp, Artificial Sequence
  Synthetic DNA
ttaaacgtcttactatag

SEQ ID NO: 28840 - DNA, 18 bp, Artificial Sequence
  Synthetic DNA
ttatactacactctatag

SEQ ID NO: 28841 - DNA, 18 bp, Artificial Sequence
  Synthetic DNA
ttatccgtctcactttag

SEQ ID NO: 28842 - DNA, 18 bp, Artificial Sequence
  Synthetic DNA
taattcaactcattattg

SEQ ID NO: 28843 - DNA, 18 bp, Artificial Sequence
  Synthetic DNA
taattcgacccacttttg

SEQ ID NO: 28844 - DNA, 18 bp, Artificial Sequence
  Synthetic DNA
aaaaacgacttactattg

SEQ ID NO: 28845 - DNA, 18 bp, Artificial Sequence
  Synthetic DNA
aaaaatgactcactattg

SEQ ID NO: 28846 - DNA, 18 bp, Artificial Sequence
  Synthetic DNA
aaatacgaatcaatattg

SEQ ID NO: 28847 - DNA, 18 bp, Artificial Sequence
  Synthetic DNA
aaattcgaatcactatcg

SEQ ID NO: 28848 - DNA, 18 bp, Artificial Sequence
  Synthetic DNA
aaattcgactctctatgg

SEQ ID NO: 28849 - DNA, 18 bp, Artificial Sequence
  Synthetic DNA
aattacgaatcactattg

SEQ ID NO: 28850 - DNA, 18 bp, Artificial Sequence
  Synthetic DNA
taacacaactcactaatg

SEQ ID NO: 28851 - DNA, 18 bp, Artificial Sequence
  Synthetic DNA
taactcgtctcattatag

SEQ ID NO: 28852 - DNA, 18 bp, Artificial Sequence
  Synthetic DNA
taataagacacactaatg

SEQ ID NO: 28853 - DNA, 18 bp, Artificial Sequence
  Synthetic DNA
taataccaatcaccattg

SEQ ID NO: 28854 - DNA, 18 bp, Artificial Sequence
  Synthetic DNA
taattcgattcactttcg

SEQ ID NO: 28855 - DNA, 18 bp, Artificial Sequence
  Synthetic DNA
taattcgcctctctttag

SEQ ID NO: 28856 - DNA, 18 bp, Artificial Sequence
  Synthetic DNA
tagttcgtttcactatag

SEQ ID NO: 28857 - DNA, 18 bp, Artificial Sequence
  Synthetic DNA
tattacgtctcacgattg

SEQ ID NO: 28858 - DNA, 18 bp, Artificial Sequence
  Synthetic DNA
tcatacgtctcactgttg

SEQ ID NO: 28859 - DNA, 18 bp, Artificial Sequence
  Synthetic DNA
tgatatgactcacaattg

SEQ ID NO: 28860 - DNA, 18 bp, Artificial Sequence
  Synthetic DNA
tgattcgtctcactttag

SEQ ID NO: 28861 - DNA, 18 bp, Artificial Sequence
  Synthetic DNA
ttaaacgcctcactattg

SEQ ID NO: 28862 - DNA, 18 bp, Artificial Sequence
  Synthetic DNA
ttataatactcactattg

SEQ ID NO: 28863 - DNA, 18 bp, Artificial Sequence
  Synthetic DNA
ttattagactcattatag

SEQ ID NO: 28864 - DNA, 18 bp, Artificial Sequence
  Synthetic DNA
aaatactactcataatag

SEQ ID NO: 28865 - DNA, 18 bp, Artificial Sequence
  Synthetic DNA
acatatgactcactttag

SEQ ID NO: 28866 - DNA, 18 bp, Artificial Sequence
  Synthetic DNA
atatacgaatcaatatag

SEQ ID NO: 28867 - DNA, 18 bp, Artificial Sequence
  Synthetic DNA
atgtacaactcactatag

SEQ ID NO: 28868 - DNA, 18 bp, Artificial Sequence
  Synthetic DNA
atttaagactcactatag

SEQ ID NO: 28869 - DNA, 18 bp, Artificial Sequence
  Synthetic DNA
taaaacaacacacaatag

SEQ ID NO: 28870 - DNA, 18 bp, Artificial Sequence
  Synthetic DNA
taaaacaacttactaaag

SEQ ID NO: 28871 - DNA, 18 bp, Artificial Sequence
  Synthetic DNA
taaaacctctcattatag

SEQ ID NO: 28872 - DNA, 18 bp, Artificial Sequence
  Synthetic DNA
taaaacggctcacaaaag

SEQ ID NO: 28873 - DNA, 18 bp, Artificial Sequence
  Synthetic DNA
taatacaaatcacattag

SEQ ID NO: 28874 - DNA, 18 bp, Artificial Sequence
  Synthetic DNA
taatacgactattaatag

SEQ ID NO: 28875 - DNA, 18 bp, Artificial Sequence
  Synthetic DNA
taatacgtctccgtttag

SEQ ID NO: 28876 - DNA, 18 bp, Artificial Sequence
  Synthetic DNA
taataggactctctacgg

SEQ ID NO: 28877 - DNA, 18 bp, Artificial Sequence
  Synthetic DNA
taatatgtctcattttag

SEQ ID NO: 28878 - DNA, 18 bp, Artificial Sequence
  Synthetic DNA
tactacatctcaccatag

SEQ ID NO: 28879 - DNA, 18 bp, Artificial Sequence
  Synthetic DNA
tagtacttctcattatag

SEQ ID NO: 28880 - DNA, 18 bp, Artificial Sequence
  Synthetic DNA
tataacgtctcactatgg

SEQ ID NO: 28881 - DNA, 18 bp, Artificial Sequence
  Synthetic DNA
tattacgactctcttaag

SEQ ID NO: 28882 - DNA, 18 bp, Artificial Sequence
  Synthetic DNA
tattacgtcttaatatag

SEQ ID NO: 28883 - DNA, 18 bp, Artificial Sequence
  Synthetic DNA
tcatccgactctctttag

SEQ ID NO: 28884 - DNA, 18 bp, Artificial Sequence
  Synthetic DNA
ttaaacaactcactttag

SEQ ID NO: 28885 - DNA, 18 bp, Artificial Sequence
  Synthetic DNA
ttaaacgaaacactatag

SEQ ID NO: 28886 - DNA, 18 bp, Artificial Sequence
  Synthetic DNA
ttaaacgacccacaatag

SEQ ID NO: 28887 - DNA, 18 bp, Artificial Sequence
  Synthetic DNA
ttatacctctcactttag

SEQ ID NO: 28888 - DNA, 18 bp, Artificial Sequence
  Synthetic DNA
ttatacgacacaaaatag

SEQ ID NO: 28889 - DNA, 18 bp, Artificial Sequence
  Synthetic DNA
ttatacgactaacgaaag

SEQ ID NO: 28890 - DNA, 18 bp, Artificial Sequence
  Synthetic DNA
ttatacgactctcattag

SEQ ID NO: 28891 - DNA, 18 bp, Artificial Sequence
  Synthetic DNA
ttatatgattcacaatag

SEQ ID NO: 28892 - DNA, 18 bp, Artificial Sequence
  Synthetic DNA
tataacgactctcaatag

SEQ ID NO: 28893 - DNA, 18 bp, Artificial Sequence
  Synthetic DNA
tatctcgactcactattg

SEQ ID NO: 28894 - DNA, 18 bp, Artificial Sequence
  Synthetic DNA
taacacgactctctaatg

SEQ ID NO: 28895 - DNA, 18 bp, Artificial Sequence
  Synthetic DNA
taatacaattcacaattg

SEQ ID NO: 28896 - DNA, 18 bp, Artificial Sequence
  Synthetic DNA
taatactacacactaatg

SEQ ID NO: 28897 - DNA, 18 bp, Artificial Sequence
  Synthetic DNA
taatccgactctcttttg

SEQ ID NO: 28898 - DNA, 18 bp, Artificial Sequence
  Synthetic DNA
tatttcgtcacactatag

SEQ ID NO: 28899 - DNA, 18 bp, Artificial Sequence
  Synthetic DNA
aaatacatctcacaatag

SEQ ID NO: 28900 - DNA, 18 bp, Artificial Sequence
  Synthetic DNA
atatacgactaacaatag

SEQ ID NO: 28901 - DNA, 18 bp, Artificial Sequence
  Synthetic DNA
taatacaactcacataag

SEQ ID NO: 28902 - DNA, 18 bp, Artificial Sequence
  Synthetic DNA
ttatacgattcacaaaag

SEQ ID NO: 28903 - DNA, 18 bp, Artificial Sequence
  Synthetic DNA
ttatacgtctcaatttag

SEQ ID NO: 28904 - DNA, 18 bp, Artificial Sequence
  Synthetic DNA
ttatatgacactctatag

SEQ ID NO: 28905 - DNA, 18 bp, Artificial Sequence
  Synthetic DNA
ttttacgtttcactatag

SEQ ID NO: 28906 - DNA, 18 bp, Artificial Sequence
  Synthetic DNA
ttattcgactcattttag

SEQ ID NO: 28907 - DNA, 18 bp, Artificial Sequence
  Synthetic DNA
atatacgacacactttag

SEQ ID NO: 28908 - DNA, 18 bp, Artificial Sequence
  Synthetic DNA
tattacttctcactaaag

SEQ ID NO: 28909 - DNA, 18 bp, Artificial Sequence
  Synthetic DNA
taattcgactctcaattg

SEQ ID NO: 28910 - DNA, 18 bp, Artificial Sequence
  Synthetic DNA
taattcgactttctattg

SEQ ID NO: 28911 - DNA, 18 bp, Artificial Sequence
  Synthetic DNA
taatacgtctatctattg

SEQ ID NO: 28912 - DNA, 18 bp, Artificial Sequence
  Synthetic DNA
ttatacgactcaataatg

SEQ ID NO: 28913 - DNA, 18 bp, Artificial Sequence
  Synthetic DNA
ttattcgacacactctag

SEQ ID NO: 28914 - DNA, 18 bp, Artificial Sequence
  Synthetic DNA
atatactactcacaatag

SEQ ID NO: 28915 - DNA, 18 bp, Artificial Sequence
  Synthetic DNA
taaaacgattctctttag

SEQ ID NO: 28916 - DNA, 18 bp, Artificial Sequence
  Synthetic DNA
taatacgaccctcaaaag

SEQ ID NO: 28917 - DNA, 18 bp, Artificial Sequence
  Synthetic DNA
ttatacaattcactaaag

SEQ ID NO: 28918 - DNA, 18 bp, Artificial Sequence
  Synthetic DNA
ttatacgattcacattag

SEQ ID NO: 28919 - DNA, 18 bp, Artificial Sequence
  Synthetic DNA
aaatatgactcgctattg

SEQ ID NO: 28920 - DNA, 18 bp, Artificial Sequence
  Synthetic DNA
aaattcgactcagtattg

SEQ ID NO: 28921 - DNA, 18 bp, Artificial Sequence
  Synthetic DNA
aacttcgactcactattg

SEQ ID NO: 28922 - DNA, 18 bp, Artificial Sequence
  Synthetic DNA
cacttcgactcactattg

SEQ ID NO: 28923 - DNA, 18 bp, Artificial Sequence
  Synthetic DNA
taaattgactcactattg

SEQ ID NO: 28924 - DNA, 18 bp, Artificial Sequence
  Synthetic DNA
taataggactcgcttttg

SEQ ID NO: 28925 - DNA, 18 bp, Artificial Sequence
  Synthetic DNA
taattcgactcacacttg

SEQ ID NO: 28926 - DNA, 18 bp, Artificial Sequence
  Synthetic DNA
taattcgactgactaatg

SEQ ID NO: 28927 - DNA, 18 bp, Artificial Sequence
  Synthetic DNA
tacttcgattcactattg

SEQ ID NO: 28928 - DNA, 18 bp, Artificial Sequence
  Synthetic DNA
aaataccactcaatattg

SEQ ID NO: 28929 - DNA, 18 bp, Artificial Sequence
  Synthetic DNA
aaatacgacagactattg

SEQ ID NO: 28930 - DNA, 18 bp, Artificial Sequence
  Synthetic DNA
aaatacgactagctaaag

SEQ ID NO: 28931 - DNA, 18 bp, Artificial Sequence
  Synthetic DNA
aaatacgactctcaattg

SEQ ID NO: 28932 - DNA, 18 bp, Artificial Sequence
  Synthetic DNA
aaatacgactctctcttg

SEQ ID NO: 28933 - DNA, 18 bp, Artificial Sequence
  Synthetic DNA
aaatacgactctctgttg

SEQ ID NO: 28934 - DNA, 18 bp, Artificial Sequence
  Synthetic DNA
aaattcgcctctctatag

SEQ ID NO: 28935 - DNA, 18 bp, Artificial Sequence
  Synthetic DNA
aaatttgagtcactatag

SEQ ID NO: 28936 - DNA, 18 bp, Artificial Sequence
  Synthetic DNA
aagttcgactctctatag

SEQ ID NO: 28937 - DNA, 18 bp, Artificial Sequence
  Synthetic DNA
acattctactcactatag

SEQ ID NO: 28938 - DNA, 18 bp, Artificial Sequence
  Synthetic DNA
caatacgactaacaattg

SEQ ID NO: 28939 - DNA, 18 bp, Artificial Sequence
  Synthetic DNA
caatacgtctcacaattg

SEQ ID NO: 28940 - DNA, 18 bp, Artificial Sequence
  Synthetic DNA
caattagactcactaaag

SEQ ID NO: 28941 - DNA, 18 bp, Artificial Sequence
  Synthetic DNA
caattagactctctatag

SEQ ID NO: 28942 - DNA, 18 bp, Artificial Sequence
  Synthetic DNA
caattcgacatactatag

SEQ ID NO: 28943 - DNA, 18 bp, Artificial Sequence
  Synthetic DNA
caatttgactcacaatag

SEQ ID NO: 28944 - DNA, 18 bp, Artificial Sequence
  Synthetic DNA
gtattcaactcactatag

SEQ ID NO: 28945 - DNA, 18 bp, Artificial Sequence
  Synthetic DNA
taaaaagactcaatattg

SEQ ID NO: 28946 - DNA, 18 bp, Artificial Sequence
  Synthetic DNA
taaaacaactaactattg

SEQ ID NO: 28947 - DNA, 18 bp, Artificial Sequence
  Synthetic DNA
taaaacgacacaatattg

SEQ ID NO: 28948 - DNA, 18 bp, Artificial Sequence
  Synthetic DNA
taaaacgacgcacaattg

SEQ ID NO: 28949 - DNA, 18 bp, Artificial Sequence
  Synthetic DNA
taaaacgagtcactcttg

SEQ ID NO: 28950 - DNA, 18 bp, Artificial Sequence
  Synthetic DNA
taaaacgcctcgttatag

SEQ ID NO: 28951 - DNA, 18 bp, Artificial Sequence
  Synthetic DNA
taaaacggctcactaatg

SEQ ID NO: 28952 - DNA, 18 bp, Artificial Sequence
  Synthetic DNA
taaaacggctcgcaatag

SEQ ID NO: 28953 - DNA, 18 bp, Artificial Sequence
  Synthetic DNA
taaaatgactcacaattg

SEQ ID NO: 28954 - DNA, 18 bp, Artificial Sequence
  Synthetic DNA
taaatagactcaccatag

SEQ ID NO: 28955 - DNA, 18 bp, Artificial Sequence
  Synthetic DNA
taaatcgactttctatag

SEQ ID NO: 28956 - DNA, 18 bp, Artificial Sequence
  Synthetic DNA
taaatctacacactatag

SEQ ID NO: 28957 - DNA, 18 bp, Artificial Sequence
  Synthetic DNA
taacacgactcaccaatg

SEQ ID NO: 28958 - DNA, 18 bp, Artificial Sequence
  Synthetic DNA
taacacgactcgccaaag

SEQ ID NO: 28959 - DNA, 18 bp, Artificial Sequence
  Synthetic DNA
taacacgtctcgatatag

SEQ ID NO: 28960 - DNA, 18 bp, Artificial Sequence
  Synthetic DNA
taactcaaatcactatag

SEQ ID NO: 28961 - DNA, 18 bp, Artificial Sequence
  Synthetic DNA
taactcgacccactttag

SEQ ID NO: 28962 - DNA, 18 bp, Artificial Sequence
  Synthetic DNA
taactcgactccctatcg

SEQ ID NO: 28963 - DNA, 18 bp, Artificial Sequence
  Synthetic DNA
taactcgtcttactatag

SEQ ID NO: 28964 - DNA, 18 bp, Artificial Sequence
  Synthetic DNA
taacttaactcactatag

SEQ ID NO: 28965 - DNA, 18 bp, Artificial Sequence
  Synthetic DNA
taagactactccctattg

SEQ ID NO: 28966 - DNA, 18 bp, Artificial Sequence
  Synthetic DNA
taataagacacgctttag

SEQ ID NO: 28967 - DNA, 18 bp, Artificial Sequence
  Synthetic DNA
taataagactaactgttg

SEQ ID NO: 28968 - DNA, 18 bp, Artificial Sequence
  Synthetic DNA
taataagactcaccaatg

SEQ ID NO: 28969 - DNA, 18 bp, Artificial Sequence
  Synthetic DNA
taataagacttacttttg

SEQ ID NO: 28970 - DNA, 18 bp, Artificial Sequence
  Synthetic DNA
taatacaaattactattg

SEQ ID NO: 28971 - DNA, 18 bp, Artificial Sequence
  Synthetic DNA
taatacaagtcaccattg

SEQ ID NO: 28972 - DNA, 18 bp, Artificial Sequence
  Synthetic DNA
taatacatcccactattg

SEQ ID NO: 28973 - DNA, 18 bp, Artificial Sequence
  Synthetic DNA
taataccactctctagtg

SEQ ID NO: 28974 - DNA, 18 bp, Artificial Sequence
  Synthetic DNA
taatacctcttactattg

SEQ ID NO: 28975 - DNA, 18 bp, Artificial Sequence
  Synthetic DNA
taatacgaatcgctaacg

SEQ ID NO: 28976 - DNA, 18 bp, Artificial Sequence
  Synthetic DNA
taatacgagtaacaattg

SEQ ID NO: 28977 - DNA, 18 bp, Artificial Sequence
  Synthetic DNA
taatacggctaacttttg

SEQ ID NO: 28978 - DNA, 18 bp, Artificial Sequence
  Synthetic DNA
taatacggctcacttatg

SEQ ID NO: 28979 - DNA, 18 bp, Artificial Sequence
  Synthetic DNA
taatacgtatcactagtg

SEQ ID NO: 28980 - DNA, 18 bp, Artificial Sequence
  Synthetic DNA
taatacgttacgctatag

SEQ ID NO: 28981 - DNA, 18 bp, Artificial Sequence
  Synthetic DNA
taatacgttttactattg

SEQ ID NO: 28982 - DNA, 18 bp, Artificial Sequence
  Synthetic DNA
taatactaatcactcttg

SEQ ID NO: 28983 - DNA, 18 bp, Artificial Sequence
  Synthetic DNA
taatactacacactactg

SEQ ID NO: 28984 - DNA, 18 bp, Artificial Sequence
  Synthetic DNA
taatactactcgctttgg

SEQ ID NO: 28985 - DNA, 18 bp, Artificial Sequence
  Synthetic DNA
taatactactctctagtg

SEQ ID NO: 28986 - DNA, 18 bp, Artificial Sequence
  Synthetic DNA
taataggactctcttttg

SEQ ID NO: 28987 - DNA, 18 bp, Artificial Sequence
  Synthetic DNA
taatccaactcacaattg

SEQ ID NO: 28988 - DNA, 18 bp, Artificial Sequence
  Synthetic DNA
taatccaactcattattg

SEQ ID NO: 28989 - DNA, 18 bp, Artificial Sequence
  Synthetic DNA
taatccgactcacctttg

SEQ ID NO: 28990 - DNA, 18 bp, Artificial Sequence
  Synthetic DNA
taatccgtctcattattg

SEQ ID NO: 28991 - DNA, 18 bp, Artificial Sequence
  Synthetic DNA
taattagactaacaatag

SEQ ID NO: 28992 - DNA, 18 bp, Artificial Sequence
  Synthetic DNA
taattcaattctctatag

SEQ ID NO: 28993 - DNA, 18 bp, Artificial Sequence
  Synthetic DNA
taattccacgctctatag

SEQ ID NO: 28994 - DNA, 18 bp, Artificial Sequence
  Synthetic DNA
taattcctctcactttag

SEQ ID NO: 28995 - DNA, 18 bp, Artificial Sequence
  Synthetic DNA
taattcgactcaccaagg

SEQ ID NO: 28996 - DNA, 18 bp, Artificial Sequence
  Synthetic DNA
taattcgatacactatgg

SEQ ID NO: 28997 - DNA, 18 bp, Artificial Sequence
  Synthetic DNA
taattcgcatctctatag

SEQ ID NO: 28998 - DNA, 18 bp, Artificial Sequence
  Synthetic DNA
taattcgccccacaatag

SEQ ID NO: 28999 - DNA, 18 bp, Artificial Sequence
  Synthetic DNA
taattcgcctcacaaaag

SEQ ID NO: 29000 - DNA, 18 bp, Artificial Sequence
  Synthetic DNA
taattcgtatgactatag

SEQ ID NO: 29001 - DNA, 18 bp, Artificial Sequence
  Synthetic DNA
taattcgtctcagtaaag

SEQ ID NO: 29002 - DNA, 18 bp, Artificial Sequence
  Synthetic DNA
taattctactctctatcg

SEQ ID NO: 29003 - DNA, 18 bp, Artificial Sequence
  Synthetic DNA
taattggaatcactacag

SEQ ID NO: 29004 - DNA, 18 bp, Artificial Sequence
  Synthetic DNA
taatttgactctctacag

SEQ ID NO: 29005 - DNA, 18 bp, Artificial Sequence
  Synthetic DNA
taatttgacttaccatag

SEQ ID NO: 29006 - DNA, 18 bp, Artificial Sequence
  Synthetic DNA
tacaatgactcactattg

SEQ ID NO: 29007 - DNA, 18 bp, Artificial Sequence
  Synthetic DNA
tactaagactcacttttg

SEQ ID NO: 29008 - DNA, 18 bp, Artificial Sequence
  Synthetic DNA
tactacaactcgctatcg

SEQ ID NO: 29009 - DNA, 18 bp, Artificial Sequence
  Synthetic DNA
tactacgactcacctttg

SEQ ID NO: 29010 - DNA, 18 bp, Artificial Sequence
  Synthetic DNA
tactacgatttactattg

SEQ ID NO: 29011 - DNA, 18 bp, Artificial Sequence
  Synthetic DNA
tacttagactcaccatag

SEQ ID NO: 29012 - DNA, 18 bp, Artificial Sequence
  Synthetic DNA
tacttcgaatcactaaag

SEQ ID NO: 29013 - DNA, 18 bp, Artificial Sequence
  Synthetic DNA
tacttcgaatcactttag

SEQ ID NO: 29014 - DNA, 18 bp, Artificial Sequence
  Synthetic DNA
tacttggactcactctag

SEQ ID NO: 29015 - DNA, 18 bp, Artificial Sequence
  Synthetic DNA
tagaacgactcactactg

SEQ ID NO: 29016 - DNA, 18 bp, Artificial Sequence
  Synthetic DNA
tagttggactcacaatag

SEQ ID NO: 29017 - DNA, 18 bp, Artificial Sequence
  Synthetic DNA
tataacgactcgctttag

SEQ ID NO: 29018 - DNA, 18 bp, Artificial Sequence
  Synthetic DNA
tatctcaactcactatag

SEQ ID NO: 29019 - DNA, 18 bp, Artificial Sequence
  Synthetic DNA
tattacgaccctctattg

SEQ ID NO: 29020 - DNA, 18 bp, Artificial Sequence
  Synthetic DNA
tattacgactctctgttg

SEQ ID NO: 29021 - DNA, 18 bp, Artificial Sequence
  Synthetic DNA
tattatgactagctatag

SEQ ID NO: 29022 - DNA, 18 bp, Artificial Sequence
  Synthetic DNA
tatttcgacacactacag

SEQ ID NO: 29023 - DNA, 18 bp, Artificial Sequence
  Synthetic DNA
tatttcgactctctatgg

SEQ ID NO: 29024 - DNA, 18 bp, Artificial Sequence
  Synthetic DNA
tatttcgcatcactatag

SEQ ID NO: 29025 - DNA, 18 bp, Artificial Sequence
  Synthetic DNA
tcataagactcgctagag

SEQ ID NO: 29026 - DNA, 18 bp, Artificial Sequence
  Synthetic DNA
tcatacatctcactattg

SEQ ID NO: 29027 - DNA, 18 bp, Artificial Sequence
  Synthetic DNA
tcatacgacactctattg

SEQ ID NO: 29028 - DNA, 18 bp, Artificial Sequence
  Synthetic DNA
tcatacgactcccttttg

SEQ ID NO: 29029 - DNA, 18 bp, Artificial Sequence
  Synthetic DNA
tcattcgactcataatag

SEQ ID NO: 29030 - DNA, 18 bp, Artificial Sequence
  Synthetic DNA
tgaaaagactcactattg

SEQ ID NO: 29031 - DNA, 18 bp, Artificial Sequence
  Synthetic DNA
tgaaacgactctctattg

SEQ ID NO: 29032 - DNA, 18 bp, Artificial Sequence
  Synthetic DNA
tgatacgacttactaatg

SEQ ID NO: 29033 - DNA, 18 bp, Artificial Sequence
  Synthetic DNA
ttaatcgactccctatag

SEQ ID NO: 29034 - DNA, 18 bp, Artificial Sequence
  Synthetic DNA
ttacatgactcactattg

SEQ ID NO: 29035 - DNA, 18 bp, Artificial Sequence
  Synthetic DNA
ttataagactaactattg

SEQ ID NO: 29036 - DNA, 18 bp, Artificial Sequence
  Synthetic DNA
ttataagactcactactg

SEQ ID NO: 29037 - DNA, 18 bp, Artificial Sequence
  Synthetic DNA
ttataccactcattattg

SEQ ID NO: 29038 - DNA, 18 bp, Artificial Sequence
  Synthetic DNA
ttatacgaataactattg

SEQ ID NO: 29039 - DNA, 18 bp, Artificial Sequence
  Synthetic DNA
ttatacggctcactaatg

SEQ ID NO: 29040 - DNA, 18 bp, Artificial Sequence
  Synthetic DNA
ttatacgtctcactgttg

SEQ ID NO: 29041 - DNA, 18 bp, Artificial Sequence
  Synthetic DNA
ttatacgtctcgccatag

SEQ ID NO: 29042 - DNA, 18 bp, Artificial Sequence
  Synthetic DNA
ttatgcaactcactattg

SEQ ID NO: 29043 - DNA, 18 bp, Artificial Sequence
  Synthetic DNA
ttatgcgactagctatag

SEQ ID NO: 29044 - DNA, 18 bp, Artificial Sequence
  Synthetic DNA
ttattagactgactatag

SEQ ID NO: 29045 - DNA, 18 bp, Artificial Sequence
  Synthetic DNA
ttattcgactaactacag

SEQ ID NO: 29046 - DNA, 18 bp, Artificial Sequence
  Synthetic DNA
ttattcgtctcactatgg

SEQ ID NO: 29047 - DNA, 18 bp, Artificial Sequence
  Synthetic DNA
ttctacgattcactattg

SEQ ID NO: 29048 - DNA, 18 bp, Artificial Sequence
  Synthetic DNA
ttgatcgactcactatag

SEQ ID NO: 29049 - DNA, 18 bp, Artificial Sequence
  Synthetic DNA
ttgtccgactcactattg

SEQ ID NO: 29050 - DNA, 18 bp, Artificial Sequence
  Synthetic DNA
ttttaccactcactattg

SEQ ID NO: 29051 - DNA, 18 bp, Artificial Sequence
  Synthetic DNA
ttttacgcctcactattg

SEQ ID NO: 29052 - DNA, 18 bp, Artificial Sequence
  Synthetic DNA
aaaaacgacttactctag

SEQ ID NO: 29053 - DNA, 18 bp, Artificial Sequence
  Synthetic DNA
aaaaacgattcactacag

SEQ ID NO: 29054 - DNA, 18 bp, Artificial Sequence
  Synthetic DNA
aaaaatgtctcactatag

SEQ ID NO: 29055 - DNA, 18 bp, Artificial Sequence
  Synthetic DNA
aaacacgattctctatag

SEQ ID NO: 29056 - DNA, 18 bp, Artificial Sequence
  Synthetic DNA
aaataaaactcactgtag

SEQ ID NO: 29057 - DNA, 18 bp, Artificial Sequence
  Synthetic DNA
aaataagaatcacaatag

SEQ ID NO: 29058 - DNA, 18 bp, Artificial Sequence
  Synthetic DNA
aaataagactcactaacg

SEQ ID NO: 29059 - DNA, 18 bp, Artificial Sequence
  Synthetic DNA
aaataatactcactatgg

SEQ ID NO: 29060 - DNA, 18 bp, Artificial Sequence
  Synthetic DNA
aaatacaacttactctag

SEQ ID NO: 29061 - DNA, 18 bp, Artificial Sequence
  Synthetic DNA
aaataccactgactttag

SEQ ID NO: 29062 - DNA, 18 bp, Artificial Sequence
  Synthetic DNA
aaataccagtcactaaag

SEQ ID NO: 29063 - DNA, 18 bp, Artificial Sequence
  Synthetic DNA
aaataccagtcactacag

SEQ ID NO: 29064 - DNA, 18 bp, Artificial Sequence
  Synthetic DNA
aaatacgacaaactctag

SEQ ID NO: 29065 - DNA, 18 bp, Artificial Sequence
  Synthetic DNA
aaatacgactaaccaaag

SEQ ID NO: 29066 - DNA, 18 bp, Artificial Sequence
  Synthetic DNA
aaatacgagtctctttag

SEQ ID NO: 29067 - DNA, 18 bp, Artificial Sequence
  Synthetic DNA
aaatacgcctctcaatag

SEQ ID NO: 29068 - DNA, 18 bp, Artificial Sequence
  Synthetic DNA
aaatacggcacactttag

SEQ ID NO: 29069 - DNA, 18 bp, Artificial Sequence
  Synthetic DNA
aaatacggcttacaatag

SEQ ID NO: 29070 - DNA, 18 bp, Artificial Sequence
  Synthetic DNA
aaatacgtgccactatag

SEQ ID NO: 29071 - DNA, 18 bp, Artificial Sequence
  Synthetic DNA
aaatactactcaatctag

SEQ ID NO: 29072 - DNA, 18 bp, Artificial Sequence
  Synthetic DNA
aaatagaactcactaaag

SEQ ID NO: 29073 - DNA, 18 bp, Artificial Sequence
  Synthetic DNA
aaatagcactcactatcg

SEQ ID NO: 29074 - DNA, 18 bp, Artificial Sequence
  Synthetic DNA
aaatgcgacacactacag

SEQ ID NO: 29075 - DNA, 18 bp, Artificial Sequence
  Synthetic DNA
aactacgattccctatag

SEQ ID NO: 29076 - DNA, 18 bp, Artificial Sequence
  Synthetic DNA
aagtacaacacactatag

SEQ ID NO: 29077 - DNA, 18 bp, Artificial Sequence
  Synthetic DNA
aattatgactcactaaag

SEQ ID NO: 29078 - DNA, 18 bp, Artificial Sequence
  Synthetic DNA
aattatgactcagtatag

SEQ ID NO: 29079 - DNA, 18 bp, Artificial Sequence
  Synthetic DNA
aattatgattcactatag

SEQ ID NO: 29080 - DNA, 18 bp, Artificial Sequence
  Synthetic DNA
acatacgactccctacag

SEQ ID NO: 29081 - DNA, 18 bp, Artificial Sequence
  Synthetic DNA
acatacgacttacaatag

SEQ ID NO: 29082 - DNA, 18 bp, Artificial Sequence
  Synthetic DNA
agatacggctcactaaag

SEQ ID NO: 29083 - DNA, 18 bp, Artificial Sequence
  Synthetic DNA
atataccacccactatag

SEQ ID NO: 29084 - DNA, 18 bp, Artificial Sequence
  Synthetic DNA
atatacgactcattatcg

SEQ ID NO: 29085 - DNA, 18 bp, Artificial Sequence
  Synthetic DNA
atatacgactctccatag

SEQ ID NO: 29086 - DNA, 18 bp, Artificial Sequence
  Synthetic DNA
atatactaatcactatag

SEQ ID NO: 29087 - DNA, 18 bp, Artificial Sequence
  Synthetic DNA
atatatcactcactatag

SEQ ID NO: 29088 - DNA, 18 bp, Artificial Sequence
  Synthetic DNA
caaaacgatacactatag

SEQ ID NO: 29089 - DNA, 18 bp, Artificial Sequence
  Synthetic DNA
caataagacacagtatag

SEQ ID NO: 29090 - DNA, 18 bp, Artificial Sequence
  Synthetic DNA
caatacgacaaactatcg

SEQ ID NO: 29091 - DNA, 18 bp, Artificial Sequence
  Synthetic DNA
caatacgacatacaatag

SEQ ID NO: 29092 - DNA, 18 bp, Artificial Sequence
  Synthetic DNA
caatacgactaattttag

SEQ ID NO: 29093 - DNA, 18 bp, Artificial Sequence
  Synthetic DNA
caatacgattcacattag

SEQ ID NO: 29094 - DNA, 18 bp, Artificial Sequence
  Synthetic DNA
caatacgtctcaataaag

SEQ ID NO: 29095 - DNA, 18 bp, Artificial Sequence
  Synthetic DNA
cactacgacttactacag

SEQ ID NO: 29096 - DNA, 18 bp, Artificial Sequence
  Synthetic DNA
cataaccactcactatag

SEQ ID NO: 29097 - DNA, 18 bp, Artificial Sequence
  Synthetic DNA
catcacgactcactaaag

SEQ ID NO: 29098 - DNA, 18 bp, Artificial Sequence
  Synthetic DNA
cattacgacttactgtag

SEQ ID NO: 29099 - DNA, 18 bp, Artificial Sequence
  Synthetic DNA
ccatacgactcacttaag

SEQ ID NO: 29100 - DNA, 18 bp, Artificial Sequence
  Synthetic DNA
ctacacgactcaatatag

SEQ ID NO: 29101 - DNA, 18 bp, Artificial Sequence
  Synthetic DNA
ctatacatctcactatag

SEQ ID NO: 29102 - DNA, 18 bp, Artificial Sequence
  Synthetic DNA
ctatactacttactatag

SEQ ID NO: 29103 - DNA, 18 bp, Artificial Sequence
  Synthetic DNA
cttaacgactcactatag

SEQ ID NO: 29104 - DNA, 18 bp, Artificial Sequence
  Synthetic DNA
ctttacgagtcactatag

SEQ ID NO: 29105 - DNA, 18 bp, Artificial Sequence
  Synthetic DNA
gaatacgatacaccatag

SEQ ID NO: 29106 - DNA, 18 bp, Artificial Sequence
  Synthetic DNA
gagtacgtctcactaaag

SEQ ID NO: 29107 - DNA, 18 bp, Artificial Sequence
  Synthetic DNA
taaaacaactcaatttag

SEQ ID NO: 29108 - DNA, 18 bp, Artificial Sequence
  Synthetic DNA
taaaacaagtcactaaag

SEQ ID NO: 29109 - DNA, 18 bp, Artificial Sequence
  Synthetic DNA
taaaacacttcactatag

SEQ ID NO: 29110 - DNA, 18 bp, Artificial Sequence
  Synthetic DNA
taaaaccactcacaatcg

SEQ ID NO: 29111 - DNA, 18 bp, Artificial Sequence
  Synthetic DNA
taaaacgaatcaatttag

SEQ ID NO: 29112 - DNA, 18 bp, Artificial Sequence
  Synthetic DNA
taaaacgactcacattcg

SEQ ID NO: 29113 - DNA, 18 bp, Artificial Sequence
  Synthetic DNA
taaaacgattaactatgg

SEQ ID NO: 29114 - DNA, 18 bp, Artificial Sequence
  Synthetic DNA
taaaacgattaattatag

SEQ ID NO: 29115 - DNA, 18 bp, Artificial Sequence
  Synthetic DNA
taaaacgattcacttcag

SEQ ID NO: 29116 - DNA, 18 bp, Artificial Sequence
  Synthetic DNA
taaaacggtttactatag

SEQ ID NO: 29117 - DNA, 18 bp, Artificial Sequence
  Synthetic DNA
taaaacgtctcattaaag

SEQ ID NO: 29118 - DNA, 18 bp, Artificial Sequence
  Synthetic DNA
taaaacgtttcaatatag

SEQ ID NO: 29119 - DNA, 18 bp, Artificial Sequence
  Synthetic DNA
taaaactactcactttgg

SEQ ID NO: 29120 - DNA, 18 bp, Artificial Sequence
  Synthetic DNA
taaaactactcccaatag

SEQ ID NO: 29121 - DNA, 18 bp, Artificial Sequence
  Synthetic DNA
taaaaggaatcactaaag

SEQ ID NO: 29122 - DNA, 18 bp, Artificial Sequence
  Synthetic DNA
taaaatcactctctatag

SEQ ID NO: 29123 - DNA, 18 bp, Artificial Sequence
  Synthetic DNA
taaaatgacacactaaag

SEQ ID NO: 29124 - DNA, 18 bp, Artificial Sequence
  Synthetic DNA
taaaatgactcacgttag

SEQ ID NO: 29125 - DNA, 18 bp, Artificial Sequence
  Synthetic DNA
taaaatgacttagtatag

SEQ ID NO: 29126 - DNA, 18 bp, Artificial Sequence
  Synthetic DNA
taaaattactcacaatag

SEQ ID NO: 29127 - DNA, 18 bp, Artificial Sequence
  Synthetic DNA
taaagcaattcactatag

SEQ ID NO: 29128 - DNA, 18 bp, Artificial Sequence
  Synthetic DNA
taaagcgtctcacaatag

SEQ ID NO: 29129 - DNA, 18 bp, Artificial Sequence
  Synthetic DNA
taacaagaattactatag

SEQ ID NO: 29130 - DNA, 18 bp, Artificial Sequence
  Synthetic DNA
taacacgaaacacaatag

SEQ ID NO: 29131 - DNA, 18 bp, Artificial Sequence
  Synthetic DNA
taacacgacaatctatag

SEQ ID NO: 29132 - DNA, 18 bp, Artificial Sequence
  Synthetic DNA
taacacgactgacaaaag

SEQ ID NO: 29133 - DNA, 18 bp, Artificial Sequence
  Synthetic DNA
taacacgtctccctacag

SEQ ID NO: 29134 - DNA, 18 bp, Artificial Sequence
  Synthetic DNA
taacactactcaatttag

SEQ ID NO: 29135 - DNA, 18 bp, Artificial Sequence
  Synthetic DNA
taacactactcacttaag

SEQ ID NO: 29136 - DNA, 18 bp, Artificial Sequence
  Synthetic DNA
taacatgacacaccatag

SEQ ID NO: 29137 - DNA, 18 bp, Artificial Sequence
  Synthetic DNA
taagacgcctcacagtag

SEQ ID NO: 29138 - DNA, 18 bp, Artificial Sequence
  Synthetic DNA
taagacgtcactctatag

SEQ ID NO: 29139 - DNA, 18 bp, Artificial Sequence
  Synthetic DNA
taataagtcacattatag

SEQ ID NO: 29140 - DNA, 18 bp, Artificial Sequence
  Synthetic DNA
taataagtctatctatag

SEQ ID NO: 29141 - DNA, 18 bp, Artificial Sequence
  Synthetic DNA
taataagtttcactatcg

SEQ ID NO: 29142 - DNA, 18 bp, Artificial Sequence
  Synthetic DNA
taataatatttactatag

SEQ ID NO: 29143 - DNA, 18 bp, Artificial Sequence
  Synthetic DNA
taataattcttactatag

SEQ ID NO: 29144 - DNA, 18 bp, Artificial Sequence
  Synthetic DNA
taatacaacagactagag

SEQ ID NO: 29145 - DNA, 18 bp, Artificial Sequence
  Synthetic DNA
taatacaaccctcaatag

SEQ ID NO: 29146 - DNA, 18 bp, Artificial Sequence
  Synthetic DNA
taatacaactaacttaag

SEQ ID NO: 29147 - DNA, 18 bp, Artificial Sequence
  Synthetic DNA
taatacaactcaaaagag

SEQ ID NO: 29148 - DNA, 18 bp, Artificial Sequence
  Synthetic DNA
taatacaactctctttcg

SEQ ID NO: 29149 - DNA, 18 bp, Artificial Sequence
  Synthetic DNA
taatacaatatactatag

SEQ ID NO: 29150 - DNA, 18 bp, Artificial Sequence
  Synthetic DNA
taatacaattcattatcg

SEQ ID NO: 29151 - DNA, 18 bp, Artificial Sequence
  Synthetic DNA
taatacacctcacttcag

SEQ ID NO: 29152 - DNA, 18 bp, Artificial Sequence
  Synthetic DNA
taatacatttcacaatag

SEQ ID NO: 29153 - DNA, 18 bp, Artificial Sequence
  Synthetic DNA
taataccagtccatatag

SEQ ID NO: 29154 - DNA, 18 bp, Artificial Sequence
  Synthetic DNA
taatacgaaattctatag

SEQ ID NO: 29155 - DNA, 18 bp, Artificial Sequence
  Synthetic DNA
taatacgaatctctccag

SEQ ID NO: 29156 - DNA, 18 bp, Artificial Sequence
  Synthetic DNA
taatacgaatttttatag

SEQ ID NO: 29157 - DNA, 18 bp, Artificial Sequence
  Synthetic DNA
taatacgacactcaacag

SEQ ID NO: 29158 - DNA, 18 bp, Artificial Sequence
  Synthetic DNA
taatacgaccctcattag

SEQ ID NO: 29159 - DNA, 18 bp, Artificial Sequence
  Synthetic DNA
taatacgaccgaatatcg

SEQ ID NO: 29160 - DNA, 18 bp, Artificial Sequence
  Synthetic DNA
taatacgacgctttaaag

SEQ ID NO: 29161 - DNA, 18 bp, Artificial Sequence
  Synthetic DNA
taatacgactaaattcag

SEQ ID NO: 29162 - DNA, 18 bp, Artificial Sequence
  Synthetic DNA
taatacgactctcaaagg

SEQ ID NO: 29163 - DNA, 18 bp, Artificial Sequence
  Synthetic DNA
taatacgactttccaaag

SEQ ID NO: 29164 - DNA, 18 bp, Artificial Sequence
  Synthetic DNA
taatacgagacaatttag

SEQ ID NO: 29165 - DNA, 18 bp, Artificial Sequence
  Synthetic DNA
taatacgagatactatgg

SEQ ID NO: 29166 - DNA, 18 bp, Artificial Sequence
  Synthetic DNA
taatacgataaactatgg

SEQ ID NO: 29167 - DNA, 18 bp, Artificial Sequence
  Synthetic DNA
taatacgatacacgacag

SEQ ID NO: 29168 - DNA, 18 bp, Artificial Sequence
  Synthetic DNA
taatacgatgcaccgtag

SEQ ID NO: 29169 - DNA, 18 bp, Artificial Sequence
  Synthetic DNA
taatacggctctttaaag

SEQ ID NO: 29170 - DNA, 18 bp, Artificial Sequence
  Synthetic DNA
taatacgtatcactccag

SEQ ID NO: 29171 - DNA, 18 bp, Artificial Sequence
  Synthetic DNA
taatacgtcacagaatag

SEQ ID NO: 29172 - DNA, 18 bp, Artificial Sequence
  Synthetic DNA
taatacgtctcacacaag

SEQ ID NO: 29173 - DNA, 18 bp, Artificial Sequence
  Synthetic DNA
taatacgtctcccttcag

SEQ ID NO: 29174 - DNA, 18 bp, Artificial Sequence
  Synthetic DNA
taatacgtctctctgaag

SEQ ID NO: 29175 - DNA, 18 bp, Artificial Sequence
  Synthetic DNA
taatacgtcttacaaaag

SEQ ID NO: 29176 - DNA, 18 bp, Artificial Sequence
  Synthetic DNA
taatacgtcttaccttag

SEQ ID NO: 29177 - DNA, 18 bp, Artificial Sequence
  Synthetic DNA
taatacgtttcactcaag

SEQ ID NO: 29178 - DNA, 18 bp, Artificial Sequence
  Synthetic DNA
taatacgtttcactttcg

SEQ ID NO: 29179 - DNA, 18 bp, Artificial Sequence
  Synthetic DNA
taatactaataactaaag

SEQ ID NO: 29180 - DNA, 18 bp, Artificial Sequence
  Synthetic DNA
taatactactaactctgg

SEQ ID NO: 29181 - DNA, 18 bp, Artificial Sequence
  Synthetic DNA
taatactatacaccatag

SEQ ID NO: 29182 - DNA, 18 bp, Artificial Sequence
  Synthetic DNA
taatactcctcaacatag

SEQ ID NO: 29183 - DNA, 18 bp, Artificial Sequence
  Synthetic DNA
taatactgctcattaaag

SEQ ID NO: 29184 - DNA, 18 bp, Artificial Sequence
  Synthetic DNA
taatactgctctatatag

SEQ ID NO: 29185 - DNA, 18 bp, Artificial Sequence
  Synthetic DNA
taatacttctcacattag

SEQ ID NO: 29186 - DNA, 18 bp, Artificial Sequence
  Synthetic DNA
taatacttcttacaatag

SEQ ID NO: 29187 - DNA, 18 bp, Artificial Sequence
  Synthetic DNA
taatacttcttactatcg

SEQ ID NO: 29188 - DNA, 18 bp, Artificial Sequence
  Synthetic DNA
taataggactccccttag

SEQ ID NO: 29189 - DNA, 18 bp, Artificial Sequence
  Synthetic DNA
taataggtcttactaaag

SEQ ID NO: 29190 - DNA, 18 bp, Artificial Sequence
  Synthetic DNA
taatataactccctttag

SEQ ID NO: 29191 - DNA, 18 bp, Artificial Sequence
  Synthetic DNA
taatataattcagtatag

SEQ ID NO: 29192 - DNA, 18 bp, Artificial Sequence
  Synthetic DNA
taatatctcccactatag

SEQ ID NO: 29193 - DNA, 18 bp, Artificial Sequence
  Synthetic DNA
taatatgaaccactttag

SEQ ID NO: 29194 - DNA, 18 bp, Artificial Sequence
  Synthetic DNA
taatatgacacaatatcg

SEQ ID NO: 29195 - DNA, 18 bp, Artificial Sequence
  Synthetic DNA
taatatgactcacttccg

SEQ ID NO: 29196 - DNA, 18 bp, Artificial Sequence
  Synthetic DNA
taatatgattcattacag

SEQ ID NO: 29197 - DNA, 18 bp, Artificial Sequence
  Synthetic DNA
taatatgtcatactatag

SEQ ID NO: 29198 - DNA, 18 bp, Artificial Sequence
  Synthetic DNA
taatcagactcaaaatag

SEQ ID NO: 29199 - DNA, 18 bp, Artificial Sequence
  Synthetic DNA
taatcagattctctatag

SEQ ID NO: 29200 - DNA, 18 bp, Artificial Sequence
  Synthetic DNA
taatccgacactctttag

SEQ ID NO: 29201 - DNA, 18 bp, Artificial Sequence
  Synthetic DNA
taatccgactctcttaag

SEQ ID NO: 29202 - DNA, 18 bp, Artificial Sequence
  Synthetic DNA
taatccgattcacttaag

SEQ ID NO: 29203 - DNA, 18 bp, Artificial Sequence
  Synthetic DNA
taatccgattcactttgg

SEQ ID NO: 29204 - DNA, 18 bp, Artificial Sequence
  Synthetic DNA
taatccgccacacaatag

SEQ ID NO: 29205 - DNA, 18 bp, Artificial Sequence
  Synthetic DNA
taatcctaatcactaaag

SEQ ID NO: 29206 - DNA, 18 bp, Artificial Sequence
  Synthetic DNA
taatccttcttactatag

SEQ ID NO: 29207 - DNA, 18 bp, Artificial Sequence
  Synthetic DNA
taatctgacacacaatag

SEQ ID NO: 29208 - DNA, 18 bp, Artificial Sequence
  Synthetic DNA
taatgagactcataatag

SEQ ID NO: 29209 - DNA, 18 bp, Artificial Sequence
  Synthetic DNA
taatgagactctctaaag

SEQ ID NO: 29210 - DNA, 18 bp, Artificial Sequence
  Synthetic DNA
taatgcgactcaccccag

SEQ ID NO: 29211 - DNA, 18 bp, Artificial Sequence
  Synthetic DNA
taatgcgactcagttcag

SEQ ID NO: 29212 - DNA, 18 bp, Artificial Sequence
  Synthetic DNA
taatgcgactctctgtgg

SEQ ID NO: 29213 - DNA, 18 bp, Artificial Sequence
  Synthetic DNA
taatgcgatcctctatag

SEQ ID NO: 29214 - DNA, 18 bp, Artificial Sequence
  Synthetic DNA
taatgggactctctttag

SEQ ID NO: 29215 - DNA, 18 bp, Artificial Sequence
  Synthetic DNA
tacaacgactctccatag

SEQ ID NO: 29216 - DNA, 18 bp, Artificial Sequence
  Synthetic DNA
tactaacacacactatag

SEQ ID NO: 29217 - DNA, 18 bp, Artificial Sequence
  Synthetic DNA
tactaagaatcaccatag

SEQ ID NO: 29218 - DNA, 18 bp, Artificial Sequence
  Synthetic DNA
tactacatcacactatag

SEQ ID NO: 29219 - DNA, 18 bp, Artificial Sequence
  Synthetic DNA
tactaccacaccctatag

SEQ ID NO: 29220 - DNA, 18 bp, Artificial Sequence
  Synthetic DNA
tactacgactatctacag

SEQ ID NO: 29221 - DNA, 18 bp, Artificial Sequence
  Synthetic DNA
tactacgactcatcatcg

SEQ ID NO: 29222 - DNA, 18 bp, Artificial Sequence
  Synthetic DNA
tactacgatacactagag

SEQ ID NO: 29223 - DNA, 18 bp, Artificial Sequence
  Synthetic DNA
tactacttatcactatag

SEQ ID NO: 29224 - DNA, 18 bp, Artificial Sequence
  Synthetic DNA
tagaccgactcactatcg

SEQ ID NO: 29225 - DNA, 18 bp, Artificial Sequence
  Synthetic DNA
tagcaagattcactatag

SEQ ID NO: 29226 - DNA, 18 bp, Artificial Sequence
  Synthetic DNA
tagtaagacacactttag

SEQ ID NO: 29227 - DNA, 18 bp, Artificial Sequence
  Synthetic DNA
tagtacgaatctctttag

SEQ ID NO: 29228 - DNA, 18 bp, Artificial Sequence
  Synthetic DNA
tagtacgactcaataacg

SEQ ID NO: 29229 - DNA, 18 bp, Artificial Sequence
  Synthetic DNA
tagtacgtctcaataaag

SEQ ID NO: 29230 - DNA, 18 bp, Artificial Sequence
  Synthetic DNA
tataacgacacactctag

SEQ ID NO: 29231 - DNA, 18 bp, Artificial Sequence
  Synthetic DNA
tataacggcacactatag

SEQ ID NO: 29232 - DNA, 18 bp, Artificial Sequence
  Synthetic DNA
tataactactcagtatag

SEQ ID NO: 29233 - DNA, 18 bp, Artificial Sequence
  Synthetic DNA
tatcacgtttcactatag

SEQ ID NO: 29234 - DNA, 18 bp, Artificial Sequence
  Synthetic DNA
tatgacgactcactttgg

SEQ ID NO: 29235 - DNA, 18 bp, Artificial Sequence
  Synthetic DNA
tatgactactcagtatag

SEQ ID NO: 29236 - DNA, 18 bp, Artificial Sequence
  Synthetic DNA
tattacaactaactaaag

SEQ ID NO: 29237 - DNA, 18 bp, Artificial Sequence
  Synthetic DNA
tattacaattcactttag

SEQ ID NO: 29238 - DNA, 18 bp, Artificial Sequence
  Synthetic DNA
tattacgacactctgtag

SEQ ID NO: 29239 - DNA, 18 bp, Artificial Sequence
  Synthetic DNA
tattacgactaactgtcg

SEQ ID NO: 29240 - DNA, 18 bp, Artificial Sequence
  Synthetic DNA
tattacgactcaacaaag

SEQ ID NO: 29241 - DNA, 18 bp, Artificial Sequence
  Synthetic DNA
tattacgactcatgaaag

SEQ ID NO: 29242 - DNA, 18 bp, Artificial Sequence
  Synthetic DNA
tattacgagtctctaaag

SEQ ID NO: 29243 - DNA, 18 bp, Artificial Sequence
  Synthetic DNA
tattacgattctcgatag

SEQ ID NO: 29244 - DNA, 18 bp, Artificial Sequence
  Synthetic DNA
tattacgcctcaatatgg

SEQ ID NO: 29245 - DNA, 18 bp, Artificial Sequence
  Synthetic DNA
tattacggatcattatag

SEQ ID NO: 29246 - DNA, 18 bp, Artificial Sequence
  Synthetic DNA
tattacgtctccccatag

SEQ ID NO: 29247 - DNA, 18 bp, Artificial Sequence
  Synthetic DNA
tattactactcactaacg

SEQ ID NO: 29248 - DNA, 18 bp, Artificial Sequence
  Synthetic DNA
tattatgacactctatag

SEQ ID NO: 29249 - DNA, 18 bp, Artificial Sequence
  Synthetic DNA
tattccgactttctatag

SEQ ID NO: 29250 - DNA, 18 bp, Artificial Sequence
  Synthetic DNA
tattgcaaatcactatag

SEQ ID NO: 29251 - DNA, 18 bp, Artificial Sequence
  Synthetic DNA
tattgcatctcactatag

SEQ ID NO: 29252 - DNA, 18 bp, Artificial Sequence
  Synthetic DNA
tcaaacaactctctatag

SEQ ID NO: 29253 - DNA, 18 bp, Artificial Sequence
  Synthetic DNA
tcataaaaatcactatag

SEQ ID NO: 29254 - DNA, 18 bp, Artificial Sequence
  Synthetic DNA
tcataatactcactttag

SEQ ID NO: 29255 - DNA, 18 bp, Artificial Sequence
  Synthetic DNA
tcataatactcattatag

SEQ ID NO: 29256 - DNA, 18 bp, Artificial Sequence
  Synthetic DNA
tcatacaacttactttag

SEQ ID NO: 29257 - DNA, 18 bp, Artificial Sequence
  Synthetic DNA
tcatacatctcactatcg

SEQ ID NO: 29258 - DNA, 18 bp, Artificial Sequence
  Synthetic DNA
tcataccactctcaatag

SEQ ID NO: 29259 - DNA, 18 bp, Artificial Sequence
  Synthetic DNA
tcatacgacacaataaag

SEQ ID NO: 29260 - DNA, 18 bp, Artificial Sequence
  Synthetic DNA
tcatacgactcacattgg

SEQ ID NO: 29261 - DNA, 18 bp, Artificial Sequence
  Synthetic DNA
tcatacgactctccatcg

SEQ ID NO: 29262 - DNA, 18 bp, Artificial Sequence
  Synthetic DNA
tcatacgatacactacag

SEQ ID NO: 29263 - DNA, 18 bp, Artificial Sequence
  Synthetic DNA
tcatacgtttcaatatag

SEQ ID NO: 29264 - DNA, 18 bp, Artificial Sequence
  Synthetic DNA
tcatactcctcacaatag

SEQ ID NO: 29265 - DNA, 18 bp, Artificial Sequence
  Synthetic DNA
tcatacttctaactatag

SEQ ID NO: 29266 - DNA, 18 bp, Artificial Sequence
  Synthetic DNA
tcatatgaccctctatag

SEQ ID NO: 29267 - DNA, 18 bp, Artificial Sequence
  Synthetic DNA
tcatgctactcactttag

SEQ ID NO: 29268 - DNA, 18 bp, Artificial Sequence
  Synthetic DNA
tcttactactcactgtag

SEQ ID NO: 29269 - DNA, 18 bp, Artificial Sequence
  Synthetic DNA
tgaaacacctcactatag

SEQ ID NO: 29270 - DNA, 18 bp, Artificial Sequence
  Synthetic DNA
tgaaacgactcaccttag

SEQ ID NO: 29271 - DNA, 18 bp, Artificial Sequence
  Synthetic DNA
tgaaaggaatcactatag

SEQ ID NO: 29272 - DNA, 18 bp, Artificial Sequence
  Synthetic DNA
tgataaaactcattatag

SEQ ID NO: 29273 - DNA, 18 bp, Artificial Sequence
  Synthetic DNA
tgataagacctactatag

SEQ ID NO: 29274 - DNA, 18 bp, Artificial Sequence
  Synthetic DNA
tgataccacttactaaag

SEQ ID NO: 29275 - DNA, 18 bp, Artificial Sequence
  Synthetic DNA
tgatacgactctcttcag

SEQ ID NO: 29276 - DNA, 18 bp, Artificial Sequence
  Synthetic DNA
tgatacgcgtcaatatag

SEQ ID NO: 29277 - DNA, 18 bp, Artificial Sequence
  Synthetic DNA
tgatacggctctctaaag

SEQ ID NO: 29278 - DNA, 18 bp, Artificial Sequence
  Synthetic DNA
tgataggacacattatag

SEQ ID NO: 29279 - DNA, 18 bp, Artificial Sequence
  Synthetic DNA
tgatatgactctctttag

SEQ ID NO: 29280 - DNA, 18 bp, Artificial Sequence
  Synthetic DNA
tgatgggactcattatag

SEQ ID NO: 29281 - DNA, 18 bp, Artificial Sequence
  Synthetic DNA
tggtacgacttactatgg

SEQ ID NO: 29282 - DNA, 18 bp, Artificial Sequence
  Synthetic DNA
tgttaagactcaatatag

SEQ ID NO: 29283 - DNA, 18 bp, Artificial Sequence
  Synthetic DNA
ttaaaccactcaccatag

SEQ ID NO: 29284 - DNA, 18 bp, Artificial Sequence
  Synthetic DNA
ttaaacgactacctatag

SEQ ID NO: 29285 - DNA, 18 bp, Artificial Sequence
  Synthetic DNA
ttaaacgactcacaacag

SEQ ID NO: 29286 - DNA, 18 bp, Artificial Sequence
  Synthetic DNA
ttaaacgactcacattag

SEQ ID NO: 29287 - DNA, 18 bp, Artificial Sequence
  Synthetic DNA
ttaaacgactcactaacg

SEQ ID NO: 29288 - DNA, 18 bp, Artificial Sequence
  Synthetic DNA
ttaaactactcacaatag

SEQ ID NO: 29289 - DNA, 18 bp, Artificial Sequence
  Synthetic DNA
ttaaactactgactatag

SEQ ID NO: 29290 - DNA, 18 bp, Artificial Sequence
  Synthetic DNA
ttaagagactcactatag

SEQ ID NO: 29291 - DNA, 18 bp, Artificial Sequence
  Synthetic DNA
ttacacaactcattatag

SEQ ID NO: 29292 - DNA, 18 bp, Artificial Sequence
  Synthetic DNA
ttacagtactcactatag

SEQ ID NO: 29293 - DNA, 18 bp, Artificial Sequence
  Synthetic DNA
ttaggcgactcactacag

SEQ ID NO: 29294 - DNA, 18 bp, Artificial Sequence
  Synthetic DNA
ttataaaactcaatatag

SEQ ID NO: 29295 - DNA, 18 bp, Artificial Sequence
  Synthetic DNA
ttataagaatcacaatag

SEQ ID NO: 29296 - DNA, 18 bp, Artificial Sequence
  Synthetic DNA
ttataagtctccctatag

SEQ ID NO: 29297 - DNA, 18 bp, Artificial Sequence
  Synthetic DNA
ttataccactcccgatag

SEQ ID NO: 29298 - DNA, 18 bp, Artificial Sequence
  Synthetic DNA
ttataccattcactttag

SEQ ID NO: 29299 - DNA, 18 bp, Artificial Sequence
  Synthetic DNA
ttatacgaataaatatag

SEQ ID NO: 29300 - DNA, 18 bp, Artificial Sequence
  Synthetic DNA
ttatacgacacacttcag

SEQ ID NO: 29301 - DNA, 18 bp, Artificial Sequence
  Synthetic DNA
ttatacgacactcgatag

SEQ ID NO: 29302 - DNA, 18 bp, Artificial Sequence
  Synthetic DNA
ttatacgacccaatttag

SEQ ID NO: 29303 - DNA, 18 bp, Artificial Sequence
  Synthetic DNA
ttatacgactccctgaag

SEQ ID NO: 29304 - DNA, 18 bp, Artificial Sequence
  Synthetic DNA
ttatacgactttctagag

SEQ ID NO: 29305 - DNA, 18 bp, Artificial Sequence
  Synthetic DNA
ttatacgagtgactaaag

SEQ ID NO: 29306 - DNA, 18 bp, Artificial Sequence
  Synthetic DNA
ttatacgtcccattatag

SEQ ID NO: 29307 - DNA, 18 bp, Artificial Sequence
  Synthetic DNA
ttatacgtcttactacag

SEQ ID NO: 29308 - DNA, 18 bp, Artificial Sequence
  Synthetic DNA
ttatactactgtctatag

SEQ ID NO: 29309 - DNA, 18 bp, Artificial Sequence
  Synthetic DNA
ttatactggtcactatag

SEQ ID NO: 29310 - DNA, 18 bp, Artificial Sequence
  Synthetic DNA
ttatagcactaactatag

SEQ ID NO: 29311 - DNA, 18 bp, Artificial Sequence
  Synthetic DNA
ttatagggctcactttag

SEQ ID NO: 29312 - DNA, 18 bp, Artificial Sequence
  Synthetic DNA
ttatagttctcactatag

SEQ ID NO: 29313 - DNA, 18 bp, Artificial Sequence
  Synthetic DNA
ttatccgactcacaaaag

SEQ ID NO: 29314 - DNA, 18 bp, Artificial Sequence
  Synthetic DNA
ttatccgactcattaaag

SEQ ID NO: 29315 - DNA, 18 bp, Artificial Sequence
  Synthetic DNA
ttatgcgacccattatag

SEQ ID NO: 29316 - DNA, 18 bp, Artificial Sequence
  Synthetic DNA
ttatgcgatacactatag

SEQ ID NO: 29317 - DNA, 18 bp, Artificial Sequence
  Synthetic DNA
ttctaagactcactaaag

SEQ ID NO: 29318 - DNA, 18 bp, Artificial Sequence
  Synthetic DNA
ttctacgatacactatag

SEQ ID NO: 29319 - DNA, 18 bp, Artificial Sequence
  Synthetic DNA
ttctatgactcactacag

SEQ ID NO: 29320 - DNA, 18 bp, Artificial Sequence
  Synthetic DNA
ttgtacgacatactatag

SEQ ID NO: 29321 - DNA, 18 bp, Artificial Sequence
  Synthetic DNA
ttgtacgattaactatag

SEQ ID NO: 29322 - DNA, 18 bp, Artificial Sequence
  Synthetic DNA
tttgacgactcactttag

SEQ ID NO: 29323 - DNA, 18 bp, Artificial Sequence
  Synthetic DNA
ttttacgaataactatag

SEQ ID NO: 29324 - DNA, 18 bp, Artificial Sequence
  Synthetic DNA
ttttacgacacactatgg

SEQ ID NO: 29325 - DNA, 18 bp, Artificial Sequence
  Synthetic DNA
ttttacgactcattaaag

SEQ ID NO: 29326 - DNA, 18 bp, Artificial Sequence
  Synthetic DNA
ttttacgtgtcactatag

SEQ ID NO: 29327 - DNA, 18 bp, Artificial Sequence
  Synthetic DNA
taatacgtcacacaattg

SEQ ID NO: 29328 - DNA, 18 bp, Artificial Sequence
  Synthetic DNA
tatttcgactcacaaaag

SEQ ID NO: 29329 - DNA, 18 bp, Artificial Sequence
  Synthetic DNA
ttatacgacacacttttg

SEQ ID NO: 29330 - DNA, 18 bp, Artificial Sequence
  Synthetic DNA
atatacgtctcactattg

SEQ ID NO: 29331 - DNA, 18 bp, Artificial Sequence
  Synthetic DNA
tattacgtcccactattg

SEQ ID NO: 29332 - DNA, 18 bp, Artificial Sequence
  Synthetic DNA
ttatacgtcccactattg

SEQ ID NO: 29333 - DNA, 18 bp, Artificial Sequence
  Synthetic DNA
aaaaacatctcactatag

SEQ ID NO: 29334 - DNA, 18 bp, Artificial Sequence
  Synthetic DNA
atatacgaatcactttag

SEQ ID NO: 29335 - DNA, 18 bp, Artificial Sequence
  Synthetic DNA
taatatgattcacattag

SEQ ID NO: 29336 - DNA, 18 bp, Artificial Sequence
  Synthetic DNA
tataacgtctcactttag

SEQ ID NO: 29337 - DNA, 18 bp, Artificial Sequence
  Synthetic DNA
tattacgactcataaaag

SEQ ID NO: 29338 - DNA, 18 bp, Artificial Sequence
  Synthetic DNA
ttatacaacacactaaag

SEQ ID NO: 29339 - DNA, 18 bp, Artificial Sequence
  Synthetic DNA
ttttactactcactaaag

SEQ ID NO: 29340 - DNA, 18 bp, Artificial Sequence
  Synthetic DNA
caattcgacccactattg

SEQ ID NO: 29341 - DNA, 18 bp, Artificial Sequence
  Synthetic DNA
taattcgacacgctaaag

SEQ ID NO: 29342 - DNA, 18 bp, Artificial Sequence
  Synthetic DNA
agatacgacacactattg

SEQ ID NO: 29343 - DNA, 18 bp, Artificial Sequence
  Synthetic DNA
taatacgtttcaccattg

SEQ ID NO: 29344 - DNA, 18 bp, Artificial Sequence
  Synthetic DNA
taatacttctaactattg

SEQ ID NO: 29345 - DNA, 18 bp, Artificial Sequence
  Synthetic DNA
taatatgtctcaatattg

SEQ ID NO: 29346 - DNA, 18 bp, Artificial Sequence
  Synthetic DNA
taatccgtctcacaattg

SEQ ID NO: 29347 - DNA, 18 bp, Artificial Sequence
  Synthetic DNA
taattcgaatcacttaag

SEQ ID NO: 29348 - DNA, 18 bp, Artificial Sequence
  Synthetic DNA
taattcgacactctttag

SEQ ID NO: 29349 - DNA, 18 bp, Artificial Sequence
  Synthetic DNA
taattctattctctatag

SEQ ID NO: 29350 - DNA, 18 bp, Artificial Sequence
  Synthetic DNA
tatttcgtctcactacag

SEQ ID NO: 29351 - DNA, 18 bp, Artificial Sequence
  Synthetic DNA
ttatacgattcactactg

SEQ ID NO: 29352 - DNA, 18 bp, Artificial Sequence
  Synthetic DNA
ttattccactcactctag

SEQ ID NO: 29353 - DNA, 18 bp, Artificial Sequence
  Synthetic DNA
ttattcgtcccactatag

SEQ ID NO: 29354 - DNA, 18 bp, Artificial Sequence
  Synthetic DNA
aaatacgtctctcaatag

SEQ ID NO: 29355 - DNA, 18 bp, Artificial Sequence
  Synthetic DNA
aaatacgttacactatag

SEQ ID NO: 29356 - DNA, 18 bp, Artificial Sequence
  Synthetic DNA
aattacgactctctaaag

SEQ ID NO: 29357 - DNA, 18 bp, Artificial Sequence
  Synthetic DNA
ataaacgactcactatgg

SEQ ID NO: 29358 - DNA, 18 bp, Artificial Sequence
  Synthetic DNA
atatacgactctctatgg

SEQ ID NO: 29359 - DNA, 18 bp, Artificial Sequence
  Synthetic DNA
taatacaattctctttag

SEQ ID NO: 29360 - DNA, 18 bp, Artificial Sequence
  Synthetic DNA
taatacgaatctgtaaag

SEQ ID NO: 29361 - DNA, 18 bp, Artificial Sequence
  Synthetic DNA
taatacttctcattaaag

SEQ ID NO: 29362 - DNA, 18 bp, Artificial Sequence
  Synthetic DNA
taatacttttcactaaag

SEQ ID NO: 29363 - DNA, 18 bp, Artificial Sequence
  Synthetic DNA
taatacttttcactttag

SEQ ID NO: 29364 - DNA, 18 bp, Artificial Sequence
  Synthetic DNA
taatataacactctatag

SEQ ID NO: 29365 - DNA, 18 bp, Artificial Sequence
  Synthetic DNA
taatatgacacacaaaag

SEQ ID NO: 29366 - DNA, 18 bp, Artificial Sequence
  Synthetic DNA
taatatgacacattttag

SEQ ID NO: 29367 - DNA, 18 bp, Artificial Sequence
  Synthetic DNA
taatgctattcactttag

SEQ ID NO: 29368 - DNA, 18 bp, Artificial Sequence
  Synthetic DNA
tattacgattgtctatag

SEQ ID NO: 29369 - DNA, 18 bp, Artificial Sequence
  Synthetic DNA
tcatacatctcactaaag

SEQ ID NO: 29370 - DNA, 18 bp, Artificial Sequence
  Synthetic DNA
tgaaacgtctcactttag

SEQ ID NO: 29371 - DNA, 18 bp, Artificial Sequence
  Synthetic DNA
tgttacaactctctatag

SEQ ID NO: 29372 - DNA, 18 bp, Artificial Sequence
  Synthetic DNA
ttaaactactcaccatag

SEQ ID NO: 29373 - DNA, 18 bp, Artificial Sequence
  Synthetic DNA
ttatacgacactccatag

SEQ ID NO: 29374 - DNA, 18 bp, Artificial Sequence
  Synthetic DNA
ttatacggctcaccaaag

SEQ ID NO: 29375 - DNA, 18 bp, Artificial Sequence
  Synthetic DNA
ttatacgtattactatag

SEQ ID NO: 29376 - DNA, 18 bp, Artificial Sequence
  Synthetic DNA
ttatactcctcactatcg

SEQ ID NO: 29377 - DNA, 18 bp, Artificial Sequence
  Synthetic DNA
ttatatgaatcactaaag

SEQ ID NO: 29378 - DNA, 18 bp, Artificial Sequence
  Synthetic DNA
ttatccgcctcactttag

SEQ ID NO: 29379 - DNA, 18 bp, Artificial Sequence
  Synthetic DNA
ttgtacgactcacttaag

SEQ ID NO: 29380 - DNA, 18 bp, Artificial Sequence
  Synthetic DNA
tttcactactcactatag

SEQ ID NO: 29381 - DNA, 18 bp, Artificial Sequence
  Synthetic DNA
ttatacatctcactattg

SEQ ID NO: 29382 - DNA, 18 bp, Artificial Sequence
  Synthetic DNA
aaattcgactctctttag

SEQ ID NO: 29383 - DNA, 18 bp, Artificial Sequence
  Synthetic DNA
taatacgattctctactg

SEQ ID NO: 29384 - DNA, 18 bp, Artificial Sequence
  Synthetic DNA
taatatgactctcttttg

SEQ ID NO: 29385 - DNA, 18 bp, Artificial Sequence
  Synthetic DNA
tatttcaactcactttag

SEQ ID NO: 29386 - DNA, 18 bp, Artificial Sequence
  Synthetic DNA
aaatgcgtctcactaaag

SEQ ID NO: 29387 - DNA, 18 bp, Artificial Sequence
  Synthetic DNA
taatacgcctctcttaag

SEQ ID NO: 29388 - DNA, 18 bp, Artificial Sequence
  Synthetic DNA
taattcttctcactaaag

SEQ ID NO: 29389 - DNA, 18 bp, Artificial Sequence
  Synthetic DNA
ttaatcaactcactatag

SEQ ID NO: 29390 - DNA, 18 bp, Artificial Sequence
  Synthetic DNA
ttattagactctctatag

SEQ ID NO: 29391 - DNA, 18 bp, Artificial Sequence
  Synthetic DNA
aaaaacgtcttactatag

SEQ ID NO: 29392 - DNA, 18 bp, Artificial Sequence
  Synthetic DNA
atatacgactcacaaaag

SEQ ID NO: 29393 - DNA, 18 bp, Artificial Sequence
  Synthetic DNA
taatacgattttctttag

SEQ ID NO: 29394 - DNA, 18 bp, Artificial Sequence
  Synthetic DNA
taatatgtctctcaatag

SEQ ID NO: 29395 - DNA, 18 bp, Artificial Sequence
  Synthetic DNA
tattacgactctttttag

SEQ ID NO: 29396 - DNA, 18 bp, Artificial Sequence
  Synthetic DNA
tcatacgtctctctaaag

SEQ ID NO: 29397 - DNA, 18 bp, Artificial Sequence
  Synthetic DNA
ttttacgtctctctatag

SEQ ID NO: 29398 - DNA, 18 bp, Artificial Sequence
  Synthetic DNA
caattcgactaactattg

SEQ ID NO: 29399 - DNA, 18 bp, Artificial Sequence
  Synthetic DNA
taattcacctcgctatag

SEQ ID NO: 29400 - DNA, 18 bp, Artificial Sequence
  Synthetic DNA
taattcgaatcgctatgg

SEQ ID NO: 29401 - DNA, 18 bp, Artificial Sequence
  Synthetic DNA
taattctactcagtattg

SEQ ID NO: 29402 - DNA, 18 bp, Artificial Sequence
  Synthetic DNA
ttattcgactcactgttg

SEQ ID NO: 29403 - DNA, 18 bp, Artificial Sequence
  Synthetic DNA
aaatacctctcactattg

SEQ ID NO: 29404 - DNA, 18 bp, Artificial Sequence
  Synthetic DNA
aaatactactcacaattg

SEQ ID NO: 29405 - DNA, 18 bp, Artificial Sequence
  Synthetic DNA
aaattcaacacactatag

SEQ ID NO: 29406 - DNA, 18 bp, Artificial Sequence
  Synthetic DNA
aaattcaactcactttag

SEQ ID NO: 29407 - DNA, 18 bp, Artificial Sequence
  Synthetic DNA
aaattcgactcagaatag

SEQ ID NO: 29408 - DNA, 18 bp, Artificial Sequence
  Synthetic DNA
aaattctactcattatag

SEQ ID NO: 29409 - DNA, 18 bp, Artificial Sequence
  Synthetic DNA
aattacggctcactattg

SEQ ID NO: 29410 - DNA, 18 bp, Artificial Sequence
  Synthetic DNA
caaatcgactcattatag

SEQ ID NO: 29411 - DNA, 18 bp, Artificial Sequence
  Synthetic DNA
caacacgaatcactattg

SEQ ID NO: 29412 - DNA, 18 bp, Artificial Sequence
  Synthetic DNA
caatacaactcacttttg

SEQ ID NO: 29413 - DNA, 18 bp, Artificial Sequence
  Synthetic DNA
caatacgaatcactaatg

SEQ ID NO: 29414 - DNA, 18 bp, Artificial Sequence
  Synthetic DNA
caattcgactaactaaag

SEQ ID NO: 29415 - DNA, 18 bp, Artificial Sequence
  Synthetic DNA
caattctattcactatag

SEQ ID NO: 29416 - DNA, 18 bp, Artificial Sequence
  Synthetic DNA
catttcgactcattatag

SEQ ID NO: 29417 - DNA, 18 bp, Artificial Sequence
  Synthetic DNA
gattacgactctctattg

SEQ ID NO: 29418 - DNA, 18 bp, Artificial Sequence
  Synthetic DNA
taaaacgactcacagttg

SEQ ID NO: 29419 - DNA, 18 bp, Artificial Sequence
  Synthetic DNA
taaaagaactcactattg

SEQ ID NO: 29420 - DNA, 18 bp, Artificial Sequence
  Synthetic DNA
taaatcgactccccatag

SEQ ID NO: 29421 - DNA, 18 bp, Artificial Sequence
  Synthetic DNA
taacaaaactcactattg

SEQ ID NO: 29422 - DNA, 18 bp, Artificial Sequence
  Synthetic DNA
taacacgactgaatattg

SEQ ID NO: 29423 - DNA, 18 bp, Artificial Sequence
  Synthetic DNA
taacacgtttcactattg

SEQ ID NO: 29424 - DNA, 18 bp, Artificial Sequence
  Synthetic DNA
taactcgattgactatag

SEQ ID NO: 29425 - DNA, 18 bp, Artificial Sequence
  Synthetic DNA
taatacaactctctaatg

SEQ ID NO: 29426 - DNA, 18 bp, Artificial Sequence
  Synthetic DNA
taataccactcataattg

SEQ ID NO: 29427 - DNA, 18 bp, Artificial Sequence
  Synthetic DNA
taatacctcacactattg

SEQ ID NO: 29428 - DNA, 18 bp, Artificial Sequence
  Synthetic DNA
taatacctctcactactg

SEQ ID NO: 29429 - DNA, 18 bp, Artificial Sequence
  Synthetic DNA
taatacgactaacagttg

SEQ ID NO: 29430 - DNA, 18 bp, Artificial Sequence
  Synthetic DNA
taatacgactctctgatg

SEQ ID NO: 29431 - DNA, 18 bp, Artificial Sequence
  Synthetic DNA
taatacgactttatattg

SEQ ID NO: 29432 - DNA, 18 bp, Artificial Sequence
  Synthetic DNA
taatacgattaattattg

SEQ ID NO: 29433 - DNA, 18 bp, Artificial Sequence
  Synthetic DNA
taatacgattaggtatag

SEQ ID NO: 29434 - DNA, 18 bp, Artificial Sequence
  Synthetic DNA
taatacgattcaaaattg

SEQ ID NO: 29435 - DNA, 18 bp, Artificial Sequence
  Synthetic DNA
taatacgattcaattttg

SEQ ID NO: 29436 - DNA, 18 bp, Artificial Sequence
  Synthetic DNA
taatacggctcccaattg

SEQ ID NO: 29437 - DNA, 18 bp, Artificial Sequence
  Synthetic DNA
taatacgtcacactagtg

SEQ ID NO: 29438 - DNA, 18 bp, Artificial Sequence
  Synthetic DNA
taatacgtctcccttttg

SEQ ID NO: 29439 - DNA, 18 bp, Artificial Sequence
  Synthetic DNA
taatacgtctggatatag

SEQ ID NO: 29440 - DNA, 18 bp, Artificial Sequence
  Synthetic DNA
taatactacacgcaatag

SEQ ID NO: 29441 - DNA, 18 bp, Artificial Sequence
  Synthetic DNA
taatactacccaccattg

SEQ ID NO: 29442 - DNA, 18 bp, Artificial Sequence
  Synthetic DNA
taatactacccactaatg

SEQ ID NO: 29443 - DNA, 18 bp, Artificial Sequence
  Synthetic DNA
taatactactcaccaatg

SEQ ID NO: 29444 - DNA, 18 bp, Artificial Sequence
  Synthetic DNA
taatactactcgcttaag

SEQ ID NO: 29445 - DNA, 18 bp, Artificial Sequence
  Synthetic DNA
taatactcctcgcaatag

SEQ ID NO: 29446 - DNA, 18 bp, Artificial Sequence
  Synthetic DNA
taataggaatcattattg

SEQ ID NO: 29447 - DNA, 18 bp, Artificial Sequence
  Synthetic DNA
taataggactcaccaatg

SEQ ID NO: 29448 - DNA, 18 bp, Artificial Sequence
  Synthetic DNA
taataggtctaactattg

SEQ ID NO: 29449 - DNA, 18 bp, Artificial Sequence
  Synthetic DNA
taatatgactctctcttg

SEQ ID NO: 29450 - DNA, 18 bp, Artificial Sequence
  Synthetic DNA
taatccgactttctattg

SEQ ID NO: 29451 - DNA, 18 bp, Artificial Sequence
  Synthetic DNA
taatccgtctaactattg

SEQ ID NO: 29452 - DNA, 18 bp, Artificial Sequence
  Synthetic DNA
taatccgtctcgctatcg

SEQ ID NO: 29453 - DNA, 18 bp, Artificial Sequence
  Synthetic DNA
taatgagcctcactattg

SEQ ID NO: 29454 - DNA, 18 bp, Artificial Sequence
  Synthetic DNA
taatgcgacaaactattg

SEQ ID NO: 29455 - DNA, 18 bp, Artificial Sequence
  Synthetic DNA
taattatacttactatag

SEQ ID NO: 29456 - DNA, 18 bp, Artificial Sequence
  Synthetic DNA
taattcaaatcacaatag

SEQ ID NO: 29457 - DNA, 18 bp, Artificial Sequence
  Synthetic DNA
taattcaacaccctatag

SEQ ID NO: 29458 - DNA, 18 bp, Artificial Sequence
  Synthetic DNA
taattcatcttactatag

SEQ ID NO: 29459 - DNA, 18 bp, Artificial Sequence
  Synthetic DNA
taattccaatcacaatag

SEQ ID NO: 29460 - DNA, 18 bp, Artificial Sequence
  Synthetic DNA
taattcctttcactatag

SEQ ID NO: 29461 - DNA, 18 bp, Artificial Sequence
  Synthetic DNA
taattcgaaactctatag

SEQ ID NO: 29462 - DNA, 18 bp, Artificial Sequence
  Synthetic DNA
taattcgaatctctgtag

SEQ ID NO: 29463 - DNA, 18 bp, Artificial Sequence
  Synthetic DNA
taattcgacccagaatag

SEQ ID NO: 29464 - DNA, 18 bp, Artificial Sequence
  Synthetic DNA
taattcgactaacattag

SEQ ID NO: 29465 - DNA, 18 bp, Artificial Sequence
  Synthetic DNA
taattcgacttactttcg

SEQ ID NO: 29466 - DNA, 18 bp, Artificial Sequence
  Synthetic DNA
taattcgagacactaaag

SEQ ID NO: 29467 - DNA, 18 bp, Artificial Sequence
  Synthetic DNA
taattcgatacactagag

SEQ ID NO: 29468 - DNA, 18 bp, Artificial Sequence
  Synthetic DNA
taattcgattaactgtag

SEQ ID NO: 29469 - DNA, 18 bp, Artificial Sequence
  Synthetic DNA
taattcgcattactatag

SEQ ID NO: 29470 - DNA, 18 bp, Artificial Sequence
  Synthetic DNA
taattcggctcactttcg

SEQ ID NO: 29471 - DNA, 18 bp, Artificial Sequence
  Synthetic DNA
taattcggcttaccatag

SEQ ID NO: 29472 - DNA, 18 bp, Artificial Sequence
  Synthetic DNA
taattcgtctcaccgtag

SEQ ID NO: 29473 - DNA, 18 bp, Artificial Sequence
  Synthetic DNA
taattcgtctcactttgg

SEQ ID NO: 29474 - DNA, 18 bp, Artificial Sequence
  Synthetic DNA
taattcgtctccctatcg

SEQ ID NO: 29475 - DNA, 18 bp, Artificial Sequence
  Synthetic DNA
taattctacacactgtag

SEQ ID NO: 29476 - DNA, 18 bp, Artificial Sequence
  Synthetic DNA
taattctactgacgatag

SEQ ID NO: 29477 - DNA, 18 bp, Artificial Sequence
  Synthetic DNA
taattggaatcattatag

SEQ ID NO: 29478 - DNA, 18 bp, Artificial Sequence
  Synthetic DNA
taattggacacaatatag

SEQ ID NO: 29479 - DNA, 18 bp, Artificial Sequence
  Synthetic DNA
taatttgtctccctatag

SEQ ID NO: 29480 - DNA, 18 bp, Artificial Sequence
  Synthetic DNA
tacaacgactcaatattg

SEQ ID NO: 29481 - DNA, 18 bp, Artificial Sequence
  Synthetic DNA
tactaccactcagtattg

SEQ ID NO: 29482 - DNA, 18 bp, Artificial Sequence
  Synthetic DNA
tactacgacacattattg

SEQ ID NO: 29483 - DNA, 18 bp, Artificial Sequence
  Synthetic DNA
tactaggactaactattg

SEQ ID NO: 29484 - DNA, 18 bp, Artificial Sequence
  Synthetic DNA
tacttcgactgactttag

SEQ ID NO: 29485 - DNA, 18 bp, Artificial Sequence
  Synthetic DNA
tagtacgaatcacttttg

SEQ ID NO: 29486 - DNA, 18 bp, Artificial Sequence
  Synthetic DNA
tagttcaactcagtatag

SEQ ID NO: 29487 - DNA, 18 bp, Artificial Sequence
  Synthetic DNA
tagttcgactcacttaag

SEQ ID NO: 29488 - DNA, 18 bp, Artificial Sequence
  Synthetic DNA
tagttcgacttattatag

SEQ ID NO: 29489 - DNA, 18 bp, Artificial Sequence
  Synthetic DNA
tatcacgcctcgctatag

SEQ ID NO: 29490 - DNA, 18 bp, Artificial Sequence
  Synthetic DNA
tatcacgtctcgctatag

SEQ ID NO: 29491 - DNA, 18 bp, Artificial Sequence
  Synthetic DNA
tattacgactcaatgttg

SEQ ID NO: 29492 - DNA, 18 bp, Artificial Sequence
  Synthetic DNA
tattacgactcattcttg

SEQ ID NO: 29493 - DNA, 18 bp, Artificial Sequence
  Synthetic DNA
tattacgattccctattg

SEQ ID NO: 29494 - DNA, 18 bp, Artificial Sequence
  Synthetic DNA
tattactactcattattg

SEQ ID NO: 29495 - DNA, 18 bp, Artificial Sequence
  Synthetic DNA
tattcagactcactattg

SEQ ID NO: 29496 - DNA, 18 bp, Artificial Sequence
  Synthetic DNA
tattccgacacactattg

SEQ ID NO: 29497 - DNA, 18 bp, Artificial Sequence
  Synthetic DNA
tatttcgcctcactagag

SEQ ID NO: 29498 - DNA, 18 bp, Artificial Sequence
  Synthetic DNA
tatttggaatcactatag

SEQ ID NO: 29499 - DNA, 18 bp, Artificial Sequence
  Synthetic DNA
tcattcgactctctttag

SEQ ID NO: 29500 - DNA, 18 bp, Artificial Sequence
  Synthetic DNA
tcattcgactttctatag

SEQ ID NO: 29501 - DNA, 18 bp, Artificial Sequence
  Synthetic DNA
tgattcgagtcactaaag

SEQ ID NO: 29502 - DNA, 18 bp, Artificial Sequence
  Synthetic DNA
tgtttcgactctctatag

SEQ ID NO: 29503 - DNA, 18 bp, Artificial Sequence
  Synthetic DNA
tgtttctactcactatag

SEQ ID NO: 29504 - DNA, 18 bp, Artificial Sequence
  Synthetic DNA
ttaaacgattcactattg

SEQ ID NO: 29505 - DNA, 18 bp, Artificial Sequence
  Synthetic DNA
ttactcgactcaatatag

SEQ ID NO: 29506 - DNA, 18 bp, Artificial Sequence
  Synthetic DNA
ttactcgactctctatag

SEQ ID NO: 29507 - DNA, 18 bp, Artificial Sequence
  Synthetic DNA
ttagtcgtctcactatag

SEQ ID NO: 29508 - DNA, 18 bp, Artificial Sequence
  Synthetic DNA
ttatacgacaaactattg

SEQ ID NO: 29509 - DNA, 18 bp, Artificial Sequence
  Synthetic DNA
ttatacgactgactaatg

SEQ ID NO: 29510 - DNA, 18 bp, Artificial Sequence
  Synthetic DNA
ttattcgaatccctatag

SEQ ID NO: 29511 - DNA, 18 bp, Artificial Sequence
  Synthetic DNA
ttgttcaactcactatag

SEQ ID NO: 29512 - DNA, 18 bp, Artificial Sequence
  Synthetic DNA
aaaaacgtatcactatag

SEQ ID NO: 29513 - DNA, 18 bp, Artificial Sequence
  Synthetic DNA
aaacacgactctcaatag

SEQ ID NO: 29514 - DNA, 18 bp, Artificial Sequence
  Synthetic DNA
aaataattctcactatag

SEQ ID NO: 29515 - DNA, 18 bp, Artificial Sequence
  Synthetic DNA
aaatacaaatctctatag

SEQ ID NO: 29516 - DNA, 18 bp, Artificial Sequence
  Synthetic DNA
aaatacaactctcaatag

SEQ ID NO: 29517 - DNA, 18 bp, Artificial Sequence
  Synthetic DNA
aaatacgaataattatag

SEQ ID NO: 29518 - DNA, 18 bp, Artificial Sequence
  Synthetic DNA
aaatacgaattacaatag

SEQ ID NO: 29519 - DNA, 18 bp, Artificial Sequence
  Synthetic DNA
aaatacgactctctgaag

SEQ ID NO: 29520 - DNA, 18 bp, Artificial Sequence
  Synthetic DNA
aaatacgactctcttgag

SEQ ID NO: 29521 - DNA, 18 bp, Artificial Sequence
  Synthetic DNA
aaatacgacttactctcg

SEQ ID NO: 29522 - DNA, 18 bp, Artificial Sequence
  Synthetic DNA
aaatacgactttctaaag

SEQ ID NO: 29523 - DNA, 18 bp, Artificial Sequence
  Synthetic DNA
aaatacgattctctaaag

SEQ ID NO: 29524 - DNA, 18 bp, Artificial Sequence
  Synthetic DNA
aaatacgattctctatcg

SEQ ID NO: 29525 - DNA, 18 bp, Artificial Sequence
  Synthetic DNA
aaatacggttcaatatag

SEQ ID NO: 29526 - DNA, 18 bp, Artificial Sequence
  Synthetic DNA
aaatacgtctaacaatag

SEQ ID NO: 29527 - DNA, 18 bp, Artificial Sequence
  Synthetic DNA
aaatacgtctaactaaag

SEQ ID NO: 29528 - DNA, 18 bp, Artificial Sequence
  Synthetic DNA
aaatacgtctcactttcg

SEQ ID NO: 29529 - DNA, 18 bp, Artificial Sequence
  Synthetic DNA
aaatagggctcactttag

SEQ ID NO: 29530 - DNA, 18 bp, Artificial Sequence
  Synthetic DNA
aaatatgactcacttgag

SEQ ID NO: 29531 - DNA, 18 bp, Artificial Sequence
  Synthetic DNA
aaatatgactcagtttag

SEQ ID NO: 29532 - DNA, 18 bp, Artificial Sequence
  Synthetic DNA
aaatatggctcacaatag

SEQ ID NO: 29533 - DNA, 18 bp, Artificial Sequence
  Synthetic DNA
aaatccgactcacttaag

SEQ ID NO: 29534 - DNA, 18 bp, Artificial Sequence
  Synthetic DNA
aaatgccaatcactatag

SEQ ID NO: 29535 - DNA, 18 bp, Artificial Sequence
  Synthetic DNA
aactacgattcacaatag

SEQ ID NO: 29536 - DNA, 18 bp, Artificial Sequence
  Synthetic DNA
aactccgaatcactatag

SEQ ID NO: 29537 - DNA, 18 bp, Artificial Sequence
  Synthetic DNA
aatcacgcctcactatag

SEQ ID NO: 29538 - DNA, 18 bp, Artificial Sequence
  Synthetic DNA
aattaccactcattatag

SEQ ID NO: 29539 - DNA, 18 bp, Artificial Sequence
  Synthetic DNA
aattacctctcactatag

SEQ ID NO: 29540 - DNA, 18 bp, Artificial Sequence
  Synthetic DNA
aattacgacacactctag

SEQ ID NO: 29541 - DNA, 18 bp, Artificial Sequence
  Synthetic DNA
aattacgactcaaaatag

SEQ ID NO: 29542 - DNA, 18 bp, Artificial Sequence
  Synthetic DNA
aattacgactcacattag

SEQ ID NO: 29543 - DNA, 18 bp, Artificial Sequence
  Synthetic DNA
aattacgattcaccatag

SEQ ID NO: 29544 - DNA, 18 bp, Artificial Sequence
  Synthetic DNA
aattacgcctctctatag

SEQ ID NO: 29545 - DNA, 18 bp, Artificial Sequence
  Synthetic DNA
aattccgattcactatag

SEQ ID NO: 29546 - DNA, 18 bp, Artificial Sequence
  Synthetic DNA
acataagactcactacag

SEQ ID NO: 29547 - DNA, 18 bp, Artificial Sequence
  Synthetic DNA
acatacgacacaccatag

SEQ ID NO: 29548 - DNA, 18 bp, Artificial Sequence
  Synthetic DNA
acatacgcctcactatcg

SEQ ID NO: 29549 - DNA, 18 bp, Artificial Sequence
  Synthetic DNA
acatatgactcaatatag

SEQ ID NO: 29550 - DNA, 18 bp, Artificial Sequence
  Synthetic DNA
atatacgactaactaaag

SEQ ID NO: 29551 - DNA, 18 bp, Artificial Sequence
  Synthetic DNA
atatacgcctcagtatag

SEQ ID NO: 29552 - DNA, 18 bp, Artificial Sequence
  Synthetic DNA
atatacggcacactatag

SEQ ID NO: 29553 - DNA, 18 bp, Artificial Sequence
  Synthetic DNA
atatatgaatcactatag

SEQ ID NO: 29554 - DNA, 18 bp, Artificial Sequence
  Synthetic DNA
caataagacacacaatag

SEQ ID NO: 29555 - DNA, 18 bp, Artificial Sequence
  Synthetic DNA
caatacgacttccgatag

SEQ ID NO: 29556 - DNA, 18 bp, Artificial Sequence
  Synthetic DNA
caatacgtctcaatttag

SEQ ID NO: 29557 - DNA, 18 bp, Artificial Sequence
  Synthetic DNA
caatacgtctctctctag

SEQ ID NO: 29558 - DNA, 18 bp, Artificial Sequence
  Synthetic DNA
caatgtgattcactatag

SEQ ID NO: 29559 - DNA, 18 bp, Artificial Sequence
  Synthetic DNA
cattactacacactatag

SEQ ID NO: 29560 - DNA, 18 bp, Artificial Sequence
  Synthetic DNA
ccatactactcacaatag

SEQ ID NO: 29561 - DNA, 18 bp, Artificial Sequence
  Synthetic DNA
ccatactactcactatgg

SEQ ID NO: 29562 - DNA, 18 bp, Artificial Sequence
  Synthetic DNA
ctatacgactcacaatcg

SEQ ID NO: 29563 - DNA, 18 bp, Artificial Sequence
  Synthetic DNA
ctatacgactcacttaag

SEQ ID NO: 29564 - DNA, 18 bp, Artificial Sequence
  Synthetic DNA
ctatccgactcacaatag

SEQ ID NO: 29565 - DNA, 18 bp, Artificial Sequence
  Synthetic DNA
gaaaatgactcactttag

SEQ ID NO: 29566 - DNA, 18 bp, Artificial Sequence
  Synthetic DNA
gataaagactcactatag

SEQ ID NO: 29567 - DNA, 18 bp, Artificial Sequence
  Synthetic DNA
gtatacgagtaactatag

SEQ ID NO: 29568 - DNA, 18 bp, Artificial Sequence
  Synthetic DNA
gtatacggttcactatag

SEQ ID NO: 29569 - DNA, 18 bp, Artificial Sequence
  Synthetic DNA
gtatccgaatcactatag

SEQ ID NO: 29570 - DNA, 18 bp, Artificial Sequence
  Synthetic DNA
taaaaacactcactatgg

SEQ ID NO: 29571 - DNA, 18 bp, Artificial Sequence
  Synthetic DNA
taaaacaactaactacag

SEQ ID NO: 29572 - DNA, 18 bp, Artificial Sequence
  Synthetic DNA
taaaacgacagactttag

SEQ ID NO: 29573 - DNA, 18 bp, Artificial Sequence
  Synthetic DNA
taaaacgacctaatatag

SEQ ID NO: 29574 - DNA, 18 bp, Artificial Sequence
  Synthetic DNA
taaaacgtctcacaagag

SEQ ID NO: 29575 - DNA, 18 bp, Artificial Sequence
  Synthetic DNA
taaaactactcactctgg

SEQ ID NO: 29576 - DNA, 18 bp, Artificial Sequence
  Synthetic DNA
taaaacttctcactacag

SEQ ID NO: 29577 - DNA, 18 bp, Artificial Sequence
  Synthetic DNA
taaaataacttactatag

SEQ ID NO: 29578 - DNA, 18 bp, Artificial Sequence
  Synthetic DNA
taaacctcctcactatag

SEQ ID NO: 29579 - DNA, 18 bp, Artificial Sequence
  Synthetic DNA
taaagcgactaattatag

SEQ ID NO: 29580 - DNA, 18 bp, Artificial Sequence
  Synthetic DNA
taacaagacactctatag

SEQ ID NO: 29581 - DNA, 18 bp, Artificial Sequence
  Synthetic DNA
taacaagtttcactatag

SEQ ID NO: 29582 - DNA, 18 bp, Artificial Sequence
  Synthetic DNA
taacacctctaactatag

SEQ ID NO: 29583 - DNA, 18 bp, Artificial Sequence
  Synthetic DNA
taacacgtctcacattag

SEQ ID NO: 29584 - DNA, 18 bp, Artificial Sequence
  Synthetic DNA
taacactgcacactatag

SEQ ID NO: 29585 - DNA, 18 bp, Artificial Sequence
  Synthetic DNA
taaccctactcacaatag

SEQ ID NO: 29586 - DNA, 18 bp, Artificial Sequence
  Synthetic DNA
taataaatctaactatag

SEQ ID NO: 29587 - DNA, 18 bp, Artificial Sequence
  Synthetic DNA
taataagaatcattctag

SEQ ID NO: 29588 - DNA, 18 bp, Artificial Sequence
  Synthetic DNA
taataagattcattaaag

SEQ ID NO: 29589 - DNA, 18 bp, Artificial Sequence
  Synthetic DNA
taataaggcactctatag

SEQ ID NO: 29590 - DNA, 18 bp, Artificial Sequence
  Synthetic DNA
taatacaaatctctacag

SEQ ID NO: 29591 - DNA, 18 bp, Artificial Sequence
  Synthetic DNA
taatacaacacaatacag

SEQ ID NO: 29592 - DNA, 18 bp, Artificial Sequence
  Synthetic DNA
taatacaacacattgtag

SEQ ID NO: 29593 - DNA, 18 bp, Artificial Sequence
  Synthetic DNA
taatacaacttactttcg

SEQ ID NO: 29594 - DNA, 18 bp, Artificial Sequence
  Synthetic DNA
taatacaactttctatcg

SEQ ID NO: 29595 - DNA, 18 bp, Artificial Sequence
  Synthetic DNA
taatacaagtaacaatag

SEQ ID NO: 29596 - DNA, 18 bp, Artificial Sequence
  Synthetic DNA
taataccaattactaaag

SEQ ID NO: 29597 - DNA, 18 bp, Artificial Sequence
  Synthetic DNA
taataccactaacattag

SEQ ID NO: 29598 - DNA, 18 bp, Artificial Sequence
  Synthetic DNA
taataccattcacttaag

SEQ ID NO: 29599 - DNA, 18 bp, Artificial Sequence
  Synthetic DNA
taatacgaacctcaatag

SEQ ID NO: 29600 - DNA, 18 bp, Artificial Sequence
  Synthetic DNA
taatacgaatcattttcg

SEQ ID NO: 29601 - DNA, 18 bp, Artificial Sequence
  Synthetic DNA
taatacgacaacctttag

SEQ ID NO: 29602 - DNA, 18 bp, Artificial Sequence
  Synthetic DNA
taatacgacacaataacg

SEQ ID NO: 29603 - DNA, 18 bp, Artificial Sequence
  Synthetic DNA
taatacgacacatcaaag

SEQ ID NO: 29604 - DNA, 18 bp, Artificial Sequence
  Synthetic DNA
taatacgacaccttctag

SEQ ID NO: 29605 - DNA, 18 bp, Artificial Sequence
  Synthetic DNA
taatacgaccctataaag

SEQ ID NO: 29606 - DNA, 18 bp, Artificial Sequence
  Synthetic DNA
taatacgactatcgaaag

SEQ ID NO: 29607 - DNA, 18 bp, Artificial Sequence
  Synthetic DNA
taatacgactcacatccg

SEQ ID NO: 29608 - DNA, 18 bp, Artificial Sequence
  Synthetic DNA
taatacgagatactacag

SEQ ID NO: 29609 - DNA, 18 bp, Artificial Sequence
  Synthetic DNA
taatacgatactatatag

SEQ ID NO: 29610 - DNA, 18 bp, Artificial Sequence
  Synthetic DNA
taatacgattgtctaaag

SEQ ID NO: 29611 - DNA, 18 bp, Artificial Sequence
  Synthetic DNA
taatacgccactcaatag

SEQ ID NO: 29612 - DNA, 18 bp, Artificial Sequence
  Synthetic DNA
taatacggaacaccatag

SEQ ID NO: 29613 - DNA, 18 bp, Artificial Sequence
  Synthetic DNA
taatacggttctcaatag

SEQ ID NO: 29614 - DNA, 18 bp, Artificial Sequence
  Synthetic DNA
taatacgtaaaactatag

SEQ ID NO: 29615 - DNA, 18 bp, Artificial Sequence
  Synthetic DNA
taatacgtcagactaaag

SEQ ID NO: 29616 - DNA, 18 bp, Artificial Sequence
  Synthetic DNA
taatacgtcctaccatag

SEQ ID NO: 29617 - DNA, 18 bp, Artificial Sequence
  Synthetic DNA
taatacgtctatctttag

SEQ ID NO: 29618 - DNA, 18 bp, Artificial Sequence
  Synthetic DNA
taatacgtctcattcaag

SEQ ID NO: 29619 - DNA, 18 bp, Artificial Sequence
  Synthetic DNA
taatacgtctctatctag

SEQ ID NO: 29620 - DNA, 18 bp, Artificial Sequence
  Synthetic DNA
taatacgttccactatgg

SEQ ID NO: 29621 - DNA, 18 bp, Artificial Sequence
  Synthetic DNA
taatactaccaactttag

SEQ ID NO: 29622 - DNA, 18 bp, Artificial Sequence
  Synthetic DNA
taatactactctctgtcg

SEQ ID NO: 29623 - DNA, 18 bp, Artificial Sequence
  Synthetic DNA
taatactactgacaaaag

SEQ ID NO: 29624 - DNA, 18 bp, Artificial Sequence
  Synthetic DNA
taatacttcacactctag

SEQ ID NO: 29625 - DNA, 18 bp, Artificial Sequence
  Synthetic DNA
taatacttctcagtaaag

SEQ ID NO: 29626 - DNA, 18 bp, Artificial Sequence
  Synthetic DNA
taataggaatctctaaag

SEQ ID NO: 29627 - DNA, 18 bp, Artificial Sequence
  Synthetic DNA
taatataacttactttag

SEQ ID NO: 29628 - DNA, 18 bp, Artificial Sequence
  Synthetic DNA
taatatatctcactatgg

SEQ ID NO: 29629 - DNA, 18 bp, Artificial Sequence
  Synthetic DNA
taatatcaatcactttag

SEQ ID NO: 29630 - DNA, 18 bp, Artificial Sequence
  Synthetic DNA
taatatgaaacactaaag

SEQ ID NO: 29631 - DNA, 18 bp, Artificial Sequence
  Synthetic DNA
taatatgacaaaatatag

SEQ ID NO: 29632 - DNA, 18 bp, Artificial Sequence
  Synthetic DNA
taatatgattcaagatag

SEQ ID NO: 29633 - DNA, 18 bp, Artificial Sequence
  Synthetic DNA
taatcagacaccctatag

SEQ ID NO: 29634 - DNA, 18 bp, Artificial Sequence
  Synthetic DNA
taatcagactcacaaaag

SEQ ID NO: 29635 - DNA, 18 bp, Artificial Sequence
  Synthetic DNA
taatccgacacattaaag

SEQ ID NO: 29636 - DNA, 18 bp, Artificial Sequence
  Synthetic DNA
taatcctactcactttcg

SEQ ID NO: 29637 - DNA, 18 bp, Artificial Sequence
  Synthetic DNA
taatcctactctttatag

SEQ ID NO: 29638 - DNA, 18 bp, Artificial Sequence
  Synthetic DNA
taatctaactcagtatag

SEQ ID NO: 29639 - DNA, 18 bp, Artificial Sequence
  Synthetic DNA
taatctgacacattatag

SEQ ID NO: 29640 - DNA, 18 bp, Artificial Sequence
  Synthetic DNA
taatctgtctcactttag

SEQ ID NO: 29641 - DNA, 18 bp, Artificial Sequence
  Synthetic DNA
taatgccactctctagag

SEQ ID NO: 29642 - DNA, 18 bp, Artificial Sequence
  Synthetic DNA
taatgcgactctttttag

SEQ ID NO: 29643 - DNA, 18 bp, Artificial Sequence
  Synthetic DNA
taatgcgacttattttag

SEQ ID NO: 29644 - DNA, 18 bp, Artificial Sequence
  Synthetic DNA
taatgctactcattctag

SEQ ID NO: 29645 - DNA, 18 bp, Artificial Sequence
  Synthetic DNA
tacaaccactcactaaag

SEQ ID NO: 29646 - DNA, 18 bp, Artificial Sequence
  Synthetic DNA
tacaacgaatcaatatag

SEQ ID NO: 29647 - DNA, 18 bp, Artificial Sequence
  Synthetic DNA
tacaacgacacattatag

SEQ ID NO: 29648 - DNA, 18 bp, Artificial Sequence
  Synthetic DNA
tacaacgacatactatag

SEQ ID NO: 29649 - DNA, 18 bp, Artificial Sequence
  Synthetic DNA
tactacgaaacagtatag

SEQ ID NO: 29650 - DNA, 18 bp, Artificial Sequence
  Synthetic DNA
tactacgacacacaaaag

SEQ ID NO: 29651 - DNA, 18 bp, Artificial Sequence
  Synthetic DNA
tactacgtccaactatag

SEQ ID NO: 29652 - DNA, 18 bp, Artificial Sequence
  Synthetic DNA
tactacgtcttactctag

SEQ ID NO: 29653 - DNA, 18 bp, Artificial Sequence
  Synthetic DNA
tactacgtttcactacag

SEQ ID NO: 29654 - DNA, 18 bp, Artificial Sequence
  Synthetic DNA
tactatgacacactttag

SEQ ID NO: 29655 - DNA, 18 bp, Artificial Sequence
  Synthetic DNA
tactatgactatctatag

SEQ ID NO: 29656 - DNA, 18 bp, Artificial Sequence
  Synthetic DNA
tactccgactcaatatgg

SEQ ID NO: 29657 - DNA, 18 bp, Artificial Sequence
  Synthetic DNA
tactgcgactcaatatcg

SEQ ID NO: 29658 - DNA, 18 bp, Artificial Sequence
  Synthetic DNA
tagtacgaatcatcatag

SEQ ID NO: 29659 - DNA, 18 bp, Artificial Sequence
  Synthetic DNA
tagtacgagtcattacag

SEQ ID NO: 29660 - DNA, 18 bp, Artificial Sequence
  Synthetic DNA
tagtactactcagtttag

SEQ ID NO: 29661 - DNA, 18 bp, Artificial Sequence
  Synthetic DNA
tagtactacttactatcg

SEQ ID NO: 29662 - DNA, 18 bp, Artificial Sequence
  Synthetic DNA
tataaagaatcactatag

SEQ ID NO: 29663 - DNA, 18 bp, Artificial Sequence
  Synthetic DNA
tataacgacacactacag

SEQ ID NO: 29664 - DNA, 18 bp, Artificial Sequence
  Synthetic DNA
tataacgattcactctag

SEQ ID NO: 29665 - DNA, 18 bp, Artificial Sequence
  Synthetic DNA
tatcacaactcattatag

SEQ ID NO: 29666 - DNA, 18 bp, Artificial Sequence
  Synthetic DNA
tatcacctctcactatag

SEQ ID NO: 29667 - DNA, 18 bp, Artificial Sequence
  Synthetic DNA
tatcacgactcacattag

SEQ ID NO: 29668 - DNA, 18 bp, Artificial Sequence
  Synthetic DNA
tatcacggctcactaaag

SEQ ID NO: 29669 - DNA, 18 bp, Artificial Sequence
  Synthetic DNA
tattaagactcaccaaag

SEQ ID NO: 29670 - DNA, 18 bp, Artificial Sequence
  Synthetic DNA
tattaagactgacaatag

SEQ ID NO: 29671 - DNA, 18 bp, Artificial Sequence
  Synthetic DNA
tattaagattcaatatag

SEQ ID NO: 29672 - DNA, 18 bp, Artificial Sequence
  Synthetic DNA
tattacgaatctatatag

SEQ ID NO: 29673 - DNA, 18 bp, Artificial Sequence
  Synthetic DNA
tattacgacacaccaaag

SEQ ID NO: 29674 - DNA, 18 bp, Artificial Sequence
  Synthetic DNA
tattacgacactctatcg

SEQ ID NO: 29675 - DNA, 18 bp, Artificial Sequence
  Synthetic DNA
tattacgactcaatttgg

SEQ ID NO: 29676 - DNA, 18 bp, Artificial Sequence
  Synthetic DNA
tattacgacttactaagg

SEQ ID NO: 29677 - DNA, 18 bp, Artificial Sequence
  Synthetic DNA
tattacgacttattaaag

SEQ ID NO: 29678 - DNA, 18 bp, Artificial Sequence
  Synthetic DNA
tattacgattaacaatag

SEQ ID NO: 29679 - DNA, 18 bp, Artificial Sequence
  Synthetic DNA
tattacggatctctatag

SEQ ID NO: 29680 - DNA, 18 bp, Artificial Sequence
  Synthetic DNA
tattacggcaaactatag

SEQ ID NO: 29681 - DNA, 18 bp, Artificial Sequence
  Synthetic DNA
tattactaatcactatcg

SEQ ID NO: 29682 - DNA, 18 bp, Artificial Sequence
  Synthetic DNA
tattactacacactaaag

SEQ ID NO: 29683 - DNA, 18 bp, Artificial Sequence
  Synthetic DNA
tattactagtcactgtag

SEQ ID NO: 29684 - DNA, 18 bp, Artificial Sequence
  Synthetic DNA
tattactagtcactttag

SEQ ID NO: 29685 - DNA, 18 bp, Artificial Sequence
  Synthetic DNA
tattacttgtcactatag

SEQ ID NO: 29686 - DNA, 18 bp, Artificial Sequence
  Synthetic DNA
tattagaacttactatag

SEQ ID NO: 29687 - DNA, 18 bp, Artificial Sequence
  Synthetic DNA
tattatgactcacactag

SEQ ID NO: 29688 - DNA, 18 bp, Artificial Sequence
  Synthetic DNA
tattattactcattatag

SEQ ID NO: 29689 - DNA, 18 bp, Artificial Sequence
  Synthetic DNA
tattccgtcacactatag

SEQ ID NO: 29690 - DNA, 18 bp, Artificial Sequence
  Synthetic DNA
tattctgattcactatag

SEQ ID NO: 29691 - DNA, 18 bp, Artificial Sequence
  Synthetic DNA
tattgcaactcactaaag

SEQ ID NO: 29692 - DNA, 18 bp, Artificial Sequence
  Synthetic DNA
tcaaatgactctctatag

SEQ ID NO: 29693 - DNA, 18 bp, Artificial Sequence
  Synthetic DNA
tcatacaactctctctag

SEQ ID NO: 29694 - DNA, 18 bp, Artificial Sequence
  Synthetic DNA
tcataccactaactctag

SEQ ID NO: 29695 - DNA, 18 bp, Artificial Sequence
  Synthetic DNA
tcataccactcactaagg

SEQ ID NO: 29696 - DNA, 18 bp, Artificial Sequence
  Synthetic DNA
tcatacgaatcacttcag

SEQ ID NO: 29697 - DNA, 18 bp, Artificial Sequence
  Synthetic DNA
tcatacgacttacaaaag

SEQ ID NO: 29698 - DNA, 18 bp, Artificial Sequence
  Synthetic DNA
tcatacgattcacattag

SEQ ID NO: 29699 - DNA, 18 bp, Artificial Sequence
  Synthetic DNA
tcatacgattctctaaag

SEQ ID NO: 29700 - DNA, 18 bp, Artificial Sequence
  Synthetic DNA
tcatactactcattttag

SEQ ID NO: 29701 - DNA, 18 bp, Artificial Sequence
  Synthetic DNA
tcatataactaactatag

SEQ ID NO: 29702 - DNA, 18 bp, Artificial Sequence
  Synthetic DNA
tcccacgactcactctag

SEQ ID NO: 29703 - DNA, 18 bp, Artificial Sequence
  Synthetic DNA
tgacacaactcactacag

SEQ ID NO: 29704 - DNA, 18 bp, Artificial Sequence
  Synthetic DNA
tgacatgactcactacag

SEQ ID NO: 29705 - DNA, 18 bp, Artificial Sequence
  Synthetic DNA
tgataagactcaataaag

SEQ ID NO: 29706 - DNA, 18 bp, Artificial Sequence
  Synthetic DNA
tgatacaatacactatag

SEQ ID NO: 29707 - DNA, 18 bp, Artificial Sequence
  Synthetic DNA
tgatacgacataatatag

SEQ ID NO: 29708 - DNA, 18 bp, Artificial Sequence
  Synthetic DNA
tgatacgacccactcaag

SEQ ID NO: 29709 - DNA, 18 bp, Artificial Sequence
  Synthetic DNA
tgatacgactcagttaag

SEQ ID NO: 29710 - DNA, 18 bp, Artificial Sequence
  Synthetic DNA
tgatacgacttacgttag

SEQ ID NO: 29711 - DNA, 18 bp, Artificial Sequence
  Synthetic DNA
tgatatgactcataatag

SEQ ID NO: 29712 - DNA, 18 bp, Artificial Sequence
  Synthetic DNA
tgatccgactctcaatag

SEQ ID NO: 29713 - DNA, 18 bp, Artificial Sequence
  Synthetic DNA
tgatgctactctctatag

SEQ ID NO: 29714 - DNA, 18 bp, Artificial Sequence
  Synthetic DNA
tgcaacgattcactatag

SEQ ID NO: 29715 - DNA, 18 bp, Artificial Sequence
  Synthetic DNA
tgttacgactcactttcg

SEQ ID NO: 29716 - DNA, 18 bp, Artificial Sequence
  Synthetic DNA
tgttacgactctctacag

SEQ ID NO: 29717 - DNA, 18 bp, Artificial Sequence
  Synthetic DNA
ttacacgacacaatatag

SEQ ID NO: 29718 - DNA, 18 bp, Artificial Sequence
  Synthetic DNA
ttacacgactaacgatag

SEQ ID NO: 29719 - DNA, 18 bp, Artificial Sequence
  Synthetic DNA
ttataagacaccctatag

SEQ ID NO: 29720 - DNA, 18 bp, Artificial Sequence
  Synthetic DNA
ttataaggctcactgtag

SEQ ID NO: 29721 - DNA, 18 bp, Artificial Sequence
  Synthetic DNA
ttataatactcagtatag

SEQ ID NO: 29722 - DNA, 18 bp, Artificial Sequence
  Synthetic DNA
ttatacaagtgactatag

SEQ ID NO: 29723 - DNA, 18 bp, Artificial Sequence
  Synthetic DNA
ttataccacacacaatag

SEQ ID NO: 29724 - DNA, 18 bp, Artificial Sequence
  Synthetic DNA
ttataccactatctatag

SEQ ID NO: 29725 - DNA, 18 bp, Artificial Sequence
  Synthetic DNA
ttatacctctcaccatag

SEQ ID NO: 29726 - DNA, 18 bp, Artificial Sequence
  Synthetic DNA
ttatacgacaaacaatag

SEQ ID NO: 29727 - DNA, 18 bp, Artificial Sequence
  Synthetic DNA
ttatacgactcagttaag

SEQ ID NO: 29728 - DNA, 18 bp, Artificial Sequence
  Synthetic DNA
ttatacgactcatattag

SEQ ID NO: 29729 - DNA, 18 bp, Artificial Sequence
  Synthetic DNA
ttatacgccttactttag

SEQ ID NO: 29730 - DNA, 18 bp, Artificial Sequence
  Synthetic DNA
ttatacgcttcactttag

SEQ ID NO: 29731 - DNA, 18 bp, Artificial Sequence
  Synthetic DNA
ttatacgtctaattatag

SEQ ID NO: 29732 - DNA, 18 bp, Artificial Sequence
  Synthetic DNA
ttatacgtctgaccatag

SEQ ID NO: 29733 - DNA, 18 bp, Artificial Sequence
  Synthetic DNA
ttatacgttttactatag

SEQ ID NO: 29734 - DNA, 18 bp, Artificial Sequence
  Synthetic DNA
ttataggactctttatag

SEQ ID NO: 29735 - DNA, 18 bp, Artificial Sequence
  Synthetic DNA
ttatatgactcacaaaag

SEQ ID NO: 29736 - DNA, 18 bp, Artificial Sequence
  Synthetic DNA
ttatgcgagtcacaatag

SEQ ID NO: 29737 - DNA, 18 bp, Artificial Sequence
  Synthetic DNA
ttccacgtctcactatag

SEQ ID NO: 29738 - DNA, 18 bp, Artificial Sequence
  Synthetic DNA
ttctacgactcattaaag

SEQ ID NO: 29739 - DNA, 18 bp, Artificial Sequence
  Synthetic DNA
ttgaacgactcactatcg

SEQ ID NO: 29740 - DNA, 18 bp, Artificial Sequence
  Synthetic DNA
ttgaacgagtcactatag

SEQ ID NO: 29741 - DNA, 18 bp, Artificial Sequence
  Synthetic DNA
ttgtacgactttctatag

SEQ ID NO: 29742 - DNA, 18 bp, Artificial Sequence
  Synthetic DNA
ttgtatgactcacaatag

SEQ ID NO: 29743 - DNA, 18 bp, Artificial Sequence
  Synthetic DNA
tttcacgactcacaatag

SEQ ID NO: 29744 - DNA, 18 bp, Artificial Sequence
  Synthetic DNA
ttttacaactcactacag

SEQ ID NO: 29745 - DNA, 18 bp, Artificial Sequence
  Synthetic DNA
ttttacgaaacactatag

SEQ ID NO: 29746 - DNA, 18 bp, Artificial Sequence
  Synthetic DNA
ttttacgactcacttaag

SEQ ID NO: 29747 - DNA, 18 bp, Artificial Sequence
  Synthetic DNA
taattcgtctcaataaag

SEQ ID NO: 29748 - DNA, 18 bp, Artificial Sequence
  Synthetic DNA
atatacgtcacactatag

SEQ ID NO: 29749 - DNA, 18 bp, Artificial Sequence
  Synthetic DNA
ttaaacgactcacaattg

SEQ ID NO: 29750 - DNA, 18 bp, Artificial Sequence
  Synthetic DNA
taatactacacacttttg

SEQ ID NO: 29751 - DNA, 18 bp, Artificial Sequence
  Synthetic DNA
ttatacgactcacttatg

SEQ ID NO: 29752 - DNA, 18 bp, Artificial Sequence
  Synthetic DNA
taatacatttcactaaag

SEQ ID NO: 29753 - DNA, 18 bp, Artificial Sequence
  Synthetic DNA
ttatacatctcacaatag

SEQ ID NO: 29754 - DNA, 18 bp, Artificial Sequence
  Synthetic DNA
ttattagactcactattg

SEQ ID NO: 29755 - DNA, 18 bp, Artificial Sequence
  Synthetic DNA
ttattcgactaactattg

SEQ ID NO: 29756 - DNA, 18 bp, Artificial Sequence
  Synthetic DNA
aaattcaactcactaaag

SEQ ID NO: 29757 - DNA, 18 bp, Artificial Sequence
  Synthetic DNA
aattacgactcactaatg

SEQ ID NO: 29758 - DNA, 18 bp, Artificial Sequence
  Synthetic DNA
atattcgactcactctag

SEQ ID NO: 29759 - DNA, 18 bp, Artificial Sequence
  Synthetic DNA
caatacgactctttattg

SEQ ID NO: 29760 - DNA, 18 bp, Artificial Sequence
  Synthetic DNA
taaaaagactcattattg

SEQ ID NO: 29761 - DNA, 18 bp, Artificial Sequence
  Synthetic DNA
taaaaccactcacaattg

SEQ ID NO: 29762 - DNA, 18 bp, Artificial Sequence
  Synthetic DNA
taattcaactaacaatag

SEQ ID NO: 29763 - DNA, 18 bp, Artificial Sequence
  Synthetic DNA
taattcgtcaaactatag

SEQ ID NO: 29764 - DNA, 18 bp, Artificial Sequence
  Synthetic DNA
tagaacgattcactattg

SEQ ID NO: 29765 - DNA, 18 bp, Artificial Sequence
  Synthetic DNA
tatcacgactcacttttg

SEQ ID NO: 29766 - DNA, 18 bp, Artificial Sequence
  Synthetic DNA
tattacgacacaatattg

SEQ ID NO: 29767 - DNA, 18 bp, Artificial Sequence
  Synthetic DNA
ttaaacgacttactattg

SEQ ID NO: 29768 - DNA, 18 bp, Artificial Sequence
  Synthetic DNA
aaatacgactctttagag

SEQ ID NO: 29769 - DNA, 18 bp, Artificial Sequence
  Synthetic DNA
atgtacgactcactttag

SEQ ID NO: 29770 - DNA, 18 bp, Artificial Sequence
  Synthetic DNA
taaaactactcagtttag

SEQ ID NO: 29771 - DNA, 18 bp, Artificial Sequence
  Synthetic DNA
taaaccgacactctatag

SEQ ID NO: 29772 - DNA, 18 bp, Artificial Sequence
  Synthetic DNA
taatacaattcacattag

SEQ ID NO: 29773 - DNA, 18 bp, Artificial Sequence
  Synthetic DNA
taatacatctaactttag

SEQ ID NO: 29774 - DNA, 18 bp, Artificial Sequence
  Synthetic DNA
taataccacacacattag

SEQ ID NO: 29775 - DNA, 18 bp, Artificial Sequence
  Synthetic DNA
taatacgacatacattag

SEQ ID NO: 29776 - DNA, 18 bp, Artificial Sequence
  Synthetic DNA
taatacgacattctaaag

SEQ ID NO: 29777 - DNA, 18 bp, Artificial Sequence
  Synthetic DNA
taatacgagtcaatcgag

SEQ ID NO: 29778 - DNA, 18 bp, Artificial Sequence
  Synthetic DNA
taatctgtctcactaaag

SEQ ID NO: 29779 - DNA, 18 bp, Artificial Sequence
  Synthetic DNA
tataacgacacacaatag

SEQ ID NO: 29780 - DNA, 18 bp, Artificial Sequence
  Synthetic DNA
tattacgactaaatttag

SEQ ID NO: 29781 - DNA, 18 bp, Artificial Sequence
  Synthetic DNA
tgtaaagactcactatag

SEQ ID NO: 29782 - DNA, 18 bp, Artificial Sequence
  Synthetic DNA
ttaaacgactcagtaaag

SEQ ID NO: 29783 - DNA, 18 bp, Artificial Sequence
  Synthetic DNA
ttatacgactctctaacg

SEQ ID NO: 29784 - DNA, 18 bp, Artificial Sequence
  Synthetic DNA
ttatacgtctcaatgtag

SEQ ID NO: 29785 - DNA, 18 bp, Artificial Sequence
  Synthetic DNA
ttatactaatctctatag

SEQ ID NO: 29786 - DNA, 18 bp, Artificial Sequence
  Synthetic DNA
ttgaatgactcactatag

SEQ ID NO: 29787 - DNA, 18 bp, Artificial Sequence
  Synthetic DNA
ttttaagtctcactatag

SEQ ID NO: 29788 - DNA, 18 bp, Artificial Sequence
  Synthetic DNA
ttttaggactcacaatag

SEQ ID NO: 29789 - DNA, 18 bp, Artificial Sequence
  Synthetic DNA
taattcgtctcaatattg

SEQ ID NO: 29790 - DNA, 18 bp, Artificial Sequence
  Synthetic DNA
atatacgattcactattg

SEQ ID NO: 29791 - DNA, 18 bp, Artificial Sequence
  Synthetic DNA
taaaacgaatctctattg

SEQ ID NO: 29792 - DNA, 18 bp, Artificial Sequence
  Synthetic DNA
taataagacacaccattg

SEQ ID NO: 29793 - DNA, 18 bp, Artificial Sequence
  Synthetic DNA
taatacaactcatttttg

SEQ ID NO: 29794 - DNA, 18 bp, Artificial Sequence
  Synthetic DNA
taatacgtctaattattg

SEQ ID NO: 29795 - DNA, 18 bp, Artificial Sequence
  Synthetic DNA
taattcgtataactatag

SEQ ID NO: 29796 - DNA, 18 bp, Artificial Sequence
  Synthetic DNA
tattactattcactattg

SEQ ID NO: 29797 - DNA, 18 bp, Artificial Sequence
  Synthetic DNA
taaaacgtttctctatag

SEQ ID NO: 29798 - DNA, 18 bp, Artificial Sequence
  Synthetic DNA
taatacgactctcataag

SEQ ID NO: 29799 - DNA, 18 bp, Artificial Sequence
  Synthetic DNA
ttatacgatacactttag

SEQ ID NO: 29800 - DNA, 18 bp, Artificial Sequence
  Synthetic DNA
aattactactctctatag

SEQ ID NO: 29801 - DNA, 18 bp, Artificial Sequence
  Synthetic DNA
tattacgaatcacattag

SEQ ID NO: 29802 - DNA, 18 bp, Artificial Sequence
  Synthetic DNA
tattacgtctctctttag

SEQ ID NO: 29803 - DNA, 18 bp, Artificial Sequence
  Synthetic DNA
atatacgactcacttttg

SEQ ID NO: 29804 - DNA, 18 bp, Artificial Sequence
  Synthetic DNA
taataccactctatattg

SEQ ID NO: 29805 - DNA, 18 bp, Artificial Sequence
  Synthetic DNA
taatacgtctcacatttg

SEQ ID NO: 29806 - DNA, 18 bp, Artificial Sequence
  Synthetic DNA
ttatacgactctatattg

SEQ ID NO: 29807 - DNA, 18 bp, Artificial Sequence
  Synthetic DNA
ttattcaactcacaatag

SEQ ID NO: 29808 - DNA, 18 bp, Artificial Sequence
  Synthetic DNA
atatacaactcactaaag

SEQ ID NO: 29809 - DNA, 18 bp, Artificial Sequence
  Synthetic DNA
taatataacacacaatag

SEQ ID NO: 29810 - DNA, 18 bp, Artificial Sequence
  Synthetic DNA
taatatgattcgctattg

SEQ ID NO: 29811 - DNA, 18 bp, Artificial Sequence
  Synthetic DNA
taattcaacacgctatag

SEQ ID NO: 29812 - DNA, 18 bp, Artificial Sequence
  Synthetic DNA
taattcgacacgctctag

SEQ ID NO: 29813 - DNA, 18 bp, Artificial Sequence
  Synthetic DNA
taattcgacttgctgtag

SEQ ID NO: 29814 - DNA, 18 bp, Artificial Sequence
  Synthetic DNA
taattcgcctcactcttg

SEQ ID NO: 29815 - DNA, 18 bp, Artificial Sequence
  Synthetic DNA
taattttactcgctatag

SEQ ID NO: 29816 - DNA, 18 bp, Artificial Sequence
  Synthetic DNA
tagttcgactcacttttg

SEQ ID NO: 29817 - DNA, 18 bp, Artificial Sequence
  Synthetic DNA
tgattcgactcacttttg

SEQ ID NO: 29818 - DNA, 18 bp, Artificial Sequence
  Synthetic DNA
aaaaacgactcgttatag

SEQ ID NO: 29819 - DNA, 18 bp, Artificial Sequence
  Synthetic DNA
aaataccgctcactattg

SEQ ID NO: 29820 - DNA, 18 bp, Artificial Sequence
  Synthetic DNA
aaattcgactcaatttag

SEQ ID NO: 29821 - DNA, 18 bp, Artificial Sequence
  Synthetic DNA
aaattcgactctccatag

SEQ ID NO: 29822 - DNA, 18 bp, Artificial Sequence
  Synthetic DNA
aaattcggctcactttag

SEQ ID NO: 29823 - DNA, 18 bp, Artificial Sequence
  Synthetic DNA
aaattctactaactatag

SEQ ID NO: 29824 - DNA, 18 bp, Artificial Sequence
  Synthetic DNA
aacttcgactcattatag

SEQ ID NO: 29825 - DNA, 18 bp, Artificial Sequence
  Synthetic DNA
atagacgactcactattg

SEQ ID NO: 29826 - DNA, 18 bp, Artificial Sequence
  Synthetic DNA
atattcgacacactatag

SEQ ID NO: 29827 - DNA, 18 bp, Artificial Sequence
  Synthetic DNA
atattcgacttactatag

SEQ ID NO: 29828 - DNA, 18 bp, Artificial Sequence
  Synthetic DNA
caatacgacccacaattg

SEQ ID NO: 29829 - DNA, 18 bp, Artificial Sequence
  Synthetic DNA
caattcgactgaccatag

SEQ ID NO: 29830 - DNA, 18 bp, Artificial Sequence
  Synthetic DNA
cacttcgactcactttag

SEQ ID NO: 29831 - DNA, 18 bp, Artificial Sequence
  Synthetic DNA
cattacgactcaatattg

SEQ ID NO: 29832 - DNA, 18 bp, Artificial Sequence
  Synthetic DNA
ctattcggctcactatag

SEQ ID NO: 29833 - DNA, 18 bp, Artificial Sequence
  Synthetic DNA
taaaacgactcagtaatg

SEQ ID NO: 29834 - DNA, 18 bp, Artificial Sequence
  Synthetic DNA
taaaacgactggctacag

SEQ ID NO: 29835 - DNA, 18 bp, Artificial Sequence
  Synthetic DNA
taaaacgacttattattg

SEQ ID NO: 29836 - DNA, 18 bp, Artificial Sequence
  Synthetic DNA
taaaacgattcaatattg

SEQ ID NO: 29837 - DNA, 18 bp, Artificial Sequence
  Synthetic DNA
taaatcacctcactatag

SEQ ID NO: 29838 - DNA, 18 bp, Artificial Sequence
  Synthetic DNA
taaatcgagtcacaatag

SEQ ID NO: 29839 - DNA, 18 bp, Artificial Sequence
  Synthetic DNA
taacacaacacactattg

SEQ ID NO: 29840 - DNA, 18 bp, Artificial Sequence
  Synthetic DNA
taagaagactcattattg

SEQ ID NO: 29841 - DNA, 18 bp, Artificial Sequence
  Synthetic DNA
taagacgactcgcttaag

SEQ ID NO: 29842 - DNA, 18 bp, Artificial Sequence
  Synthetic DNA
taagacgactctctaatg

SEQ ID NO: 29843 - DNA, 18 bp, Artificial Sequence
  Synthetic DNA
taagtcaactcactagag

SEQ ID NO: 29844 - DNA, 18 bp, Artificial Sequence
  Synthetic DNA
taatacacctaactattg

SEQ ID NO: 29845 - DNA, 18 bp, Artificial Sequence
  Synthetic DNA
taataccactagctttag

SEQ ID NO: 29846 - DNA, 18 bp, Artificial Sequence
  Synthetic DNA
taatacgacccagtcttg

SEQ ID NO: 29847 - DNA, 18 bp, Artificial Sequence
  Synthetic DNA
taatacgactaacacttg

SEQ ID NO: 29848 - DNA, 18 bp, Artificial Sequence
  Synthetic DNA
taatacgattcaatgttg

SEQ ID NO: 29849 - DNA, 18 bp, Artificial Sequence
  Synthetic DNA
taatacgcctcacatttg

SEQ ID NO: 29850 - DNA, 18 bp, Artificial Sequence
  Synthetic DNA
taatacgtttcactcttg

SEQ ID NO: 29851 - DNA, 18 bp, Artificial Sequence
  Synthetic DNA
taatactacacaccattg

SEQ ID NO: 29852 - DNA, 18 bp, Artificial Sequence
  Synthetic DNA
taatactactcacaaatg

SEQ ID NO: 29853 - DNA, 18 bp, Artificial Sequence
  Synthetic DNA
taatatgacacactgttg

SEQ ID NO: 29854 - DNA, 18 bp, Artificial Sequence
  Synthetic DNA
taatgtaactcactattg

SEQ ID NO: 29855 - DNA, 18 bp, Artificial Sequence
  Synthetic DNA
taattagacttactttag

SEQ ID NO: 29856 - DNA, 18 bp, Artificial Sequence
  Synthetic DNA
taattcaacccactaaag

SEQ ID NO: 29857 - DNA, 18 bp, Artificial Sequence
  Synthetic DNA
taattcaactcaatttag

SEQ ID NO: 29858 - DNA, 18 bp, Artificial Sequence
  Synthetic DNA
taattcaactcattaaag

SEQ ID NO: 29859 - DNA, 18 bp, Artificial Sequence
  Synthetic DNA
taattcgacccactcaag

SEQ ID NO: 29860 - DNA, 18 bp, Artificial Sequence
  Synthetic DNA
taattcgatccaatatag

SEQ ID NO: 29861 - DNA, 18 bp, Artificial Sequence
  Synthetic DNA
taattcgattctttatag

SEQ ID NO: 29862 - DNA, 18 bp, Artificial Sequence
  Synthetic DNA
taattcgccatactatag

SEQ ID NO: 29863 - DNA, 18 bp, Artificial Sequence
  Synthetic DNA
taattcgtctcacactag

SEQ ID NO: 29864 - DNA, 18 bp, Artificial Sequence
  Synthetic DNA
taattctaatcacaatag

SEQ ID NO: 29865 - DNA, 18 bp, Artificial Sequence
  Synthetic DNA
taattctactaacaatag

SEQ ID NO: 29866 - DNA, 18 bp, Artificial Sequence
  Synthetic DNA
taattcttctcaatatag

SEQ ID NO: 29867 - DNA, 18 bp, Artificial Sequence
  Synthetic DNA
taatttgacacattatag

SEQ ID NO: 29868 - DNA, 18 bp, Artificial Sequence
  Synthetic DNA
taatttgactcacgttag

SEQ ID NO: 29869 - DNA, 18 bp, Artificial Sequence
  Synthetic DNA
taatttgatacactatag

SEQ ID NO: 29870 - DNA, 18 bp, Artificial Sequence
  Synthetic DNA
tacaacgactcacaattg

SEQ ID NO: 29871 - DNA, 18 bp, Artificial Sequence
  Synthetic DNA
tactacgattcacaattg

SEQ ID NO: 29872 - DNA, 18 bp, Artificial Sequence
  Synthetic DNA
tacttcgattcacaatag

SEQ ID NO: 29873 - DNA, 18 bp, Artificial Sequence
  Synthetic DNA
tagttcgactctttatag

SEQ ID NO: 29874 - DNA, 18 bp, Artificial Sequence
  Synthetic DNA
tatatcgactcaccatag

SEQ ID NO: 29875 - DNA, 18 bp, Artificial Sequence
  Synthetic DNA
tattacgacccagtattg

SEQ ID NO: 29876 - DNA, 18 bp, Artificial Sequence
  Synthetic DNA
tattacgactcccaattg

SEQ ID NO: 29877 - DNA, 18 bp, Artificial Sequence
  Synthetic DNA
tattacgactgacaattg

SEQ ID NO: 29878 - DNA, 18 bp, Artificial Sequence
  Synthetic DNA
tattacgtcgcactattg

SEQ ID NO: 29879 - DNA, 18 bp, Artificial Sequence
  Synthetic DNA
tattactactcactaatg

SEQ ID NO: 29880 - DNA, 18 bp, Artificial Sequence
  Synthetic DNA
tatttcgaattactatag

SEQ ID NO: 29881 - DNA, 18 bp, Artificial Sequence
  Synthetic DNA
tatttcgacttattatag

SEQ ID NO: 29882 - DNA, 18 bp, Artificial Sequence
  Synthetic DNA
tatttcgagtcactttag

SEQ ID NO: 29883 - DNA, 18 bp, Artificial Sequence
  Synthetic DNA
tatttcgatttactatag

SEQ ID NO: 29884 - DNA, 18 bp, Artificial Sequence
  Synthetic DNA
tcaaacgactctctattg

SEQ ID NO: 29885 - DNA, 18 bp, Artificial Sequence
  Synthetic DNA
tcatacgattaactattg

SEQ ID NO: 29886 - DNA, 18 bp, Artificial Sequence
  Synthetic DNA
tcatacgtctctctattg

SEQ ID NO: 29887 - DNA, 18 bp, Artificial Sequence
  Synthetic DNA
tcattcgtctcacaatag

SEQ ID NO: 29888 - DNA, 18 bp, Artificial Sequence
  Synthetic DNA
tcttacgactcactactg

SEQ ID NO: 29889 - DNA, 18 bp, Artificial Sequence
  Synthetic DNA
tcttacgacttactattg

SEQ ID NO: 29890 - DNA, 18 bp, Artificial Sequence
  Synthetic DNA
tctttctactcactatag

SEQ ID NO: 29891 - DNA, 18 bp, Artificial Sequence
  Synthetic DNA
ttatacgacttactagtg

SEQ ID NO: 29892 - DNA, 18 bp, Artificial Sequence
  Synthetic DNA
ttatacgattcactaatg

SEQ ID NO: 29893 - DNA, 18 bp, Artificial Sequence
  Synthetic DNA
ttatacggcttactattg

SEQ ID NO: 29894 - DNA, 18 bp, Artificial Sequence
  Synthetic DNA
ttatactactcagtattg

SEQ ID NO: 29895 - DNA, 18 bp, Artificial Sequence
  Synthetic DNA
ttatccaactcgctatag

SEQ ID NO: 29896 - DNA, 18 bp, Artificial Sequence
  Synthetic DNA
ttattcgaatcacaatag

SEQ ID NO: 29897 - DNA, 18 bp, Artificial Sequence
  Synthetic DNA
ttattcgactgacaatag

SEQ ID NO: 29898 - DNA, 18 bp, Artificial Sequence
  Synthetic DNA
ttattcgactgagtatag

SEQ ID NO: 29899 - DNA, 18 bp, Artificial Sequence
  Synthetic DNA
ttattctactcactacag

SEQ ID NO: 29900 - DNA, 18 bp, Artificial Sequence
  Synthetic DNA
ttgtacgactcacttttg

SEQ ID NO: 29901 - DNA, 18 bp, Artificial Sequence
  Synthetic DNA
ttttacgactaactattg

SEQ ID NO: 29902 - DNA, 18 bp, Artificial Sequence
  Synthetic DNA
aaaaacggctcacaatag

SEQ ID NO: 29903 - DNA, 18 bp, Artificial Sequence
  Synthetic DNA
aaaaatggctcactatag

SEQ ID NO: 29904 - DNA, 18 bp, Artificial Sequence
  Synthetic DNA
aaaacccactcactatag

SEQ ID NO: 29905 - DNA, 18 bp, Artificial Sequence
  Synthetic DNA
aaaaccgactcactttag

SEQ ID NO: 29906 - DNA, 18 bp, Artificial Sequence
  Synthetic DNA
aaagaccattcactatag

SEQ ID NO: 29907 - DNA, 18 bp, Artificial Sequence
  Synthetic DNA
aaataaaactaactatag

SEQ ID NO: 29908 - DNA, 18 bp, Artificial Sequence
  Synthetic DNA
aaatacaactcaccaaag

SEQ ID NO: 29909 - DNA, 18 bp, Artificial Sequence
  Synthetic DNA
aaataccactcattatcg

SEQ ID NO: 29910 - DNA, 18 bp, Artificial Sequence
  Synthetic DNA
aaatacgaatcattaaag

SEQ ID NO: 29911 - DNA, 18 bp, Artificial Sequence
  Synthetic DNA
aaatacgacacacttcag

SEQ ID NO: 29912 - DNA, 18 bp, Artificial Sequence
  Synthetic DNA
aaatacgacccactaagg

SEQ ID NO: 29913 - DNA, 18 bp, Artificial Sequence
  Synthetic DNA
aaatacgacccactttcg

SEQ ID NO: 29914 - DNA, 18 bp, Artificial Sequence
  Synthetic DNA
aaatacgactaacaacag

SEQ ID NO: 29915 - DNA, 18 bp, Artificial Sequence
  Synthetic DNA
aaatacgactctcattag

SEQ ID NO: 29916 - DNA, 18 bp, Artificial Sequence
  Synthetic DNA
aaatacgattcattaaag

SEQ ID NO: 29917 - DNA, 18 bp, Artificial Sequence
  Synthetic DNA
aaatacgtctcactttgg

SEQ ID NO: 29918 - DNA, 18 bp, Artificial Sequence
  Synthetic DNA
aaatacgtctcccaatag

SEQ ID NO: 29919 - DNA, 18 bp, Artificial Sequence
  Synthetic DNA
aaatactacacattatag

SEQ ID NO: 29920 - DNA, 18 bp, Artificial Sequence
  Synthetic DNA
aaatactactcacaatgg

SEQ ID NO: 29921 - DNA, 18 bp, Artificial Sequence
  Synthetic DNA
aaatatgtctcactctag

SEQ ID NO: 29922 - DNA, 18 bp, Artificial Sequence
  Synthetic DNA
aaatgcgacacacaatag

SEQ ID NO: 29923 - DNA, 18 bp, Artificial Sequence
  Synthetic DNA
aaatgcgacttactaaag

SEQ ID NO: 29924 - DNA, 18 bp, Artificial Sequence
  Synthetic DNA
aacaacgattcactatag

SEQ ID NO: 29925 - DNA, 18 bp, Artificial Sequence
  Synthetic DNA
aactacgtctcacaatag

SEQ ID NO: 29926 - DNA, 18 bp, Artificial Sequence
  Synthetic DNA
aactactactccctatag

SEQ ID NO: 29927 - DNA, 18 bp, Artificial Sequence
  Synthetic DNA
aattaagactcactatcg

SEQ ID NO: 29928 - DNA, 18 bp, Artificial Sequence
  Synthetic DNA
aattacgacacaatatag

SEQ ID NO: 29929 - DNA, 18 bp, Artificial Sequence
  Synthetic DNA
aattacgactctctctag

SEQ ID NO: 29930 - DNA, 18 bp, Artificial Sequence
  Synthetic DNA
aattacgattcactctag

SEQ ID NO: 29931 - DNA, 18 bp, Artificial Sequence
  Synthetic DNA
aattacgtctcactatcg

SEQ ID NO: 29932 - DNA, 18 bp, Artificial Sequence
  Synthetic DNA
aattactactaactatag

SEQ ID NO: 29933 - DNA, 18 bp, Artificial Sequence
  Synthetic DNA
acatactactcactaaag

SEQ ID NO: 29934 - DNA, 18 bp, Artificial Sequence
  Synthetic DNA
agctacgactaactatag

SEQ ID NO: 29935 - DNA, 18 bp, Artificial Sequence
  Synthetic DNA
atatacaactcaatatag

SEQ ID NO: 29936 - DNA, 18 bp, Artificial Sequence
  Synthetic DNA
atatacgacctactatag

SEQ ID NO: 29937 - DNA, 18 bp, Artificial Sequence
  Synthetic DNA
atatccgacttactatag

SEQ ID NO: 29938 - DNA, 18 bp, Artificial Sequence
  Synthetic DNA
atatgtgactcactatag

SEQ ID NO: 29939 - DNA, 18 bp, Artificial Sequence
  Synthetic DNA
atttacgactcactctag

SEQ ID NO: 29940 - DNA, 18 bp, Artificial Sequence
  Synthetic DNA
caaaacgacacactaaag

SEQ ID NO: 29941 - DNA, 18 bp, Artificial Sequence
  Synthetic DNA
caatacaattaactatag

SEQ ID NO: 29942 - DNA, 18 bp, Artificial Sequence
  Synthetic DNA
caatacgacccacgacag

SEQ ID NO: 29943 - DNA, 18 bp, Artificial Sequence
  Synthetic DNA
caatacgacttacttaag

SEQ ID NO: 29944 - DNA, 18 bp, Artificial Sequence
  Synthetic DNA
caatacgagtaacaatag

SEQ ID NO: 29945 - DNA, 18 bp, Artificial Sequence
  Synthetic DNA
caatacgattcacgttag

SEQ ID NO: 29946 - DNA, 18 bp, Artificial Sequence
  Synthetic DNA
caatacgtaccactatag

SEQ ID NO: 29947 - DNA, 18 bp, Artificial Sequence
  Synthetic DNA
caatacgtctctctaaag

SEQ ID NO: 29948 - DNA, 18 bp, Artificial Sequence
  Synthetic DNA
caatccgacactctatag

SEQ ID NO: 29949 - DNA, 18 bp, Artificial Sequence
  Synthetic DNA
cattacgacacactaaag

SEQ ID NO: 29950 - DNA, 18 bp, Artificial Sequence
  Synthetic DNA
cattacgactcactctcg

SEQ ID NO: 29951 - DNA, 18 bp, Artificial Sequence
  Synthetic DNA
cattactactcacaatag

SEQ ID NO: 29952 - DNA, 18 bp, Artificial Sequence
  Synthetic DNA
ccctacgactccctatag

SEQ ID NO: 29953 - DNA, 18 bp, Artificial Sequence
  Synthetic DNA
ctatacgaccaactatag

SEQ ID NO: 29954 - DNA, 18 bp, Artificial Sequence
  Synthetic DNA
ctatccaactcactatag

SEQ ID NO: 29955 - DNA, 18 bp, Artificial Sequence
  Synthetic DNA
gaatacaactaactaaag

SEQ ID NO: 29956 - DNA, 18 bp, Artificial Sequence
  Synthetic DNA
gaatacacctcacaatag

SEQ ID NO: 29957 - DNA, 18 bp, Artificial Sequence
  Synthetic DNA
gaatacgactaacattag

SEQ ID NO: 29958 - DNA, 18 bp, Artificial Sequence
  Synthetic DNA
gcatacaaatcactatag

SEQ ID NO: 29959 - DNA, 18 bp, Artificial Sequence
  Synthetic DNA
gtatacaactcattatag

SEQ ID NO: 29960 - DNA, 18 bp, Artificial Sequence
  Synthetic DNA
taaaaagaatcactaaag

SEQ ID NO: 29961 - DNA, 18 bp, Artificial Sequence
  Synthetic DNA
taaaacaactcaatatgg

SEQ ID NO: 29962 - DNA, 18 bp, Artificial Sequence
  Synthetic DNA
taaaacaactcattaaag

SEQ ID NO: 29963 - DNA, 18 bp, Artificial Sequence
  Synthetic DNA
taaaacaattcactatcg

SEQ ID NO: 29964 - DNA, 18 bp, Artificial Sequence
  Synthetic DNA
taaaacatctcactgtag

SEQ ID NO: 29965 - DNA, 18 bp, Artificial Sequence
  Synthetic DNA
taaaacgaatcaatacag

SEQ ID NO: 29966 - DNA, 18 bp, Artificial Sequence
  Synthetic DNA
taaaacgaattactatgg

SEQ ID NO: 29967 - DNA, 18 bp, Artificial Sequence
  Synthetic DNA
taaaacgacacactttcg

SEQ ID NO: 29968 - DNA, 18 bp, Artificial Sequence
  Synthetic DNA
taaaacgactcacgcaag

SEQ ID NO: 29969 - DNA, 18 bp, Artificial Sequence
  Synthetic DNA
taaaacgactgacattag

SEQ ID NO: 29970 - DNA, 18 bp, Artificial Sequence
  Synthetic DNA
taaaacgactgtatatag

SEQ ID NO: 29971 - DNA, 18 bp, Artificial Sequence
  Synthetic DNA
taaaacgactttctaaag

SEQ ID NO: 29972 - DNA, 18 bp, Artificial Sequence
  Synthetic DNA
taaaacgcctccctatcg

SEQ ID NO: 29973 - DNA, 18 bp, Artificial Sequence
  Synthetic DNA
taaaacgccttaatatag

SEQ ID NO: 29974 - DNA, 18 bp, Artificial Sequence
  Synthetic DNA
taaaacgtctcattacag

SEQ ID NO: 29975 - DNA, 18 bp, Artificial Sequence
  Synthetic DNA
taaaatgactcactcaag

SEQ ID NO: 29976 - DNA, 18 bp, Artificial Sequence
  Synthetic DNA
taaaatgactcacttaag

SEQ ID NO: 29977 - DNA, 18 bp, Artificial Sequence
  Synthetic DNA
taaagcgactctatatag

SEQ ID NO: 29978 - DNA, 18 bp, Artificial Sequence
  Synthetic DNA
taacacgacacaccaaag

SEQ ID NO: 29979 - DNA, 18 bp, Artificial Sequence
  Synthetic DNA
taacacgattcactcaag

SEQ ID NO: 29980 - DNA, 18 bp, Artificial Sequence
  Synthetic DNA
taagacgacattctatag

SEQ ID NO: 29981 - DNA, 18 bp, Artificial Sequence
  Synthetic DNA
taagccgtgtcactatag

SEQ ID NO: 29982 - DNA, 18 bp, Artificial Sequence
  Synthetic DNA
taataaaacacactttag

SEQ ID NO: 29983 - DNA, 18 bp, Artificial Sequence
  Synthetic DNA
taataacaataactatag

SEQ ID NO: 29984 - DNA, 18 bp, Artificial Sequence
  Synthetic DNA
taataacactcacagtag

SEQ ID NO: 29985 - DNA, 18 bp, Artificial Sequence
  Synthetic DNA
taataagaataactacag

SEQ ID NO: 29986 - DNA, 18 bp, Artificial Sequence
  Synthetic DNA
taataagactcacttagg

SEQ ID NO: 29987 - DNA, 18 bp, Artificial Sequence
  Synthetic DNA
taataagactctttaaag

SEQ ID NO: 29988 - DNA, 18 bp, Artificial Sequence
  Synthetic DNA
taatacaacacaaaatag

SEQ ID NO: 29989 - DNA, 18 bp, Artificial Sequence
  Synthetic DNA
taatacaactcacttccg

SEQ ID NO: 29990 - DNA, 18 bp, Artificial Sequence
  Synthetic DNA
taatacaattcactttgg

SEQ ID NO: 29991 - DNA, 18 bp, Artificial Sequence
  Synthetic DNA
taatacacctcacaaaag

SEQ ID NO: 29992 - DNA, 18 bp, Artificial Sequence
  Synthetic DNA
taatacctctaactgtag

SEQ ID NO: 29993 - DNA, 18 bp, Artificial Sequence
  Synthetic DNA
taatacctttctctatag

SEQ ID NO: 29994 - DNA, 18 bp, Artificial Sequence
  Synthetic DNA
taatacgaaatactttag

SEQ ID NO: 29995 - DNA, 18 bp, Artificial Sequence
  Synthetic DNA
taatacgaattattaaag

SEQ ID NO: 29996 - DNA, 18 bp, Artificial Sequence
  Synthetic DNA
taatacgacaaaccaaag

SEQ ID NO: 29997 - DNA, 18 bp, Artificial Sequence
  Synthetic DNA
taatacgacactacatag

SEQ ID NO: 29998 - DNA, 18 bp, Artificial Sequence
  Synthetic DNA
taatacgacatataatag

SEQ ID NO: 29999 - DNA, 18 bp, Artificial Sequence
  Synthetic DNA
taatacgactacttttag

SEQ ID NO: 30000 - DNA, 18 bp, Artificial Sequence
  Synthetic DNA
taatacgactctataacg

SEQ ID NO: 30001 - DNA, 18 bp, Artificial Sequence
  Synthetic DNA
taatacgactctctgtcc

SEQ ID NO: 30002 - DNA, 18 bp, Artificial Sequence
  Synthetic DNA
taatacgactctttaagg

SEQ ID NO: 30003 - DNA, 18 bp, Artificial Sequence
  Synthetic DNA
taatacgactttcactag

SEQ ID NO: 30004 - DNA, 18 bp, Artificial Sequence
  Synthetic DNA
taatacgagaaactaaag

SEQ ID NO: 30005 - DNA, 18 bp, Artificial Sequence
  Synthetic DNA
taatacgagtcacaaagg

SEQ ID NO: 30006 - DNA, 18 bp, Artificial Sequence
  Synthetic DNA
taatacgagtctatgtag

SEQ ID NO: 30007 - DNA, 18 bp, Artificial Sequence
  Synthetic DNA
taatacgattccataaag

SEQ ID NO: 30008 - DNA, 18 bp, Artificial Sequence
  Synthetic DNA
taatacgattgacattag

SEQ ID NO: 30009 - DNA, 18 bp, Artificial Sequence
  Synthetic DNA
taatacgatttagtaaag

SEQ ID NO: 30010 - DNA, 18 bp, Artificial Sequence
  Synthetic DNA
taatacgtatcaatttag

SEQ ID NO: 30011 - DNA, 18 bp, Artificial Sequence
  Synthetic DNA
taatacgtatctatatag

SEQ ID NO: 30012 - DNA, 18 bp, Artificial Sequence
  Synthetic DNA
taatacgtcacacagtag

SEQ ID NO: 30013 - DNA, 18 bp, Artificial Sequence
  Synthetic DNA
taatacgtccaactctag

SEQ ID NO: 30014 - DNA, 18 bp, Artificial Sequence
  Synthetic DNA
taatacgtctaacaagag

SEQ ID NO: 30015 - DNA, 18 bp, Artificial Sequence
  Synthetic DNA
taatacgtctcataatgg

SEQ ID NO: 30016 - DNA, 18 bp, Artificial Sequence
  Synthetic DNA
taatacgtttcaaaatag

SEQ ID NO: 30017 - DNA, 18 bp, Artificial Sequence
  Synthetic DNA
taatacgtttctctatgg

SEQ ID NO: 30018 - DNA, 18 bp, Artificial Sequence
  Synthetic DNA
taatactaaacaatatag

SEQ ID NO: 30019 - DNA, 18 bp, Artificial Sequence
  Synthetic DNA
taatactacacaatatcg

SEQ ID NO: 30020 - DNA, 18 bp, Artificial Sequence
  Synthetic DNA
taatactactcccattag

SEQ ID NO: 30021 - DNA, 18 bp, Artificial Sequence
  Synthetic DNA
taatactcctctcaatag

SEQ ID NO: 30022 - DNA, 18 bp, Artificial Sequence
  Synthetic DNA
taatactgcatactatag

SEQ ID NO: 30023 - DNA, 18 bp, Artificial Sequence
  Synthetic DNA
taataggactctcattag

SEQ ID NO: 30024 - DNA, 18 bp, Artificial Sequence
  Synthetic DNA
taataggtttctctatag

SEQ ID NO: 30025 - DNA, 18 bp, Artificial Sequence
  Synthetic DNA
taatatatcccactatag

SEQ ID NO: 30026 - DNA, 18 bp, Artificial Sequence
  Synthetic DNA
taatatcactctctaaag

SEQ ID NO: 30027 - DNA, 18 bp, Artificial Sequence
  Synthetic DNA
taatatgacaaacaatag

SEQ ID NO: 30028 - DNA, 18 bp, Artificial Sequence
  Synthetic DNA
taatatgactaactttcg

SEQ ID NO: 30029 - DNA, 18 bp, Artificial Sequence
  Synthetic DNA
taatatgactcacacaag

SEQ ID NO: 30030 - DNA, 18 bp, Artificial Sequence
  Synthetic DNA
taatatgactcagcacag

SEQ ID NO: 30031 - DNA, 18 bp, Artificial Sequence
  Synthetic DNA
taatatgactctcaacag

SEQ ID NO: 30032 - DNA, 18 bp, Artificial Sequence
  Synthetic DNA
taatatgactgtctttag

SEQ ID NO: 30033 - DNA, 18 bp, Artificial Sequence
  Synthetic DNA
taatatgagtctctttag

SEQ ID NO: 30034 - DNA, 18 bp, Artificial Sequence
  Synthetic DNA
taatatgattaaatatag

SEQ ID NO: 30035 - DNA, 18 bp, Artificial Sequence
  Synthetic DNA
taatatgattcacttcag

SEQ ID NO: 30036 - DNA, 18 bp, Artificial Sequence
  Synthetic DNA
taatatgattccctatcg

SEQ ID NO: 30037 - DNA, 18 bp, Artificial Sequence
  Synthetic DNA
taatatgtctaactaaag

SEQ ID NO: 30038 - DNA, 18 bp, Artificial Sequence
  Synthetic DNA
taatatgtctcccaatag

SEQ ID NO: 30039 - DNA, 18 bp, Artificial Sequence
  Synthetic DNA
taatatgtctctctacag

SEQ ID NO: 30040 - DNA, 18 bp, Artificial Sequence
  Synthetic DNA
taatattacttactaaag

SEQ ID NO: 30041 - DNA, 18 bp, Artificial Sequence
  Synthetic DNA
taatatttctctctatag

SEQ ID NO: 30042 - DNA, 18 bp, Artificial Sequence
  Synthetic DNA
taatcccgctcactttag

SEQ ID NO: 30043 - DNA, 18 bp, Artificial Sequence
  Synthetic DNA
taatccgacccactgtcg

SEQ ID NO: 30044 - DNA, 18 bp, Artificial Sequence
  Synthetic DNA
taatccgactaagtaaag

SEQ ID NO: 30045 - DNA, 18 bp, Artificial Sequence
  Synthetic DNA
taatccgactctaaatag

SEQ ID NO: 30046 - DNA, 18 bp, Artificial Sequence
  Synthetic DNA
taatccggctctctttag

SEQ ID NO: 30047 - DNA, 18 bp, Artificial Sequence
  Synthetic DNA
taatccgtcacactctag

SEQ ID NO: 30048 - DNA, 18 bp, Artificial Sequence
  Synthetic DNA
taatccgtctcaaaatag

SEQ ID NO: 30049 - DNA, 18 bp, Artificial Sequence
  Synthetic DNA
taatctgacacactatgg

SEQ ID NO: 30050 - DNA, 18 bp, Artificial Sequence
  Synthetic DNA
taatgcagctcacaatag

SEQ ID NO: 30051 - DNA, 18 bp, Artificial Sequence
  Synthetic DNA
taatgcatctcactaaag

SEQ ID NO: 30052 - DNA, 18 bp, Artificial Sequence
  Synthetic DNA
taatgcgaatcattatcg

SEQ ID NO: 30053 - DNA, 18 bp, Artificial Sequence
  Synthetic DNA
taatgcgactcaatcaag

SEQ ID NO: 30054 - DNA, 18 bp, Artificial Sequence
  Synthetic DNA
taatgcgcctcattaaag

SEQ ID NO: 30055 - DNA, 18 bp, Artificial Sequence
  Synthetic DNA
taatgtgactcacactag

SEQ ID NO: 30056 - DNA, 18 bp, Artificial Sequence
  Synthetic DNA
tactacgactatctttag

SEQ ID NO: 30057 - DNA, 18 bp, Artificial Sequence
  Synthetic DNA
tactacgactcatattag

SEQ ID NO: 30058 - DNA, 18 bp, Artificial Sequence
  Synthetic DNA
tactatagctcactatag

SEQ ID NO: 30059 - DNA, 18 bp, Artificial Sequence
  Synthetic DNA
tagtaagaatcactaaag

SEQ ID NO: 30060 - DNA, 18 bp, Artificial Sequence
  Synthetic DNA
tagtaagactcaataaag

SEQ ID NO: 30061 - DNA, 18 bp, Artificial Sequence
  Synthetic DNA
tagtacatttcactatag

SEQ ID NO: 30062 - DNA, 18 bp, Artificial Sequence
  Synthetic DNA
tagtacgtctcacactag

SEQ ID NO: 30063 - DNA, 18 bp, Artificial Sequence
  Synthetic DNA
tagtacgtctcactctaa

SEQ ID NO: 30064 - DNA, 18 bp, Artificial Sequence
  Synthetic DNA
tagtactactcacaacag

SEQ ID NO: 30065 - DNA, 18 bp, Artificial Sequence
  Synthetic DNA
tagtactactcagtgtag

SEQ ID NO: 30066 - DNA, 18 bp, Artificial Sequence
  Synthetic DNA
tagtacttctcactctag

SEQ ID NO: 30067 - DNA, 18 bp, Artificial Sequence
  Synthetic DNA
tataacgacacactatcg

SEQ ID NO: 30068 - DNA, 18 bp, Artificial Sequence
  Synthetic DNA
tataacgacaccctatag

SEQ ID NO: 30069 - DNA, 18 bp, Artificial Sequence
  Synthetic DNA
tataacgactcataatag

SEQ ID NO: 30070 - DNA, 18 bp, Artificial Sequence
  Synthetic DNA
tatagcgactcacaatag

SEQ ID NO: 30071 - DNA, 18 bp, Artificial Sequence
  Synthetic DNA
tatcacgacgcactatcg

SEQ ID NO: 30072 - DNA, 18 bp, Artificial Sequence
  Synthetic DNA
tatcacgattcactacag

SEQ ID NO: 30073 - DNA, 18 bp, Artificial Sequence
  Synthetic DNA
tatcatgactcactaaag

SEQ ID NO: 30074 - DNA, 18 bp, Artificial Sequence
  Synthetic DNA
tattaagaattactatag

SEQ ID NO: 30075 - DNA, 18 bp, Artificial Sequence
  Synthetic DNA
tattaagactcactaagg

SEQ ID NO: 30076 - DNA, 18 bp, Artificial Sequence
  Synthetic DNA
tattaaggctcactaaag

SEQ ID NO: 30077 - DNA, 18 bp, Artificial Sequence
  Synthetic DNA
tattaccacacactaaag

SEQ ID NO: 30078 - DNA, 18 bp, Artificial Sequence
  Synthetic DNA
tattaccactcaatgtag

SEQ ID NO: 30079 - DNA, 18 bp, Artificial Sequence
  Synthetic DNA
tattacgaattactaaag

SEQ ID NO: 30080 - DNA, 18 bp, Artificial Sequence
  Synthetic DNA
tattacgacatacaatag

SEQ ID NO: 30081 - DNA, 18 bp, Artificial Sequence
  Synthetic DNA
tattacgaccatctatag

SEQ ID NO: 30082 - DNA, 18 bp, Artificial Sequence
  Synthetic DNA
tattacgactcattttgg

SEQ ID NO: 30083 - DNA, 18 bp, Artificial Sequence
  Synthetic DNA
tattacgacttactgaag

SEQ ID NO: 30084 - DNA, 18 bp, Artificial Sequence
  Synthetic DNA
tattacgacttcatatag

SEQ ID NO: 30085 - DNA, 18 bp, Artificial Sequence
  Synthetic DNA
tattacgagacaatatag

SEQ ID NO: 30086 - DNA, 18 bp, Artificial Sequence
  Synthetic DNA
tattacgatccactaaag

SEQ ID NO: 30087 - DNA, 18 bp, Artificial Sequence
  Synthetic DNA
tattacgattaactctag

SEQ ID NO: 30088 - DNA, 18 bp, Artificial Sequence
  Synthetic DNA
tattacgattatctatag

SEQ ID NO: 30089 - DNA, 18 bp, Artificial Sequence
  Synthetic DNA
tattacgattgactttag

SEQ ID NO: 30090 - DNA, 18 bp, Artificial Sequence
  Synthetic DNA
tattacgtatcactctag

SEQ ID NO: 30091 - DNA, 18 bp, Artificial Sequence
  Synthetic DNA
tattacgtctaaatatag

SEQ ID NO: 30092 - DNA, 18 bp, Artificial Sequence
  Synthetic DNA
tattacgtctaactttag

SEQ ID NO: 30093 - DNA, 18 bp, Artificial Sequence
  Synthetic DNA
tattacgtctcacaaaag

SEQ ID NO: 30094 - DNA, 18 bp, Artificial Sequence
  Synthetic DNA
tattacgtgtcagtatag

SEQ ID NO: 30095 - DNA, 18 bp, Artificial Sequence
  Synthetic DNA
tattagaactcaatatag

SEQ ID NO: 30096 - DNA, 18 bp, Artificial Sequence
  Synthetic DNA
tattaggactcactaacg

SEQ ID NO: 30097 - DNA, 18 bp, Artificial Sequence
  Synthetic DNA
tattatgactcactttcg

SEQ ID NO: 30098 - DNA, 18 bp, Artificial Sequence
  Synthetic DNA
tattgcgaccctctatag

SEQ ID NO: 30099 - DNA, 18 bp, Artificial Sequence
  Synthetic DNA
tattgcggttcactatag

SEQ ID NO: 30100 - DNA, 18 bp, Artificial Sequence
  Synthetic DNA
tcaaacgacacactttag

SEQ ID NO: 30101 - DNA, 18 bp, Artificial Sequence
  Synthetic DNA
tcataagacacactttag

SEQ ID NO: 30102 - DNA, 18 bp, Artificial Sequence
  Synthetic DNA
tcatacaaatctctatag

SEQ ID NO: 30103 - DNA, 18 bp, Artificial Sequence
  Synthetic DNA
tcatacgaatatctatag

SEQ ID NO: 30104 - DNA, 18 bp, Artificial Sequence
  Synthetic DNA
tcatacgcctcacattag

SEQ ID NO: 30105 - DNA, 18 bp, Artificial Sequence
  Synthetic DNA
tcatactactctctttag

SEQ ID NO: 30106 - DNA, 18 bp, Artificial Sequence
  Synthetic DNA
tcgtacgacacactatcg

SEQ ID NO: 30107 - DNA, 18 bp, Artificial Sequence
  Synthetic DNA
tctaacgactcactatgg

SEQ ID NO: 30108 - DNA, 18 bp, Artificial Sequence
  Synthetic DNA
tcttacgtttcactatag

SEQ ID NO: 30109 - DNA, 18 bp, Artificial Sequence
  Synthetic DNA
tgataccaaacactatag

SEQ ID NO: 30110 - DNA, 18 bp, Artificial Sequence
  Synthetic DNA
tgatacgacaaactacag

SEQ ID NO: 30111 - DNA, 18 bp, Artificial Sequence
  Synthetic DNA
tgatacgcttcaatatag

SEQ ID NO: 30112 - DNA, 18 bp, Artificial Sequence
  Synthetic DNA
tgatacgtctacctatag

SEQ ID NO: 30113 - DNA, 18 bp, Artificial Sequence
  Synthetic DNA
tgatactactttctatag

SEQ ID NO: 30114 - DNA, 18 bp, Artificial Sequence
  Synthetic DNA
tgatatatctcactatag

SEQ ID NO: 30115 - DNA, 18 bp, Artificial Sequence
  Synthetic DNA
tgatcggactcacaatag

SEQ ID NO: 30116 - DNA, 18 bp, Artificial Sequence
  Synthetic DNA
tgttaagactcactaaag

SEQ ID NO: 30117 - DNA, 18 bp, Artificial Sequence
  Synthetic DNA
tgttaccactcactttag

SEQ ID NO: 30118 - DNA, 18 bp, Artificial Sequence
  Synthetic DNA
ttaaaaaactcactatag

SEQ ID NO: 30119 - DNA, 18 bp, Artificial Sequence
  Synthetic DNA
ttacacgaatccctatag

SEQ ID NO: 30120 - DNA, 18 bp, Artificial Sequence
  Synthetic DNA
ttacacgactcaatttag

SEQ ID NO: 30121 - DNA, 18 bp, Artificial Sequence
  Synthetic DNA
ttacacgtctcaccatag

SEQ ID NO: 30122 - DNA, 18 bp, Artificial Sequence
  Synthetic DNA
ttacactactcattatag

SEQ ID NO: 30123 - DNA, 18 bp, Artificial Sequence
  Synthetic DNA
ttagacgaatcactacag

SEQ ID NO: 30124 - DNA, 18 bp, Artificial Sequence
  Synthetic DNA
ttataacaatcactatag

SEQ ID NO: 30125 - DNA, 18 bp, Artificial Sequence
  Synthetic DNA
ttataagacatactatag

SEQ ID NO: 30126 - DNA, 18 bp, Artificial Sequence
  Synthetic DNA
ttataagactcaaaatag

SEQ ID NO: 30127 - DNA, 18 bp, Artificial Sequence
  Synthetic DNA
ttataagtatcactatag

SEQ ID NO: 30128 - DNA, 18 bp, Artificial Sequence
  Synthetic DNA
ttataagtttcactatag

SEQ ID NO: 30129 - DNA, 18 bp, Artificial Sequence
  Synthetic DNA
ttataatactcaatatag

SEQ ID NO: 30130 - DNA, 18 bp, Artificial Sequence
  Synthetic DNA
ttatacaaatcacaatag

SEQ ID NO: 30131 - DNA, 18 bp, Artificial Sequence
  Synthetic DNA
ttatacaactcattctag

SEQ ID NO: 30132 - DNA, 18 bp, Artificial Sequence
  Synthetic DNA
ttatacgacagaatatag

SEQ ID NO: 30133 - DNA, 18 bp, Artificial Sequence
  Synthetic DNA
ttatacgactaacttgag

SEQ ID NO: 30134 - DNA, 18 bp, Artificial Sequence
  Synthetic DNA
ttatacgactcaaaagag

SEQ ID NO: 30135 - DNA, 18 bp, Artificial Sequence
  Synthetic DNA
ttatacgactctctgtgg

SEQ ID NO: 30136 - DNA, 18 bp, Artificial Sequence
  Synthetic DNA
ttatacgtcacactatcg

SEQ ID NO: 30137 - DNA, 18 bp, Artificial Sequence
  Synthetic DNA
ttatactaatcaatatag

SEQ ID NO: 30138 - DNA, 18 bp, Artificial Sequence
  Synthetic DNA
ttatactaatcattatag

SEQ ID NO: 30139 - DNA, 18 bp, Artificial Sequence
  Synthetic DNA
ttatactattcactgtag

SEQ ID NO: 30140 - DNA, 18 bp, Artificial Sequence
  Synthetic DNA
ttataggacttactaaag

SEQ ID NO: 30141 - DNA, 18 bp, Artificial Sequence
  Synthetic DNA
ttataggattctctatag

SEQ ID NO: 30142 - DNA, 18 bp, Artificial Sequence
  Synthetic DNA
ttatataacacactatag

SEQ ID NO: 30143 - DNA, 18 bp, Artificial Sequence
  Synthetic DNA
ttatatgagttactatag

SEQ ID NO: 30144 - DNA, 18 bp, Artificial Sequence
  Synthetic DNA
ttatatgattcaatatag

SEQ ID NO: 30145 - DNA, 18 bp, Artificial Sequence
  Synthetic DNA
ttatatggctcactaaag

SEQ ID NO: 30146 - DNA, 18 bp, Artificial Sequence
  Synthetic DNA
ttatccgactcacttcag

SEQ ID NO: 30147 - DNA, 18 bp, Artificial Sequence
  Synthetic DNA
ttatccgtctctctatag

SEQ ID NO: 30148 - DNA, 18 bp, Artificial Sequence
  Synthetic DNA
ttatgtgacacactatag

SEQ ID NO: 30149 - DNA, 18 bp, Artificial Sequence
  Synthetic DNA
ttctacgactcactaacg

SEQ ID NO: 30150 - DNA, 18 bp, Artificial Sequence
  Synthetic DNA
ttctacgactcattttag

SEQ ID NO: 30151 - DNA, 18 bp, Artificial Sequence
  Synthetic DNA
ttattagactcactaaag

SEQ ID NO: 30152 - DNA, 18 bp, Artificial Sequence
  Synthetic DNA
ttatatgtctcacaatag

SEQ ID NO: 30153 - DNA, 18 bp, Artificial Sequence
  Synthetic DNA
tatcactactcactattg

SEQ ID NO: 30154 - DNA, 18 bp, Artificial Sequence
  Synthetic DNA
ttttatgactcactaaag

SEQ ID NO: 30155 - DNA, 18 bp, Artificial Sequence
  Synthetic DNA
taaatcgaatcactattg

SEQ ID NO: 30156 - DNA, 18 bp, Artificial Sequence
  Synthetic DNA
aaattccactcactaaag

SEQ ID NO: 30157 - DNA, 18 bp, Artificial Sequence
  Synthetic DNA
aaatttgactcacaatag

SEQ ID NO: 30158 - DNA, 18 bp, Artificial Sequence
  Synthetic DNA
taaaacgacccactaatg

SEQ ID NO: 30159 - DNA, 18 bp, Artificial Sequence
  Synthetic DNA
taaaatgactcactaatg

SEQ ID NO: 30160 - DNA, 18 bp, Artificial Sequence
  Synthetic DNA
taataagacacacaattg

SEQ ID NO: 30161 - DNA, 18 bp, Artificial Sequence
  Synthetic DNA
taattcgtatcacaatag

SEQ ID NO: 30162 - DNA, 18 bp, Artificial Sequence
  Synthetic DNA
taattcgtctcactttcg

SEQ ID NO: 30163 - DNA, 18 bp, Artificial Sequence
  Synthetic DNA
tataacaactcactattg

SEQ ID NO: 30164 - DNA, 18 bp, Artificial Sequence
  Synthetic DNA
tattacggctcacttttg

SEQ ID NO: 30165 - DNA, 18 bp, Artificial Sequence
  Synthetic DNA
tattactactccctattg

SEQ ID NO: 30166 - DNA, 18 bp, Artificial Sequence
  Synthetic DNA
tatttcgtttcactatag

SEQ ID NO: 30167 - DNA, 18 bp, Artificial Sequence
  Synthetic DNA
tatttctactcaatatag

SEQ ID NO: 30168 - DNA, 18 bp, Artificial Sequence
  Synthetic DNA
ttattcgactctcaatag

SEQ ID NO: 30169 - DNA, 18 bp, Artificial Sequence
  Synthetic DNA
ttattcgtctgactatag

SEQ ID NO: 30170 - DNA, 18 bp, Artificial Sequence
  Synthetic DNA
ttttacgactcacttttg

SEQ ID NO: 30171 - DNA, 18 bp, Artificial Sequence
  Synthetic DNA
atatacgattcactacag

SEQ ID NO: 30172 - DNA, 18 bp, Artificial Sequence
  Synthetic DNA
cattacgacactctatag

SEQ ID NO: 30173 - DNA, 18 bp, Artificial Sequence
  Synthetic DNA
taaaacaactcacttcag

SEQ ID NO: 30174 - DNA, 18 bp, Artificial Sequence
  Synthetic DNA
taacacgtctctctaaag

SEQ ID NO: 30175 - DNA, 18 bp, Artificial Sequence
  Synthetic DNA
taataagtttcacaatag

SEQ ID NO: 30176 - DNA, 18 bp, Artificial Sequence
  Synthetic DNA
taatacgattctcttcag

SEQ ID NO: 30177 - DNA, 18 bp, Artificial Sequence
  Synthetic DNA
tataaagtctcactatag

SEQ ID NO: 30178 - DNA, 18 bp, Artificial Sequence
  Synthetic DNA
tcatacgtcaaactatag

SEQ ID NO: 30179 - DNA, 18 bp, Artificial Sequence
  Synthetic DNA
tgttacgacactctatag

SEQ ID NO: 30180 - DNA, 18 bp, Artificial Sequence
  Synthetic DNA
ttataagactcactaagg

SEQ ID NO: 30181 - DNA, 18 bp, Artificial Sequence
  Synthetic DNA
ttatacaacacactttag

SEQ ID NO: 30182 - DNA, 18 bp, Artificial Sequence
  Synthetic DNA
ttatacgattaacaatag

SEQ ID NO: 30183 - DNA, 18 bp, Artificial Sequence
  Synthetic DNA
ttatattactaactatag

SEQ ID NO: 30184 - DNA, 18 bp, Artificial Sequence
  Synthetic DNA
ttctacgacacactttag

SEQ ID NO: 30185 - DNA, 18 bp, Artificial Sequence
  Synthetic DNA
ttttaagattcactatag

SEQ ID NO: 30186 - DNA, 18 bp, Artificial Sequence
  Synthetic DNA
ttttacgaatcactaaag

SEQ ID NO: 30187 - DNA, 18 bp, Artificial Sequence
  Synthetic DNA
tattacgactcacttatg

SEQ ID NO: 30188 - DNA, 18 bp, Artificial Sequence
  Synthetic DNA
ttatacgactcacatttg

SEQ ID NO: 30189 - DNA, 18 bp, Artificial Sequence
  Synthetic DNA
tattacttctcactattg

SEQ ID NO: 30190 - DNA, 18 bp, Artificial Sequence
  Synthetic DNA
taatacgtctcaaattag

SEQ ID NO: 30191 - DNA, 18 bp, Artificial Sequence
  Synthetic DNA
ttatacgtctctctaaag

SEQ ID NO: 30192 - DNA, 18 bp, Artificial Sequence
  Synthetic DNA
atattcgtctcactatag

SEQ ID NO: 30193 - DNA, 18 bp, Artificial Sequence
  Synthetic DNA
aaaatcgactcactattg

SEQ ID NO: 30194 - DNA, 18 bp, Artificial Sequence
  Synthetic DNA
taaatcgacttgctatag

SEQ ID NO: 30195 - DNA, 18 bp, Artificial Sequence
  Synthetic DNA
taattcgacatactattg

SEQ ID NO: 30196 - DNA, 18 bp, Artificial Sequence
  Synthetic DNA
taattcgactcagtaatg

SEQ ID NO: 30197 - DNA, 18 bp, Artificial Sequence
  Synthetic DNA
tatttcgactcactcttg

SEQ ID NO: 30198 - DNA, 18 bp, Artificial Sequence
  Synthetic DNA
tgatacgactcgcaattg

SEQ ID NO: 30199 - DNA, 18 bp, Artificial Sequence
  Synthetic DNA
tgattcgactcgctaaag

SEQ ID NO: 30200 - DNA, 18 bp, Artificial Sequence
  Synthetic DNA
ttattcgattcactattg

SEQ ID NO: 30201 - DNA, 18 bp, Artificial Sequence
  Synthetic DNA
aaaaacggctcactattg

SEQ ID NO: 30202 - DNA, 18 bp, Artificial Sequence
  Synthetic DNA
aaatacgacttagtattg

SEQ ID NO: 30203 - DNA, 18 bp, Artificial Sequence
  Synthetic DNA
aaattcaactcaccatag

SEQ ID NO: 30204 - DNA, 18 bp, Artificial Sequence
  Synthetic DNA
aaattcgacacactaaag

SEQ ID NO: 30205 - DNA, 18 bp, Artificial Sequence
  Synthetic DNA
aaattcgacccactctag

SEQ ID NO: 30206 - DNA, 18 bp, Artificial Sequence
  Synthetic DNA
aaattcgactccctttag

SEQ ID NO: 30207 - DNA, 18 bp, Artificial Sequence
  Synthetic DNA
atgtacgactcactattg

SEQ ID NO: 30208 - DNA, 18 bp, Artificial Sequence
  Synthetic DNA
caatacatctcactattg

SEQ ID NO: 30209 - DNA, 18 bp, Artificial Sequence
  Synthetic DNA
caatacggctcacttttg

SEQ ID NO: 30210 - DNA, 18 bp, Artificial Sequence
  Synthetic DNA
caatacgtcacactattg

SEQ ID NO: 30211 - DNA, 18 bp, Artificial Sequence
  Synthetic DNA
gaatacaacttactattg

SEQ ID NO: 30212 - DNA, 18 bp, Artificial Sequence
  Synthetic DNA
gtatacgcctcgctatag

SEQ ID NO: 30213 - DNA, 18 bp, Artificial Sequence
  Synthetic DNA
taaaaccactcgctaaag

SEQ ID NO: 30214 - DNA, 18 bp, Artificial Sequence
  Synthetic DNA
taaaacgtttcgctatag

SEQ ID NO: 30215 - DNA, 18 bp, Artificial Sequence
  Synthetic DNA
taaatctactcactatcg

SEQ ID NO: 30216 - DNA, 18 bp, Artificial Sequence
  Synthetic DNA
taagacgactctctcttg

SEQ ID NO: 30217 - DNA, 18 bp, Artificial Sequence
  Synthetic DNA
taagtagtctcactatag

SEQ ID NO: 30218 - DNA, 18 bp, Artificial Sequence
  Synthetic DNA
taatacccctcacaattg

SEQ ID NO: 30219 - DNA, 18 bp, Artificial Sequence
  Synthetic DNA
taatacgaaacactcttg

SEQ ID NO: 30220 - DNA, 18 bp, Artificial Sequence
  Synthetic DNA
taatacgaatctccattg

SEQ ID NO: 30221 - DNA, 18 bp, Artificial Sequence
  Synthetic DNA
taatacgacactctactg

SEQ ID NO: 30222 - DNA, 18 bp, Artificial Sequence
  Synthetic DNA
taatacgactgacaaatg

SEQ ID NO: 30223 - DNA, 18 bp, Artificial Sequence
  Synthetic DNA
taatacgagactctattg

SEQ ID NO: 30224 - DNA, 18 bp, Artificial Sequence
  Synthetic DNA
taatacgagttactaatg

SEQ ID NO: 30225 - DNA, 18 bp, Artificial Sequence
  Synthetic DNA
taatacgataccctattg

SEQ ID NO: 30226 - DNA, 18 bp, Artificial Sequence
  Synthetic DNA
taatacgattgtctattg

SEQ ID NO: 30227 - DNA, 18 bp, Artificial Sequence
  Synthetic DNA
taatacgccatactattg

SEQ ID NO: 30228 - DNA, 18 bp, Artificial Sequence
  Synthetic DNA
taatacgcctaactaatg

SEQ ID NO: 30229 - DNA, 18 bp, Artificial Sequence
  Synthetic DNA
taatacgcttcaatattg

SEQ ID NO: 30230 - DNA, 18 bp, Artificial Sequence
  Synthetic DNA
taatacggctttctattg

SEQ ID NO: 30231 - DNA, 18 bp, Artificial Sequence
  Synthetic DNA
taataggactctccattg

SEQ ID NO: 30232 - DNA, 18 bp, Artificial Sequence
  Synthetic DNA
taatatacctcgctatag

SEQ ID NO: 30233 - DNA, 18 bp, Artificial Sequence
  Synthetic DNA
taatatgacacaatattg

SEQ ID NO: 30234 - DNA, 18 bp, Artificial Sequence
  Synthetic DNA
taatatgtctctctattg

SEQ ID NO: 30235 - DNA, 18 bp, Artificial Sequence
  Synthetic DNA
taatgcaactccctattg

SEQ ID NO: 30236 - DNA, 18 bp, Artificial Sequence
  Synthetic DNA
taattagacatactatag

SEQ ID NO: 30237 - DNA, 18 bp, Artificial Sequence
  Synthetic DNA
taattagtctgactatag

SEQ ID NO: 30238 - DNA, 18 bp, Artificial Sequence
  Synthetic DNA
taattatactcattatag

SEQ ID NO: 30239 - DNA, 18 bp, Artificial Sequence
  Synthetic DNA
taattcaacacattatag

SEQ ID NO: 30240 - DNA, 18 bp, Artificial Sequence
  Synthetic DNA
taattcaactgacaatag

SEQ ID NO: 30241 - DNA, 18 bp, Artificial Sequence
  Synthetic DNA
taattcatctaactatag

SEQ ID NO: 30242 - DNA, 18 bp, Artificial Sequence
  Synthetic DNA
taattccactttctatag

SEQ ID NO: 30243 - DNA, 18 bp, Artificial Sequence
  Synthetic DNA
taattcgaattactctag

SEQ ID NO: 30244 - DNA, 18 bp, Artificial Sequence
  Synthetic DNA
taattcgactcacactcg

SEQ ID NO: 30245 - DNA, 18 bp, Artificial Sequence
  Synthetic DNA
taattcgactctgtaaag

SEQ ID NO: 30246 - DNA, 18 bp, Artificial Sequence
  Synthetic DNA
taattcgtcacactatcg

SEQ ID NO: 30247 - DNA, 18 bp, Artificial Sequence
  Synthetic DNA
taattcgtcccactaaag

SEQ ID NO: 30248 - DNA, 18 bp, Artificial Sequence
  Synthetic DNA
taattcgtctgaatatag

SEQ ID NO: 30249 - DNA, 18 bp, Artificial Sequence
  Synthetic DNA
taattcgtttcactagag

SEQ ID NO: 30250 - DNA, 18 bp, Artificial Sequence
  Synthetic DNA
taattctacacactatgg

SEQ ID NO: 30251 - DNA, 18 bp, Artificial Sequence
  Synthetic DNA
taattctacttcctatag

SEQ ID NO: 30252 - DNA, 18 bp, Artificial Sequence
  Synthetic DNA
taattggtctcactacag

SEQ ID NO: 30253 - DNA, 18 bp, Artificial Sequence
  Synthetic DNA
taatttaactcactatgg

SEQ ID NO: 30254 - DNA, 18 bp, Artificial Sequence
  Synthetic DNA
taatttcactcacaatag

SEQ ID NO: 30255 - DNA, 18 bp, Artificial Sequence
  Synthetic DNA
tactacgacctactattg

SEQ ID NO: 30256 - DNA, 18 bp, Artificial Sequence
  Synthetic DNA
tacttcgactctgtatag

SEQ ID NO: 30257 - DNA, 18 bp, Artificial Sequence
  Synthetic DNA
tagattgactcactatag

SEQ ID NO: 30258 - DNA, 18 bp, Artificial Sequence
  Synthetic DNA
tagtacgactcacagttg

SEQ ID NO: 30259 - DNA, 18 bp, Artificial Sequence
  Synthetic DNA
tagtacgactccccattg

SEQ ID NO: 30260 - DNA, 18 bp, Artificial Sequence
  Synthetic DNA
tagtactacacactattg

SEQ ID NO: 30261 - DNA, 18 bp, Artificial Sequence
  Synthetic DNA
tagttcaactcacaatag

SEQ ID NO: 30262 - DNA, 18 bp, Artificial Sequence
  Synthetic DNA
tagttcgaatctctatag

SEQ ID NO: 30263 - DNA, 18 bp, Artificial Sequence
  Synthetic DNA
tattaccactcacttttg

SEQ ID NO: 30264 - DNA, 18 bp, Artificial Sequence
  Synthetic DNA
tattacgattcgctttag

SEQ ID NO: 30265 - DNA, 18 bp, Artificial Sequence
  Synthetic DNA
tattacgcctctctattg

SEQ ID NO: 30266 - DNA, 18 bp, Artificial Sequence
  Synthetic DNA
tattccgattcactattg

SEQ ID NO: 30267 - DNA, 18 bp, Artificial Sequence
  Synthetic DNA
tattccgattcgctatag

SEQ ID NO: 30268 - DNA, 18 bp, Artificial Sequence
  Synthetic DNA
tatttcgtatcactatag

SEQ ID NO: 30269 - DNA, 18 bp, Artificial Sequence
  Synthetic DNA
tatttcgtctcaatatag

SEQ ID NO: 30270 - DNA, 18 bp, Artificial Sequence
  Synthetic DNA
tatttcgtctcactttag

SEQ ID NO: 30271 - DNA, 18 bp, Artificial Sequence
  Synthetic DNA
tatttggactctctatag

SEQ ID NO: 30272 - DNA, 18 bp, Artificial Sequence
  Synthetic DNA
tcaaacgactcactaatg

SEQ ID NO: 30273 - DNA, 18 bp, Artificial Sequence
  Synthetic DNA
tcatacgactaacaattg

SEQ ID NO: 30274 - DNA, 18 bp, Artificial Sequence
  Synthetic DNA
tcatacgactcacaactg

SEQ ID NO: 30275 - DNA, 18 bp, Artificial Sequence
  Synthetic DNA
tcattctaatcactatag

SEQ ID NO: 30276 - DNA, 18 bp, Artificial Sequence
  Synthetic DNA
tcttacgactctctattg

SEQ ID NO: 30277 - DNA, 18 bp, Artificial Sequence
  Synthetic DNA
tgatacgactcattcttg

SEQ ID NO: 30278 - DNA, 18 bp, Artificial Sequence
  Synthetic DNA
tgatactactctctattg

SEQ ID NO: 30279 - DNA, 18 bp, Artificial Sequence
  Synthetic DNA
tgattcaactctctatag

SEQ ID NO: 30280 - DNA, 18 bp, Artificial Sequence
  Synthetic DNA
tgattcgactctttatag

SEQ ID NO: 30281 - DNA, 18 bp, Artificial Sequence
  Synthetic DNA
tgattcgattcactttag

SEQ ID NO: 30282 - DNA, 18 bp, Artificial Sequence
  Synthetic DNA
tgattctactctctatag

SEQ ID NO: 30283 - DNA, 18 bp, Artificial Sequence
  Synthetic DNA
tgtctcgactcactatag

SEQ ID NO: 30284 - DNA, 18 bp, Artificial Sequence
  Synthetic DNA
tgttacgactcattattg

SEQ ID NO: 30285 - DNA, 18 bp, Artificial Sequence
  Synthetic DNA
ttaaacgactcaccattg

SEQ ID NO: 30286 - DNA, 18 bp, Artificial Sequence
  Synthetic DNA
ttaatctactcactatag

SEQ ID NO: 30287 - DNA, 18 bp, Artificial Sequence
  Synthetic DNA
ttatacgacaccctattg

SEQ ID NO: 30288 - DNA, 18 bp, Artificial Sequence
  Synthetic DNA
ttatacgacgcactcttg

SEQ ID NO: 30289 - DNA, 18 bp, Artificial Sequence
  Synthetic DNA
ttatacgactcattcttg

SEQ ID NO: 30290 - DNA, 18 bp, Artificial Sequence
  Synthetic DNA
ttatactactcactactg

SEQ ID NO: 30291 - DNA, 18 bp, Artificial Sequence
  Synthetic DNA
ttatatgactcgctaaag

SEQ ID NO: 30292 - DNA, 18 bp, Artificial Sequence
  Synthetic DNA
ttatccgacacactattg

SEQ ID NO: 30293 - DNA, 18 bp, Artificial Sequence
  Synthetic DNA
ttatgcgacttactattg

SEQ ID NO: 30294 - DNA, 18 bp, Artificial Sequence
  Synthetic DNA
ttattcgattcaatatag

SEQ ID NO: 30295 - DNA, 18 bp, Artificial Sequence
  Synthetic DNA
ttgttcgtctcactatag

SEQ ID NO: 30296 - DNA, 18 bp, Artificial Sequence
  Synthetic DNA
aaaaaacactcactatag

SEQ ID NO: 30297 - DNA, 18 bp, Artificial Sequence
  Synthetic DNA
aaaaacgaatcactctag

SEQ ID NO: 30298 - DNA, 18 bp, Artificial Sequence
  Synthetic DNA
aaaaacgactcaccaaag

SEQ ID NO: 30299 - DNA, 18 bp, Artificial Sequence
  Synthetic DNA
aaaaacgactcagtaaag

SEQ ID NO: 30300 - DNA, 18 bp, Artificial Sequence
  Synthetic DNA
aaacacgaatcattatag

SEQ ID NO: 30301 - DNA, 18 bp, Artificial Sequence
  Synthetic DNA
aaataagaatcactaaag

SEQ ID NO: 30302 - DNA, 18 bp, Artificial Sequence
  Synthetic DNA
aaataagtctcactgtag

SEQ ID NO: 30303 - DNA, 18 bp, Artificial Sequence
  Synthetic DNA
aaatacaacacactttag

SEQ ID NO: 30304 - DNA, 18 bp, Artificial Sequence
  Synthetic DNA
aaatacgacactctacag

SEQ ID NO: 30305 - DNA, 18 bp, Artificial Sequence
  Synthetic DNA
aaatacgattcacaaaag

SEQ ID NO: 30306 - DNA, 18 bp, Artificial Sequence
  Synthetic DNA
aaatactatacactatag

SEQ ID NO: 30307 - DNA, 18 bp, Artificial Sequence
  Synthetic DNA
aaatatcactcacaatag

SEQ ID NO: 30308 - DNA, 18 bp, Artificial Sequence
  Synthetic DNA
aaatattactcactaaag

SEQ ID NO: 30309 - DNA, 18 bp, Artificial Sequence
  Synthetic DNA
aactactactcacaatag

SEQ ID NO: 30310 - DNA, 18 bp, Artificial Sequence
  Synthetic DNA
aagtacgactcattaaag

SEQ ID NO: 30311 - DNA, 18 bp, Artificial Sequence
  Synthetic DNA
aagtacgtcccactatag

SEQ ID NO: 30312 - DNA, 18 bp, Artificial Sequence
  Synthetic DNA
aagtacgtctcaatatag

SEQ ID NO: 30313 - DNA, 18 bp, Artificial Sequence
  Synthetic DNA
aattaagactccctatag

SEQ ID NO: 30314 - DNA, 18 bp, Artificial Sequence
  Synthetic DNA
aattacgactcacttgag

SEQ ID NO: 30315 - DNA, 18 bp, Artificial Sequence
  Synthetic DNA
aattatgacacactatag

SEQ ID NO: 30316 - DNA, 18 bp, Artificial Sequence
  Synthetic DNA
acaaatgactcactatag

SEQ ID NO: 30317 - DNA, 18 bp, Artificial Sequence
  Synthetic DNA
acataagacacactatag

SEQ ID NO: 30318 - DNA, 18 bp, Artificial Sequence
  Synthetic DNA
acatacgacctactatag

SEQ ID NO: 30319 - DNA, 18 bp, Artificial Sequence
  Synthetic DNA
acatacgactctctatgg

SEQ ID NO: 30320 - DNA, 18 bp, Artificial Sequence
  Synthetic DNA
agaaacgactcactctag

SEQ ID NO: 30321 - DNA, 18 bp, Artificial Sequence
  Synthetic DNA
agatacgactcacattag

SEQ ID NO: 30322 - DNA, 18 bp, Artificial Sequence
  Synthetic DNA
ataaacgactcaccatag

SEQ ID NO: 30323 - DNA, 18 bp, Artificial Sequence
  Synthetic DNA
atatacgacacacgatag

SEQ ID NO: 30324 - DNA, 18 bp, Artificial Sequence
  Synthetic DNA
atatacgattcactaaag

SEQ ID NO: 30325 - DNA, 18 bp, Artificial Sequence
  Synthetic DNA
atatacggctcacgatag

SEQ ID NO: 30326 - DNA, 18 bp, Artificial Sequence
  Synthetic DNA
atatgcgtctcactatag

SEQ ID NO: 30327 - DNA, 18 bp, Artificial Sequence
  Synthetic DNA
atctacgactcacaatag

SEQ ID NO: 30328 - DNA, 18 bp, Artificial Sequence
  Synthetic DNA
caataacactcacaatag

SEQ ID NO: 30329 - DNA, 18 bp, Artificial Sequence
  Synthetic DNA
caataagaatcactttag

SEQ ID NO: 30330 - DNA, 18 bp, Artificial Sequence
  Synthetic DNA
caatacgactcaaaaaag

SEQ ID NO: 30331 - DNA, 18 bp, Artificial Sequence
  Synthetic DNA
catgacgactaactatag

SEQ ID NO: 30332 - DNA, 18 bp, Artificial Sequence
  Synthetic DNA
cattacggctcactctag

SEQ ID NO: 30333 - DNA, 18 bp, Artificial Sequence
  Synthetic DNA
ccatacgacttacaatag

SEQ ID NO: 30334 - DNA, 18 bp, Artificial Sequence
  Synthetic DNA
cgatacgactcattagag

SEQ ID NO: 30335 - DNA, 18 bp, Artificial Sequence
  Synthetic DNA
cgatacgactgactaaag

SEQ ID NO: 30336 - DNA, 18 bp, Artificial Sequence
  Synthetic DNA
ctatacgtctcaatatag

SEQ ID NO: 30337 - DNA, 18 bp, Artificial Sequence
  Synthetic DNA
gattacgcctcactttag

SEQ ID NO: 30338 - DNA, 18 bp, Artificial Sequence
  Synthetic DNA
gtatacatctcactatag

SEQ ID NO: 30339 - DNA, 18 bp, Artificial Sequence
  Synthetic DNA
taaaaagactctctatcg

SEQ ID NO: 30340 - DNA, 18 bp, Artificial Sequence
  Synthetic DNA
taaaacatctcactctag

SEQ ID NO: 30341 - DNA, 18 bp, Artificial Sequence
  Synthetic DNA
taaaacgacaacctatag

SEQ ID NO: 30342 - DNA, 18 bp, Artificial Sequence
  Synthetic DNA
taaaacgacagacaatag

SEQ ID NO: 30343 - DNA, 18 bp, Artificial Sequence
  Synthetic DNA
taaaacgactatctatcg

SEQ ID NO: 30344 - DNA, 18 bp, Artificial Sequence
  Synthetic DNA
taaaacgattaactaaag

SEQ ID NO: 30345 - DNA, 18 bp, Artificial Sequence
  Synthetic DNA
taaaacgtcacaatatag

SEQ ID NO: 30346 - DNA, 18 bp, Artificial Sequence
  Synthetic DNA
taaaacgtgacactatag

SEQ ID NO: 30347 - DNA, 18 bp, Artificial Sequence
  Synthetic DNA
taaaacgtttcactatcg

SEQ ID NO: 30348 - DNA, 18 bp, Artificial Sequence
  Synthetic DNA
taaaacgtttcactatgg

SEQ ID NO: 30349 - DNA, 18 bp, Artificial Sequence
  Synthetic DNA
taaaactactatctatag

SEQ ID NO: 30350 - DNA, 18 bp, Artificial Sequence
  Synthetic DNA
taaaactccacactatag

SEQ ID NO: 30351 - DNA, 18 bp, Artificial Sequence
  Synthetic DNA
taaagagattcactatag

SEQ ID NO: 30352 - DNA, 18 bp, Artificial Sequence
  Synthetic DNA
taaagcgactcattttag

SEQ ID NO: 30353 - DNA, 18 bp, Artificial Sequence
  Synthetic DNA
taacaaaactaactatag

SEQ ID NO: 30354 - DNA, 18 bp, Artificial Sequence
  Synthetic DNA
taacacaactcaaaatag

SEQ ID NO: 30355 - DNA, 18 bp, Artificial Sequence
  Synthetic DNA
taacacaactcaccatcg

SEQ ID NO: 30356 - DNA, 18 bp, Artificial Sequence
  Synthetic DNA
taacacgaatctctttag

SEQ ID NO: 30357 - DNA, 18 bp, Artificial Sequence
  Synthetic DNA
taacacgagtctcaatag

SEQ ID NO: 30358 - DNA, 18 bp, Artificial Sequence
  Synthetic DNA
taacacgtcactctatag

SEQ ID NO: 30359 - DNA, 18 bp, Artificial Sequence
  Synthetic DNA
taacacgtttcattatag

SEQ ID NO: 30360 - DNA, 18 bp, Artificial Sequence
  Synthetic DNA
taacacgtttctctatag

SEQ ID NO: 30361 - DNA, 18 bp, Artificial Sequence
  Synthetic DNA
taacatgactcactttcg

SEQ ID NO: 30362 - DNA, 18 bp, Artificial Sequence
  Synthetic DNA
taacgcgactcattttag

SEQ ID NO: 30363 - DNA, 18 bp, Artificial Sequence
  Synthetic DNA
taaggctactcacaatag

SEQ ID NO: 30364 - DNA, 18 bp, Artificial Sequence
  Synthetic DNA
taataacaccctctatag

SEQ ID NO: 30365 - DNA, 18 bp, Artificial Sequence
  Synthetic DNA
taataagactcagtttcg

SEQ ID NO: 30366 - DNA, 18 bp, Artificial Sequence
  Synthetic DNA
taataagtcacactctag

SEQ ID NO: 30367 - DNA, 18 bp, Artificial Sequence
  Synthetic DNA
taatacaacacactttcg

SEQ ID NO: 30368 - DNA, 18 bp, Artificial Sequence
  Synthetic DNA
taatacaactcattaacg

SEQ ID NO: 30369 - DNA, 18 bp, Artificial Sequence
  Synthetic DNA
taatacaactctcaacag

SEQ ID NO: 30370 - DNA, 18 bp, Artificial Sequence
  Synthetic DNA
taatacaactctcttaag

SEQ ID NO: 30371 - DNA, 18 bp, Artificial Sequence
  Synthetic DNA
taatacaacttacaatgg

SEQ ID NO: 30372 - DNA, 18 bp, Artificial Sequence
  Synthetic DNA
taatacaagtcagcatag

SEQ ID NO: 30373 - DNA, 18 bp, Artificial Sequence
  Synthetic DNA
taatacaattaactaaag

SEQ ID NO: 30374 - DNA, 18 bp, Artificial Sequence
  Synthetic DNA
taatacagcacacaatag

SEQ ID NO: 30375 - DNA, 18 bp, Artificial Sequence
  Synthetic DNA
taatacatctcaacatag

SEQ ID NO: 30376 - DNA, 18 bp, Artificial Sequence
  Synthetic DNA
taataccaatcactctcg

SEQ ID NO: 30377 - DNA, 18 bp, Artificial Sequence
  Synthetic DNA
taataccactctataaag

SEQ ID NO: 30378 - DNA, 18 bp, Artificial Sequence
  Synthetic DNA
taatacgacacatgacag

SEQ ID NO: 30379 - DNA, 18 bp, Artificial Sequence
  Synthetic DNA
taatacgaccctcaacag

SEQ ID NO: 30380 - DNA, 18 bp, Artificial Sequence
  Synthetic DNA
taatacgactatctcaag

SEQ ID NO: 30381 - DNA, 18 bp, Artificial Sequence
  Synthetic DNA
taatacgactatgaatag

SEQ ID NO: 30382 - DNA, 18 bp, Artificial Sequence
  Synthetic DNA
taatacgactcttttcag

SEQ ID NO: 30383 - DNA, 18 bp, Artificial Sequence
  Synthetic DNA
taatacgactttacatag

SEQ ID NO: 30384 - DNA, 18 bp, Artificial Sequence
  Synthetic DNA
taatacgatccacttaag

SEQ ID NO: 30385 - DNA, 18 bp, Artificial Sequence
  Synthetic DNA
taatacgattccctttcg

SEQ ID NO: 30386 - DNA, 18 bp, Artificial Sequence
  Synthetic DNA
taatacgatttaccaaag

SEQ ID NO: 30387 - DNA, 18 bp, Artificial Sequence
  Synthetic DNA
taatacgcatcacaaaag

SEQ ID NO: 30388 - DNA, 18 bp, Artificial Sequence
  Synthetic DNA
taatacgcctctataaag

SEQ ID NO: 30389 - DNA, 18 bp, Artificial Sequence
  Synthetic DNA
taatacgctaccctatag

SEQ ID NO: 30390 - DNA, 18 bp, Artificial Sequence
  Synthetic DNA
taatacgcttcaatatcg

SEQ ID NO: 30391 - DNA, 18 bp, Artificial Sequence
  Synthetic DNA
taatacgtataacaatag

SEQ ID NO: 30392 - DNA, 18 bp, Artificial Sequence
  Synthetic DNA
taatacgtctcccattag

SEQ ID NO: 30393 - DNA, 18 bp, Artificial Sequence
  Synthetic DNA
taatacgtttcataatag

SEQ ID NO: 30394 - DNA, 18 bp, Artificial Sequence
  Synthetic DNA
taatacgtttctttatag

SEQ ID NO: 30395 - DNA, 18 bp, Artificial Sequence
  Synthetic DNA
taatactacccacttaag

SEQ ID NO: 30396 - DNA, 18 bp, Artificial Sequence
  Synthetic DNA
taatactactctctaggg

SEQ ID NO: 30397 - DNA, 18 bp, Artificial Sequence
  Synthetic DNA
taatactacttactttcg

SEQ ID NO: 30398 - DNA, 18 bp, Artificial Sequence
  Synthetic DNA
taatactccttacaatag

SEQ ID NO: 30399 - DNA, 18 bp, Artificial Sequence
  Synthetic DNA
taatacttctctccatag

SEQ ID NO: 30400 - DNA, 18 bp, Artificial Sequence
  Synthetic DNA
taatagatctaactatag

SEQ ID NO: 30401 - DNA, 18 bp, Artificial Sequence
  Synthetic DNA
taataggactaacattag

SEQ ID NO: 30402 - DNA, 18 bp, Artificial Sequence
  Synthetic DNA
taataggactctatttag

SEQ ID NO: 30403 - DNA, 18 bp, Artificial Sequence
  Synthetic DNA
taataggactttctaaag

SEQ ID NO: 30404 - DNA, 18 bp, Artificial Sequence
  Synthetic DNA
taataggtcatactatag

SEQ ID NO: 30405 - DNA, 18 bp, Artificial Sequence
  Synthetic DNA
taatatcactcactaagg

SEQ ID NO: 30406 - DNA, 18 bp, Artificial Sequence
  Synthetic DNA
taatatcactcataatag

SEQ ID NO: 30407 - DNA, 18 bp, Artificial Sequence
  Synthetic DNA
taatatgaatcagaatag

SEQ ID NO: 30408 - DNA, 18 bp, Artificial Sequence
  Synthetic DNA
taatatgacacacttaag

SEQ ID NO: 30409 - DNA, 18 bp, Artificial Sequence
  Synthetic DNA
taatatgagtctcaatag

SEQ ID NO: 30410 - DNA, 18 bp, Artificial Sequence
  Synthetic DNA
taatatgatccagtatag

SEQ ID NO: 30411 - DNA, 18 bp, Artificial Sequence
  Synthetic DNA
taatatgattcccaatag

SEQ ID NO: 30412 - DNA, 18 bp, Artificial Sequence
  Synthetic DNA
taatatgcatcactaaag

SEQ ID NO: 30413 - DNA, 18 bp, Artificial Sequence
  Synthetic DNA
taatatgccacacaatag

SEQ ID NO: 30414 - DNA, 18 bp, Artificial Sequence
  Synthetic DNA
taatatgttccactatag

SEQ ID NO: 30415 - DNA, 18 bp, Artificial Sequence
  Synthetic DNA
taatatttctaactatag

SEQ ID NO: 30416 - DNA, 18 bp, Artificial Sequence
  Synthetic DNA
taatcaaattcactatag

SEQ ID NO: 30417 - DNA, 18 bp, Artificial Sequence
  Synthetic DNA
taatcagcctcactaaag

SEQ ID NO: 30418 - DNA, 18 bp, Artificial Sequence
  Synthetic DNA
taatccgacgcaggatag

SEQ ID NO: 30419 - DNA, 18 bp, Artificial Sequence
  Synthetic DNA
taatccgtcacactatcg

SEQ ID NO: 30420 - DNA, 18 bp, Artificial Sequence
  Synthetic DNA
taatctcactctctatag

SEQ ID NO: 30421 - DNA, 18 bp, Artificial Sequence
  Synthetic DNA
taatgcttctcaatatag

SEQ ID NO: 30422 - DNA, 18 bp, Artificial Sequence
  Synthetic DNA
taatgtgattcaccatag

SEQ ID NO: 30423 - DNA, 18 bp, Artificial Sequence
  Synthetic DNA
tacaacgacttactttag

SEQ ID NO: 30424 - DNA, 18 bp, Artificial Sequence
  Synthetic DNA
tacaactacacactatag

SEQ ID NO: 30425 - DNA, 18 bp, Artificial Sequence
  Synthetic DNA
tactacaactcaatttag

SEQ ID NO: 30426 - DNA, 18 bp, Artificial Sequence
  Synthetic DNA
tactacaactcacattag

SEQ ID NO: 30427 - DNA, 18 bp, Artificial Sequence
  Synthetic DNA
tactacgagacactgtag

SEQ ID NO: 30428 - DNA, 18 bp, Artificial Sequence
  Synthetic DNA
tactacgtttcactatcg

SEQ ID NO: 30429 - DNA, 18 bp, Artificial Sequence
  Synthetic DNA
tactaggactaactttag

SEQ ID NO: 30430 - DNA, 18 bp, Artificial Sequence
  Synthetic DNA
tactatgactctctaaag

SEQ ID NO: 30431 - DNA, 18 bp, Artificial Sequence
  Synthetic DNA
tagtacaacacattatag

SEQ ID NO: 30432 - DNA, 18 bp, Artificial Sequence
  Synthetic DNA
tagtacgacacattttag

SEQ ID NO: 30433 - DNA, 18 bp, Artificial Sequence
  Synthetic DNA
tagtacgactctaaatag

SEQ ID NO: 30434 - DNA, 18 bp, Artificial Sequence
  Synthetic DNA
tagtatgactctcaatag

SEQ ID NO: 30435 - DNA, 18 bp, Artificial Sequence
  Synthetic DNA
tataacgaatctctatag

SEQ ID NO: 30436 - DNA, 18 bp, Artificial Sequence
  Synthetic DNA
tataacgacatactatag

SEQ ID NO: 30437 - DNA, 18 bp, Artificial Sequence
  Synthetic DNA
tataacgtctcactctag

SEQ ID NO: 30438 - DNA, 18 bp, Artificial Sequence
  Synthetic DNA
tataactacttactatag

SEQ ID NO: 30439 - DNA, 18 bp, Artificial Sequence
  Synthetic DNA
tatcacgacacactttag

SEQ ID NO: 30440 - DNA, 18 bp, Artificial Sequence
  Synthetic DNA
tatcacgactaactaaag

SEQ ID NO: 30441 - DNA, 18 bp, Artificial Sequence
  Synthetic DNA
tatcacgacttactaaag

SEQ ID NO: 30442 - DNA, 18 bp, Artificial Sequence
  Synthetic DNA
tattaagagtcactaaag

SEQ ID NO: 30443 - DNA, 18 bp, Artificial Sequence
  Synthetic DNA
tattaagtcccactatag

SEQ ID NO: 30444 - DNA, 18 bp, Artificial Sequence
  Synthetic DNA
tattaatactcactatcg

SEQ ID NO: 30445 - DNA, 18 bp, Artificial Sequence
  Synthetic DNA
tattacaattcacgatag

SEQ ID NO: 30446 - DNA, 18 bp, Artificial Sequence
  Synthetic DNA
tattaccactccctaaag

SEQ ID NO: 30447 - DNA, 18 bp, Artificial Sequence
  Synthetic DNA
tattacgaatcactacgg

SEQ ID NO: 30448 - DNA, 18 bp, Artificial Sequence
  Synthetic DNA
tattacgactctcttgag

SEQ ID NO: 30449 - DNA, 18 bp, Artificial Sequence
  Synthetic DNA
tattacgatacactaaag

SEQ ID NO: 30450 - DNA, 18 bp, Artificial Sequence
  Synthetic DNA
tattacgattcaccttag

SEQ ID NO: 30451 - DNA, 18 bp, Artificial Sequence
  Synthetic DNA
tattacgccttattatag

SEQ ID NO: 30452 - DNA, 18 bp, Artificial Sequence
  Synthetic DNA
tattacgtatgactatag

SEQ ID NO: 30453 - DNA, 18 bp, Artificial Sequence
  Synthetic DNA
tattacgtctcacgctag

SEQ ID NO: 30454 - DNA, 18 bp, Artificial Sequence
  Synthetic DNA
tattacgtcttactgtag

SEQ ID NO: 30455 - DNA, 18 bp, Artificial Sequence
  Synthetic DNA
tattactactaactacag

SEQ ID NO: 30456 - DNA, 18 bp, Artificial Sequence
  Synthetic DNA
tattactactcagtatcg

SEQ ID NO: 30457 - DNA, 18 bp, Artificial Sequence
  Synthetic DNA
tattatgactctatatag

SEQ ID NO: 30458 - DNA, 18 bp, Artificial Sequence
  Synthetic DNA
tattatgacttcctatag

SEQ ID NO: 30459 - DNA, 18 bp, Artificial Sequence
  Synthetic DNA
tattatgtcacactatag

SEQ ID NO: 30460 - DNA, 18 bp, Artificial Sequence
  Synthetic DNA
tattgccactcactttag

SEQ ID NO: 30461 - DNA, 18 bp, Artificial Sequence
  Synthetic DNA
tcaaacgtctcattatag

SEQ ID NO: 30462 - DNA, 18 bp, Artificial Sequence
  Synthetic DNA
tcataagacacacaatag

SEQ ID NO: 30463 - DNA, 18 bp, Artificial Sequence
  Synthetic DNA
tcataagaccccctatag

SEQ ID NO: 30464 - DNA, 18 bp, Artificial Sequence
  Synthetic DNA
tcatacgaatcacgaaag

SEQ ID NO: 30465 - DNA, 18 bp, Artificial Sequence
  Synthetic DNA
tcatacgactaacaatcg

SEQ ID NO: 30466 - DNA, 18 bp, Artificial Sequence
  Synthetic DNA
tcatacgtctcacaaaag

SEQ ID NO: 30467 - DNA, 18 bp, Artificial Sequence
  Synthetic DNA
tcatactactcacactag

SEQ ID NO: 30468 - DNA, 18 bp, Artificial Sequence
  Synthetic DNA
tcatacttctcacaatag

SEQ ID NO: 30469 - DNA, 18 bp, Artificial Sequence
  Synthetic DNA
tgaaacgtctcactacag

SEQ ID NO: 30470 - DNA, 18 bp, Artificial Sequence
  Synthetic DNA
tgacacgagtctctatag

SEQ ID NO: 30471 - DNA, 18 bp, Artificial Sequence
  Synthetic DNA
tgataaaacacactatag

SEQ ID NO: 30472 - DNA, 18 bp, Artificial Sequence
  Synthetic DNA
tgataagactcacattag

SEQ ID NO: 30473 - DNA, 18 bp, Artificial Sequence
  Synthetic DNA
tgatgcgactcaatttag

SEQ ID NO: 30474 - DNA, 18 bp, Artificial Sequence
  Synthetic DNA
tgctacgactcacttaag

SEQ ID NO: 30475 - DNA, 18 bp, Artificial Sequence
  Synthetic DNA
tgttacgactcaatatgg

SEQ ID NO: 30476 - DNA, 18 bp, Artificial Sequence
  Synthetic DNA
tgttacgactctctttag

SEQ ID NO: 30477 - DNA, 18 bp, Artificial Sequence
  Synthetic DNA
tgttacgtttcactatag

SEQ ID NO: 30478 - DNA, 18 bp, Artificial Sequence
  Synthetic DNA
ttaaaagactctctatag

SEQ ID NO: 30479 - DNA, 18 bp, Artificial Sequence
  Synthetic DNA
ttaaacgtctcagtatag

SEQ ID NO: 30480 - DNA, 18 bp, Artificial Sequence
  Synthetic DNA
ttaaacgtttcactatag

SEQ ID NO: 30481 - DNA, 18 bp, Artificial Sequence
  Synthetic DNA
ttaaagaactcactatag

SEQ ID NO: 30482 - DNA, 18 bp, Artificial Sequence
  Synthetic DNA
ttacacgacttactaaag

SEQ ID NO: 30483 - DNA, 18 bp, Artificial Sequence
  Synthetic DNA
ttataagacaaactatag

SEQ ID NO: 30484 - DNA, 18 bp, Artificial Sequence
  Synthetic DNA
ttataagacttactatgg

SEQ ID NO: 30485 - DNA, 18 bp, Artificial Sequence
  Synthetic DNA
ttataagactttctatag

SEQ ID NO: 30486 - DNA, 18 bp, Artificial Sequence
  Synthetic DNA
ttatacaacccattatag

SEQ ID NO: 30487 - DNA, 18 bp, Artificial Sequence
  Synthetic DNA
ttatacaactgaccatag

SEQ ID NO: 30488 - DNA, 18 bp, Artificial Sequence
  Synthetic DNA
ttataccactaaatatag

SEQ ID NO: 30489 - DNA, 18 bp, Artificial Sequence
  Synthetic DNA
ttatacgaatcactccag

SEQ ID NO: 30490 - DNA, 18 bp, Artificial Sequence
  Synthetic DNA
ttatacgaatcataatag

SEQ ID NO: 30491 - DNA, 18 bp, Artificial Sequence
  Synthetic DNA
ttatacgaatctttatag

SEQ ID NO: 30492 - DNA, 18 bp, Artificial Sequence
  Synthetic DNA
ttatacgaatttctatag

SEQ ID NO: 30493 - DNA, 18 bp, Artificial Sequence
  Synthetic DNA
ttatacgacacacgttag

SEQ ID NO: 30494 - DNA, 18 bp, Artificial Sequence
  Synthetic DNA
ttatacgactcactcagg

SEQ ID NO: 30495 - DNA, 18 bp, Artificial Sequence
  Synthetic DNA
ttatacgactctaaatag

SEQ ID NO: 30496 - DNA, 18 bp, Artificial Sequence
  Synthetic DNA
ttatacgactctccatgg

SEQ ID NO: 30497 - DNA, 18 bp, Artificial Sequence
  Synthetic DNA
ttatacgacttacaatcg

SEQ ID NO: 30498 - DNA, 18 bp, Artificial Sequence
  Synthetic DNA
ttatacgacttagaatag

SEQ ID NO: 30499 - DNA, 18 bp, Artificial Sequence
  Synthetic DNA
ttatacgcctccctctag

SEQ ID NO: 30500 - DNA, 18 bp, Artificial Sequence
  Synthetic DNA
ttatacgcttcacaatag

SEQ ID NO: 30501 - DNA, 18 bp, Artificial Sequence
  Synthetic DNA
ttatacgtatcaatatag

SEQ ID NO: 30502 - DNA, 18 bp, Artificial Sequence
  Synthetic DNA
ttatacgtgtccctatag

SEQ ID NO: 30503 - DNA, 18 bp, Artificial Sequence
  Synthetic DNA
ttatacttctcacgatag

SEQ ID NO: 30504 - DNA, 18 bp, Artificial Sequence
  Synthetic DNA
ttatagctctcactatag

SEQ ID NO: 30505 - DNA, 18 bp, Artificial Sequence
  Synthetic DNA
ttatatcattcactatag

SEQ ID NO: 30506 - DNA, 18 bp, Artificial Sequence
  Synthetic DNA
ttatatgactaaatatag

SEQ ID NO: 30507 - DNA, 18 bp, Artificial Sequence
  Synthetic DNA
ttatatgactctctatcg

SEQ ID NO: 30508 - DNA, 18 bp, Artificial Sequence
  Synthetic DNA
ttatatgagtcagtatag

SEQ ID NO: 30509 - DNA, 18 bp, Artificial Sequence
  Synthetic DNA
ttatccgagtcactttag

SEQ ID NO: 30510 - DNA, 18 bp, Artificial Sequence
  Synthetic DNA
ttatgcgtctcagtatag

SEQ ID NO: 30511 - DNA, 18 bp, Artificial Sequence
  Synthetic DNA
ttctacaactcagtatag

SEQ ID NO: 30512 - DNA, 18 bp, Artificial Sequence
  Synthetic DNA
ttctacgactcactcaag

SEQ ID NO: 30513 - DNA, 18 bp, Artificial Sequence
  Synthetic DNA
ttctacgactctctttag

SEQ ID NO: 30514 - DNA, 18 bp, Artificial Sequence
  Synthetic DNA
ttctactacacactatag

SEQ ID NO: 30515 - DNA, 18 bp, Artificial Sequence
  Synthetic DNA
ttttaagactgactatag

SEQ ID NO: 30516 - DNA, 18 bp, Artificial Sequence
  Synthetic DNA
ttttacgattcactacag

SEQ ID NO: 30517 - DNA, 18 bp, Artificial Sequence
  Synthetic DNA
ttttacgcatcactatag

SEQ ID NO: 30518 - DNA, 18 bp, Artificial Sequence
  Synthetic DNA
ttttacgtctcactctag

SEQ ID NO: 30519 - DNA, 18 bp, Artificial Sequence
  Synthetic DNA
ttattcatctcactatag

SEQ ID NO: 30520 - DNA, 18 bp, Artificial Sequence
  Synthetic DNA
tttaacgactcacaatag

SEQ ID NO: 30521 - DNA, 18 bp, Artificial Sequence
  Synthetic DNA
aaatacgactcacatttg

SEQ ID NO: 30522 - DNA, 18 bp, Artificial Sequence
  Synthetic DNA
taatacgactcacatctg

SEQ ID NO: 30523 - DNA, 18 bp, Artificial Sequence
  Synthetic DNA
tattacgattcacaattg

SEQ ID NO: 30524 - DNA, 18 bp, Artificial Sequence
  Synthetic DNA
ttataagactcacttttg

SEQ ID NO: 30525 - DNA, 18 bp, Artificial Sequence
  Synthetic DNA
ttattcgactcacattag

SEQ ID NO: 30526 - DNA, 18 bp, Artificial Sequence
  Synthetic DNA
aattacgactcacaattg

SEQ ID NO: 30527 - DNA, 18 bp, Artificial Sequence
  Synthetic DNA
taaagcgactcacaattg

SEQ ID NO: 30528 - DNA, 18 bp, Artificial Sequence
  Synthetic DNA
taatacgaatcaattttg

SEQ ID NO: 30529 - DNA, 18 bp, Artificial Sequence
  Synthetic DNA
taattagattcactttag

SEQ ID NO: 30530 - DNA, 18 bp, Artificial Sequence
  Synthetic DNA
taattcgacttaatttag

SEQ ID NO: 30531 - DNA, 18 bp, Artificial Sequence
  Synthetic DNA
taattttactctctatag

SEQ ID NO: 30532 - DNA, 18 bp, Artificial Sequence
  Synthetic DNA
tattacgaatcaatattg

SEQ ID NO: 30533 - DNA, 18 bp, Artificial Sequence
  Synthetic DNA
tatttcttctcactatag

SEQ ID NO: 30534 - DNA, 18 bp, Artificial Sequence
  Synthetic DNA
ttatactactcactcttg

SEQ ID NO: 30535 - DNA, 18 bp, Artificial Sequence
  Synthetic DNA
aaatacgactcatttaag

SEQ ID NO: 30536 - DNA, 18 bp, Artificial Sequence
  Synthetic DNA
atatacgattctctatag

SEQ ID NO: 30537 - DNA, 18 bp, Artificial Sequence
  Synthetic DNA
taaaacgacacaccaaag

SEQ ID NO: 30538 - DNA, 18 bp, Artificial Sequence
  Synthetic DNA
taaaacgactctttacag

SEQ ID NO: 30539 - DNA, 18 bp, Artificial Sequence
  Synthetic DNA
taataagactctcaaaag

SEQ ID NO: 30540 - DNA, 18 bp, Artificial Sequence
  Synthetic DNA
taatacaactatctaaag

SEQ ID NO: 30541 - DNA, 18 bp, Artificial Sequence
  Synthetic DNA
taatacctctcacaaaag

SEQ ID NO: 30542 - DNA, 18 bp, Artificial Sequence
  Synthetic DNA
taatacgtcaatctatag

SEQ ID NO: 30543 - DNA, 18 bp, Artificial Sequence
  Synthetic DNA
taatacgtcactttatag

SEQ ID NO: 30544 - DNA, 18 bp, Artificial Sequence
  Synthetic DNA
taatacttctctcaatag

SEQ ID NO: 30545 - DNA, 18 bp, Artificial Sequence
  Synthetic DNA
tattacgaaacaatatag

SEQ ID NO: 30546 - DNA, 18 bp, Artificial Sequence
  Synthetic DNA
tattacgactcactgtcc

SEQ ID NO: 30547 - DNA, 18 bp, Artificial Sequence
  Synthetic DNA
tattatgactcacttcag

SEQ ID NO: 30548 - DNA, 18 bp, Artificial Sequence
  Synthetic DNA
ttatacgattccctttag

SEQ ID NO: 30549 - DNA, 18 bp, Artificial Sequence
  Synthetic DNA
ttatacgattctttatag

SEQ ID NO: 30550 - DNA, 18 bp, Artificial Sequence
  Synthetic DNA
ttatatgactcattttag

SEQ ID NO: 30551 - DNA, 18 bp, Artificial Sequence
  Synthetic DNA
tatatcgactctctatag

SEQ ID NO: 30552 - DNA, 18 bp, Artificial Sequence
  Synthetic DNA
aaatacgtctcacaattg

SEQ ID NO: 30553 - DNA, 18 bp, Artificial Sequence
  Synthetic DNA
tatttcgactaacaatag

SEQ ID NO: 30554 - DNA, 18 bp, Artificial Sequence
  Synthetic DNA
aattacgactcacaaaag

SEQ ID NO: 30555 - DNA, 18 bp, Artificial Sequence
  Synthetic DNA
ataaacgtctcactatag

SEQ ID NO: 30556 - DNA, 18 bp, Artificial Sequence
  Synthetic DNA
atatacgacttactttag

SEQ ID NO: 30557 - DNA, 18 bp, Artificial Sequence
  Synthetic DNA
taaaacgtctctctttag

SEQ ID NO: 30558 - DNA, 18 bp, Artificial Sequence
  Synthetic DNA
taatacgtcactatatag

SEQ ID NO: 30559 - DNA, 18 bp, Artificial Sequence
  Synthetic DNA
tataacgtctcacaatag

SEQ ID NO: 30560 - DNA, 18 bp, Artificial Sequence
  Synthetic DNA
ttattcgtctctctatag

SEQ ID NO: 30561 - DNA, 18 bp, Artificial Sequence
  Synthetic DNA
aaatactactcactaatg

SEQ ID NO: 30562 - DNA, 18 bp, Artificial Sequence
  Synthetic DNA
taatacgtctcacaaatg

SEQ ID NO: 30563 - DNA, 18 bp, Artificial Sequence
  Synthetic DNA
taattcaactcacaaaag

SEQ ID NO: 30564 - DNA, 18 bp, Artificial Sequence
  Synthetic DNA
tataaggactcactattg

SEQ ID NO: 30565 - DNA, 18 bp, Artificial Sequence
  Synthetic DNA
ttatactactctctattg

SEQ ID NO: 30566 - DNA, 18 bp, Artificial Sequence
  Synthetic DNA
taatacatcacactttag

SEQ ID NO: 30567 - DNA, 18 bp, Artificial Sequence
  Synthetic DNA
tattacgactctatttag

SEQ ID NO: 30568 - DNA, 18 bp, Artificial Sequence
  Synthetic DNA
ttcaacgactcacaatag

SEQ ID NO: 30569 - DNA, 18 bp, Artificial Sequence
  Synthetic DNA
aaattcgactcattattg

SEQ ID NO: 30570 - DNA, 18 bp, Artificial Sequence
  Synthetic DNA
ccattcgactcactattg

SEQ ID NO: 30571 - DNA, 18 bp, Artificial Sequence
  Synthetic DNA
taatgcgactcgatattg

SEQ ID NO: 30572 - DNA, 18 bp, Artificial Sequence
  Synthetic DNA
taattccactcgcaatag

SEQ ID NO: 30573 - DNA, 18 bp, Artificial Sequence
  Synthetic DNA
taattcgacaagctatag

SEQ ID NO: 30574 - DNA, 18 bp, Artificial Sequence
  Synthetic DNA
taattcgactcaattttg

SEQ ID NO: 30575 - DNA, 18 bp, Artificial Sequence
  Synthetic DNA
taattcgtctcgatatag

SEQ ID NO: 30576 - DNA, 18 bp, Artificial Sequence
  Synthetic DNA
ttattcgactcgctagag

SEQ ID NO: 30577 - DNA, 18 bp, Artificial Sequence
  Synthetic DNA
aaataccacacactattg

SEQ ID NO: 30578 - DNA, 18 bp, Artificial Sequence
  Synthetic DNA
aaattagacttactatag

SEQ ID NO: 30579 - DNA, 18 bp, Artificial Sequence
  Synthetic DNA
aaattcaactcacaatag

SEQ ID NO: 30580 - DNA, 18 bp, Artificial Sequence
  Synthetic DNA
aaattcgagtcaccatag

SEQ ID NO: 30581 - DNA, 18 bp, Artificial Sequence
  Synthetic DNA
aaatttgactcactttag

SEQ ID NO: 30582 - DNA, 18 bp, Artificial Sequence
  Synthetic DNA
aatgacgactcactattg

SEQ ID NO: 30583 - DNA, 18 bp, Artificial Sequence
  Synthetic DNA
aatttcgactgactatag

SEQ ID NO: 30584 - DNA, 18 bp, Artificial Sequence
  Synthetic DNA
caattcgactcattttag

SEQ ID NO: 30585 - DNA, 18 bp, Artificial Sequence
  Synthetic DNA
caattggacacactatag

SEQ ID NO: 30586 - DNA, 18 bp, Artificial Sequence
  Synthetic DNA
ctatacgactcagtattg

SEQ ID NO: 30587 - DNA, 18 bp, Artificial Sequence
  Synthetic DNA
ctattcgactaactatag

SEQ ID NO: 30588 - DNA, 18 bp, Artificial Sequence
  Synthetic DNA
ctctacgactcgctatag

SEQ ID NO: 30589 - DNA, 18 bp, Artificial Sequence
  Synthetic DNA
taaaacagctcactattg

SEQ ID NO: 30590 - DNA, 18 bp, Artificial Sequence
  Synthetic DNA
taaaacgacaaactattg

SEQ ID NO: 30591 - DNA, 18 bp, Artificial Sequence
  Synthetic DNA
taaaacgactcaaaattg

SEQ ID NO: 30592 - DNA, 18 bp, Artificial Sequence
  Synthetic DNA
taaagcgacacactattg

SEQ ID NO: 30593 - DNA, 18 bp, Artificial Sequence
  Synthetic DNA
taaatcgactaactaaag

SEQ ID NO: 30594 - DNA, 18 bp, Artificial Sequence
  Synthetic DNA
taaatcgactcaccttag

SEQ ID NO: 30595 - DNA, 18 bp, Artificial Sequence
  Synthetic DNA
taaatctactcattatag

SEQ ID NO: 30596 - DNA, 18 bp, Artificial Sequence
  Synthetic DNA
taacacgacacaatattg

SEQ ID NO: 30597 - DNA, 18 bp, Artificial Sequence
  Synthetic DNA
taacacgactcaattttg

SEQ ID NO: 30598 - DNA, 18 bp, Artificial Sequence
  Synthetic DNA
taacacgattctctattg

SEQ ID NO: 30599 - DNA, 18 bp, Artificial Sequence
  Synthetic DNA
taacacgcctcattattg

SEQ ID NO: 30600 - DNA, 18 bp, Artificial Sequence
  Synthetic DNA
taactcgacttactttag

SEQ ID NO: 30601 - DNA, 18 bp, Artificial Sequence
  Synthetic DNA
taataacactccctattg

SEQ ID NO: 30602 - DNA, 18 bp, Artificial Sequence
  Synthetic DNA
taataagaattactattg

SEQ ID NO: 30603 - DNA, 18 bp, Artificial Sequence
  Synthetic DNA
taataagactctatattg

SEQ ID NO: 30604 - DNA, 18 bp, Artificial Sequence
  Synthetic DNA
taataagtctcgctaaag

SEQ ID NO: 30605 - DNA, 18 bp, Artificial Sequence
  Synthetic DNA
taataatactaactattg

SEQ ID NO: 30606 - DNA, 18 bp, Artificial Sequence
  Synthetic DNA
taatacaaatcactaatg

SEQ ID NO: 30607 - DNA, 18 bp, Artificial Sequence
  Synthetic DNA
taataccaatctctattg

SEQ ID NO: 30608 - DNA, 18 bp, Artificial Sequence
  Synthetic DNA
taatacgacacaataatg

SEQ ID NO: 30609 - DNA, 18 bp, Artificial Sequence
  Synthetic DNA
taatacgacagacttttg

SEQ ID NO: 30610 - DNA, 18 bp, Artificial Sequence
  Synthetic DNA
taatacgacctgctgtag

SEQ ID NO: 30611 - DNA, 18 bp, Artificial Sequence
  Synthetic DNA
taatacgactaataattg

SEQ ID NO: 30612 - DNA, 18 bp, Artificial Sequence
  Synthetic DNA
taatacgactcatttctg

SEQ ID NO: 30613 - DNA, 18 bp, Artificial Sequence
  Synthetic DNA
taatacgactcgtaaaag

SEQ ID NO: 30614 - DNA, 18 bp, Artificial Sequence
  Synthetic DNA
taatacgactctgcattg

SEQ ID NO: 30615 - DNA, 18 bp, Artificial Sequence
  Synthetic DNA
taatacgactttctagtg

SEQ ID NO: 30616 - DNA, 18 bp, Artificial Sequence
  Synthetic DNA
taatacgactttctcttg

SEQ ID NO: 30617 - DNA, 18 bp, Artificial Sequence
  Synthetic DNA
taatacgagtcataattg

SEQ ID NO: 30618 - DNA, 18 bp, Artificial Sequence
  Synthetic DNA
taatacgattcacgaatg

SEQ ID NO: 30619 - DNA, 18 bp, Artificial Sequence
  Synthetic DNA
taatacgtcacgctgtag

SEQ ID NO: 30620 - DNA, 18 bp, Artificial Sequence
  Synthetic DNA
taatacgtttagctatag

SEQ ID NO: 30621 - DNA, 18 bp, Artificial Sequence
  Synthetic DNA
taatatgactcaccgttg

SEQ ID NO: 30622 - DNA, 18 bp, Artificial Sequence
  Synthetic DNA
taatccaactcacttttg

SEQ ID NO: 30623 - DNA, 18 bp, Artificial Sequence
  Synthetic DNA
taatcccactcacttttg

SEQ ID NO: 30624 - DNA, 18 bp, Artificial Sequence
  Synthetic DNA
taatctgactcacttttg

SEQ ID NO: 30625 - DNA, 18 bp, Artificial Sequence
  Synthetic DNA
taatgcgtctaactattg

SEQ ID NO: 30626 - DNA, 18 bp, Artificial Sequence
  Synthetic DNA
taattaaactctctatag

SEQ ID NO: 30627 - DNA, 18 bp, Artificial Sequence
  Synthetic DNA
taattagattcacaatag

SEQ ID NO: 30628 - DNA, 18 bp, Artificial Sequence
  Synthetic DNA
taattcaactcaccatgg

SEQ ID NO: 30629 - DNA, 18 bp, Artificial Sequence
  Synthetic DNA
taattcaactcataatag

SEQ ID NO: 30630 - DNA, 18 bp, Artificial Sequence
  Synthetic DNA
taattcaagtcactttag

SEQ ID NO: 30631 - DNA, 18 bp, Artificial Sequence
  Synthetic DNA
taattcaatacactatag

SEQ ID NO: 30632 - DNA, 18 bp, Artificial Sequence
  Synthetic DNA
taattcaattcactttag

SEQ ID NO: 30633 - DNA, 18 bp, Artificial Sequence
  Synthetic DNA
taattccaatcagtatag

SEQ ID NO: 30634 - DNA, 18 bp, Artificial Sequence
  Synthetic DNA
taattcgacatactagag

SEQ ID NO: 30635 - DNA, 18 bp, Artificial Sequence
  Synthetic DNA
taattcgacttactaacg

SEQ ID NO: 30636 - DNA, 18 bp, Artificial Sequence
  Synthetic DNA
taattcggctaactttag

SEQ ID NO: 30637 - DNA, 18 bp, Artificial Sequence
  Synthetic DNA
taattcgtctgactatcg

SEQ ID NO: 30638 - DNA, 18 bp, Artificial Sequence
  Synthetic DNA
taattctactcaccttag

SEQ ID NO: 30639 - DNA, 18 bp, Artificial Sequence
  Synthetic DNA
taattggactttctatag

SEQ ID NO: 30640 - DNA, 18 bp, Artificial Sequence
  Synthetic DNA
taattggagtcactttag

SEQ ID NO: 30641 - DNA, 18 bp, Artificial Sequence
  Synthetic DNA
taattggattcactaaag

SEQ ID NO: 30642 - DNA, 18 bp, Artificial Sequence
  Synthetic DNA
taattggtctcacaatag

SEQ ID NO: 30643 - DNA, 18 bp, Artificial Sequence
  Synthetic DNA
taatttgactcaccaaag

SEQ ID NO: 30644 - DNA, 18 bp, Artificial Sequence
  Synthetic DNA
taatttgattcacaatag

SEQ ID NO: 30645 - DNA, 18 bp, Artificial Sequence
  Synthetic DNA
tacaacgactctctattg

SEQ ID NO: 30646 - DNA, 18 bp, Artificial Sequence
  Synthetic DNA
tactaagtctcactattg

SEQ ID NO: 30647 - DNA, 18 bp, Artificial Sequence
  Synthetic DNA
tagaacgactcactaatg

SEQ ID NO: 30648 - DNA, 18 bp, Artificial Sequence
  Synthetic DNA
tagttcgtctcactatgg

SEQ ID NO: 30649 - DNA, 18 bp, Artificial Sequence
  Synthetic DNA
tagtttgactcacaatag

SEQ ID NO: 30650 - DNA, 18 bp, Artificial Sequence
  Synthetic DNA
tataccgactcactattg

SEQ ID NO: 30651 - DNA, 18 bp, Artificial Sequence
  Synthetic DNA
tatatcgactcagtatag

SEQ ID NO: 30652 - DNA, 18 bp, Artificial Sequence
  Synthetic DNA
tattgcgattcactattg

SEQ ID NO: 30653 - DNA, 18 bp, Artificial Sequence
  Synthetic DNA
tatttagactcaatatag

SEQ ID NO: 30654 - DNA, 18 bp, Artificial Sequence
  Synthetic DNA
tatttcgactcaataaag

SEQ ID NO: 30655 - DNA, 18 bp, Artificial Sequence
  Synthetic DNA
tcaaacaactcactattg

SEQ ID NO: 30656 - DNA, 18 bp, Artificial Sequence
  Synthetic DNA
tcatattactcactattg

SEQ ID NO: 30657 - DNA, 18 bp, Artificial Sequence
  Synthetic DNA
tcattcgacacactaaag

SEQ ID NO: 30658 - DNA, 18 bp, Artificial Sequence
  Synthetic DNA
tcattcgtctcactatcg

SEQ ID NO: 30659 - DNA, 18 bp, Artificial Sequence
  Synthetic DNA
tcatttgactcaatatag

SEQ ID NO: 30660 - DNA, 18 bp, Artificial Sequence
  Synthetic DNA
tgatacgtcacactattg

SEQ ID NO: 30661 - DNA, 18 bp, Artificial Sequence
  Synthetic DNA
tgatacgtctcacttttg

SEQ ID NO: 30662 - DNA, 18 bp, Artificial Sequence
  Synthetic DNA
tgattcttctcactatag

SEQ ID NO: 30663 - DNA, 18 bp, Artificial Sequence
  Synthetic DNA
tgtatcgactcactatag

SEQ ID NO: 30664 - DNA, 18 bp, Artificial Sequence
  Synthetic DNA
ttaaacgactagctatag

SEQ ID NO: 30665 - DNA, 18 bp, Artificial Sequence
  Synthetic DNA
ttactcgactcacaatag

SEQ ID NO: 30666 - DNA, 18 bp, Artificial Sequence
  Synthetic DNA
ttagtcgaatcactatag

SEQ ID NO: 30667 - DNA, 18 bp, Artificial Sequence
  Synthetic DNA
ttataagactctctattg

SEQ ID NO: 30668 - DNA, 18 bp, Artificial Sequence
  Synthetic DNA
ttatacgattaactattg

SEQ ID NO: 30669 - DNA, 18 bp, Artificial Sequence
  Synthetic DNA
ttatacgattcacaattg

SEQ ID NO: 30670 - DNA, 18 bp, Artificial Sequence
  Synthetic DNA
ttatactactcgcaatag

SEQ ID NO: 30671 - DNA, 18 bp, Artificial Sequence
  Synthetic DNA
ttattcaactcaatatag

SEQ ID NO: 30672 - DNA, 18 bp, Artificial Sequence
  Synthetic DNA
ttattcgactcattctag

SEQ ID NO: 30673 - DNA, 18 bp, Artificial Sequence
  Synthetic DNA
ttattcgactctctatgg

SEQ ID NO: 30674 - DNA, 18 bp, Artificial Sequence
  Synthetic DNA
ttattcgagtcacaatag

SEQ ID NO: 30675 - DNA, 18 bp, Artificial Sequence
  Synthetic DNA
ttattctactccctatag

SEQ ID NO: 30676 - DNA, 18 bp, Artificial Sequence
  Synthetic DNA
ttctttgactcactatag

SEQ ID NO: 30677 - DNA, 18 bp, Artificial Sequence
  Synthetic DNA
ttgtaccactcactattg

SEQ ID NO: 30678 - DNA, 18 bp, Artificial Sequence
  Synthetic DNA
aaaaacgactaactttag

SEQ ID NO: 30679 - DNA, 18 bp, Artificial Sequence
  Synthetic DNA
aaaaacgactgactttag

SEQ ID NO: 30680 - DNA, 18 bp, Artificial Sequence
  Synthetic DNA
aaatacaactgactaaag

SEQ ID NO: 30681 - DNA, 18 bp, Artificial Sequence
  Synthetic DNA
aaatacatctctctatag

SEQ ID NO: 30682 - DNA, 18 bp, Artificial Sequence
  Synthetic DNA
aaatacgacaaacaatag

SEQ ID NO: 30683 - DNA, 18 bp, Artificial Sequence
  Synthetic DNA
aaatacgacaaactaaag

SEQ ID NO: 30684 - DNA, 18 bp, Artificial Sequence
  Synthetic DNA
aaatacgactcactgacg

SEQ ID NO: 30685 - DNA, 18 bp, Artificial Sequence
  Synthetic DNA
aaatacgactcattttgg

SEQ ID NO: 30686 - DNA, 18 bp, Artificial Sequence
  Synthetic DNA
aaatactactcacttaag

SEQ ID NO: 30687 - DNA, 18 bp, Artificial Sequence
  Synthetic DNA
aaatactactccctttag

SEQ ID NO: 30688 - DNA, 18 bp, Artificial Sequence
  Synthetic DNA
aaatactacttactttag

SEQ ID NO: 30689 - DNA, 18 bp, Artificial Sequence
  Synthetic DNA
aaatatgtctctctatag

SEQ ID NO: 30690 - DNA, 18 bp, Artificial Sequence
  Synthetic DNA
aaatccgactcacaatcg

SEQ ID NO: 30691 - DNA, 18 bp, Artificial Sequence
  Synthetic DNA
aactacgatacactatag

SEQ ID NO: 30692 - DNA, 18 bp, Artificial Sequence
  Synthetic DNA
aattacgactcaccaaag

SEQ ID NO: 30693 - DNA, 18 bp, Artificial Sequence
  Synthetic DNA
aattacgactcactaagg

SEQ ID NO: 30694 - DNA, 18 bp, Artificial Sequence
  Synthetic DNA
aattacgactcattttag

SEQ ID NO: 30695 - DNA, 18 bp, Artificial Sequence
  Synthetic DNA
aattacgtgtcactatag

SEQ ID NO: 30696 - DNA, 18 bp, Artificial Sequence
  Synthetic DNA
aattcccactcactatag

SEQ ID NO: 30697 - DNA, 18 bp, Artificial Sequence
  Synthetic DNA
acttacgagtcactatag

SEQ ID NO: 30698 - DNA, 18 bp, Artificial Sequence
  Synthetic DNA
agatacgtctcactacag

SEQ ID NO: 30699 - DNA, 18 bp, Artificial Sequence
  Synthetic DNA
agtaacgactcactatag

SEQ ID NO: 30700 - DNA, 18 bp, Artificial Sequence
  Synthetic DNA
atatacgagtcacaatag

SEQ ID NO: 30701 - DNA, 18 bp, Artificial Sequence
  Synthetic DNA
atatacgagtcactaaag

SEQ ID NO: 30702 - DNA, 18 bp, Artificial Sequence
  Synthetic DNA
atatactactcactgtag

SEQ ID NO: 30703 - DNA, 18 bp, Artificial Sequence
  Synthetic DNA
atttacaactcactatag

SEQ ID NO: 30704 - DNA, 18 bp, Artificial Sequence
  Synthetic DNA
caatacaactaactaaag

SEQ ID NO: 30705 - DNA, 18 bp, Artificial Sequence
  Synthetic DNA
caatacagcttactatag

SEQ ID NO: 30706 - DNA, 18 bp, Artificial Sequence
  Synthetic DNA
caatacctctcactaaag

SEQ ID NO: 30707 - DNA, 18 bp, Artificial Sequence
  Synthetic DNA
caatacgaataacaatag

SEQ ID NO: 30708 - DNA, 18 bp, Artificial Sequence
  Synthetic DNA
caatacgattcaatacag

SEQ ID NO: 30709 - DNA, 18 bp, Artificial Sequence
  Synthetic DNA
caatacgtctcattttag

SEQ ID NO: 30710 - DNA, 18 bp, Artificial Sequence
  Synthetic DNA
caatactactcactttcg

SEQ ID NO: 30711 - DNA, 18 bp, Artificial Sequence
  Synthetic DNA
caatgcgacccactacag

SEQ ID NO: 30712 - DNA, 18 bp, Artificial Sequence
  Synthetic DNA
cattactactcagtatag

SEQ ID NO: 30713 - DNA, 18 bp, Artificial Sequence
  Synthetic DNA
ctatacgacacactaaag

SEQ ID NO: 30714 - DNA, 18 bp, Artificial Sequence
  Synthetic DNA
ctatgtgactcactatag

SEQ ID NO: 30715 - DNA, 18 bp, Artificial Sequence
  Synthetic DNA
gaaaaagactccctatag

SEQ ID NO: 30716 - DNA, 18 bp, Artificial Sequence
  Synthetic DNA
gattacaactcacaatag

SEQ ID NO: 30717 - DNA, 18 bp, Artificial Sequence
  Synthetic DNA
gtatacgtctcattatag

SEQ ID NO: 30718 - DNA, 18 bp, Artificial Sequence
  Synthetic DNA
taaaaagactcacactag

SEQ ID NO: 30719 - DNA, 18 bp, Artificial Sequence
  Synthetic DNA
taaaaagtctcaccatag

SEQ ID NO: 30720 - DNA, 18 bp, Artificial Sequence
  Synthetic DNA
taaaacaagacactatag

SEQ ID NO: 30721 - DNA, 18 bp, Artificial Sequence
  Synthetic DNA
taaaacaattcactaaag

SEQ ID NO: 30722 - DNA, 18 bp, Artificial Sequence
  Synthetic DNA
taaaacatatcactatag

SEQ ID NO: 30723 - DNA, 18 bp, Artificial Sequence
  Synthetic DNA
taaaacgaatcactttcg

SEQ ID NO: 30724 - DNA, 18 bp, Artificial Sequence
  Synthetic DNA
taaaacgaatcattacag

SEQ ID NO: 30725 - DNA, 18 bp, Artificial Sequence
  Synthetic DNA
taaaacgaatctctatcg

SEQ ID NO: 30726 - DNA, 18 bp, Artificial Sequence
  Synthetic DNA
taaaacgacacacaaaag

SEQ ID NO: 30727 - DNA, 18 bp, Artificial Sequence
  Synthetic DNA
taaaacgacactatatag

SEQ ID NO: 30728 - DNA, 18 bp, Artificial Sequence
  Synthetic DNA
taaaacgactcattcaag

SEQ ID NO: 30729 - DNA, 18 bp, Artificial Sequence
  Synthetic DNA
taaaacgactgactcaag

SEQ ID NO: 30730 - DNA, 18 bp, Artificial Sequence
  Synthetic DNA
taaaacgcctttctatag

SEQ ID NO: 30731 - DNA, 18 bp, Artificial Sequence
  Synthetic DNA
taaaacgtcccactaaag

SEQ ID NO: 30732 - DNA, 18 bp, Artificial Sequence
  Synthetic DNA
taaaacgtctcacaaaag

SEQ ID NO: 30733 - DNA, 18 bp, Artificial Sequence
  Synthetic DNA
taaaacgtctgactaaag

SEQ ID NO: 30734 - DNA, 18 bp, Artificial Sequence
  Synthetic DNA
taaaacgtcttattatag

SEQ ID NO: 30735 - DNA, 18 bp, Artificial Sequence
  Synthetic DNA
taaaactaatcactaaag

SEQ ID NO: 30736 - DNA, 18 bp, Artificial Sequence
  Synthetic DNA
taaaactactcaatgtag

SEQ ID NO: 30737 - DNA, 18 bp, Artificial Sequence
  Synthetic DNA
taaaactactgtctatag

SEQ ID NO: 30738 - DNA, 18 bp, Artificial Sequence
  Synthetic DNA
taaaatgactcacactag

SEQ ID NO: 30739 - DNA, 18 bp, Artificial Sequence
  Synthetic DNA
taaacaaactcactatag

SEQ ID NO: 30740 - DNA, 18 bp, Artificial Sequence
  Synthetic DNA
taaagccactctctatag

SEQ ID NO: 30741 - DNA, 18 bp, Artificial Sequence
  Synthetic DNA
taaagcctctcactatag

SEQ ID NO: 30742 - DNA, 18 bp, Artificial Sequence
  Synthetic DNA
taaagcgactcacttgag

SEQ ID NO: 30743 - DNA, 18 bp, Artificial Sequence
  Synthetic DNA
taaagcgacttactatcg

SEQ ID NO: 30744 - DNA, 18 bp, Artificial Sequence
  Synthetic DNA
taacaagtctcactttag

SEQ ID NO: 30745 - DNA, 18 bp, Artificial Sequence
  Synthetic DNA
taacacgacactctaaag

SEQ ID NO: 30746 - DNA, 18 bp, Artificial Sequence
  Synthetic DNA
taacacgtttcactacag

SEQ ID NO: 30747 - DNA, 18 bp, Artificial Sequence
  Synthetic DNA
taacattactcactttag

SEQ ID NO: 30748 - DNA, 18 bp, Artificial Sequence
  Synthetic DNA
taataaccctcactacag

SEQ ID NO: 30749 - DNA, 18 bp, Artificial Sequence
  Synthetic DNA
taataagacaccctaaag

SEQ ID NO: 30750 - DNA, 18 bp, Artificial Sequence
  Synthetic DNA
taataagacactcaatag

SEQ ID NO: 30751 - DNA, 18 bp, Artificial Sequence
  Synthetic DNA
taataagactacatatag

SEQ ID NO: 30752 - DNA, 18 bp, Artificial Sequence
  Synthetic DNA
taataagactcagttaag

SEQ ID NO: 30753 - DNA, 18 bp, Artificial Sequence
  Synthetic DNA
taataagactctccaaag

SEQ ID NO: 30754 - DNA, 18 bp, Artificial Sequence
  Synthetic DNA
taataagactttctttag

SEQ ID NO: 30755 - DNA, 18 bp, Artificial Sequence
  Synthetic DNA
taatacaactgcctttag

SEQ ID NO: 30756 - DNA, 18 bp, Artificial Sequence
  Synthetic DNA
taataccactgacattag

SEQ ID NO: 30757 - DNA, 18 bp, Artificial Sequence
  Synthetic DNA
taatacgaaatactaaag

SEQ ID NO: 30758 - DNA, 18 bp, Artificial Sequence
  Synthetic DNA
taatacgaataactaagg

SEQ ID NO: 30759 - DNA, 18 bp, Artificial Sequence
  Synthetic DNA
taatacgaataacttaag

SEQ ID NO: 30760 - DNA, 18 bp, Artificial Sequence
  Synthetic DNA
taatacgaatctttttag

SEQ ID NO: 30761 - DNA, 18 bp, Artificial Sequence
  Synthetic DNA
taatacgacactcaagag

SEQ ID NO: 30762 - DNA, 18 bp, Artificial Sequence
  Synthetic DNA
taatacgactaaatttcg

SEQ ID NO: 30763 - DNA, 18 bp, Artificial Sequence
  Synthetic DNA
taatacgactaagtaacg

SEQ ID NO: 30764 - DNA, 18 bp, Artificial Sequence
  Synthetic DNA
taatacgactcaaactgg

SEQ ID NO: 30765 - DNA, 18 bp, Artificial Sequence
  Synthetic DNA
taatacgatactctaaag

SEQ ID NO: 30766 - DNA, 18 bp, Artificial Sequence
  Synthetic DNA
taatacgattcaaaaaag

SEQ ID NO: 30767 - DNA, 18 bp, Artificial Sequence
  Synthetic DNA
taatacgcctctttaaag

SEQ ID NO: 30768 - DNA, 18 bp, Artificial Sequence
  Synthetic DNA
taatacgcctttatatag

SEQ ID NO: 30769 - DNA, 18 bp, Artificial Sequence
  Synthetic DNA
taatacggttcacttcag

SEQ ID NO: 30770 - DNA, 18 bp, Artificial Sequence
  Synthetic DNA
taatacgtatcactctcg

SEQ ID NO: 30771 - DNA, 18 bp, Artificial Sequence
  Synthetic DNA
taatacgtatttctatag

SEQ ID NO: 30772 - DNA, 18 bp, Artificial Sequence
  Synthetic DNA
taatacgtcacagtttag

SEQ ID NO: 30773 - DNA, 18 bp, Artificial Sequence
  Synthetic DNA
taatacgtcacattctag

SEQ ID NO: 30774 - DNA, 18 bp, Artificial Sequence
  Synthetic DNA
taatacgtctaattttag

SEQ ID NO: 30775 - DNA, 18 bp, Artificial Sequence
  Synthetic DNA
taatacgtttctccatag

SEQ ID NO: 30776 - DNA, 18 bp, Artificial Sequence
  Synthetic DNA
taatacgtttgactctag

SEQ ID NO: 30777 - DNA, 18 bp, Artificial Sequence
  Synthetic DNA
taatactaatcacaatgg

SEQ ID NO: 30778 - DNA, 18 bp, Artificial Sequence
  Synthetic DNA
taatactactctcaatcg

SEQ ID NO: 30779 - DNA, 18 bp, Artificial Sequence
  Synthetic DNA
taatacttctcacgttag

SEQ ID NO: 30780 - DNA, 18 bp, Artificial Sequence
  Synthetic DNA
taataggacactctaaag

SEQ ID NO: 30781 - DNA, 18 bp, Artificial Sequence
  Synthetic DNA
taataggacattctatag

SEQ ID NO: 30782 - DNA, 18 bp, Artificial Sequence
  Synthetic DNA
taatataactcaatttag

SEQ ID NO: 30783 - DNA, 18 bp, Artificial Sequence
  Synthetic DNA
taatatgaatcattttag

SEQ ID NO: 30784 - DNA, 18 bp, Artificial Sequence
  Synthetic DNA
taatatgacaaaccatag

SEQ ID NO: 30785 - DNA, 18 bp, Artificial Sequence
  Synthetic DNA
taatatgaccctctttag

SEQ ID NO: 30786 - DNA, 18 bp, Artificial Sequence
  Synthetic DNA
taatatgactcacaaacg

SEQ ID NO: 30787 - DNA, 18 bp, Artificial Sequence
  Synthetic DNA
taatatgactctgtaaag

SEQ ID NO: 30788 - DNA, 18 bp, Artificial Sequence
  Synthetic DNA
taatatgactgacttcag

SEQ ID NO: 30789 - DNA, 18 bp, Artificial Sequence
  Synthetic DNA
taatatgccatactatag

SEQ ID NO: 30790 - DNA, 18 bp, Artificial Sequence
  Synthetic DNA
taatatggcttactttag

SEQ ID NO: 30791 - DNA, 18 bp, Artificial Sequence
  Synthetic DNA
taatatgtccctctatag

SEQ ID NO: 30792 - DNA, 18 bp, Artificial Sequence
  Synthetic DNA
taatatgtctgactttag

SEQ ID NO: 30793 - DNA, 18 bp, Artificial Sequence
  Synthetic DNA
taatccgactcacttagg

SEQ ID NO: 30794 - DNA, 18 bp, Artificial Sequence
  Synthetic DNA
taatccgactctttaaag

SEQ ID NO: 30795 - DNA, 18 bp, Artificial Sequence
  Synthetic DNA
taatgagactttctatag

SEQ ID NO: 30796 - DNA, 18 bp, Artificial Sequence
  Synthetic DNA
taatgcgaatctttatag

SEQ ID NO: 30797 - DNA, 18 bp, Artificial Sequence
  Synthetic DNA
taatgcgacacagtatgg

SEQ ID NO: 30798 - DNA, 18 bp, Artificial Sequence
  Synthetic DNA
taatgcgacttagaatag

SEQ ID NO: 30799 - DNA, 18 bp, Artificial Sequence
  Synthetic DNA
taatgcgtctcaccaaag

SEQ ID NO: 30800 - DNA, 18 bp, Artificial Sequence
  Synthetic DNA
tactacgactctcagtag

SEQ ID NO: 30801 - DNA, 18 bp, Artificial Sequence
  Synthetic DNA
tactgcttctcactatag

SEQ ID NO: 30802 - DNA, 18 bp, Artificial Sequence
  Synthetic DNA
tagaaagactcactaaag

SEQ ID NO: 30803 - DNA, 18 bp, Artificial Sequence
  Synthetic DNA
tagaacgacatactatag

SEQ ID NO: 30804 - DNA, 18 bp, Artificial Sequence
  Synthetic DNA
tagaacgtctcattatag

SEQ ID NO: 30805 - DNA, 18 bp, Artificial Sequence
  Synthetic DNA
tagtacgaatgtctatag

SEQ ID NO: 30806 - DNA, 18 bp, Artificial Sequence
  Synthetic DNA
tagtatgactatctatag

SEQ ID NO: 30807 - DNA, 18 bp, Artificial Sequence
  Synthetic DNA
tataacaactcaatatag

SEQ ID NO: 30808 - DNA, 18 bp, Artificial Sequence
  Synthetic DNA
tataacgattcactagag

SEQ ID NO: 30809 - DNA, 18 bp, Artificial Sequence
  Synthetic DNA
tatagcgattcactatag

SEQ ID NO: 30810 - DNA, 18 bp, Artificial Sequence
  Synthetic DNA
tattaatgctcactatag

SEQ ID NO: 30811 - DNA, 18 bp, Artificial Sequence
  Synthetic DNA
tattacaacttactaaag

SEQ ID NO: 30812 - DNA, 18 bp, Artificial Sequence
  Synthetic DNA
tattacaattcacaatag

SEQ ID NO: 30813 - DNA, 18 bp, Artificial Sequence
  Synthetic DNA
tattaccactcccaatag

SEQ ID NO: 30814 - DNA, 18 bp, Artificial Sequence
  Synthetic DNA
tattacgaaacactttag

SEQ ID NO: 30815 - DNA, 18 bp, Artificial Sequence
  Synthetic DNA
tattacgaaactctatag

SEQ ID NO: 30816 - DNA, 18 bp, Artificial Sequence
  Synthetic DNA
tattacgactaaccttag

SEQ ID NO: 30817 - DNA, 18 bp, Artificial Sequence
  Synthetic DNA
tattacgactcaataacg

SEQ ID NO: 30818 - DNA, 18 bp, Artificial Sequence
  Synthetic DNA
tattacgactcacactcg

SEQ ID NO: 30819 - DNA, 18 bp, Artificial Sequence
  Synthetic DNA
tattacgactctctgtcg

SEQ ID NO: 30820 - DNA, 18 bp, Artificial Sequence
  Synthetic DNA
tattacgattcactttcg

SEQ ID NO: 30821 - DNA, 18 bp, Artificial Sequence
  Synthetic DNA
tattacgattcagtaaag

SEQ ID NO: 30822 - DNA, 18 bp, Artificial Sequence
  Synthetic DNA
tattacgattcagtttag

SEQ ID NO: 30823 - DNA, 18 bp, Artificial Sequence
  Synthetic DNA
tattacgccatactatag

SEQ ID NO: 30824 - DNA, 18 bp, Artificial Sequence
  Synthetic DNA
tattacgcctcacttaag

SEQ ID NO: 30825 - DNA, 18 bp, Artificial Sequence
  Synthetic DNA
tattacgtatcactatcg

SEQ ID NO: 30826 - DNA, 18 bp, Artificial Sequence
  Synthetic DNA
tattacgtctaactacag

SEQ ID NO: 30827 - DNA, 18 bp, Artificial Sequence
  Synthetic DNA
tattactactcactcaag

SEQ ID NO: 30828 - DNA, 18 bp, Artificial Sequence
  Synthetic DNA
tattactattcactgtag

SEQ ID NO: 30829 - DNA, 18 bp, Artificial Sequence
  Synthetic DNA
tattacttctcaccatag

SEQ ID NO: 30830 - DNA, 18 bp, Artificial Sequence
  Synthetic DNA
tattaggacacactttag

SEQ ID NO: 30831 - DNA, 18 bp, Artificial Sequence
  Synthetic DNA
tattaggacatactatag

SEQ ID NO: 30832 - DNA, 18 bp, Artificial Sequence
  Synthetic DNA
tattatgacacaccatag

SEQ ID NO: 30833 - DNA, 18 bp, Artificial Sequence
  Synthetic DNA
tattatgatttactatag

SEQ ID NO: 30834 - DNA, 18 bp, Artificial Sequence
  Synthetic DNA
tcataccactctatatag

SEQ ID NO: 30835 - DNA, 18 bp, Artificial Sequence
  Synthetic DNA
tcatacgtatcactaaag

SEQ ID NO: 30836 - DNA, 18 bp, Artificial Sequence
  Synthetic DNA
tcatacgtctatctatag

SEQ ID NO: 30837 - DNA, 18 bp, Artificial Sequence
  Synthetic DNA
tcatactactttctatag

SEQ ID NO: 30838 - DNA, 18 bp, Artificial Sequence
  Synthetic DNA
tcgtacgactctctttag

SEQ ID NO: 30839 - DNA, 18 bp, Artificial Sequence
  Synthetic DNA
tcttacgattcactatcg

SEQ ID NO: 30840 - DNA, 18 bp, Artificial Sequence
  Synthetic DNA
tgaaacgactcacaacag

SEQ ID NO: 30841 - DNA, 18 bp, Artificial Sequence
  Synthetic DNA
tgacacgactcacttaag

SEQ ID NO: 30842 - DNA, 18 bp, Artificial Sequence
  Synthetic DNA
tgacacgattcaatatag

SEQ ID NO: 30843 - DNA, 18 bp, Artificial Sequence
  Synthetic DNA
tgacactacacactatag

SEQ ID NO: 30844 - DNA, 18 bp, Artificial Sequence
  Synthetic DNA
tgatacaactcaagatag

SEQ ID NO: 30845 - DNA, 18 bp, Artificial Sequence
  Synthetic DNA
tgatacaactctctctag

SEQ ID NO: 30846 - DNA, 18 bp, Artificial Sequence
  Synthetic DNA
tgatacgtctccctatcg

SEQ ID NO: 30847 - DNA, 18 bp, Artificial Sequence
  Synthetic DNA
tgatactacacactttag

SEQ ID NO: 30848 - DNA, 18 bp, Artificial Sequence
  Synthetic DNA
tgatccgtctcattatag

SEQ ID NO: 30849 - DNA, 18 bp, Artificial Sequence
  Synthetic DNA
tgatgcgattcactatgg

SEQ ID NO: 30850 - DNA, 18 bp, Artificial Sequence
  Synthetic DNA
tgttacgagtctctatag

SEQ ID NO: 30851 - DNA, 18 bp, Artificial Sequence
  Synthetic DNA
tgttatgactcacaatag

SEQ ID NO: 30852 - DNA, 18 bp, Artificial Sequence
  Synthetic DNA
ttaaacgacacactaaag

SEQ ID NO: 30853 - DNA, 18 bp, Artificial Sequence
  Synthetic DNA
ttaaacgactaactatgg

SEQ ID NO: 30854 - DNA, 18 bp, Artificial Sequence
  Synthetic DNA
ttaaactactcactacag

SEQ ID NO: 30855 - DNA, 18 bp, Artificial Sequence
  Synthetic DNA
ttaaataactcactatag

SEQ ID NO: 30856 - DNA, 18 bp, Artificial Sequence
  Synthetic DNA
ttaaattactcactatag

SEQ ID NO: 30857 - DNA, 18 bp, Artificial Sequence
  Synthetic DNA
ttacacgactttctatag

SEQ ID NO: 30858 - DNA, 18 bp, Artificial Sequence
  Synthetic DNA
ttataaaactcacgatag

SEQ ID NO: 30859 - DNA, 18 bp, Artificial Sequence
  Synthetic DNA
ttataagacccaccatag

SEQ ID NO: 30860 - DNA, 18 bp, Artificial Sequence
  Synthetic DNA
ttataatactccctatag

SEQ ID NO: 30861 - DNA, 18 bp, Artificial Sequence
  Synthetic DNA
ttatacatctcagtatag

SEQ ID NO: 30862 - DNA, 18 bp, Artificial Sequence
  Synthetic DNA
ttatacgacacaccagag

SEQ ID NO: 30863 - DNA, 18 bp, Artificial Sequence
  Synthetic DNA
ttatacgactaaaaatag

SEQ ID NO: 30864 - DNA, 18 bp, Artificial Sequence
  Synthetic DNA
ttatacgactaaataaag

SEQ ID NO: 30865 - DNA, 18 bp, Artificial Sequence
  Synthetic DNA
ttatacgactgacaaaag

SEQ ID NO: 30866 - DNA, 18 bp, Artificial Sequence
  Synthetic DNA
ttatacgattacctatag

SEQ ID NO: 30867 - DNA, 18 bp, Artificial Sequence
  Synthetic DNA
ttatacgcctcattacag

SEQ ID NO: 30868 - DNA, 18 bp, Artificial Sequence
  Synthetic DNA
ttatacgtcacactagag

SEQ ID NO: 30869 - DNA, 18 bp, Artificial Sequence
  Synthetic DNA
ttatacgtctcaacatag

SEQ ID NO: 30870 - DNA, 18 bp, Artificial Sequence
  Synthetic DNA
ttatactactgaccatag

SEQ ID NO: 30871 - DNA, 18 bp, Artificial Sequence
  Synthetic DNA
ttatactagtaactatag

SEQ ID NO: 30872 - DNA, 18 bp, Artificial Sequence
  Synthetic DNA
ttatatgactcacttcag

SEQ ID NO: 30873 - DNA, 18 bp, Artificial Sequence
  Synthetic DNA
ttatatgattcactaaag

SEQ ID NO: 30874 - DNA, 18 bp, Artificial Sequence
  Synthetic DNA
ttatccgaatcaccatag

SEQ ID NO: 30875 - DNA, 18 bp, Artificial Sequence
  Synthetic DNA
ttatccgacacactaaag

SEQ ID NO: 30876 - DNA, 18 bp, Artificial Sequence
  Synthetic DNA
ttatccgacatactatag

SEQ ID NO: 30877 - DNA, 18 bp, Artificial Sequence
  Synthetic DNA
ttatctgactcactaaag

SEQ ID NO: 30878 - DNA, 18 bp, Artificial Sequence
  Synthetic DNA
ttatgctactcattatag

SEQ ID NO: 30879 - DNA, 18 bp, Artificial Sequence
  Synthetic DNA
ttatgtgactcattatag

SEQ ID NO: 30880 - DNA, 18 bp, Artificial Sequence
  Synthetic DNA
ttctaagactcaccatag

SEQ ID NO: 30881 - DNA, 18 bp, Artificial Sequence
  Synthetic DNA
ttctacgtctcactatgg

SEQ ID NO: 30882 - DNA, 18 bp, Artificial Sequence
  Synthetic DNA
ttgaacgactcattatag

SEQ ID NO: 30883 - DNA, 18 bp, Artificial Sequence
  Synthetic DNA
ttttacgactcaatatcg

SEQ ID NO: 30884 - DNA, 18 bp, Artificial Sequence
  Synthetic DNA
ttttacgatttactatag

SEQ ID NO: 30885 - DNA, 18 bp, Artificial Sequence
  Synthetic DNA
ttattcgactcacaattg

SEQ ID NO: 30886 - DNA, 18 bp, Artificial Sequence
  Synthetic DNA
ttatacgactctcttttg

SEQ ID NO: 30887 - DNA, 18 bp, Artificial Sequence
  Synthetic DNA
taaatcgacacaatatag

SEQ ID NO: 30888 - DNA, 18 bp, Artificial Sequence
  Synthetic DNA
taaatctattcactatag

SEQ ID NO: 30889 - DNA, 18 bp, Artificial Sequence
  Synthetic DNA
taatacgtattactattg

SEQ ID NO: 30890 - DNA, 18 bp, Artificial Sequence
  Synthetic DNA
taatctgaatcactattg

SEQ ID NO: 30891 - DNA, 18 bp, Artificial Sequence
  Synthetic DNA
taattccactcacttcag

SEQ ID NO: 30892 - DNA, 18 bp, Artificial Sequence
  Synthetic DNA
tacatcgtctcactatag

SEQ ID NO: 30893 - DNA, 18 bp, Artificial Sequence
  Synthetic DNA
tactacgactctcaattg

SEQ ID NO: 30894 - DNA, 18 bp, Artificial Sequence
  Synthetic DNA
ttaatcgactctctatag

SEQ ID NO: 30895 - DNA, 18 bp, Artificial Sequence
  Synthetic DNA
ttattctacttactatag

SEQ ID NO: 30896 - DNA, 18 bp, Artificial Sequence
  Synthetic DNA
aattaccactcactaaag

SEQ ID NO: 30897 - DNA, 18 bp, Artificial Sequence
  Synthetic DNA
aattacttctcactatag

SEQ ID NO: 30898 - DNA, 18 bp, Artificial Sequence
  Synthetic DNA
atatacgtttcactatag

SEQ ID NO: 30899 - DNA, 18 bp, Artificial Sequence
  Synthetic DNA
taatacgataaacaatag

SEQ ID NO: 30900 - DNA, 18 bp, Artificial Sequence
  Synthetic DNA
taatacgattcatattag

SEQ ID NO: 30901 - DNA, 18 bp, Artificial Sequence
  Synthetic DNA
taatacgtcacacttcag

SEQ ID NO: 30902 - DNA, 18 bp, Artificial Sequence
  Synthetic DNA
taatactatttacaatag

SEQ ID NO: 30903 - DNA, 18 bp, Artificial Sequence
  Synthetic DNA
taatacttctcacaaaag

SEQ ID NO: 30904 - DNA, 18 bp, Artificial Sequence
  Synthetic DNA
tattacaactcattaaag

SEQ ID NO: 30905 - DNA, 18 bp, Artificial Sequence
  Synthetic DNA
tattacgactttctttag

SEQ ID NO: 30906 - DNA, 18 bp, Artificial Sequence
  Synthetic DNA
ttacacgtctcactgtag

SEQ ID NO: 30907 - DNA, 18 bp, Artificial Sequence
  Synthetic DNA
tatttctactcactattg

SEQ ID NO: 30908 - DNA, 18 bp, Artificial Sequence
  Synthetic DNA
aaattcgactatctatag

SEQ ID NO: 30909 - DNA, 18 bp, Artificial Sequence
  Synthetic DNA
tattacgtcacactattg

SEQ ID NO: 30910 - DNA, 18 bp, Artificial Sequence
  Synthetic DNA
tataacgaatcactttag

SEQ ID NO: 30911 - DNA, 18 bp, Artificial Sequence
  Synthetic DNA
ttatacgtctctctctag

SEQ ID NO: 30912 - DNA, 18 bp, Artificial Sequence
  Synthetic DNA
tatttcgactcacttttg

SEQ ID NO: 30913 - DNA, 18 bp, Artificial Sequence
  Synthetic DNA
taattcgattctcaatag

SEQ ID NO: 30914 - DNA, 18 bp, Artificial Sequence
  Synthetic DNA
tattacgactttctattg

SEQ ID NO: 30915 - DNA, 18 bp, Artificial Sequence
  Synthetic DNA
taaaaagactctctaaag

SEQ ID NO: 30916 - DNA, 18 bp, Artificial Sequence
  Synthetic DNA
taaaacgactttcaatag

SEQ ID NO: 30917 - DNA, 18 bp, Artificial Sequence
  Synthetic DNA
taatacgtcacaatttag

SEQ ID NO: 30918 - DNA, 18 bp, Artificial Sequence
  Synthetic DNA
tattacgactctcaaaag

SEQ ID NO: 30919 - DNA, 18 bp, Artificial Sequence
  Synthetic DNA
cagttcgactcactattg

SEQ ID NO: 30920 - DNA, 18 bp, Artificial Sequence
  Synthetic DNA
taaatcgacttactattg

SEQ ID NO: 30921 - DNA, 18 bp, Artificial Sequence
  Synthetic DNA
taattcaactcgcaatag

SEQ ID NO: 30922 - DNA, 18 bp, Artificial Sequence
  Synthetic DNA
taattccactctctattg

SEQ ID NO: 30923 - DNA, 18 bp, Artificial Sequence
  Synthetic DNA
taattcgaatcactactg

SEQ ID NO: 30924 - DNA, 18 bp, Artificial Sequence
  Synthetic DNA
taattcgacacacaattg

SEQ ID NO: 30925 - DNA, 18 bp, Artificial Sequence
  Synthetic DNA
taattcgactcccttttg

SEQ ID NO: 30926 - DNA, 18 bp, Artificial Sequence
  Synthetic DNA
tatttcgactcattattg

SEQ ID NO: 30927 - DNA, 18 bp, Artificial Sequence
  Synthetic DNA
ttatacgactcgctcttg

SEQ ID NO: 30928 - DNA, 18 bp, Artificial Sequence
  Synthetic DNA
ttattccactcactattg

SEQ ID NO: 30929 - DNA, 18 bp, Artificial Sequence
  Synthetic DNA
aaaaacgactccctattg

SEQ ID NO: 30930 - DNA, 18 bp, Artificial Sequence
  Synthetic DNA
aaataagaatcactattg

SEQ ID NO: 30931 - DNA, 18 bp, Artificial Sequence
  Synthetic DNA
aaatacaagtcactattg

SEQ ID NO: 30932 - DNA, 18 bp, Artificial Sequence
  Synthetic DNA
aaatacgactctctagtg

SEQ ID NO: 30933 - DNA, 18 bp, Artificial Sequence
  Synthetic DNA
aaatacgtcttactattg

SEQ ID NO: 30934 - DNA, 18 bp, Artificial Sequence
  Synthetic DNA
aaatactactctctattg

SEQ ID NO: 30935 - DNA, 18 bp, Artificial Sequence
  Synthetic DNA
aaattcgaatctctatag

SEQ ID NO: 30936 - DNA, 18 bp, Artificial Sequence
  Synthetic DNA
aaattctactcactttag

SEQ ID NO: 30937 - DNA, 18 bp, Artificial Sequence
  Synthetic DNA
aagtacgactgactattg

SEQ ID NO: 30938 - DNA, 18 bp, Artificial Sequence
  Synthetic DNA
aattacgactcaccattg

SEQ ID NO: 30939 - DNA, 18 bp, Artificial Sequence
  Synthetic DNA
aattacgactccctattg

SEQ ID NO: 30940 - DNA, 18 bp, Artificial Sequence
  Synthetic DNA
ataaacgactcgctatag

SEQ ID NO: 30941 - DNA, 18 bp, Artificial Sequence
  Synthetic DNA
atattggactcactatag

SEQ ID NO: 30942 - DNA, 18 bp, Artificial Sequence
  Synthetic DNA
caatacaactcattattg

SEQ ID NO: 30943 - DNA, 18 bp, Artificial Sequence
  Synthetic DNA
caatacgacgcaatattg

SEQ ID NO: 30944 - DNA, 18 bp, Artificial Sequence
  Synthetic DNA
caatttgactcaatatag

SEQ ID NO: 30945 - DNA, 18 bp, Artificial Sequence
  Synthetic DNA
taaaactactcaccattg

SEQ ID NO: 30946 - DNA, 18 bp, Artificial Sequence
  Synthetic DNA
taaaactactcactaatg

SEQ ID NO: 30947 - DNA, 18 bp, Artificial Sequence
  Synthetic DNA
taaatccactctctatag

SEQ ID NO: 30948 - DNA, 18 bp, Artificial Sequence
  Synthetic DNA
taaatcgaatctctatag

SEQ ID NO: 30949 - DNA, 18 bp, Artificial Sequence
  Synthetic DNA
taaatcgtcacactatag

SEQ ID NO: 30950 - DNA, 18 bp, Artificial Sequence
  Synthetic DNA
taacacgactctctactg

SEQ ID NO: 30951 - DNA, 18 bp, Artificial Sequence
  Synthetic DNA
taactcgaatcacaatag

SEQ ID NO: 30952 - DNA, 18 bp, Artificial Sequence
  Synthetic DNA
taagaagattcactattg

SEQ ID NO: 30953 - DNA, 18 bp, Artificial Sequence
  Synthetic DNA
taagacgtctcgctttag

SEQ ID NO: 30954 - DNA, 18 bp, Artificial Sequence
  Synthetic DNA
taataaatctcactattg

SEQ ID NO: 30955 - DNA, 18 bp, Artificial Sequence
  Synthetic DNA
taataagacaccctattg

SEQ ID NO: 30956 - DNA, 18 bp, Artificial Sequence
  Synthetic DNA
taataagactcaataatg

SEQ ID NO: 30957 - DNA, 18 bp, Artificial Sequence
  Synthetic DNA
taatacaacactctattg

SEQ ID NO: 30958 - DNA, 18 bp, Artificial Sequence
  Synthetic DNA
taatacaactcgatttag

SEQ ID NO: 30959 - DNA, 18 bp, Artificial Sequence
  Synthetic DNA
taataccactcaataatg

SEQ ID NO: 30960 - DNA, 18 bp, Artificial Sequence
  Synthetic DNA
taatacgacatacttttg

SEQ ID NO: 30961 - DNA, 18 bp, Artificial Sequence
  Synthetic DNA
taatacgactagctcaag

SEQ ID NO: 30962 - DNA, 18 bp, Artificial Sequence
  Synthetic DNA
taatacgatgcacttttg

SEQ ID NO: 30963 - DNA, 18 bp, Artificial Sequence
  Synthetic DNA
taatacggctcacttctg

SEQ ID NO: 30964 - DNA, 18 bp, Artificial Sequence
  Synthetic DNA
taatacgtctcgcattag

SEQ ID NO: 30965 - DNA, 18 bp, Artificial Sequence
  Synthetic DNA
taatacgtctgagtattg

SEQ ID NO: 30966 - DNA, 18 bp, Artificial Sequence
  Synthetic DNA
taatactacgcattattg

SEQ ID NO: 30967 - DNA, 18 bp, Artificial Sequence
  Synthetic DNA
taatactactcattcttg

SEQ ID NO: 30968 - DNA, 18 bp, Artificial Sequence
  Synthetic DNA
taatactactcccttttg

SEQ ID NO: 30969 - DNA, 18 bp, Artificial Sequence
  Synthetic DNA
taatatgactgtctattg

SEQ ID NO: 30970 - DNA, 18 bp, Artificial Sequence
  Synthetic DNA
taatgcgtctcactactg

SEQ ID NO: 30971 - DNA, 18 bp, Artificial Sequence
  Synthetic DNA
taattatactcacaatag

SEQ ID NO: 30972 - DNA, 18 bp, Artificial Sequence
  Synthetic DNA
taattcaactccccatag

SEQ ID NO: 30973 - DNA, 18 bp, Artificial Sequence
  Synthetic DNA
taattcaacttattatag

SEQ ID NO: 30974 - DNA, 18 bp, Artificial Sequence
  Synthetic DNA
taattcgaccctatatag

SEQ ID NO: 30975 - DNA, 18 bp, Artificial Sequence
  Synthetic DNA
taattcgactatatatag

SEQ ID NO: 30976 - DNA, 18 bp, Artificial Sequence
  Synthetic DNA
taattcgactcaaaaaag

SEQ ID NO: 30977 - DNA, 18 bp, Artificial Sequence
  Synthetic DNA
taattcgacttcctaaag

SEQ ID NO: 30978 - DNA, 18 bp, Artificial Sequence
  Synthetic DNA
taattcgattaattatag

SEQ ID NO: 30979 - DNA, 18 bp, Artificial Sequence
  Synthetic DNA
taatttgactaaccatag

SEQ ID NO: 30980 - DNA, 18 bp, Artificial Sequence
  Synthetic DNA
tactacaagtcactattg

SEQ ID NO: 30981 - DNA, 18 bp, Artificial Sequence
  Synthetic DNA
tactacgactcaattttg

SEQ ID NO: 30982 - DNA, 18 bp, Artificial Sequence
  Synthetic DNA
tacttcgactcaataaag

SEQ ID NO: 30983 - DNA, 18 bp, Artificial Sequence
  Synthetic DNA
tagtacaattcactattg

SEQ ID NO: 30984 - DNA, 18 bp, Artificial Sequence
  Synthetic DNA
tataacgacacactattg

SEQ ID NO: 30985 - DNA, 18 bp, Artificial Sequence
  Synthetic DNA
tattacgaatcactcttg

SEQ ID NO: 30986 - DNA, 18 bp, Artificial Sequence
  Synthetic DNA
tattacgacccgctttag

SEQ ID NO: 30987 - DNA, 18 bp, Artificial Sequence
  Synthetic DNA
tattacgactcactcgtg

SEQ ID NO: 30988 - DNA, 18 bp, Artificial Sequence
  Synthetic DNA
tatttagtctcactatag

SEQ ID NO: 30989 - DNA, 18 bp, Artificial Sequence
  Synthetic DNA
tatttcgactcccaatag

SEQ ID NO: 30990 - DNA, 18 bp, Artificial Sequence
  Synthetic DNA
tcatacaactcgccatag

SEQ ID NO: 30991 - DNA, 18 bp, Artificial Sequence
  Synthetic DNA
tcatacgactcacttctg

SEQ ID NO: 30992 - DNA, 18 bp, Artificial Sequence
  Synthetic DNA
tcatacgactcatttttg

SEQ ID NO: 30993 - DNA, 18 bp, Artificial Sequence
  Synthetic DNA
tcattcgattcaccatag

SEQ ID NO: 30994 - DNA, 18 bp, Artificial Sequence
  Synthetic DNA
tgatacgactaagtattg

SEQ ID NO: 30995 - DNA, 18 bp, Artificial Sequence
  Synthetic DNA
tgattcaactcacaatag

SEQ ID NO: 30996 - DNA, 18 bp, Artificial Sequence
  Synthetic DNA
tgttacgacacactattg

SEQ ID NO: 30997 - DNA, 18 bp, Artificial Sequence
  Synthetic DNA
ttaaactactcactattg

SEQ ID NO: 30998 - DNA, 18 bp, Artificial Sequence
  Synthetic DNA
ttatacgacacgcaatag

SEQ ID NO: 30999 - DNA, 18 bp, Artificial Sequence
  Synthetic DNA
ttatatgattcactattg

SEQ ID NO: 31000 - DNA, 18 bp, Artificial Sequence
  Synthetic DNA
ttatccgaatcactattg

SEQ ID NO: 31001 - DNA, 18 bp, Artificial Sequence
  Synthetic DNA
ttattcgcctctctatag

SEQ ID NO: 31002 - DNA, 18 bp, Artificial Sequence
  Synthetic DNA
tttttagactcactatag

SEQ ID NO: 31003 - DNA, 18 bp, Artificial Sequence
  Synthetic DNA
aaaaaggactcactttag

SEQ ID NO: 31004 - DNA, 18 bp, Artificial Sequence
  Synthetic DNA
aaacacgactcactttcg

SEQ ID NO: 31005 - DNA, 18 bp, Artificial Sequence
  Synthetic DNA
aaataagactcacaaaag

SEQ ID NO: 31006 - DNA, 18 bp, Artificial Sequence
  Synthetic DNA
aaataagactcactttgg

SEQ ID NO: 31007 - DNA, 18 bp, Artificial Sequence
  Synthetic DNA
aaataagactccgtatag

SEQ ID NO: 31008 - DNA, 18 bp, Artificial Sequence
  Synthetic DNA
aaataagacttactttag

SEQ ID NO: 31009 - DNA, 18 bp, Artificial Sequence
  Synthetic DNA
aaatacgacatattatag

SEQ ID NO: 31010 - DNA, 18 bp, Artificial Sequence
  Synthetic DNA
aaatacgcccccctatag

SEQ ID NO: 31011 - DNA, 18 bp, Artificial Sequence
  Synthetic DNA
aaatactactcacaagag

SEQ ID NO: 31012 - DNA, 18 bp, Artificial Sequence
  Synthetic DNA
aaatactactcattaaag

SEQ ID NO: 31013 - DNA, 18 bp, Artificial Sequence
  Synthetic DNA
aactacgactcattatcg

SEQ ID NO: 31014 - DNA, 18 bp, Artificial Sequence
  Synthetic DNA
aagtacaactcactaaag

SEQ ID NO: 31015 - DNA, 18 bp, Artificial Sequence
  Synthetic DNA
aagtacgactttctatag

SEQ ID NO: 31016 - DNA, 18 bp, Artificial Sequence
  Synthetic DNA
aagtacgtctcactttag

SEQ ID NO: 31017 - DNA, 18 bp, Artificial Sequence
  Synthetic DNA
aataacgactcactacag

SEQ ID NO: 31018 - DNA, 18 bp, Artificial Sequence
  Synthetic DNA
aatcacgactgactatag

SEQ ID NO: 31019 - DNA, 18 bp, Artificial Sequence
  Synthetic DNA
aatgacgactcaatatag

SEQ ID NO: 31020 - DNA, 18 bp, Artificial Sequence
  Synthetic DNA
aattaagtctcactatag

SEQ ID NO: 31021 - DNA, 18 bp, Artificial Sequence
  Synthetic DNA
aattacgacccattatag

SEQ ID NO: 31022 - DNA, 18 bp, Artificial Sequence
  Synthetic DNA
aattacgactcaatatcg

SEQ ID NO: 31023 - DNA, 18 bp, Artificial Sequence
  Synthetic DNA
aattacgactcaatttag

SEQ ID NO: 31024 - DNA, 18 bp, Artificial Sequence
  Synthetic DNA
aattacgactcacaacag

SEQ ID NO: 31025 - DNA, 18 bp, Artificial Sequence
  Synthetic DNA
aattatgacccactatag

SEQ ID NO: 31026 - DNA, 18 bp, Artificial Sequence
  Synthetic DNA
acatacgaataactatag

SEQ ID NO: 31027 - DNA, 18 bp, Artificial Sequence
  Synthetic DNA
acatacgtctcactaaag

SEQ ID NO: 31028 - DNA, 18 bp, Artificial Sequence
  Synthetic DNA
agatacgtctcattatag

SEQ ID NO: 31029 - DNA, 18 bp, Artificial Sequence
  Synthetic DNA
atatacgactaaccatag

SEQ ID NO: 31030 - DNA, 18 bp, Artificial Sequence
  Synthetic DNA
atatacgactcacactag

SEQ ID NO: 31031 - DNA, 18 bp, Artificial Sequence
  Synthetic DNA
atatacgactccctaaag

SEQ ID NO: 31032 - DNA, 18 bp, Artificial Sequence
  Synthetic DNA
atatatgactaactatag

SEQ ID NO: 31033 - DNA, 18 bp, Artificial Sequence
  Synthetic DNA
caacacgactaactaaag

SEQ ID NO: 31034 - DNA, 18 bp, Artificial Sequence
  Synthetic DNA
caacactactcattatag

SEQ ID NO: 31035 - DNA, 18 bp, Artificial Sequence
  Synthetic DNA
caatacaaatctctatag

SEQ ID NO: 31036 - DNA, 18 bp, Artificial Sequence
  Synthetic DNA
caatacgattcaccaaag

SEQ ID NO: 31037 - DNA, 18 bp, Artificial Sequence
  Synthetic DNA
cacaaccactcactatag

SEQ ID NO: 31038 - DNA, 18 bp, Artificial Sequence
  Synthetic DNA
cattactactctctatag

SEQ ID NO: 31039 - DNA, 18 bp, Artificial Sequence
  Synthetic DNA
taaaacaacactctatag

SEQ ID NO: 31040 - DNA, 18 bp, Artificial Sequence
  Synthetic DNA
taaaacgaatcattaaag

SEQ ID NO: 31041 - DNA, 18 bp, Artificial Sequence
  Synthetic DNA
taaaacgactctcttcag

SEQ ID NO: 31042 - DNA, 18 bp, Artificial Sequence
  Synthetic DNA
taaaacgcattactatag

SEQ ID NO: 31043 - DNA, 18 bp, Artificial Sequence
  Synthetic DNA
taaaacgtcccactatgg

SEQ ID NO: 31044 - DNA, 18 bp, Artificial Sequence
  Synthetic DNA
taaacctactgactatag

SEQ ID NO: 31045 - DNA, 18 bp, Artificial Sequence
  Synthetic DNA
taaagcgactcacaaaag

SEQ ID NO: 31046 - DNA, 18 bp, Artificial Sequence
  Synthetic DNA
taaagcgtcacactatag

SEQ ID NO: 31047 - DNA, 18 bp, Artificial Sequence
  Synthetic DNA
taaagctactctctatag

SEQ ID NO: 31048 - DNA, 18 bp, Artificial Sequence
  Synthetic DNA
taacacaacaaactatag

SEQ ID NO: 31049 - DNA, 18 bp, Artificial Sequence
  Synthetic DNA
taacacgtctcacaaaag

SEQ ID NO: 31050 - DNA, 18 bp, Artificial Sequence
  Synthetic DNA
taataactctcactctag

SEQ ID NO: 31051 - DNA, 18 bp, Artificial Sequence
  Synthetic DNA
taataagactctcaacag

SEQ ID NO: 31052 - DNA, 18 bp, Artificial Sequence
  Synthetic DNA
taataagacttattctag

SEQ ID NO: 31053 - DNA, 18 bp, Artificial Sequence
  Synthetic DNA
taataaggctcactcgag

SEQ ID NO: 31054 - DNA, 18 bp, Artificial Sequence
  Synthetic DNA
taataatattctctatag

SEQ ID NO: 31055 - DNA, 18 bp, Artificial Sequence
  Synthetic DNA
taatacaactcataaaag

SEQ ID NO: 31056 - DNA, 18 bp, Artificial Sequence
  Synthetic DNA
taatacaactccaaatag

SEQ ID NO: 31057 - DNA, 18 bp, Artificial Sequence
  Synthetic DNA
taatacaacttcctttag

SEQ ID NO: 31058 - DNA, 18 bp, Artificial Sequence
  Synthetic DNA
taatacaattcactaagg

SEQ ID NO: 31059 - DNA, 18 bp, Artificial Sequence
  Synthetic DNA
taatacaattcactgtgg

SEQ ID NO: 31060 - DNA, 18 bp, Artificial Sequence
  Synthetic DNA
taatacatcacactatgg

SEQ ID NO: 31061 - DNA, 18 bp, Artificial Sequence
  Synthetic DNA
taataccactctaaatag

SEQ ID NO: 31062 - DNA, 18 bp, Artificial Sequence
  Synthetic DNA
taatacctgacactatag

SEQ ID NO: 31063 - DNA, 18 bp, Artificial Sequence
  Synthetic DNA
taatacgaatatctttag

SEQ ID NO: 31064 - DNA, 18 bp, Artificial Sequence
  Synthetic DNA
taatacgacactctttcg

SEQ ID NO: 31065 - DNA, 18 bp, Artificial Sequence
  Synthetic DNA
taatacgacattctatcg

SEQ ID NO: 31066 - DNA, 18 bp, Artificial Sequence
  Synthetic DNA
taatacgactaatttaag

SEQ ID NO: 31067 - DNA, 18 bp, Artificial Sequence
  Synthetic DNA
taatacgatacactttcg

SEQ ID NO: 31068 - DNA, 18 bp, Artificial Sequence
  Synthetic DNA
taatacgattcattgaag

SEQ ID NO: 31069 - DNA, 18 bp, Artificial Sequence
  Synthetic DNA
taatacgattctaaatag

SEQ ID NO: 31070 - DNA, 18 bp, Artificial Sequence
  Synthetic DNA
taatacgcaacacaatag

SEQ ID NO: 31071 - DNA, 18 bp, Artificial Sequence
  Synthetic DNA
taatacgtaccattatag

SEQ ID NO: 31072 - DNA, 18 bp, Artificial Sequence
  Synthetic DNA
taatacgtatcagtaaag

SEQ ID NO: 31073 - DNA, 18 bp, Artificial Sequence
  Synthetic DNA
taatacgtatccatatag

SEQ ID NO: 31074 - DNA, 18 bp, Artificial Sequence
  Synthetic DNA
taatacgtcacaaaatag

SEQ ID NO: 31075 - DNA, 18 bp, Artificial Sequence
  Synthetic DNA
taatacgtcataatatag

SEQ ID NO: 31076 - DNA, 18 bp, Artificial Sequence
  Synthetic DNA
taatacgtccaactaaag

SEQ ID NO: 31077 - DNA, 18 bp, Artificial Sequence
  Synthetic DNA
taatacgtctctataaag

SEQ ID NO: 31078 - DNA, 18 bp, Artificial Sequence
  Synthetic DNA
taatacgtctctatatgg

SEQ ID NO: 31079 - DNA, 18 bp, Artificial Sequence
  Synthetic DNA
taatacgtcttattacag

SEQ ID NO: 31080 - DNA, 18 bp, Artificial Sequence
  Synthetic DNA
taatacgtcttcctatcg

SEQ ID NO: 31081 - DNA, 18 bp, Artificial Sequence
  Synthetic DNA
taatacgttttactttag

SEQ ID NO: 31082 - DNA, 18 bp, Artificial Sequence
  Synthetic DNA
taatactaaactctatag

SEQ ID NO: 31083 - DNA, 18 bp, Artificial Sequence
  Synthetic DNA
taatactactttctctag

SEQ ID NO: 31084 - DNA, 18 bp, Artificial Sequence
  Synthetic DNA
taatactattcaatttag

SEQ ID NO: 31085 - DNA, 18 bp, Artificial Sequence
  Synthetic DNA
taatactattctctatcg

SEQ ID NO: 31086 - DNA, 18 bp, Artificial Sequence
  Synthetic DNA
taatactttacactatag

SEQ ID NO: 31087 - DNA, 18 bp, Artificial Sequence
  Synthetic DNA
taatataaatcactttag

SEQ ID NO: 31088 - DNA, 18 bp, Artificial Sequence
  Synthetic DNA
taatataactcaataaag

SEQ ID NO: 31089 - DNA, 18 bp, Artificial Sequence
  Synthetic DNA
taatatgaaacacaatag

SEQ ID NO: 31090 - DNA, 18 bp, Artificial Sequence
  Synthetic DNA
taatatgagtcattttag

SEQ ID NO: 31091 - DNA, 18 bp, Artificial Sequence
  Synthetic DNA
taatattactaactaaag

SEQ ID NO: 31092 - DNA, 18 bp, Artificial Sequence
  Synthetic DNA
taatattcttcactatag

SEQ ID NO: 31093 - DNA, 18 bp, Artificial Sequence
  Synthetic DNA
taatccaactctctatgg

SEQ ID NO: 31094 - DNA, 18 bp, Artificial Sequence
  Synthetic DNA
taatccgacactcaatag

SEQ ID NO: 31095 - DNA, 18 bp, Artificial Sequence
  Synthetic DNA
taatgacacttactatag

SEQ ID NO: 31096 - DNA, 18 bp, Artificial Sequence
  Synthetic DNA
taatgcgattcattatcg

SEQ ID NO: 31097 - DNA, 18 bp, Artificial Sequence
  Synthetic DNA
taatgcttcacactatag

SEQ ID NO: 31098 - DNA, 18 bp, Artificial Sequence
  Synthetic DNA
tacaacgactctttatag

SEQ ID NO: 31099 - DNA, 18 bp, Artificial Sequence
  Synthetic DNA
tactaagactcacattag

SEQ ID NO: 31100 - DNA, 18 bp, Artificial Sequence
  Synthetic DNA
tactacgattctcaatag

SEQ ID NO: 31101 - DNA, 18 bp, Artificial Sequence
  Synthetic DNA
tagaaggactcactaaag

SEQ ID NO: 31102 - DNA, 18 bp, Artificial Sequence
  Synthetic DNA
tagaatgactcactttag

SEQ ID NO: 31103 - DNA, 18 bp, Artificial Sequence
  Synthetic DNA
tagtacgacttacttaag

SEQ ID NO: 31104 - DNA, 18 bp, Artificial Sequence
  Synthetic DNA
tagtacgtctaactttag

SEQ ID NO: 31105 - DNA, 18 bp, Artificial Sequence
  Synthetic DNA
tagtacgtcttacaatag

SEQ ID NO: 31106 - DNA, 18 bp, Artificial Sequence
  Synthetic DNA
tagtatgactcactctgg

SEQ ID NO: 31107 - DNA, 18 bp, Artificial Sequence
  Synthetic DNA
tataacgactctctctag

SEQ ID NO: 31108 - DNA, 18 bp, Artificial Sequence
  Synthetic DNA
tataacgacttactttag

SEQ ID NO: 31109 - DNA, 18 bp, Artificial Sequence
  Synthetic DNA
tatagcgactcaccatag

SEQ ID NO: 31110 - DNA, 18 bp, Artificial Sequence
  Synthetic DNA
tatcactactcactaaag

SEQ ID NO: 31111 - DNA, 18 bp, Artificial Sequence
  Synthetic DNA
tattaaaactccctatag

SEQ ID NO: 31112 - DNA, 18 bp, Artificial Sequence
  Synthetic DNA
tattaagactcactttgg

SEQ ID NO: 31113 - DNA, 18 bp, Artificial Sequence
  Synthetic DNA
tattaaggctgactatag

SEQ ID NO: 31114 - DNA, 18 bp, Artificial Sequence
  Synthetic DNA
tattaagtcttactatag

SEQ ID NO: 31115 - DNA, 18 bp, Artificial Sequence
  Synthetic DNA
tattacaacacactgtag

SEQ ID NO: 31116 - DNA, 18 bp, Artificial Sequence
  Synthetic DNA
tattacatctaactatag

SEQ ID NO: 31117 - DNA, 18 bp, Artificial Sequence
  Synthetic DNA
tattacgaataaatatag

SEQ ID NO: 31118 - DNA, 18 bp, Artificial Sequence
  Synthetic DNA
tattacgaatctttatag

SEQ ID NO: 31119 - DNA, 18 bp, Artificial Sequence
  Synthetic DNA
tattacgacacactaacg

SEQ ID NO: 31120 - DNA, 18 bp, Artificial Sequence
  Synthetic DNA
tattacgacaccctaaag

SEQ ID NO: 31121 - DNA, 18 bp, Artificial Sequence
  Synthetic DNA
tattacgacactctatgg

SEQ ID NO: 31122 - DNA, 18 bp, Artificial Sequence
  Synthetic DNA
tattacgaccgtctatag

SEQ ID NO: 31123 - DNA, 18 bp, Artificial Sequence
  Synthetic DNA
tattacgactcaacttag

SEQ ID NO: 31124 - DNA, 18 bp, Artificial Sequence
  Synthetic DNA
tattacgacttacttaag

SEQ ID NO: 31125 - DNA, 18 bp, Artificial Sequence
  Synthetic DNA
tattacgtctcattaaag

SEQ ID NO: 31126 - DNA, 18 bp, Artificial Sequence
  Synthetic DNA
tattacgtctcccaatag

SEQ ID NO: 31127 - DNA, 18 bp, Artificial Sequence
  Synthetic DNA
tattacgtctcccgatag

SEQ ID NO: 31128 - DNA, 18 bp, Artificial Sequence
  Synthetic DNA
tattaggactcacttaag

SEQ ID NO: 31129 - DNA, 18 bp, Artificial Sequence
  Synthetic DNA
tattagtattcactatag

SEQ ID NO: 31130 - DNA, 18 bp, Artificial Sequence
  Synthetic DNA
tattatgacacactatcg

SEQ ID NO: 31131 - DNA, 18 bp, Artificial Sequence
  Synthetic DNA
tattatgacttacaatag

SEQ ID NO: 31132 - DNA, 18 bp, Artificial Sequence
  Synthetic DNA
tattatgacttattatag

SEQ ID NO: 31133 - DNA, 18 bp, Artificial Sequence
  Synthetic DNA
tattatgattcactatcg

SEQ ID NO: 31134 - DNA, 18 bp, Artificial Sequence
  Synthetic DNA
tattatgcctcacaatag

SEQ ID NO: 31135 - DNA, 18 bp, Artificial Sequence
  Synthetic DNA
tattgcgtctcacaatag

SEQ ID NO: 31136 - DNA, 18 bp, Artificial Sequence
  Synthetic DNA
tcatacaactcacaaaag

SEQ ID NO: 31137 - DNA, 18 bp, Artificial Sequence
  Synthetic DNA
tcatacaacttacaatag

SEQ ID NO: 31138 - DNA, 18 bp, Artificial Sequence
  Synthetic DNA
tcatacctgtcactatag

SEQ ID NO: 31139 - DNA, 18 bp, Artificial Sequence
  Synthetic DNA
tcatacgacacactgaag

SEQ ID NO: 31140 - DNA, 18 bp, Artificial Sequence
  Synthetic DNA
tcatacgacatactacag

SEQ ID NO: 31141 - DNA, 18 bp, Artificial Sequence
  Synthetic DNA
tcatacgactcaaattag

SEQ ID NO: 31142 - DNA, 18 bp, Artificial Sequence
  Synthetic DNA
tcatacgtcacactaaag

SEQ ID NO: 31143 - DNA, 18 bp, Artificial Sequence
  Synthetic DNA
tcatacgtctctttatag

SEQ ID NO: 31144 - DNA, 18 bp, Artificial Sequence
  Synthetic DNA
tcatccgactaactttag

SEQ ID NO: 31145 - DNA, 18 bp, Artificial Sequence
  Synthetic DNA
tcgtacgacacaatatag

SEQ ID NO: 31146 - DNA, 18 bp, Artificial Sequence
  Synthetic DNA
tctaaccactcactatag

SEQ ID NO: 31147 - DNA, 18 bp, Artificial Sequence
  Synthetic DNA
tctcacgactctctatag

SEQ ID NO: 31148 - DNA, 18 bp, Artificial Sequence
  Synthetic DNA
tcttacgactcaaaatag

SEQ ID NO: 31149 - DNA, 18 bp, Artificial Sequence
  Synthetic DNA
tcttacgtctcactgtag

SEQ ID NO: 31150 - DNA, 18 bp, Artificial Sequence
  Synthetic DNA
tgaaaagacacactatag

SEQ ID NO: 31151 - DNA, 18 bp, Artificial Sequence
  Synthetic DNA
tgaaactacacactatag

SEQ ID NO: 31152 - DNA, 18 bp, Artificial Sequence
  Synthetic DNA
tgatacaacactctatag

SEQ ID NO: 31153 - DNA, 18 bp, Artificial Sequence
  Synthetic DNA
tgatacgattctttatag

SEQ ID NO: 31154 - DNA, 18 bp, Artificial Sequence
  Synthetic DNA
tgatacgtctcattttag

SEQ ID NO: 31155 - DNA, 18 bp, Artificial Sequence
  Synthetic DNA
tgatactattcactttag

SEQ ID NO: 31156 - DNA, 18 bp, Artificial Sequence
  Synthetic DNA
tgctacgacttattatag

SEQ ID NO: 31157 - DNA, 18 bp, Artificial Sequence
  Synthetic DNA
tgtaacgactcactaaag

SEQ ID NO: 31158 - DNA, 18 bp, Artificial Sequence
  Synthetic DNA
tgttatgactcactttag

SEQ ID NO: 31159 - DNA, 18 bp, Artificial Sequence
  Synthetic DNA
tgttatgactcattatag

SEQ ID NO: 31160 - DNA, 18 bp, Artificial Sequence
  Synthetic DNA
ttaaaagactaactatag

SEQ ID NO: 31161 - DNA, 18 bp, Artificial Sequence
  Synthetic DNA
ttacacgaatcactaaag

SEQ ID NO: 31162 - DNA, 18 bp, Artificial Sequence
  Synthetic DNA
ttacacgattcactaaag

SEQ ID NO: 31163 - DNA, 18 bp, Artificial Sequence
  Synthetic DNA
ttataagacacacaatag

SEQ ID NO: 31164 - DNA, 18 bp, Artificial Sequence
  Synthetic DNA
ttataagactaactttag

SEQ ID NO: 31165 - DNA, 18 bp, Artificial Sequence
  Synthetic DNA
ttataagactgacaatag

SEQ ID NO: 31166 - DNA, 18 bp, Artificial Sequence
  Synthetic DNA
ttataagtctcactgtag

SEQ ID NO: 31167 - DNA, 18 bp, Artificial Sequence
  Synthetic DNA
ttatacacatcactatag

SEQ ID NO: 31168 - DNA, 18 bp, Artificial Sequence
  Synthetic DNA
ttataccactccatatag

SEQ ID NO: 31169 - DNA, 18 bp, Artificial Sequence
  Synthetic DNA
ttataccactctctacag

SEQ ID NO: 31170 - DNA, 18 bp, Artificial Sequence
  Synthetic DNA
ttatacgaataactctag

SEQ ID NO: 31171 - DNA, 18 bp, Artificial Sequence
  Synthetic DNA
ttatacgaccaacaatag

SEQ ID NO: 31172 - DNA, 18 bp, Artificial Sequence
  Synthetic DNA
ttatacgactttctacag

SEQ ID NO: 31173 - DNA, 18 bp, Artificial Sequence
  Synthetic DNA
ttatacgagtctatatag

SEQ ID NO: 31174 - DNA, 18 bp, Artificial Sequence
  Synthetic DNA
ttatactacacaccatag

SEQ ID NO: 31175 - DNA, 18 bp, Artificial Sequence
  Synthetic DNA
ttatactactaactatgg

SEQ ID NO: 31176 - DNA, 18 bp, Artificial Sequence
  Synthetic DNA
ttatactactcagaatag

SEQ ID NO: 31177 - DNA, 18 bp, Artificial Sequence
  Synthetic DNA
ttatacttctcactagag

SEQ ID NO: 31178 - DNA, 18 bp, Artificial Sequence
  Synthetic DNA
ttatacttctccctatag

SEQ ID NO: 31179 - DNA, 18 bp, Artificial Sequence
  Synthetic DNA
ttataggactcaatttag

SEQ ID NO: 31180 - DNA, 18 bp, Artificial Sequence
  Synthetic DNA
ttataggactcacaatcg

SEQ ID NO: 31181 - DNA, 18 bp, Artificial Sequence
  Synthetic DNA
ttataggtttcactatag

SEQ ID NO: 31182 - DNA, 18 bp, Artificial Sequence
  Synthetic DNA
ttatagtactctctatag

SEQ ID NO: 31183 - DNA, 18 bp, Artificial Sequence
  Synthetic DNA
ttatatgactcaatttag

SEQ ID NO: 31184 - DNA, 18 bp, Artificial Sequence
  Synthetic DNA
ttatgcgactcccaatag

SEQ ID NO: 31185 - DNA, 18 bp, Artificial Sequence
  Synthetic DNA
ttatgcgattcactatcg

SEQ ID NO: 31186 - DNA, 18 bp, Artificial Sequence
  Synthetic DNA
ttatgctactcactatcg

SEQ ID NO: 31187 - DNA, 18 bp, Artificial Sequence
  Synthetic DNA
ttctacgactctctaaag

SEQ ID NO: 31188 - DNA, 18 bp, Artificial Sequence
  Synthetic DNA
ttttacgactaacaatag

SEQ ID NO: 31189 - DNA, 18 bp, Artificial Sequence
  Synthetic DNA
ttttactactccctatag

SEQ ID NO: 31190 - DNA, 18 bp, Artificial Sequence
  Synthetic DNA
ttataagactcacaattg

SEQ ID NO: 31191 - DNA, 18 bp, Artificial Sequence
  Synthetic DNA
taatttgtctcactattg

SEQ ID NO: 31192 - DNA, 18 bp, Artificial Sequence
  Synthetic DNA
acattcgactcactaaag

SEQ ID NO: 31193 - DNA, 18 bp, Artificial Sequence
  Synthetic DNA
taatacgtctaaatattg

SEQ ID NO: 31194 - DNA, 18 bp, Artificial Sequence
  Synthetic DNA
taattcgaccctctaaag

SEQ ID NO: 31195 - DNA, 18 bp, Artificial Sequence
  Synthetic DNA
taatttgactcacaaaag

SEQ ID NO: 31196 - DNA, 18 bp, Artificial Sequence
  Synthetic DNA
tattacgattcacttttg

SEQ ID NO: 31197 - DNA, 18 bp, Artificial Sequence
  Synthetic DNA
ttattcgactctatatag

SEQ ID NO: 31198 - DNA, 18 bp, Artificial Sequence
  Synthetic DNA
aaatacgactctttaaag

SEQ ID NO: 31199 - DNA, 18 bp, Artificial Sequence
  Synthetic DNA
aaatcctactcacaatag

SEQ ID NO: 31200 - DNA, 18 bp, Artificial Sequence
  Synthetic DNA
atatacgactacctatag

SEQ ID NO: 31201 - DNA, 18 bp, Artificial Sequence
  Synthetic DNA
atatccgtctcactatag

SEQ ID NO: 31202 - DNA, 18 bp, Artificial Sequence
  Synthetic DNA
taaaacgaatctcaatag

SEQ ID NO: 31203 - DNA, 18 bp, Artificial Sequence
  Synthetic DNA
taatacgattcatttaag

SEQ ID NO: 31204 - DNA, 18 bp, Artificial Sequence
  Synthetic DNA
taatacttctctttatag

SEQ ID NO: 31205 - DNA, 18 bp, Artificial Sequence
  Synthetic DNA
tataaagactcacaatag

SEQ ID NO: 31206 - DNA, 18 bp, Artificial Sequence
  Synthetic DNA
tattaccattcactaaag

SEQ ID NO: 31207 - DNA, 18 bp, Artificial Sequence
  Synthetic DNA
tattacgtctccctttag

SEQ ID NO: 31208 - DNA, 18 bp, Artificial Sequence
  Synthetic DNA
ttatacgacactatatag

SEQ ID NO: 31209 - DNA, 18 bp, Artificial Sequence
  Synthetic DNA
taaaacgtctctctaaag

SEQ ID NO: 31210 - DNA, 18 bp, Artificial Sequence
  Synthetic DNA
atataagactcactattg

SEQ ID NO: 31211 - DNA, 18 bp, Artificial Sequence
  Synthetic DNA
ttatacatctcactttag

SEQ ID NO: 31212 - DNA, 18 bp, Artificial Sequence
  Synthetic DNA
ttttacgtctcactttag

SEQ ID NO: 31213 - DNA, 18 bp, Artificial Sequence
  Synthetic DNA
ttaaacgactctctattg

SEQ ID NO: 31214 - DNA, 18 bp, Artificial Sequence
  Synthetic DNA
tattacgtttcactattg

SEQ ID NO: 31215 - DNA, 18 bp, Artificial Sequence
  Synthetic DNA
taatacatttctctatag

SEQ ID NO: 31216 - DNA, 18 bp, Artificial Sequence
  Synthetic DNA
taactcgattcactattg

SEQ ID NO: 31217 - DNA, 18 bp, Artificial Sequence
  Synthetic DNA
taatacaacttgctattg

SEQ ID NO: 31218 - DNA, 18 bp, Artificial Sequence
  Synthetic DNA
taatacgactcgcgatta

SEQ ID NO: 31219 - DNA, 18 bp, Artificial Sequence
  Synthetic DNA
taattcgacactctattg

SEQ ID NO: 31220 - DNA, 18 bp, Artificial Sequence
  Synthetic DNA
taattctactcactactg

SEQ ID NO: 31221 - DNA, 18 bp, Artificial Sequence
  Synthetic DNA
taattttactcactattg

SEQ ID NO: 31222 - DNA, 18 bp, Artificial Sequence
  Synthetic DNA
tagatcgactcactattg

SEQ ID NO: 31223 - DNA, 18 bp, Artificial Sequence
  Synthetic DNA
tatttccactcactattg

SEQ ID NO: 31224 - DNA, 18 bp, Artificial Sequence
  Synthetic DNA
aaaatcgactcactatcg

SEQ ID NO: 31225 - DNA, 18 bp, Artificial Sequence
  Synthetic DNA
aaactcgattcactatag

SEQ ID NO: 31226 - DNA, 18 bp, Artificial Sequence
  Synthetic DNA
aaatacgacttacttttg

SEQ ID NO: 31227 - DNA, 18 bp, Artificial Sequence
  Synthetic DNA
aaatacggctcacttttg

SEQ ID NO: 31228 - DNA, 18 bp, Artificial Sequence
  Synthetic DNA
aaattcgacacactacag

SEQ ID NO: 31229 - DNA, 18 bp, Artificial Sequence
  Synthetic DNA
aaattcgactcaataaag

SEQ ID NO: 31230 - DNA, 18 bp, Artificial Sequence
  Synthetic DNA
aaattcgactcccaatag

SEQ ID NO: 31231 - DNA, 18 bp, Artificial Sequence
  Synthetic DNA
aaccacgactcactattg

SEQ ID NO: 31232 - DNA, 18 bp, Artificial Sequence
  Synthetic DNA
caatacaactcactaatg

SEQ ID NO: 31233 - DNA, 18 bp, Artificial Sequence
  Synthetic DNA
caatacgactcactcatg

SEQ ID NO: 31234 - DNA, 18 bp, Artificial Sequence
  Synthetic DNA
caatacgactgtctattg

SEQ ID NO: 31235 - DNA, 18 bp, Artificial Sequence
  Synthetic DNA
caatacgcctaactattg

SEQ ID NO: 31236 - DNA, 18 bp, Artificial Sequence
  Synthetic DNA
caattcgacttactctag

SEQ ID NO: 31237 - DNA, 18 bp, Artificial Sequence
  Synthetic DNA
gattacgtctcactattg

SEQ ID NO: 31238 - DNA, 18 bp, Artificial Sequence
  Synthetic DNA
gtatacgactctctattg

SEQ ID NO: 31239 - DNA, 18 bp, Artificial Sequence
  Synthetic DNA
taaaactacacgctatag

SEQ ID NO: 31240 - DNA, 18 bp, Artificial Sequence
  Synthetic DNA
taaaactacttactattg

SEQ ID NO: 31241 - DNA, 18 bp, Artificial Sequence
  Synthetic DNA
taaatcaactcattatag

SEQ ID NO: 31242 - DNA, 18 bp, Artificial Sequence
  Synthetic DNA
taaatcgacatactatag

SEQ ID NO: 31243 - DNA, 18 bp, Artificial Sequence
  Synthetic DNA
taaatcgactcactaagg

SEQ ID NO: 31244 - DNA, 18 bp, Artificial Sequence
  Synthetic DNA
taaattgattcactatag

SEQ ID NO: 31245 - DNA, 18 bp, Artificial Sequence
  Synthetic DNA
taacaagactctctattg

SEQ ID NO: 31246 - DNA, 18 bp, Artificial Sequence
  Synthetic DNA
taataagtctctctattg

SEQ ID NO: 31247 - DNA, 18 bp, Artificial Sequence
  Synthetic DNA
taatacaactttctattg

SEQ ID NO: 31248 - DNA, 18 bp, Artificial Sequence
  Synthetic DNA
taatacgaatctctcttg

SEQ ID NO: 31249 - DNA, 18 bp, Artificial Sequence
  Synthetic DNA
taatacgaccctcaattg

SEQ ID NO: 31250 - DNA, 18 bp, Artificial Sequence
  Synthetic DNA
taatacgtctcattactg

SEQ ID NO: 31251 - DNA, 18 bp, Artificial Sequence
  Synthetic DNA
taatactactaactaatg

SEQ ID NO: 31252 - DNA, 18 bp, Artificial Sequence
  Synthetic DNA
taatactactcacagttg

SEQ ID NO: 31253 - DNA, 18 bp, Artificial Sequence
  Synthetic DNA
taatactacttactactg

SEQ ID NO: 31254 - DNA, 18 bp, Artificial Sequence
  Synthetic DNA
taatacttctcactactg

SEQ ID NO: 31255 - DNA, 18 bp, Artificial Sequence
  Synthetic DNA
taatccgactcaaaattg

SEQ ID NO: 31256 - DNA, 18 bp, Artificial Sequence
  Synthetic DNA
taatctgactcactaatg

SEQ ID NO: 31257 - DNA, 18 bp, Artificial Sequence
  Synthetic DNA
taatggaactcactattg

SEQ ID NO: 31258 - DNA, 18 bp, Artificial Sequence
  Synthetic DNA
taattagactctctatcg

SEQ ID NO: 31259 - DNA, 18 bp, Artificial Sequence
  Synthetic DNA
taattcacctcactttag

SEQ ID NO: 31260 - DNA, 18 bp, Artificial Sequence
  Synthetic DNA
taattcgacacaatctag

SEQ ID NO: 31261 - DNA, 18 bp, Artificial Sequence
  Synthetic DNA
taattcgacacacagtag

SEQ ID NO: 31262 - DNA, 18 bp, Artificial Sequence
  Synthetic DNA
taattcgacactcgatag

SEQ ID NO: 31263 - DNA, 18 bp, Artificial Sequence
  Synthetic DNA
taattcgactgtcaatag

SEQ ID NO: 31264 - DNA, 18 bp, Artificial Sequence
  Synthetic DNA
taattcgtcttactacag

SEQ ID NO: 31265 - DNA, 18 bp, Artificial Sequence
  Synthetic DNA
taatttcactctctatag

SEQ ID NO: 31266 - DNA, 18 bp, Artificial Sequence
  Synthetic DNA
taatttgacacactgtag

SEQ ID NO: 31267 - DNA, 18 bp, Artificial Sequence
  Synthetic DNA
taatttgactcaacatag

SEQ ID NO: 31268 - DNA, 18 bp, Artificial Sequence
  Synthetic DNA
tacttcaactcacaatag

SEQ ID NO: 31269 - DNA, 18 bp, Artificial Sequence
  Synthetic DNA
tacttcgactcattttag

SEQ ID NO: 31270 - DNA, 18 bp, Artificial Sequence
  Synthetic DNA
tagtaggactcactaatg

SEQ ID NO: 31271 - DNA, 18 bp, Artificial Sequence
  Synthetic DNA
tatctcgaatcactatag

SEQ ID NO: 31272 - DNA, 18 bp, Artificial Sequence
  Synthetic DNA
tattacgactctctatta

SEQ ID NO: 31273 - DNA, 18 bp, Artificial Sequence
  Synthetic DNA
tattacgacttacaattg

SEQ ID NO: 31274 - DNA, 18 bp, Artificial Sequence
  Synthetic DNA
tattacgtgtcactattg

SEQ ID NO: 31275 - DNA, 18 bp, Artificial Sequence
  Synthetic DNA
tattccgaatcactattg

SEQ ID NO: 31276 - DNA, 18 bp, Artificial Sequence
  Synthetic DNA
tatttcgacacaccatag

SEQ ID NO: 31277 - DNA, 18 bp, Artificial Sequence
  Synthetic DNA
tatttcgactcattatcg

SEQ ID NO: 31278 - DNA, 18 bp, Artificial Sequence
  Synthetic DNA
tatttcgagtcactaaag

SEQ ID NO: 31279 - DNA, 18 bp, Artificial Sequence
  Synthetic DNA
tcatacaactcgctttag

SEQ ID NO: 31280 - DNA, 18 bp, Artificial Sequence
  Synthetic DNA
tgatacgcatcactattg

SEQ ID NO: 31281 - DNA, 18 bp, Artificial Sequence
  Synthetic DNA
tgattcgactcattatcg

SEQ ID NO: 31282 - DNA, 18 bp, Artificial Sequence
  Synthetic DNA
ttaaacgacccactattg

SEQ ID NO: 31283 - DNA, 18 bp, Artificial Sequence
  Synthetic DNA
ttaatcgactcattatag

SEQ ID NO: 31284 - DNA, 18 bp, Artificial Sequence
  Synthetic DNA
ttatacaactcacgattg

SEQ ID NO: 31285 - DNA, 18 bp, Artificial Sequence
  Synthetic DNA
ttatacgactaactaatg

SEQ ID NO: 31286 - DNA, 18 bp, Artificial Sequence
  Synthetic DNA
ttatacgactcactcatg

SEQ ID NO: 31287 - DNA, 18 bp, Artificial Sequence
  Synthetic DNA
ttatacgagtctctattg

SEQ ID NO: 31288 - DNA, 18 bp, Artificial Sequence
  Synthetic DNA
ttatacgattctctattg

SEQ ID NO: 31289 - DNA, 18 bp, Artificial Sequence
  Synthetic DNA
ttatacgcctgactattg

SEQ ID NO: 31290 - DNA, 18 bp, Artificial Sequence
  Synthetic DNA
ttatactattcgctatag

SEQ ID NO: 31291 - DNA, 18 bp, Artificial Sequence
  Synthetic DNA
ttattcgactaattatag

SEQ ID NO: 31292 - DNA, 18 bp, Artificial Sequence
  Synthetic DNA
ttattcgactcactgcag

SEQ ID NO: 31293 - DNA, 18 bp, Artificial Sequence
  Synthetic DNA
ttattcggctaactatag

SEQ ID NO: 31294 - DNA, 18 bp, Artificial Sequence
  Synthetic DNA
ttattcttctcactatag

SEQ ID NO: 31295 - DNA, 18 bp, Artificial Sequence
  Synthetic DNA
ttctacgagtcactattg

SEQ ID NO: 31296 - DNA, 18 bp, Artificial Sequence
  Synthetic DNA
ttgttcgactccctatag

SEQ ID NO: 31297 - DNA, 18 bp, Artificial Sequence
  Synthetic DNA
aaataagactaactaaag

SEQ ID NO: 31298 - DNA, 18 bp, Artificial Sequence
  Synthetic DNA
aaatacatctcactgtag

SEQ ID NO: 31299 - DNA, 18 bp, Artificial Sequence
  Synthetic DNA
aaatacgacatactgtag

SEQ ID NO: 31300 - DNA, 18 bp, Artificial Sequence
  Synthetic DNA
aaatacgactcccattag

SEQ ID NO: 31301 - DNA, 18 bp, Artificial Sequence
  Synthetic DNA
aaatacgatacactaaag

SEQ ID NO: 31302 - DNA, 18 bp, Artificial Sequence
  Synthetic DNA
aaatacgtctcaatttag

SEQ ID NO: 31303 - DNA, 18 bp, Artificial Sequence
  Synthetic DNA
aaatacgtctcacagtag

SEQ ID NO: 31304 - DNA, 18 bp, Artificial Sequence
  Synthetic DNA
aaatacgtctcactaagg

SEQ ID NO: 31305 - DNA, 18 bp, Artificial Sequence
  Synthetic DNA
aaatacgtctccctttag

SEQ ID NO: 31306 - DNA, 18 bp, Artificial Sequence
  Synthetic DNA
aaatacgtttcactatgg

SEQ ID NO: 31307 - DNA, 18 bp, Artificial Sequence
  Synthetic DNA
aaatactgatcactatag

SEQ ID NO: 31308 - DNA, 18 bp, Artificial Sequence
  Synthetic DNA
aaataggactcaataaag

SEQ ID NO: 31309 - DNA, 18 bp, Artificial Sequence
  Synthetic DNA
aaataggacttactttag

SEQ ID NO: 31310 - DNA, 18 bp, Artificial Sequence
  Synthetic DNA
aaatccgactctctatcg

SEQ ID NO: 31311 - DNA, 18 bp, Artificial Sequence
  Synthetic DNA
aaatccgactgacaatag

SEQ ID NO: 31312 - DNA, 18 bp, Artificial Sequence
  Synthetic DNA
aaatgcgactttctatag

SEQ ID NO: 31313 - DNA, 18 bp, Artificial Sequence
  Synthetic DNA
aacaaagactcactatag

SEQ ID NO: 31314 - DNA, 18 bp, Artificial Sequence
  Synthetic DNA
aagtacgactcattatgg

SEQ ID NO: 31315 - DNA, 18 bp, Artificial Sequence
  Synthetic DNA
aagtacgacttactttag

SEQ ID NO: 31316 - DNA, 18 bp, Artificial Sequence
  Synthetic DNA
aatgaagactcactatag

SEQ ID NO: 31317 - DNA, 18 bp, Artificial Sequence
  Synthetic DNA
acatactactcaatatag

SEQ ID NO: 31318 - DNA, 18 bp, Artificial Sequence
  Synthetic DNA
ataagcgactcactatag

SEQ ID NO: 31319 - DNA, 18 bp, Artificial Sequence
  Synthetic DNA
atataagactcactaaag

SEQ ID NO: 31320 - DNA, 18 bp, Artificial Sequence
  Synthetic DNA
atataagactcactacag

SEQ ID NO: 31321 - DNA, 18 bp, Artificial Sequence
  Synthetic DNA
atatacgactctcaatag

SEQ ID NO: 31322 - DNA, 18 bp, Artificial Sequence
  Synthetic DNA
atatccgactcactatcg

SEQ ID NO: 31323 - DNA, 18 bp, Artificial Sequence
  Synthetic DNA
atgtacgagtcactatag

SEQ ID NO: 31324 - DNA, 18 bp, Artificial Sequence
  Synthetic DNA
caaaacgactctttatag

SEQ ID NO: 31325 - DNA, 18 bp, Artificial Sequence
  Synthetic DNA
caatacgaatcacttaag

SEQ ID NO: 31326 - DNA, 18 bp, Artificial Sequence
  Synthetic DNA
caatacgacacacaacag

SEQ ID NO: 31327 - DNA, 18 bp, Artificial Sequence
  Synthetic DNA
caatacgtctaattatag

SEQ ID NO: 31328 - DNA, 18 bp, Artificial Sequence
  Synthetic DNA
caatacgtctcattatgg

SEQ ID NO: 31329 - DNA, 18 bp, Artificial Sequence
  Synthetic DNA
caatactactcccaatag

SEQ ID NO: 31330 - DNA, 18 bp, Artificial Sequence
  Synthetic DNA
cattaccacacactatag

SEQ ID NO: 31331 - DNA, 18 bp, Artificial Sequence
  Synthetic DNA
taaaaagtcgcactatag

SEQ ID NO: 31332 - DNA, 18 bp, Artificial Sequence
  Synthetic DNA
taaaacaactatctatag

SEQ ID NO: 31333 - DNA, 18 bp, Artificial Sequence
  Synthetic DNA
taaaaccactctatatag

SEQ ID NO: 31334 - DNA, 18 bp, Artificial Sequence
  Synthetic DNA
taaaaccactctccatag

SEQ ID NO: 31335 - DNA, 18 bp, Artificial Sequence
  Synthetic DNA
taaaacgactcatattag

SEQ ID NO: 31336 - DNA, 18 bp, Artificial Sequence
  Synthetic DNA
taaaacgactcccaaaag

SEQ ID NO: 31337 - DNA, 18 bp, Artificial Sequence
  Synthetic DNA
taaaacgactctataaag

SEQ ID NO: 31338 - DNA, 18 bp, Artificial Sequence
  Synthetic DNA
taaaacgcctcactctcg

SEQ ID NO: 31339 - DNA, 18 bp, Artificial Sequence
  Synthetic DNA
taaaacgtttcactacag

SEQ ID NO: 31340 - DNA, 18 bp, Artificial Sequence
  Synthetic DNA
taaacagactgactatag

SEQ ID NO: 31341 - DNA, 18 bp, Artificial Sequence
  Synthetic DNA
taaaccgaatctctatag

SEQ ID NO: 31342 - DNA, 18 bp, Artificial Sequence
  Synthetic DNA
taacaaaactcactaaag

SEQ ID NO: 31343 - DNA, 18 bp, Artificial Sequence
  Synthetic DNA
taacacgactcttcatag

SEQ ID NO: 31344 - DNA, 18 bp, Artificial Sequence
  Synthetic DNA
taacacgtcacattatag

SEQ ID NO: 31345 - DNA, 18 bp, Artificial Sequence
  Synthetic DNA
taacactattcagtatag

SEQ ID NO: 31346 - DNA, 18 bp, Artificial Sequence
  Synthetic DNA
taacatgactcattaaag

SEQ ID NO: 31347 - DNA, 18 bp, Artificial Sequence
  Synthetic DNA
taagacgactcatttaag

SEQ ID NO: 31348 - DNA, 18 bp, Artificial Sequence
  Synthetic DNA
taaggtgactcactaaag

SEQ ID NO: 31349 - DNA, 18 bp, Artificial Sequence
  Synthetic DNA
taataaatcttactatag

SEQ ID NO: 31350 - DNA, 18 bp, Artificial Sequence
  Synthetic DNA
taataagaatcacaaaag

SEQ ID NO: 31351 - DNA, 18 bp, Artificial Sequence
  Synthetic DNA
taataagaatctctttag

SEQ ID NO: 31352 - DNA, 18 bp, Artificial Sequence
  Synthetic DNA
taataagacactctaaag

SEQ ID NO: 31353 - DNA, 18 bp, Artificial Sequence
  Synthetic DNA
taataagactcacatcag

SEQ ID NO: 31354 - DNA, 18 bp, Artificial Sequence
  Synthetic DNA
taataagactcagaacag

SEQ ID NO: 31355 - DNA, 18 bp, Artificial Sequence
  Synthetic DNA
taataagactctcagtag

SEQ ID NO: 31356 - DNA, 18 bp, Artificial Sequence
  Synthetic DNA
taataagtcacagtatag

SEQ ID NO: 31357 - DNA, 18 bp, Artificial Sequence
  Synthetic DNA
taatacaacactccatag

SEQ ID NO: 31358 - DNA, 18 bp, Artificial Sequence
  Synthetic DNA
taatacaactaacattag

SEQ ID NO: 31359 - DNA, 18 bp, Artificial Sequence
  Synthetic DNA
taatacaactcacattcg

SEQ ID NO: 31360 - DNA, 18 bp, Artificial Sequence
  Synthetic DNA
taatacatcgaactatag

SEQ ID NO: 31361 - DNA, 18 bp, Artificial Sequence
  Synthetic DNA
taataccaatcacaaaag

SEQ ID NO: 31362 - DNA, 18 bp, Artificial Sequence
  Synthetic DNA
taataccgctcacaaaag

SEQ ID NO: 31363 - DNA, 18 bp, Artificial Sequence
  Synthetic DNA
taatacgaaaaacaatag

SEQ ID NO: 31364 - DNA, 18 bp, Artificial Sequence
  Synthetic DNA
taatacgaattactttcg

SEQ ID NO: 31365 - DNA, 18 bp, Artificial Sequence
  Synthetic DNA
taatacgacacacataag

SEQ ID NO: 31366 - DNA, 18 bp, Artificial Sequence
  Synthetic DNA
taatacgactctcattgg

SEQ ID NO: 31367 - DNA, 18 bp, Artificial Sequence
  Synthetic DNA
taatacgactctgattag

SEQ ID NO: 31368 - DNA, 18 bp, Artificial Sequence
  Synthetic DNA
taatacgacttttaatag

SEQ ID NO: 31369 - DNA, 18 bp, Artificial Sequence
  Synthetic DNA
taatacgagtctttttag

SEQ ID NO: 31370 - DNA, 18 bp, Artificial Sequence
  Synthetic DNA
taatacgattaaataaag

SEQ ID NO: 31371 - DNA, 18 bp, Artificial Sequence
  Synthetic DNA
taatacgattcactcacg

SEQ ID NO: 31372 - DNA, 18 bp, Artificial Sequence
  Synthetic DNA
taatacgattttatatag

SEQ ID NO: 31373 - DNA, 18 bp, Artificial Sequence
  Synthetic DNA
taatacgcgtcaatttag

SEQ ID NO: 31374 - DNA, 18 bp, Artificial Sequence
  Synthetic DNA
taatacgtcaaactctag

SEQ ID NO: 31375 - DNA, 18 bp, Artificial Sequence
  Synthetic DNA
taatacgtcacacggtag

SEQ ID NO: 31376 - DNA, 18 bp, Artificial Sequence
  Synthetic DNA
taatacgtcagaccatag

SEQ ID NO: 31377 - DNA, 18 bp, Artificial Sequence
  Synthetic DNA
taatacgtctccttttag

SEQ ID NO: 31378 - DNA, 18 bp, Artificial Sequence
  Synthetic DNA
taatacgtctctccacag

SEQ ID NO: 31379 - DNA, 18 bp, Artificial Sequence
  Synthetic DNA
taatacgtcttaatttag

SEQ ID NO: 31380 - DNA, 18 bp, Artificial Sequence
  Synthetic DNA
taatacgtgactctatag

SEQ ID NO: 31381 - DNA, 18 bp, Artificial Sequence
  Synthetic DNA
taatactacttataatag

SEQ ID NO: 31382 - DNA, 18 bp, Artificial Sequence
  Synthetic DNA
taatacttccaactatag

SEQ ID NO: 31383 - DNA, 18 bp, Artificial Sequence
  Synthetic DNA
taatacttcccactaaag

SEQ ID NO: 31384 - DNA, 18 bp, Artificial Sequence
  Synthetic DNA
taatacttctcacttcag

SEQ ID NO: 31385 - DNA, 18 bp, Artificial Sequence
  Synthetic DNA
taatacttcttattatag

SEQ ID NO: 31386 - DNA, 18 bp, Artificial Sequence
  Synthetic DNA
taataggacacataatag

SEQ ID NO: 31387 - DNA, 18 bp, Artificial Sequence
  Synthetic DNA
taataggtcacaatatag

SEQ ID NO: 31388 - DNA, 18 bp, Artificial Sequence
  Synthetic DNA
taatatctctctctatag

SEQ ID NO: 31389 - DNA, 18 bp, Artificial Sequence
  Synthetic DNA
taatatgattcacaaaag

SEQ ID NO: 31390 - DNA, 18 bp, Artificial Sequence
  Synthetic DNA
taatccgactgactttcg

SEQ ID NO: 31391 - DNA, 18 bp, Artificial Sequence
  Synthetic DNA
taatccgtcacactttag

SEQ ID NO: 31392 - DNA, 18 bp, Artificial Sequence
  Synthetic DNA
taatctaacacactatag

SEQ ID NO: 31393 - DNA, 18 bp, Artificial Sequence
  Synthetic DNA
taatctgactctttatag

SEQ ID NO: 31394 - DNA, 18 bp, Artificial Sequence
  Synthetic DNA
taatgcgacaaacaatag

SEQ ID NO: 31395 - DNA, 18 bp, Artificial Sequence
  Synthetic DNA
taatgcgtctcactaccg

SEQ ID NO: 31396 - DNA, 18 bp, Artificial Sequence
  Synthetic DNA
taatgttacacactatag

SEQ ID NO: 31397 - DNA, 18 bp, Artificial Sequence
  Synthetic DNA
taatgttactctctatag

SEQ ID NO: 31398 - DNA, 18 bp, Artificial Sequence
  Synthetic DNA
tactacgaccctctttag

SEQ ID NO: 31399 - DNA, 18 bp, Artificial Sequence
  Synthetic DNA
tactaggactaattatag

SEQ ID NO: 31400 - DNA, 18 bp, Artificial Sequence
  Synthetic DNA
tactcctactcactaaag

SEQ ID NO: 31401 - DNA, 18 bp, Artificial Sequence
  Synthetic DNA
tataacaactaactatag

SEQ ID NO: 31402 - DNA, 18 bp, Artificial Sequence
  Synthetic DNA
tataacgactcagtctag

SEQ ID NO: 31403 - DNA, 18 bp, Artificial Sequence
  Synthetic DNA
tataatgtctcactatag

SEQ ID NO: 31404 - DNA, 18 bp, Artificial Sequence
  Synthetic DNA
tatcactactcaatatag

SEQ ID NO: 31405 - DNA, 18 bp, Artificial Sequence
  Synthetic DNA
tattaagaatctctatag

SEQ ID NO: 31406 - DNA, 18 bp, Artificial Sequence
  Synthetic DNA
tattaagacacactttag

SEQ ID NO: 31407 - DNA, 18 bp, Artificial Sequence
  Synthetic DNA
tattaagactccctttag

SEQ ID NO: 31408 - DNA, 18 bp, Artificial Sequence
  Synthetic DNA
tattaagactgaccatag

SEQ ID NO: 31409 - DNA, 18 bp, Artificial Sequence
  Synthetic DNA
tattaagtctcactaaag

SEQ ID NO: 31410 - DNA, 18 bp, Artificial Sequence
  Synthetic DNA
tattacaagtaactatag

SEQ ID NO: 31411 - DNA, 18 bp, Artificial Sequence
  Synthetic DNA
tattacgacacactaagg

SEQ ID NO: 31412 - DNA, 18 bp, Artificial Sequence
  Synthetic DNA
tattacgacaccccatag

SEQ ID NO: 31413 - DNA, 18 bp, Artificial Sequence
  Synthetic DNA
tattacgactctcaatcg

SEQ ID NO: 31414 - DNA, 18 bp, Artificial Sequence
  Synthetic DNA
tattacgagtcattttag

SEQ ID NO: 31415 - DNA, 18 bp, Artificial Sequence
  Synthetic DNA
tattacggctatctatag

SEQ ID NO: 31416 - DNA, 18 bp, Artificial Sequence
  Synthetic DNA
tattacggcttacaatag

SEQ ID NO: 31417 - DNA, 18 bp, Artificial Sequence
  Synthetic DNA
tattactcctcactttag

SEQ ID NO: 31418 - DNA, 18 bp, Artificial Sequence
  Synthetic DNA
tattaggaatccctatag

SEQ ID NO: 31419 - DNA, 18 bp, Artificial Sequence
  Synthetic DNA
tcaaacaacacactatag

SEQ ID NO: 31420 - DNA, 18 bp, Artificial Sequence
  Synthetic DNA
tcaaacgactcacttcag

SEQ ID NO: 31421 - DNA, 18 bp, Artificial Sequence
  Synthetic DNA
tcataagacttactaaag

SEQ ID NO: 31422 - DNA, 18 bp, Artificial Sequence
  Synthetic DNA
tcatacatctcattatag

SEQ ID NO: 31423 - DNA, 18 bp, Artificial Sequence
  Synthetic DNA
tcatacgaatcattatcg

SEQ ID NO: 31424 - DNA, 18 bp, Artificial Sequence
  Synthetic DNA
tcatacgacacacaaaag

SEQ ID NO: 31425 - DNA, 18 bp, Artificial Sequence
  Synthetic DNA
tcatacgattcaataaag

SEQ ID NO: 31426 - DNA, 18 bp, Artificial Sequence
  Synthetic DNA
tcatacgtcacaatatag

SEQ ID NO: 31427 - DNA, 18 bp, Artificial Sequence
  Synthetic DNA
tcatacttttcactatag

SEQ ID NO: 31428 - DNA, 18 bp, Artificial Sequence
  Synthetic DNA
tcataggactttctatag

SEQ ID NO: 31429 - DNA, 18 bp, Artificial Sequence
  Synthetic DNA
tcatatatctcactatag

SEQ ID NO: 31430 - DNA, 18 bp, Artificial Sequence
  Synthetic DNA
tcatatgactcccaatag

SEQ ID NO: 31431 - DNA, 18 bp, Artificial Sequence
  Synthetic DNA
tcttacgcttcactatag

SEQ ID NO: 31432 - DNA, 18 bp, Artificial Sequence
  Synthetic DNA
tgatacaactctcaatag

SEQ ID NO: 31433 - DNA, 18 bp, Artificial Sequence
  Synthetic DNA
tgatacgatacactaaag

SEQ ID NO: 31434 - DNA, 18 bp, Artificial Sequence
  Synthetic DNA
tgctacgagacactatag

SEQ ID NO: 31435 - DNA, 18 bp, Artificial Sequence
  Synthetic DNA
tgctacgtctctctatag

SEQ ID NO: 31436 - DNA, 18 bp, Artificial Sequence
  Synthetic DNA
ttaaacatctcactatag

SEQ ID NO: 31437 - DNA, 18 bp, Artificial Sequence
  Synthetic DNA
ttaaacgactcactccag

SEQ ID NO: 31438 - DNA, 18 bp, Artificial Sequence
  Synthetic DNA
ttaaacgatttactatag

SEQ ID NO: 31439 - DNA, 18 bp, Artificial Sequence
  Synthetic DNA
ttacacgactaactttag

SEQ ID NO: 31440 - DNA, 18 bp, Artificial Sequence
  Synthetic DNA
ttacacgactaattatag

SEQ ID NO: 31441 - DNA, 18 bp, Artificial Sequence
  Synthetic DNA
ttagacgccttactatag

SEQ ID NO: 31442 - DNA, 18 bp, Artificial Sequence
  Synthetic DNA
ttataagacacactgtag

SEQ ID NO: 31443 - DNA, 18 bp, Artificial Sequence
  Synthetic DNA
ttatacaactatctatag

SEQ ID NO: 31444 - DNA, 18 bp, Artificial Sequence
  Synthetic DNA
ttatacaagtcactttag

SEQ ID NO: 31445 - DNA, 18 bp, Artificial Sequence
  Synthetic DNA
ttataccactcattttag

SEQ ID NO: 31446 - DNA, 18 bp, Artificial Sequence
  Synthetic DNA
ttatacccctctctatag

SEQ ID NO: 31447 - DNA, 18 bp, Artificial Sequence
  Synthetic DNA
ttatacgacaaaatatag

SEQ ID NO: 31448 - DNA, 18 bp, Artificial Sequence
  Synthetic DNA
ttatacgacccattttag

SEQ ID NO: 31449 - DNA, 18 bp, Artificial Sequence
  Synthetic DNA
ttatacgactatatatag

SEQ ID NO: 31450 - DNA, 18 bp, Artificial Sequence
  Synthetic DNA
ttatacgactttctatgg

SEQ ID NO: 31451 - DNA, 18 bp, Artificial Sequence
  Synthetic DNA
ttatacgactttgtatag

SEQ ID NO: 31452 - DNA, 18 bp, Artificial Sequence
  Synthetic DNA
ttatacgtcgctctatag

SEQ ID NO: 31453 - DNA, 18 bp, Artificial Sequence
  Synthetic DNA
ttatacgtctcatcatag

SEQ ID NO: 31454 - DNA, 18 bp, Artificial Sequence
  Synthetic DNA
ttatactactcaatgtag

SEQ ID NO: 31455 - DNA, 18 bp, Artificial Sequence
  Synthetic DNA
ttatactcctcactctag

SEQ ID NO: 31456 - DNA, 18 bp, Artificial Sequence
  Synthetic DNA
ttataggattcattatag

SEQ ID NO: 31457 - DNA, 18 bp, Artificial Sequence
  Synthetic DNA
ttatccgaatcactaaag

SEQ ID NO: 31458 - DNA, 18 bp, Artificial Sequence
  Synthetic DNA
ttatgcgaatcattatag

SEQ ID NO: 31459 - DNA, 18 bp, Artificial Sequence
  Synthetic DNA
ttctccgtctcactatag

SEQ ID NO: 31460 - DNA, 18 bp, Artificial Sequence
  Synthetic DNA
ttgtagtactcactatag

SEQ ID NO: 31461 - DNA, 18 bp, Artificial Sequence
  Synthetic DNA
tttaacgaatcactatag

SEQ ID NO: 31462 - DNA, 18 bp, Artificial Sequence
  Synthetic DNA
ttttacgactcattatgg

SEQ ID NO: 31463 - DNA, 18 bp, Artificial Sequence
  Synthetic DNA
ttttacgactcattctag

SEQ ID NO: 31464 - DNA, 18 bp, Artificial Sequence
  Synthetic DNA
taatacgactttcaattg

SEQ ID NO: 31465 - DNA, 18 bp, Artificial Sequence
  Synthetic DNA
taatacaacactctaaag

SEQ ID NO: 31466 - DNA, 18 bp, Artificial Sequence
  Synthetic DNA
tatcacgacactctatag

SEQ ID NO: 31467 - DNA, 18 bp, Artificial Sequence
  Synthetic DNA
tattactactcacattag

SEQ ID NO: 31468 - DNA, 18 bp, Artificial Sequence
  Synthetic DNA
tattacgactctctaatg

SEQ ID NO: 31469 - DNA, 18 bp, Artificial Sequence
  Synthetic DNA
tgattcgactcacaattg

SEQ ID NO: 31470 - DNA, 18 bp, Artificial Sequence
  Synthetic DNA
taaaacaaatcactattg

SEQ ID NO: 31471 - DNA, 18 bp, Artificial Sequence
  Synthetic DNA
taaatcaactcactaaag

SEQ ID NO: 31472 - DNA, 18 bp, Artificial Sequence
  Synthetic DNA
taattcaactctctaaag

SEQ ID NO: 31473 - DNA, 18 bp, Artificial Sequence
  Synthetic DNA
tattatgtctcactattg

SEQ ID NO: 31474 - DNA, 18 bp, Artificial Sequence
  Synthetic DNA
aaatacgtatcattatag

SEQ ID NO: 31475 - DNA, 18 bp, Artificial Sequence
  Synthetic DNA
aataacgactaactatag

SEQ ID NO: 31476 - DNA, 18 bp, Artificial Sequence
  Synthetic DNA
ataaacgactaactatag

SEQ ID NO: 31477 - DNA, 18 bp, Artificial Sequence
  Synthetic DNA
taaaacgacacattaaag

SEQ ID NO: 31478 - DNA, 18 bp, Artificial Sequence
  Synthetic DNA
taacacgtctctcaatag

SEQ ID NO: 31479 - DNA, 18 bp, Artificial Sequence
  Synthetic DNA
taatgcgactctcttaag

SEQ ID NO: 31480 - DNA, 18 bp, Artificial Sequence
  Synthetic DNA
tgatacgattcattttag

SEQ ID NO: 31481 - DNA, 18 bp, Artificial Sequence
  Synthetic DNA
ttataagactcactcaag

SEQ ID NO: 31482 - DNA, 18 bp, Artificial Sequence
  Synthetic DNA
ttatacgtttcactttag

SEQ ID NO: 31483 - DNA, 18 bp, Artificial Sequence
  Synthetic DNA
ttgtacgtctaactatag

SEQ ID NO: 31484 - DNA, 18 bp, Artificial Sequence
  Synthetic DNA
ttaaacgactctctttag

SEQ ID NO: 31485 - DNA, 18 bp, Artificial Sequence
  Synthetic DNA
taattcgactcacataag

SEQ ID NO: 31486 - DNA, 18 bp, Artificial Sequence
  Synthetic DNA
ttatactacacactattg

SEQ ID NO: 31487 - DNA, 18 bp, Artificial Sequence
  Synthetic DNA
atatacgattcacaatag

SEQ ID NO: 31488 - DNA, 18 bp, Artificial Sequence
  Synthetic DNA
ttatacgtcttactttag

SEQ ID NO: 31489 - DNA, 18 bp, Artificial Sequence
  Synthetic DNA
ttaaacgactcacaaaag

SEQ ID NO: 31490 - DNA, 18 bp, Artificial Sequence
  Synthetic DNA
taataagtctcactaatg

SEQ ID NO: 31491 - DNA, 18 bp, Artificial Sequence
  Synthetic DNA
taattcatctcacaatag

SEQ ID NO: 31492 - DNA, 18 bp, Artificial Sequence
  Synthetic DNA
tattacgactctcaattg

SEQ ID NO: 31493 - DNA, 18 bp, Artificial Sequence
  Synthetic DNA
caatacgactcgcaattg

SEQ ID NO: 31494 - DNA, 18 bp, Artificial Sequence
  Synthetic DNA
taattggattcgctatag

SEQ ID NO: 31495 - DNA, 18 bp, Artificial Sequence
  Synthetic DNA
ttattcgactcactcttg

SEQ ID NO: 31496 - DNA, 18 bp, Artificial Sequence
  Synthetic DNA
aaaatggactcactatag

SEQ ID NO: 31497 - DNA, 18 bp, Artificial Sequence
  Synthetic DNA
aaataagactcgcaatag

SEQ ID NO: 31498 - DNA, 18 bp, Artificial Sequence
  Synthetic DNA
aaatacgattccctattg

SEQ ID NO: 31499 - DNA, 18 bp, Artificial Sequence
  Synthetic DNA
aaattccactcactttag

SEQ ID NO: 31500 - DNA, 18 bp, Artificial Sequence
  Synthetic DNA
aaattcgactgtctatag

SEQ ID NO: 31501 - DNA, 18 bp, Artificial Sequence
  Synthetic DNA
agatacgactcacttttg

SEQ ID NO: 31502 - DNA, 18 bp, Artificial Sequence
  Synthetic DNA
atatgcgactcgctatag

SEQ ID NO: 31503 - DNA, 18 bp, Artificial Sequence
  Synthetic DNA
caattcgactaactgtag

SEQ ID NO: 31504 - DNA, 18 bp, Artificial Sequence
  Synthetic DNA
caattcgacttattatag

SEQ ID NO: 31505 - DNA, 18 bp, Artificial Sequence
  Synthetic DNA
taaaacaattcactattg

SEQ ID NO: 31506 - DNA, 18 bp, Artificial Sequence
  Synthetic DNA
taaaacgactccctaatg

SEQ ID NO: 31507 - DNA, 18 bp, Artificial Sequence
  Synthetic DNA
taaaacgcttcactattg

SEQ ID NO: 31508 - DNA, 18 bp, Artificial Sequence
  Synthetic DNA
taaaacgtcccactattg

SEQ ID NO: 31509 - DNA, 18 bp, Artificial Sequence
  Synthetic DNA
taaatcaacacactatag

SEQ ID NO: 31510 - DNA, 18 bp, Artificial Sequence
  Synthetic DNA
taacagggctcgctatag

SEQ ID NO: 31511 - DNA, 18 bp, Artificial Sequence
  Synthetic DNA
taactcgactttctatag

SEQ ID NO: 31512 - DNA, 18 bp, Artificial Sequence
  Synthetic DNA
taataatacacactattg

SEQ ID NO: 31513 - DNA, 18 bp, Artificial Sequence
  Synthetic DNA
taatacaacacacgattg

SEQ ID NO: 31514 - DNA, 18 bp, Artificial Sequence
  Synthetic DNA
taatacgaatcactcatg

SEQ ID NO: 31515 - DNA, 18 bp, Artificial Sequence
  Synthetic DNA
taatacgacacactgatg

SEQ ID NO: 31516 - DNA, 18 bp, Artificial Sequence
  Synthetic DNA
taatacgacacataattg

SEQ ID NO: 31517 - DNA, 18 bp, Artificial Sequence
  Synthetic DNA
taatacgactcgccgaag

SEQ ID NO: 31518 - DNA, 18 bp, Artificial Sequence
  Synthetic DNA
taatacgattcagtcttg

SEQ ID NO: 31519 - DNA, 18 bp, Artificial Sequence
  Synthetic DNA
taatacgattcatttttg

SEQ ID NO: 31520 - DNA, 18 bp, Artificial Sequence
  Synthetic DNA
taatacgcttcacaattg

SEQ ID NO: 31521 - DNA, 18 bp, Artificial Sequence
  Synthetic DNA
taatacggctctatattg

SEQ ID NO: 31522 - DNA, 18 bp, Artificial Sequence
  Synthetic DNA
taatacgtctcaacattg

SEQ ID NO: 31523 - DNA, 18 bp, Artificial Sequence
  Synthetic DNA
taatactagtctctattg

SEQ ID NO: 31524 - DNA, 18 bp, Artificial Sequence
  Synthetic DNA
taatatgaatcactaatg

SEQ ID NO: 31525 - DNA, 18 bp, Artificial Sequence
  Synthetic DNA
taatatgactcattactg

SEQ ID NO: 31526 - DNA, 18 bp, Artificial Sequence
  Synthetic DNA
taatatgtcttactattg

SEQ ID NO: 31527 - DNA, 18 bp, Artificial Sequence
  Synthetic DNA
taatcagattcactattg

SEQ ID NO: 31528 - DNA, 18 bp, Artificial Sequence
  Synthetic DNA
taatccgaattactattg

SEQ ID NO: 31529 - DNA, 18 bp, Artificial Sequence
  Synthetic DNA
taatccgacgcacaattg

SEQ ID NO: 31530 - DNA, 18 bp, Artificial Sequence
  Synthetic DNA
taatccgtttcactattg

SEQ ID NO: 31531 - DNA, 18 bp, Artificial Sequence
  Synthetic DNA
taatgcgaaacgctatag

SEQ ID NO: 31532 - DNA, 18 bp, Artificial Sequence
  Synthetic DNA
taattagaatcactttag

SEQ ID NO: 31533 - DNA, 18 bp, Artificial Sequence
  Synthetic DNA
taattagattgactatag

SEQ ID NO: 31534 - DNA, 18 bp, Artificial Sequence
  Synthetic DNA
taattccactcattgtag

SEQ ID NO: 31535 - DNA, 18 bp, Artificial Sequence
  Synthetic DNA
taattcgaatcagaatag

SEQ ID NO: 31536 - DNA, 18 bp, Artificial Sequence
  Synthetic DNA
taattcgactcaataagg

SEQ ID NO: 31537 - DNA, 18 bp, Artificial Sequence
  Synthetic DNA
taattcgactcaattcag

SEQ ID NO: 31538 - DNA, 18 bp, Artificial Sequence
  Synthetic DNA
taattcgagtcacttaag

SEQ ID NO: 31539 - DNA, 18 bp, Artificial Sequence
  Synthetic DNA
taattcgattcaaaatag

SEQ ID NO: 31540 - DNA, 18 bp, Artificial Sequence
  Synthetic DNA
taattcggcactctatag

SEQ ID NO: 31541 - DNA, 18 bp, Artificial Sequence
  Synthetic DNA
taattcggctcaataaag

SEQ ID NO: 31542 - DNA, 18 bp, Artificial Sequence
  Synthetic DNA
taattcgtatcactttag

SEQ ID NO: 31543 - DNA, 18 bp, Artificial Sequence
  Synthetic DNA
taattctaaacactatag

SEQ ID NO: 31544 - DNA, 18 bp, Artificial Sequence
  Synthetic DNA
taattctaatcactaaag

SEQ ID NO: 31545 - DNA, 18 bp, Artificial Sequence
  Synthetic DNA
taattgaattcactatag

SEQ ID NO: 31546 - DNA, 18 bp, Artificial Sequence
  Synthetic DNA
taattggactcataatag

SEQ ID NO: 31547 - DNA, 18 bp, Artificial Sequence
  Synthetic DNA
taatttgactcacaatcg

SEQ ID NO: 31548 - DNA, 18 bp, Artificial Sequence
  Synthetic DNA
tacaacgactcactaatg

SEQ ID NO: 31549 - DNA, 18 bp, Artificial Sequence
  Synthetic DNA
tactacgtcacgctatag

SEQ ID NO: 31550 - DNA, 18 bp, Artificial Sequence
  Synthetic DNA
tacttcaactaactatag

SEQ ID NO: 31551 - DNA, 18 bp, Artificial Sequence
  Synthetic DNA
tagtatgagtcactattg

SEQ ID NO: 31552 - DNA, 18 bp, Artificial Sequence
  Synthetic DNA
tatcttgactcactatag

SEQ ID NO: 31553 - DNA, 18 bp, Artificial Sequence
  Synthetic DNA
tatgacgactctctattg

SEQ ID NO: 31554 - DNA, 18 bp, Artificial Sequence
  Synthetic DNA
tattacaactcactgttg

SEQ ID NO: 31555 - DNA, 18 bp, Artificial Sequence
  Synthetic DNA
tattacggctcacaattg

SEQ ID NO: 31556 - DNA, 18 bp, Artificial Sequence
  Synthetic DNA
tattactactcactactg

SEQ ID NO: 31557 - DNA, 18 bp, Artificial Sequence
  Synthetic DNA
tcattcgattccctatag

SEQ ID NO: 31558 - DNA, 18 bp, Artificial Sequence
  Synthetic DNA
tcttttgactcactatag

SEQ ID NO: 31559 - DNA, 18 bp, Artificial Sequence
  Synthetic DNA
tgatacgtctctctattg

SEQ ID NO: 31560 - DNA, 18 bp, Artificial Sequence
  Synthetic DNA
tgatactactcacaattg

SEQ ID NO: 31561 - DNA, 18 bp, Artificial Sequence
  Synthetic DNA
ttattttactcactatag

SEQ ID NO: 31562 - DNA, 18 bp, Artificial Sequence
  Synthetic DNA
aaaaaagactcacaatag

SEQ ID NO: 31563 - DNA, 18 bp, Artificial Sequence
  Synthetic DNA
aaaaacgacttacaatag

SEQ ID NO: 31564 - DNA, 18 bp, Artificial Sequence
  Synthetic DNA
aaagaccacacactatag

SEQ ID NO: 31565 - DNA, 18 bp, Artificial Sequence
  Synthetic DNA
aaataaaactcactttag

SEQ ID NO: 31566 - DNA, 18 bp, Artificial Sequence
  Synthetic DNA
aaataagactctctatcg

SEQ ID NO: 31567 - DNA, 18 bp, Artificial Sequence
  Synthetic DNA
aaataagtcacactatag

SEQ ID NO: 31568 - DNA, 18 bp, Artificial Sequence
  Synthetic DNA
aaatacaactcacttaag

SEQ ID NO: 31569 - DNA, 18 bp, Artificial Sequence
  Synthetic DNA
aaatacgactgacaatgg

SEQ ID NO: 31570 - DNA, 18 bp, Artificial Sequence
  Synthetic DNA
aaatacgactttctacag

SEQ ID NO: 31571 - DNA, 18 bp, Artificial Sequence
  Synthetic DNA
aaatacgattaactttag

SEQ ID NO: 31572 - DNA, 18 bp, Artificial Sequence
  Synthetic DNA
aaatacggcttaccatag

SEQ ID NO: 31573 - DNA, 18 bp, Artificial Sequence
  Synthetic DNA
aaatacggcttactaaag

SEQ ID NO: 31574 - DNA, 18 bp, Artificial Sequence
  Synthetic DNA
aaatacgtctctatatag

SEQ ID NO: 31575 - DNA, 18 bp, Artificial Sequence
  Synthetic DNA
aaatatgtctcactttag

SEQ ID NO: 31576 - DNA, 18 bp, Artificial Sequence
  Synthetic DNA
aagtacgacacactaaag

SEQ ID NO: 31577 - DNA, 18 bp, Artificial Sequence
  Synthetic DNA
aagtacgtctcacaatag

SEQ ID NO: 31578 - DNA, 18 bp, Artificial Sequence
  Synthetic DNA
aattacgactaactatcg

SEQ ID NO: 31579 - DNA, 18 bp, Artificial Sequence
  Synthetic DNA
aattacgactcactaacg

SEQ ID NO: 31580 - DNA, 18 bp, Artificial Sequence
  Synthetic DNA
aattacggctcactttag

SEQ ID NO: 31581 - DNA, 18 bp, Artificial Sequence
  Synthetic DNA
aattatgactctctatag

SEQ ID NO: 31582 - DNA, 18 bp, Artificial Sequence
  Synthetic DNA
acaaacgactctctatag

SEQ ID NO: 31583 - DNA, 18 bp, Artificial Sequence
  Synthetic DNA
atgtacgactcactctag

SEQ ID NO: 31584 - DNA, 18 bp, Artificial Sequence
  Synthetic DNA
caacacgactcaccaaag

SEQ ID NO: 31585 - DNA, 18 bp, Artificial Sequence
  Synthetic DNA
cactacgtctcactaaag

SEQ ID NO: 31586 - DNA, 18 bp, Artificial Sequence
  Synthetic DNA
cattacgattcactttag

SEQ ID NO: 31587 - DNA, 18 bp, Artificial Sequence
  Synthetic DNA
ctatactattcactatag

SEQ ID NO: 31588 - DNA, 18 bp, Artificial Sequence
  Synthetic DNA
taaaaagactctcaatag

SEQ ID NO: 31589 - DNA, 18 bp, Artificial Sequence
  Synthetic DNA
taaaacaactcataatag

SEQ ID NO: 31590 - DNA, 18 bp, Artificial Sequence
  Synthetic DNA
taaaacaattcacaatag

SEQ ID NO: 31591 - DNA, 18 bp, Artificial Sequence
  Synthetic DNA
taaaaccacacactatgg

SEQ ID NO: 31592 - DNA, 18 bp, Artificial Sequence
  Synthetic DNA
taaaacgactaacattag

SEQ ID NO: 31593 - DNA, 18 bp, Artificial Sequence
  Synthetic DNA
taaaacgactcacttacg

SEQ ID NO: 31594 - DNA, 18 bp, Artificial Sequence
  Synthetic DNA
taaaacgattcacttaag

SEQ ID NO: 31595 - DNA, 18 bp, Artificial Sequence
  Synthetic DNA
taaaacgattgaccatag

SEQ ID NO: 31596 - DNA, 18 bp, Artificial Sequence
  Synthetic DNA
taaaacgtctaactatgg

SEQ ID NO: 31597 - DNA, 18 bp, Artificial Sequence
  Synthetic DNA
taaaacgtctcacaatcg

SEQ ID NO: 31598 - DNA, 18 bp, Artificial Sequence
  Synthetic DNA
taaaacgtctcacttaag

SEQ ID NO: 31599 - DNA, 18 bp, Artificial Sequence
  Synthetic DNA
taaaacgtctctctagag

SEQ ID NO: 31600 - DNA, 18 bp, Artificial Sequence
  Synthetic DNA
taaaactatttactatag

SEQ ID NO: 31601 - DNA, 18 bp, Artificial Sequence
  Synthetic DNA
taaaaggccacactatag

SEQ ID NO: 31602 - DNA, 18 bp, Artificial Sequence
  Synthetic DNA
taaaagtactcactatcg

SEQ ID NO: 31603 - DNA, 18 bp, Artificial Sequence
  Synthetic DNA
taaaatgactcacaaaag

SEQ ID NO: 31604 - DNA, 18 bp, Artificial Sequence
  Synthetic DNA
taacatgacacacaatag

SEQ ID NO: 31605 - DNA, 18 bp, Artificial Sequence
  Synthetic DNA
taataagacttacaacag

SEQ ID NO: 31606 - DNA, 18 bp, Artificial Sequence
  Synthetic DNA
taataagatttattatag

SEQ ID NO: 31607 - DNA, 18 bp, Artificial Sequence
  Synthetic DNA
taataagcctctcaatag

SEQ ID NO: 31608 - DNA, 18 bp, Artificial Sequence
  Synthetic DNA
taataagtatcacaatag

SEQ ID NO: 31609 - DNA, 18 bp, Artificial Sequence
  Synthetic DNA
taataagtcttaccatag

SEQ ID NO: 31610 - DNA, 18 bp, Artificial Sequence
  Synthetic DNA
taatacaactcaaaatcg

SEQ ID NO: 31611 - DNA, 18 bp, Artificial Sequence
  Synthetic DNA
taatacatcacactaaag

SEQ ID NO: 31612 - DNA, 18 bp, Artificial Sequence
  Synthetic DNA
taatacctcacactaaag

SEQ ID NO: 31613 - DNA, 18 bp, Artificial Sequence
  Synthetic DNA
taatacgaacctctaaag

SEQ ID NO: 31614 - DNA, 18 bp, Artificial Sequence
  Synthetic DNA
taatacgactaacattcg

SEQ ID NO: 31615 - DNA, 18 bp, Artificial Sequence
  Synthetic DNA
taatacgactcacatagg

SEQ ID NO: 31616 - DNA, 18 bp, Artificial Sequence
  Synthetic DNA
taatacgactcctaatcg

SEQ ID NO: 31617 - DNA, 18 bp, Artificial Sequence
  Synthetic DNA
taatacgactctacaaag

SEQ ID NO: 31618 - DNA, 18 bp, Artificial Sequence
  Synthetic DNA
taatacgatactgtatag

SEQ ID NO: 31619 - DNA, 18 bp, Artificial Sequence
  Synthetic DNA
taatacgattctgtttag

SEQ ID NO: 31620 - DNA, 18 bp, Artificial Sequence
  Synthetic DNA
taatacggatctttatag

SEQ ID NO: 31621 - DNA, 18 bp, Artificial Sequence
  Synthetic DNA
taatacgtcacaccttag

SEQ ID NO: 31622 - DNA, 18 bp, Artificial Sequence
  Synthetic DNA
taatacgtcacagtaaag

SEQ ID NO: 31623 - DNA, 18 bp, Artificial Sequence
  Synthetic DNA
taatacgtcttatcatag

SEQ ID NO: 31624 - DNA, 18 bp, Artificial Sequence
  Synthetic DNA
taatacgtttaaatatag

SEQ ID NO: 31625 - DNA, 18 bp, Artificial Sequence
  Synthetic DNA
taatacgtttcacttcag

SEQ ID NO: 31626 - DNA, 18 bp, Artificial Sequence
  Synthetic DNA
taatacgtttcccaatag

SEQ ID NO: 31627 - DNA, 18 bp, Artificial Sequence
  Synthetic DNA
taatactactaattaaag

SEQ ID NO: 31628 - DNA, 18 bp, Artificial Sequence
  Synthetic DNA
taatactattaactttag

SEQ ID NO: 31629 - DNA, 18 bp, Artificial Sequence
  Synthetic DNA
taatacttctctctatcg

SEQ ID NO: 31630 - DNA, 18 bp, Artificial Sequence
  Synthetic DNA
taatacttcttactctag

SEQ ID NO: 31631 - DNA, 18 bp, Artificial Sequence
  Synthetic DNA
taatataaatctctatag

SEQ ID NO: 31632 - DNA, 18 bp, Artificial Sequence
  Synthetic DNA
taatataacacaccatag

SEQ ID NO: 31633 - DNA, 18 bp, Artificial Sequence
  Synthetic DNA
taatatgactgtctaaag

SEQ ID NO: 31634 - DNA, 18 bp, Artificial Sequence
  Synthetic DNA
taatatgtcacactaaag

SEQ ID NO: 31635 - DNA, 18 bp, Artificial Sequence
  Synthetic DNA
taatccgattcacaaaag

SEQ ID NO: 31636 - DNA, 18 bp, Artificial Sequence
  Synthetic DNA
taatctgacttacaatag

SEQ ID NO: 31637 - DNA, 18 bp, Artificial Sequence
  Synthetic DNA
taatgcgactaacattag

SEQ ID NO: 31638 - DNA, 18 bp, Artificial Sequence
  Synthetic DNA
taatgcgactcattttcg

SEQ ID NO: 31639 - DNA, 18 bp, Artificial Sequence
  Synthetic DNA
taatgcgtttcactaaag

SEQ ID NO: 31640 - DNA, 18 bp, Artificial Sequence
  Synthetic DNA
taatgctactccctttag

SEQ ID NO: 31641 - DNA, 18 bp, Artificial Sequence
  Synthetic DNA
taatgtgactttctatag

SEQ ID NO: 31642 - DNA, 18 bp, Artificial Sequence
  Synthetic DNA
tacagcgactcactaaag

SEQ ID NO: 31643 - DNA, 18 bp, Artificial Sequence
  Synthetic DNA
tactaagacttaccatag

SEQ ID NO: 31644 - DNA, 18 bp, Artificial Sequence
  Synthetic DNA
tactacaactgaatatag

SEQ ID NO: 31645 - DNA, 18 bp, Artificial Sequence
  Synthetic DNA
tactacgactcaattaag

SEQ ID NO: 31646 - DNA, 18 bp, Artificial Sequence
  Synthetic DNA
tactacggcctactatag

SEQ ID NO: 31647 - DNA, 18 bp, Artificial Sequence
  Synthetic DNA
tactatgacacacaatag

SEQ ID NO: 31648 - DNA, 18 bp, Artificial Sequence
  Synthetic DNA
tagtacaaatctctatag

SEQ ID NO: 31649 - DNA, 18 bp, Artificial Sequence
  Synthetic DNA
tataacgactcaataaag

SEQ ID NO: 31650 - DNA, 18 bp, Artificial Sequence
  Synthetic DNA
tataacgactctccatag

SEQ ID NO: 31651 - DNA, 18 bp, Artificial Sequence
  Synthetic DNA
tataacgatccactatag

SEQ ID NO: 31652 - DNA, 18 bp, Artificial Sequence
  Synthetic DNA
tatcacgacccacgatag

SEQ ID NO: 31653 - DNA, 18 bp, Artificial Sequence
  Synthetic DNA
tatcacgactcattacag

SEQ ID NO: 31654 - DNA, 18 bp, Artificial Sequence
  Synthetic DNA
tatcacgactctatatag

SEQ ID NO: 31655 - DNA, 18 bp, Artificial Sequence
  Synthetic DNA
tatcacgtctctctatag

SEQ ID NO: 31656 - DNA, 18 bp, Artificial Sequence
  Synthetic DNA
tattaaaactcactttag

SEQ ID NO: 31657 - DNA, 18 bp, Artificial Sequence
  Synthetic DNA
tattaagattcaccatag

SEQ ID NO: 31658 - DNA, 18 bp, Artificial Sequence
  Synthetic DNA
tattaagattcactagag

SEQ ID NO: 31659 - DNA, 18 bp, Artificial Sequence
  Synthetic DNA
tattacaactaattatag

SEQ ID NO: 31660 - DNA, 18 bp, Artificial Sequence
  Synthetic DNA
tattacgaatcaataaag

SEQ ID NO: 31661 - DNA, 18 bp, Artificial Sequence
  Synthetic DNA
tattacgacacagtttag

SEQ ID NO: 31662 - DNA, 18 bp, Artificial Sequence
  Synthetic DNA
tattacgactaattgtag

SEQ ID NO: 31663 - DNA, 18 bp, Artificial Sequence
  Synthetic DNA
tattacgattcattttag

SEQ ID NO: 31664 - DNA, 18 bp, Artificial Sequence
  Synthetic DNA
tattacgtcacactgtag

SEQ ID NO: 31665 - DNA, 18 bp, Artificial Sequence
  Synthetic DNA
tattacgtctcaccttag

SEQ ID NO: 31666 - DNA, 18 bp, Artificial Sequence
  Synthetic DNA
tattactactcataatag

SEQ ID NO: 31667 - DNA, 18 bp, Artificial Sequence
  Synthetic DNA
tattaggaatcacaatag

SEQ ID NO: 31668 - DNA, 18 bp, Artificial Sequence
  Synthetic DNA
tattatgacacactaaag

SEQ ID NO: 31669 - DNA, 18 bp, Artificial Sequence
  Synthetic DNA
tattatgactctctaaag

SEQ ID NO: 31670 - DNA, 18 bp, Artificial Sequence
  Synthetic DNA
tattccgatacactatag

SEQ ID NO: 31671 - DNA, 18 bp, Artificial Sequence
  Synthetic DNA
tattgcgactgattatag

SEQ ID NO: 31672 - DNA, 18 bp, Artificial Sequence
  Synthetic DNA
tcacacgtctcactaaag

SEQ ID NO: 31673 - DNA, 18 bp, Artificial Sequence
  Synthetic DNA
tcatacgacacaaaatag

SEQ ID NO: 31674 - DNA, 18 bp, Artificial Sequence
  Synthetic DNA
tcatacgacacacaatcg

SEQ ID NO: 31675 - DNA, 18 bp, Artificial Sequence
  Synthetic DNA
tcatacgattaactttag

SEQ ID NO: 31676 - DNA, 18 bp, Artificial Sequence
  Synthetic DNA
tcatacgtctctcaatag

SEQ ID NO: 31677 - DNA, 18 bp, Artificial Sequence
  Synthetic DNA
tgaaatgactctctatag

SEQ ID NO: 31678 - DNA, 18 bp, Artificial Sequence
  Synthetic DNA
tgacacgacttaatatag

SEQ ID NO: 31679 - DNA, 18 bp, Artificial Sequence
  Synthetic DNA
ttaaaagacttactatag

SEQ ID NO: 31680 - DNA, 18 bp, Artificial Sequence
  Synthetic DNA
ttaaacgtctcacaatag

SEQ ID NO: 31681 - DNA, 18 bp, Artificial Sequence
  Synthetic DNA
ttaagcgactcacaatag

SEQ ID NO: 31682 - DNA, 18 bp, Artificial Sequence
  Synthetic DNA
ttataatactcaccatag

SEQ ID NO: 31683 - DNA, 18 bp, Artificial Sequence
  Synthetic DNA
ttatacccctcaatatag

SEQ ID NO: 31684 - DNA, 18 bp, Artificial Sequence
  Synthetic DNA
ttatacgaaccactttag

SEQ ID NO: 31685 - DNA, 18 bp, Artificial Sequence
  Synthetic DNA
ttatacgaatcaatttag

SEQ ID NO: 31686 - DNA, 18 bp, Artificial Sequence
  Synthetic DNA
ttatacgacatattatag

SEQ ID NO: 31687 - DNA, 18 bp, Artificial Sequence
  Synthetic DNA
ttatacgactaaatatcg

SEQ ID NO: 31688 - DNA, 18 bp, Artificial Sequence
  Synthetic DNA
ttatacgcttcactaaag

SEQ ID NO: 31689 - DNA, 18 bp, Artificial Sequence
  Synthetic DNA
ttatacggctcacaaaag

SEQ ID NO: 31690 - DNA, 18 bp, Artificial Sequence
  Synthetic DNA
ttatatgaatcactttag

SEQ ID NO: 31691 - DNA, 18 bp, Artificial Sequence
  Synthetic DNA
ttatcagactcactatcg

SEQ ID NO: 31692 - DNA, 18 bp, Artificial Sequence
  Synthetic DNA
ttatcggactcaatatag

SEQ ID NO: 31693 - DNA, 18 bp, Artificial Sequence
  Synthetic DNA
tttaacgactccctatag

SEQ ID NO: 31694 - DNA, 18 bp, Artificial Sequence
  Synthetic DNA
ttttacgactcagcatag

SEQ ID NO: 31695 - DNA, 18 bp, Artificial Sequence
  Synthetic DNA
ttttacgattcacgatag

SEQ ID NO: 31696 - DNA, 18 bp, Artificial Sequence
  Synthetic DNA
ttttactactcacaatag

SEQ ID NO: 31697 - DNA, 18 bp, Artificial Sequence
  Synthetic DNA
ttttccgacacactatag

SEQ ID NO: 31698 - DNA, 18 bp, Artificial Sequence
  Synthetic DNA
ttttgcgacacactatag

SEQ ID NO: 31699 - DNA, 18 bp, Artificial Sequence
  Synthetic DNA
ttttgcgactcaatatag

SEQ ID NO: 31700 - DNA, 18 bp, Artificial Sequence
  Synthetic DNA
ttttgtgactcactatag

SEQ ID NO: 31701 - DNA, 18 bp, Artificial Sequence
  Synthetic DNA
taataagtctcacttttg

SEQ ID NO: 31702 - DNA, 18 bp, Artificial Sequence
  Synthetic DNA
taattcgactttctttag

SEQ ID NO: 31703 - DNA, 18 bp, Artificial Sequence
  Synthetic DNA
ttattcaactcactttag

SEQ ID NO: 31704 - DNA, 18 bp, Artificial Sequence
  Synthetic DNA
taaaactactctcaatag

SEQ ID NO: 31705 - DNA, 18 bp, Artificial Sequence
  Synthetic DNA
tattaagtctcacaatag

SEQ ID NO: 31706 - DNA, 18 bp, Artificial Sequence
  Synthetic DNA
ttatacgaatcacttaag

SEQ ID NO: 31707 - DNA, 18 bp, Artificial Sequence
  Synthetic DNA
ctattcgactcactctag

SEQ ID NO: 31708 - DNA, 18 bp, Artificial Sequence
  Synthetic DNA
taatacaaatcacttttg

SEQ ID NO: 31709 - DNA, 18 bp, Artificial Sequence
  Synthetic DNA
taatacgactatcttttg

SEQ ID NO: 31710 - DNA, 18 bp, Artificial Sequence
  Synthetic DNA
taatattactctctattg

SEQ ID NO: 31711 - DNA, 18 bp, Artificial Sequence
  Synthetic DNA
taattctacttactttag

SEQ ID NO: 31712 - DNA, 18 bp, Artificial Sequence
  Synthetic DNA
tattacgactaattattg

SEQ ID NO: 31713 - DNA, 18 bp, Artificial Sequence
  Synthetic DNA
tcatacaactcacttttg

SEQ ID NO: 31714 - DNA, 18 bp, Artificial Sequence
  Synthetic DNA
ttattcgtctcacaatag

SEQ ID NO: 31715 - DNA, 18 bp, Artificial Sequence
  Synthetic DNA
ttattcgtttcactatag

SEQ ID NO: 31716 - DNA, 18 bp, Artificial Sequence
  Synthetic DNA
atttacgactcacaatag

SEQ ID NO: 31717 - DNA, 18 bp, Artificial Sequence
  Synthetic DNA
taatacataacactatag

SEQ ID NO: 31718 - DNA, 18 bp, Artificial Sequence
  Synthetic DNA
taatacgtattactaaag

SEQ ID NO: 31719 - DNA, 18 bp, Artificial Sequence
  Synthetic DNA
tattactactaactttag

SEQ ID NO: 31720 - DNA, 18 bp, Artificial Sequence
  Synthetic DNA
ttatacgtcacactattg

SEQ ID NO: 31721 - DNA, 18 bp, Artificial Sequence
  Synthetic DNA
aatttcgtctcactatag

SEQ ID NO: 31722 - DNA, 18 bp, Artificial Sequence
  Synthetic DNA
atatacgactcacaattg

SEQ ID NO: 31723 - DNA, 18 bp, Artificial Sequence
  Synthetic DNA
aaatacgtctcacttaag

SEQ ID NO: 31724 - DNA, 18 bp, Artificial Sequence
  Synthetic DNA
taatacgtcacacaaaag

SEQ ID NO: 31725 - DNA, 18 bp, Artificial Sequence
  Synthetic DNA
ttaaacgtctctctatag

SEQ ID NO: 31726 - DNA, 18 bp, Artificial Sequence
  Synthetic DNA
ttatacgtcttactattg

SEQ ID NO: 31727 - DNA, 18 bp, Artificial Sequence
  Synthetic DNA
tttttcgactcacaatag

SEQ ID NO: 31728 - DNA, 18 bp, Artificial Sequence
  Synthetic DNA
taatacgattctccaaag

SEQ ID NO: 31729 - DNA, 18 bp, Artificial Sequence
  Synthetic DNA
taatacgtctcgatattg

SEQ ID NO: 31730 - DNA, 18 bp, Artificial Sequence
  Synthetic DNA
taatacgtctcgcttttg

SEQ ID NO: 31731 - DNA, 18 bp, Artificial Sequence
  Synthetic DNA
taattaggctcactattg

SEQ ID NO: 31732 - DNA, 18 bp, Artificial Sequence
  Synthetic DNA
tatttcgaatcactattg

SEQ ID NO: 31733 - DNA, 18 bp, Artificial Sequence
  Synthetic DNA
aaacacgactctctattg

SEQ ID NO: 31734 - DNA, 18 bp, Artificial Sequence
  Synthetic DNA
aaatacgattcactgttg

SEQ ID NO: 31735 - DNA, 18 bp, Artificial Sequence
  Synthetic DNA
aaatacgattctctattg

SEQ ID NO: 31736 - DNA, 18 bp, Artificial Sequence
  Synthetic DNA
aaattcgacccactttag

SEQ ID NO: 31737 - DNA, 18 bp, Artificial Sequence
  Synthetic DNA
aaattcgactcaacatag

SEQ ID NO: 31738 - DNA, 18 bp, Artificial Sequence
  Synthetic DNA
taaaaagactctctattg

SEQ ID NO: 31739 - DNA, 18 bp, Artificial Sequence
  Synthetic DNA
taaatcaactcactacag

SEQ ID NO: 31740 - DNA, 18 bp, Artificial Sequence
  Synthetic DNA
taaatcgacacacaatag

SEQ ID NO: 31741 - DNA, 18 bp, Artificial Sequence
  Synthetic DNA
taaatcgactcaataaag

SEQ ID NO: 31742 - DNA, 18 bp, Artificial Sequence
  Synthetic DNA
taaatcgacttacaatag

SEQ ID NO: 31743 - DNA, 18 bp, Artificial Sequence
  Synthetic DNA
taaatcgagtcactttag

SEQ ID NO: 31744 - DNA, 18 bp, Artificial Sequence
  Synthetic DNA
taaatcgtctaactatag

SEQ ID NO: 31745 - DNA, 18 bp, Artificial Sequence
  Synthetic DNA
taacacgactcaccactg

SEQ ID NO: 31746 - DNA, 18 bp, Artificial Sequence
  Synthetic DNA
taacacgactcataattg

SEQ ID NO: 31747 - DNA, 18 bp, Artificial Sequence
  Synthetic DNA
taactcgcttcactatag

SEQ ID NO: 31748 - DNA, 18 bp, Artificial Sequence
  Synthetic DNA
taataaaactcactaatg

SEQ ID NO: 31749 - DNA, 18 bp, Artificial Sequence
  Synthetic DNA
taataagattcacttttg

SEQ ID NO: 31750 - DNA, 18 bp, Artificial Sequence
  Synthetic DNA
taataatcctcactattg

SEQ ID NO: 31751 - DNA, 18 bp, Artificial Sequence
  Synthetic DNA
taatacaactcacttatg

SEQ ID NO: 31752 - DNA, 18 bp, Artificial Sequence
  Synthetic DNA
taatacagctccctattg

SEQ ID NO: 31753 - DNA, 18 bp, Artificial Sequence
  Synthetic DNA
taatacctatcactattg

SEQ ID NO: 31754 - DNA, 18 bp, Artificial Sequence
  Synthetic DNA
taatacgacactctgttg

SEQ ID NO: 31755 - DNA, 18 bp, Artificial Sequence
  Synthetic DNA
taatacgactagcttaag

SEQ ID NO: 31756 - DNA, 18 bp, Artificial Sequence
  Synthetic DNA
taatacgatccacaattg

SEQ ID NO: 31757 - DNA, 18 bp, Artificial Sequence
  Synthetic DNA
taatacgtctcactgatg

SEQ ID NO: 31758 - DNA, 18 bp, Artificial Sequence
  Synthetic DNA
taatactacgcaccattg

SEQ ID NO: 31759 - DNA, 18 bp, Artificial Sequence
  Synthetic DNA
taatactactcacatttg

SEQ ID NO: 31760 - DNA, 18 bp, Artificial Sequence
  Synthetic DNA
taataggactctctaatg

SEQ ID NO: 31761 - DNA, 18 bp, Artificial Sequence
  Synthetic DNA
taatatgacttacaattg

SEQ ID NO: 31762 - DNA, 18 bp, Artificial Sequence
  Synthetic DNA
taattagacacactatcg

SEQ ID NO: 31763 - DNA, 18 bp, Artificial Sequence
  Synthetic DNA
taattagaccaactatag

SEQ ID NO: 31764 - DNA, 18 bp, Artificial Sequence
  Synthetic DNA
taattagactcacaacag

SEQ ID NO: 31765 - DNA, 18 bp, Artificial Sequence
  Synthetic DNA
taattagactcaccaaag

SEQ ID NO: 31766 - DNA, 18 bp, Artificial Sequence
  Synthetic DNA
taattagacttaatatag

SEQ ID NO: 31767 - DNA, 18 bp, Artificial Sequence
  Synthetic DNA
taattatacacactatag

SEQ ID NO: 31768 - DNA, 18 bp, Artificial Sequence
  Synthetic DNA
taattccattcattatag

SEQ ID NO: 31769 - DNA, 18 bp, Artificial Sequence
  Synthetic DNA
taattcgactcaaaacag

SEQ ID NO: 31770 - DNA, 18 bp, Artificial Sequence
  Synthetic DNA
taattcgcctttctatag

SEQ ID NO: 31771 - DNA, 18 bp, Artificial Sequence
  Synthetic DNA
taattctactaactttag

SEQ ID NO: 31772 - DNA, 18 bp, Artificial Sequence
  Synthetic DNA
taattggactcacgaaag

SEQ ID NO: 31773 - DNA, 18 bp, Artificial Sequence
  Synthetic DNA
taatttgaatcactttag

SEQ ID NO: 31774 - DNA, 18 bp, Artificial Sequence
  Synthetic DNA
taattttacacactatag

SEQ ID NO: 31775 - DNA, 18 bp, Artificial Sequence
  Synthetic DNA
tacaacgacccactattg

SEQ ID NO: 31776 - DNA, 18 bp, Artificial Sequence
  Synthetic DNA
tactacgactcgcaatgg

SEQ ID NO: 31777 - DNA, 18 bp, Artificial Sequence
  Synthetic DNA
tactacgtctcacaattg

SEQ ID NO: 31778 - DNA, 18 bp, Artificial Sequence
  Synthetic DNA
tacttcaattcactatag

SEQ ID NO: 31779 - DNA, 18 bp, Artificial Sequence
  Synthetic DNA
tagaacgactaactattg

SEQ ID NO: 31780 - DNA, 18 bp, Artificial Sequence
  Synthetic DNA
tatcacgactcactcttg

SEQ ID NO: 31781 - DNA, 18 bp, Artificial Sequence
  Synthetic DNA
tattacgattaactattg

SEQ ID NO: 31782 - DNA, 18 bp, Artificial Sequence
  Synthetic DNA
tattatgactcaccattg

SEQ ID NO: 31783 - DNA, 18 bp, Artificial Sequence
  Synthetic DNA
tatttatactcactatag

SEQ ID NO: 31784 - DNA, 18 bp, Artificial Sequence
  Synthetic DNA
tatttcaactcaatatag

SEQ ID NO: 31785 - DNA, 18 bp, Artificial Sequence
  Synthetic DNA
tatttcgattcaatatag

SEQ ID NO: 31786 - DNA, 18 bp, Artificial Sequence
  Synthetic DNA
tatttcgtgtcactatag

SEQ ID NO: 31787 - DNA, 18 bp, Artificial Sequence
  Synthetic DNA
tatttctactgactatag

SEQ ID NO: 31788 - DNA, 18 bp, Artificial Sequence
  Synthetic DNA
tcaaaagactcactattg

SEQ ID NO: 31789 - DNA, 18 bp, Artificial Sequence
  Synthetic DNA
tcataagactcacaattg

SEQ ID NO: 31790 - DNA, 18 bp, Artificial Sequence
  Synthetic DNA
tcatacgtctcactagtg

SEQ ID NO: 31791 - DNA, 18 bp, Artificial Sequence
  Synthetic DNA
tctttcgactctctatag

SEQ ID NO: 31792 - DNA, 18 bp, Artificial Sequence
  Synthetic DNA
tgatacaactcacaattg

SEQ ID NO: 31793 - DNA, 18 bp, Artificial Sequence
  Synthetic DNA
tgtttcgactcattatag

SEQ ID NO: 31794 - DNA, 18 bp, Artificial Sequence
  Synthetic DNA
ttataagattcactattg

SEQ ID NO: 31795 - DNA, 18 bp, Artificial Sequence
  Synthetic DNA
ttattcaactcactaaag

SEQ ID NO: 31796 - DNA, 18 bp, Artificial Sequence
  Synthetic DNA
ttattcgaatcactaaag

SEQ ID NO: 31797 - DNA, 18 bp, Artificial Sequence
  Synthetic DNA
ttattcgagtaactatag

SEQ ID NO: 31798 - DNA, 18 bp, Artificial Sequence
  Synthetic DNA
ttattcgattcactgtag

SEQ ID NO: 31799 - DNA, 18 bp, Artificial Sequence
  Synthetic DNA
aaaaacgaatctctatag

SEQ ID NO: 31800 - DNA, 18 bp, Artificial Sequence
  Synthetic DNA
aaagacgattcactaaag

SEQ ID NO: 31801 - DNA, 18 bp, Artificial Sequence
  Synthetic DNA
aaataagacacactaaag

SEQ ID NO: 31802 - DNA, 18 bp, Artificial Sequence
  Synthetic DNA
aaatacgacacacattag

SEQ ID NO: 31803 - DNA, 18 bp, Artificial Sequence
  Synthetic DNA
aaatacgactcattgtcg

SEQ ID NO: 31804 - DNA, 18 bp, Artificial Sequence
  Synthetic DNA
aaatccgacacactacag

SEQ ID NO: 31805 - DNA, 18 bp, Artificial Sequence
  Synthetic DNA
aaatccgacactctatag

SEQ ID NO: 31806 - DNA, 18 bp, Artificial Sequence
  Synthetic DNA
aaatgctaatcactatag

SEQ ID NO: 31807 - DNA, 18 bp, Artificial Sequence
  Synthetic DNA
aactacaattcactatag

SEQ ID NO: 31808 - DNA, 18 bp, Artificial Sequence
  Synthetic DNA
aattacgactcacactag

SEQ ID NO: 31809 - DNA, 18 bp, Artificial Sequence
  Synthetic DNA
aattacgactttctatag

SEQ ID NO: 31810 - DNA, 18 bp, Artificial Sequence
  Synthetic DNA
aattacgtctcacaatag

SEQ ID NO: 31811 - DNA, 18 bp, Artificial Sequence
  Synthetic DNA
aattaggtctcactatag

SEQ ID NO: 31812 - DNA, 18 bp, Artificial Sequence
  Synthetic DNA
atatacaactcactatcg

SEQ ID NO: 31813 - DNA, 18 bp, Artificial Sequence
  Synthetic DNA
atatacgacacactctag

SEQ ID NO: 31814 - DNA, 18 bp, Artificial Sequence
  Synthetic DNA
atttacgacttactatag

SEQ ID NO: 31815 - DNA, 18 bp, Artificial Sequence
  Synthetic DNA
caataagactcaatttag

SEQ ID NO: 31816 - DNA, 18 bp, Artificial Sequence
  Synthetic DNA
caatacgactccttaaag

SEQ ID NO: 31817 - DNA, 18 bp, Artificial Sequence
  Synthetic DNA
caatacgattaactaaag

SEQ ID NO: 31818 - DNA, 18 bp, Artificial Sequence
  Synthetic DNA
cattacaactccctatag

SEQ ID NO: 31819 - DNA, 18 bp, Artificial Sequence
  Synthetic DNA
taaaacgaatcactgaag

SEQ ID NO: 31820 - DNA, 18 bp, Artificial Sequence
  Synthetic DNA
taaaacgacaaactaaag

SEQ ID NO: 31821 - DNA, 18 bp, Artificial Sequence
  Synthetic DNA
taaaacgactcaaaaaag

SEQ ID NO: 31822 - DNA, 18 bp, Artificial Sequence
  Synthetic DNA
taaaacgactcacattgg

SEQ ID NO: 31823 - DNA, 18 bp, Artificial Sequence
  Synthetic DNA
taaaacgactgacactag

SEQ ID NO: 31824 - DNA, 18 bp, Artificial Sequence
  Synthetic DNA
taaaacgagtctcaatag

SEQ ID NO: 31825 - DNA, 18 bp, Artificial Sequence
  Synthetic DNA
taaaatgactctatatag

SEQ ID NO: 31826 - DNA, 18 bp, Artificial Sequence
  Synthetic DNA
taaacagactctctatag

SEQ ID NO: 31827 - DNA, 18 bp, Artificial Sequence
  Synthetic DNA
taaaccgtctaactatag

SEQ ID NO: 31828 - DNA, 18 bp, Artificial Sequence
  Synthetic DNA
taacaagacacactttag

SEQ ID NO: 31829 - DNA, 18 bp, Artificial Sequence
  Synthetic DNA
taacacggttcactttag

SEQ ID NO: 31830 - DNA, 18 bp, Artificial Sequence
  Synthetic DNA
taacacgtcacactttag

SEQ ID NO: 31831 - DNA, 18 bp, Artificial Sequence
  Synthetic DNA
taacataactcaatatag

SEQ ID NO: 31832 - DNA, 18 bp, Artificial Sequence
  Synthetic DNA
taataacactctctttag

SEQ ID NO: 31833 - DNA, 18 bp, Artificial Sequence
  Synthetic DNA
taatacatctccctatgg

SEQ ID NO: 31834 - DNA, 18 bp, Artificial Sequence
  Synthetic DNA
taataccactaccaatag

SEQ ID NO: 31835 - DNA, 18 bp, Artificial Sequence
  Synthetic DNA
taatacgaaacaataaag

SEQ ID NO: 31836 - DNA, 18 bp, Artificial Sequence
  Synthetic DNA
taatacgaatcccttaag

SEQ ID NO: 31837 - DNA, 18 bp, Artificial Sequence
  Synthetic DNA
taatacgacataaaatag

SEQ ID NO: 31838 - DNA, 18 bp, Artificial Sequence
  Synthetic DNA
taatacgacattcaatag

SEQ ID NO: 31839 - DNA, 18 bp, Artificial Sequence
  Synthetic DNA
taatacgactcattacct

SEQ ID NO: 31840 - DNA, 18 bp, Artificial Sequence
  Synthetic DNA
taatacgactccattaag

SEQ ID NO: 31841 - DNA, 18 bp, Artificial Sequence
  Synthetic DNA
taatacgacttaaaacag

SEQ ID NO: 31842 - DNA, 18 bp, Artificial Sequence
  Synthetic DNA
taatacgatctattatag

SEQ ID NO: 31843 - DNA, 18 bp, Artificial Sequence
  Synthetic DNA
taatacggctcataaaag

SEQ ID NO: 31844 - DNA, 18 bp, Artificial Sequence
  Synthetic DNA
taatacgtaactctatag

SEQ ID NO: 31845 - DNA, 18 bp, Artificial Sequence
  Synthetic DNA
taatacgtatcacttaag

SEQ ID NO: 31846 - DNA, 18 bp, Artificial Sequence
  Synthetic DNA
taatacgtctatctctag

SEQ ID NO: 31847 - DNA, 18 bp, Artificial Sequence
  Synthetic DNA
taatacgtctgtcaatag

SEQ ID NO: 31848 - DNA, 18 bp, Artificial Sequence
  Synthetic DNA
taatacgtttctctacag

SEQ ID NO: 31849 - DNA, 18 bp, Artificial Sequence
  Synthetic DNA
taatacgtttgaatatag

SEQ ID NO: 31850 - DNA, 18 bp, Artificial Sequence
  Synthetic DNA
taatactaatctctttag

SEQ ID NO: 31851 - DNA, 18 bp, Artificial Sequence
  Synthetic DNA
taatactactcattaagg

SEQ ID NO: 31852 - DNA, 18 bp, Artificial Sequence
  Synthetic DNA
taatactataccctatag

SEQ ID NO: 31853 - DNA, 18 bp, Artificial Sequence
  Synthetic DNA
taatactcctaactaaag

SEQ ID NO: 31854 - DNA, 18 bp, Artificial Sequence
  Synthetic DNA
taataggaatcacaaaag

SEQ ID NO: 31855 - DNA, 18 bp, Artificial Sequence
  Synthetic DNA
taatattactcacttaag

SEQ ID NO: 31856 - DNA, 18 bp, Artificial Sequence
  Synthetic DNA
taatgcgacactctctag

SEQ ID NO: 31857 - DNA, 18 bp, Artificial Sequence
  Synthetic DNA
taatgcgactctccacag

SEQ ID NO: 31858 - DNA, 18 bp, Artificial Sequence
  Synthetic DNA
taatgcgcctcataatag

SEQ ID NO: 31859 - DNA, 18 bp, Artificial Sequence
  Synthetic DNA
taatgctaatcactttag

SEQ ID NO: 31860 - DNA, 18 bp, Artificial Sequence
  Synthetic DNA
taatgtatctcactatag

SEQ ID NO: 31861 - DNA, 18 bp, Artificial Sequence
  Synthetic DNA
tacaacgaataactatag

SEQ ID NO: 31862 - DNA, 18 bp, Artificial Sequence
  Synthetic DNA
tacaatgactcactaaag

SEQ ID NO: 31863 - DNA, 18 bp, Artificial Sequence
  Synthetic DNA
tagaacgtctcactaaag

SEQ ID NO: 31864 - DNA, 18 bp, Artificial Sequence
  Synthetic DNA
tagagcgtctcactatag

SEQ ID NO: 31865 - DNA, 18 bp, Artificial Sequence
  Synthetic DNA
tagtaaaacttactatag

SEQ ID NO: 31866 - DNA, 18 bp, Artificial Sequence
  Synthetic DNA
tagtcagtctcactatag

SEQ ID NO: 31867 - DNA, 18 bp, Artificial Sequence
  Synthetic DNA
tataacgacacaatatag

SEQ ID NO: 31868 - DNA, 18 bp, Artificial Sequence
  Synthetic DNA
tataacgtctaactatag

SEQ ID NO: 31869 - DNA, 18 bp, Artificial Sequence
  Synthetic DNA
tatcacatctcactatag

SEQ ID NO: 31870 - DNA, 18 bp, Artificial Sequence
  Synthetic DNA
tatgacgtttcactatag

SEQ ID NO: 31871 - DNA, 18 bp, Artificial Sequence
  Synthetic DNA
tattaacactcacaatag

SEQ ID NO: 31872 - DNA, 18 bp, Artificial Sequence
  Synthetic DNA
tattaagactcacttaag

SEQ ID NO: 31873 - DNA, 18 bp, Artificial Sequence
  Synthetic DNA
tattacaacatactatag

SEQ ID NO: 31874 - DNA, 18 bp, Artificial Sequence
  Synthetic DNA
tattacatctcactttag

SEQ ID NO: 31875 - DNA, 18 bp, Artificial Sequence
  Synthetic DNA
tattacgacattctatag

SEQ ID NO: 31876 - DNA, 18 bp, Artificial Sequence
  Synthetic DNA
tattacgactttcaatag

SEQ ID NO: 31877 - DNA, 18 bp, Artificial Sequence
  Synthetic DNA
tattacgtatcaatatag

SEQ ID NO: 31878 - DNA, 18 bp, Artificial Sequence
  Synthetic DNA
tattacgtcacaccatag

SEQ ID NO: 31879 - DNA, 18 bp, Artificial Sequence
  Synthetic DNA
tattacgtctacctatag

SEQ ID NO: 31880 - DNA, 18 bp, Artificial Sequence
  Synthetic DNA
tattacgtctcattctag

SEQ ID NO: 31881 - DNA, 18 bp, Artificial Sequence
  Synthetic DNA
tattacgtcttaccatag

SEQ ID NO: 31882 - DNA, 18 bp, Artificial Sequence
  Synthetic DNA
tattactaatcacaatag

SEQ ID NO: 31883 - DNA, 18 bp, Artificial Sequence
  Synthetic DNA
tattataactctctatag

SEQ ID NO: 31884 - DNA, 18 bp, Artificial Sequence
  Synthetic DNA
tattatgactcacaacag

SEQ ID NO: 31885 - DNA, 18 bp, Artificial Sequence
  Synthetic DNA
tattattactctctatag

SEQ ID NO: 31886 - DNA, 18 bp, Artificial Sequence
  Synthetic DNA
tattctgactctctatag

SEQ ID NO: 31887 - DNA, 18 bp, Artificial Sequence
  Synthetic DNA
tattgcgactctctatgg

SEQ ID NO: 31888 - DNA, 18 bp, Artificial Sequence
  Synthetic DNA
tattgcgtctctctatag

SEQ ID NO: 31889 - DNA, 18 bp, Artificial Sequence
  Synthetic DNA
tcaaacgactcacaaaag

SEQ ID NO: 31890 - DNA, 18 bp, Artificial Sequence
  Synthetic DNA
tcataagtcttactatag

SEQ ID NO: 31891 - DNA, 18 bp, Artificial Sequence
  Synthetic DNA
tcataccattcactttag

SEQ ID NO: 31892 - DNA, 18 bp, Artificial Sequence
  Synthetic DNA
tcatacgtttcacaatag

SEQ ID NO: 31893 - DNA, 18 bp, Artificial Sequence
  Synthetic DNA
tcatactactgtctatag

SEQ ID NO: 31894 - DNA, 18 bp, Artificial Sequence
  Synthetic DNA
tcttacgtctcactttag

SEQ ID NO: 31895 - DNA, 18 bp, Artificial Sequence
  Synthetic DNA
tgatactactcaccaaag

SEQ ID NO: 31896 - DNA, 18 bp, Artificial Sequence
  Synthetic DNA
tgttacgactcaatatcg

SEQ ID NO: 31897 - DNA, 18 bp, Artificial Sequence
  Synthetic DNA
tgttacgactgtctatag

SEQ ID NO: 31898 - DNA, 18 bp, Artificial Sequence
  Synthetic DNA
ttaaacgagtcattatag

SEQ ID NO: 31899 - DNA, 18 bp, Artificial Sequence
  Synthetic DNA
ttaaactagtcactatag

SEQ ID NO: 31900 - DNA, 18 bp, Artificial Sequence
  Synthetic DNA
ttaaaggattcactatag

SEQ ID NO: 31901 - DNA, 18 bp, Artificial Sequence
  Synthetic DNA
ttataagacacactttag

SEQ ID NO: 31902 - DNA, 18 bp, Artificial Sequence
  Synthetic DNA
ttatacaactcactaagg

SEQ ID NO: 31903 - DNA, 18 bp, Artificial Sequence
  Synthetic DNA
ttatacaatacactatag

SEQ ID NO: 31904 - DNA, 18 bp, Artificial Sequence
  Synthetic DNA
ttatacacctcactaaag

SEQ ID NO: 31905 - DNA, 18 bp, Artificial Sequence
  Synthetic DNA
ttataccacactctatag

SEQ ID NO: 31906 - DNA, 18 bp, Artificial Sequence
  Synthetic DNA
ttatacgacacactttcg

SEQ ID NO: 31907 - DNA, 18 bp, Artificial Sequence
  Synthetic DNA
ttatacgactcatcaaag

SEQ ID NO: 31908 - DNA, 18 bp, Artificial Sequence
  Synthetic DNA
ttatacgactccctaagg

SEQ ID NO: 31909 - DNA, 18 bp, Artificial Sequence
  Synthetic DNA
ttatacgatacactatcg

SEQ ID NO: 31910 - DNA, 18 bp, Artificial Sequence
  Synthetic DNA
ttatacgattcacaatgg

SEQ ID NO: 31911 - DNA, 18 bp, Artificial Sequence
  Synthetic DNA
ttatactacacattatag

SEQ ID NO: 31912 - DNA, 18 bp, Artificial Sequence
  Synthetic DNA
ttatactactcaatttag

SEQ ID NO: 31913 - DNA, 18 bp, Artificial Sequence
  Synthetic DNA
ttatactactcacaacag

SEQ ID NO: 31914 - DNA, 18 bp, Artificial Sequence
  Synthetic DNA
ttatactactcacactag

SEQ ID NO: 31915 - DNA, 18 bp, Artificial Sequence
  Synthetic DNA
ttatattaatcactatag

SEQ ID NO: 31916 - DNA, 18 bp, Artificial Sequence
  Synthetic DNA
ttatattattcactatag

SEQ ID NO: 31917 - DNA, 18 bp, Artificial Sequence
  Synthetic DNA
ttatcagactccctatag

SEQ ID NO: 31918 - DNA, 18 bp, Artificial Sequence
  Synthetic DNA
ttatccgaatcactctag

SEQ ID NO: 31919 - DNA, 18 bp, Artificial Sequence
  Synthetic DNA
ttatgagactcattatag

SEQ ID NO: 31920 - DNA, 18 bp, Artificial Sequence
  Synthetic DNA
ttatgcgactctctaaag

SEQ ID NO: 31921 - DNA, 18 bp, Artificial Sequence
  Synthetic DNA
ttcaacgaatcactatag

SEQ ID NO: 31922 - DNA, 18 bp, Artificial Sequence
  Synthetic DNA
ttctacaactcaatatag

SEQ ID NO: 31923 - DNA, 18 bp, Artificial Sequence
  Synthetic DNA
ttctacgactaactaaag

SEQ ID NO: 31924 - DNA, 18 bp, Artificial Sequence
  Synthetic DNA
ttgaacgacttactatag

SEQ ID NO: 31925 - DNA, 18 bp, Artificial Sequence
  Synthetic DNA
ttgtacgactctttatag

SEQ ID NO: 31926 - DNA, 18 bp, Artificial Sequence
  Synthetic DNA
aatttcgactcactttag

SEQ ID NO: 31927 - DNA, 18 bp, Artificial Sequence
  Synthetic DNA
atatacgactcaatattg

SEQ ID NO: 31928 - DNA, 18 bp, Artificial Sequence
  Synthetic DNA
aaattcgaatcactattg

SEQ ID NO: 31929 - DNA, 18 bp, Artificial Sequence
  Synthetic DNA
taattcttctcactattg

SEQ ID NO: 31930 - DNA, 18 bp, Artificial Sequence
  Synthetic DNA
taaaacgactaacttttg

SEQ ID NO: 31931 - DNA, 18 bp, Artificial Sequence
  Synthetic DNA
taatacgtttctctattg

SEQ ID NO: 31932 - DNA, 18 bp, Artificial Sequence
  Synthetic DNA
taattcgtctctcaatag

SEQ ID NO: 31933 - DNA, 18 bp, Artificial Sequence
  Synthetic DNA
taatttttctcactatag

SEQ ID NO: 31934 - DNA, 18 bp, Artificial Sequence
  Synthetic DNA
tatttcgactcacactag

SEQ ID NO: 31935 - DNA, 18 bp, Artificial Sequence
  Synthetic DNA
aaaaacgacacactaaag

SEQ ID NO: 31936 - DNA, 18 bp, Artificial Sequence
  Synthetic DNA
aaatactactctcaatag

SEQ ID NO: 31937 - DNA, 18 bp, Artificial Sequence
  Synthetic DNA
taatacgactcttattag

SEQ ID NO: 31938 - DNA, 18 bp, Artificial Sequence
  Synthetic DNA
tactacgactctttaaag

SEQ ID NO: 31939 - DNA, 18 bp, Artificial Sequence
  Synthetic DNA
tattacgtcttacaatag

SEQ ID NO: 31940 - DNA, 18 bp, Artificial Sequence
  Synthetic DNA
ttatacgcctctatatag

SEQ ID NO: 31941 - DNA, 18 bp, Artificial Sequence
  Synthetic DNA
atatactactcactattg

SEQ ID NO: 31942 - DNA, 18 bp, Artificial Sequence
  Synthetic DNA
ataaacgactcactttag

SEQ ID NO: 31943 - DNA, 18 bp, Artificial Sequence
  Synthetic DNA
taaatcgactctctattg

SEQ ID NO: 31944 - DNA, 18 bp, Artificial Sequence
  Synthetic DNA
taattcagctcactattg

SEQ ID NO: 31945 - DNA, 18 bp, Artificial Sequence
  Synthetic DNA
taattcgaatcattattg

SEQ ID NO: 31946 - DNA, 18 bp, Artificial Sequence
  Synthetic DNA
taattcgtctaactattg

SEQ ID NO: 31947 - DNA, 18 bp, Artificial Sequence
  Synthetic DNA
taattcgtgtcactattg

SEQ ID NO: 31948 - DNA, 18 bp, Artificial Sequence
  Synthetic DNA
taatttgactcgctttag

SEQ ID NO: 31949 - DNA, 18 bp, Artificial Sequence
  Synthetic DNA
tacttcgacacactattg

SEQ ID NO: 31950 - DNA, 18 bp, Artificial Sequence
  Synthetic DNA
tgatacaactcgctattg

SEQ ID NO: 31951 - DNA, 18 bp, Artificial Sequence
  Synthetic DNA
aaacacaactcactattg

SEQ ID NO: 31952 - DNA, 18 bp, Artificial Sequence
  Synthetic DNA
aaataagactcgctttag

SEQ ID NO: 31953 - DNA, 18 bp, Artificial Sequence
  Synthetic DNA
aaatacgattcactactg

SEQ ID NO: 31954 - DNA, 18 bp, Artificial Sequence
  Synthetic DNA
aaatacgtctcaatattg

SEQ ID NO: 31955 - DNA, 18 bp, Artificial Sequence
  Synthetic DNA
aaattcgattcaatatag

SEQ ID NO: 31956 - DNA, 18 bp, Artificial Sequence
  Synthetic DNA
aattacgactctctattg

SEQ ID NO: 31957 - DNA, 18 bp, Artificial Sequence
  Synthetic DNA
acattcgactcactttag

SEQ ID NO: 31958 - DNA, 18 bp, Artificial Sequence
  Synthetic DNA
atatactactcgctatag

SEQ ID NO: 31959 - DNA, 18 bp, Artificial Sequence
  Synthetic DNA
caataggactccctattg

SEQ ID NO: 31960 - DNA, 18 bp, Artificial Sequence
  Synthetic DNA
cattacgactaactattg

SEQ ID NO: 31961 - DNA, 18 bp, Artificial Sequence
  Synthetic DNA
taaaaccattcactattg

SEQ ID NO: 31962 - DNA, 18 bp, Artificial Sequence
  Synthetic DNA
taaaacgactcacatttg

SEQ ID NO: 31963 - DNA, 18 bp, Artificial Sequence
  Synthetic DNA
taaaacgtctcactaatg

SEQ ID NO: 31964 - DNA, 18 bp, Artificial Sequence
  Synthetic DNA
taaaactactcacaattg

SEQ ID NO: 31965 - DNA, 18 bp, Artificial Sequence
  Synthetic DNA
taacaagactcgctttag

SEQ ID NO: 31966 - DNA, 18 bp, Artificial Sequence
  Synthetic DNA
taactcgactcactaagg

SEQ ID NO: 31967 - DNA, 18 bp, Artificial Sequence
  Synthetic DNA
taactcgactccctttag

SEQ ID NO: 31968 - DNA, 18 bp, Artificial Sequence
  Synthetic DNA
taacttgacttactatag

SEQ ID NO: 31969 - DNA, 18 bp, Artificial Sequence
  Synthetic DNA
taataagactctctactg

SEQ ID NO: 31970 - DNA, 18 bp, Artificial Sequence
  Synthetic DNA
taatacatctcactaatg

SEQ ID NO: 31971 - DNA, 18 bp, Artificial Sequence
  Synthetic DNA
taatacgacaccctaatg

SEQ ID NO: 31972 - DNA, 18 bp, Artificial Sequence
  Synthetic DNA
taatacgacatagtattg

SEQ ID NO: 31973 - DNA, 18 bp, Artificial Sequence
  Synthetic DNA
taatacgactagcattag

SEQ ID NO: 31974 - DNA, 18 bp, Artificial Sequence
  Synthetic DNA
taatacgactatctaatg

SEQ ID NO: 31975 - DNA, 18 bp, Artificial Sequence
  Synthetic DNA
taatacgatttcctattg

SEQ ID NO: 31976 - DNA, 18 bp, Artificial Sequence
  Synthetic DNA
taatacggctgaccattg

SEQ ID NO: 31977 - DNA, 18 bp, Artificial Sequence
  Synthetic DNA
taatacgtatcattattg

SEQ ID NO: 31978 - DNA, 18 bp, Artificial Sequence
  Synthetic DNA
taatacgtctcaataatg

SEQ ID NO: 31979 - DNA, 18 bp, Artificial Sequence
  Synthetic DNA
taatacgtctcgcactag

SEQ ID NO: 31980 - DNA, 18 bp, Artificial Sequence
  Synthetic DNA
taatacgtcttacttttg

SEQ ID NO: 31981 - DNA, 18 bp, Artificial Sequence
  Synthetic DNA
taatatgacatactattg

SEQ ID NO: 31982 - DNA, 18 bp, Artificial Sequence
  Synthetic DNA
taatatgacttacttttg

SEQ ID NO: 31983 - DNA, 18 bp, Artificial Sequence
  Synthetic DNA
taatccgactcaataatg

SEQ ID NO: 31984 - DNA, 18 bp, Artificial Sequence
  Synthetic DNA
taatcctactctctattg

SEQ ID NO: 31985 - DNA, 18 bp, Artificial Sequence
  Synthetic DNA
taatgcgattctctattg

SEQ ID NO: 31986 - DNA, 18 bp, Artificial Sequence
  Synthetic DNA
taattcaacttactaaag

SEQ ID NO: 31987 - DNA, 18 bp, Artificial Sequence
  Synthetic DNA
taattcaattcactaaag

SEQ ID NO: 31988 - DNA, 18 bp, Artificial Sequence
  Synthetic DNA
taattcctcacactatag

SEQ ID NO: 31989 - DNA, 18 bp, Artificial Sequence
  Synthetic DNA
taattcgactaactttgg

SEQ ID NO: 31990 - DNA, 18 bp, Artificial Sequence
  Synthetic DNA
taattcgattgactaaag

SEQ ID NO: 31991 - DNA, 18 bp, Artificial Sequence
  Synthetic DNA
taattcggctcacattag

SEQ ID NO: 31992 - DNA, 18 bp, Artificial Sequence
  Synthetic DNA
taattcgtatcactgtag

SEQ ID NO: 31993 - DNA, 18 bp, Artificial Sequence
  Synthetic DNA
taattcgtcacactatgg

SEQ ID NO: 31994 - DNA, 18 bp, Artificial Sequence
  Synthetic DNA
taattcgtcaccctatag

SEQ ID NO: 31995 - DNA, 18 bp, Artificial Sequence
  Synthetic DNA
taattcgtctcaatatgg

SEQ ID NO: 31996 - DNA, 18 bp, Artificial Sequence
  Synthetic DNA
taattcgtcttaatatag

SEQ ID NO: 31997 - DNA, 18 bp, Artificial Sequence
  Synthetic DNA
taattcgtttcactacag

SEQ ID NO: 31998 - DNA, 18 bp, Artificial Sequence
  Synthetic DNA
taatttgagtcactaaag

SEQ ID NO: 31999 - DNA, 18 bp, Artificial Sequence
  Synthetic DNA
tagttcgacacattatag

SEQ ID NO: 32000 - DNA, 18 bp, Artificial Sequence
  Synthetic DNA
tagtttgactcaccatag

SEQ ID NO: 32001 - DNA, 18 bp, Artificial Sequence
  Synthetic DNA
tatctcgacttactatag

SEQ ID NO: 32002 - DNA, 18 bp, Artificial Sequence
  Synthetic DNA
tattacaattcactattg

SEQ ID NO: 32003 - DNA, 18 bp, Artificial Sequence
  Synthetic DNA
tattacgactcaccaatg

SEQ ID NO: 32004 - DNA, 18 bp, Artificial Sequence
  Synthetic DNA
tattacgactctccattg

SEQ ID NO: 32005 - DNA, 18 bp, Artificial Sequence
  Synthetic DNA
tatttcgacacaatatag

SEQ ID NO: 32006 - DNA, 18 bp, Artificial Sequence
  Synthetic DNA
tatttcgacacacaatag

SEQ ID NO: 32007 - DNA, 18 bp, Artificial Sequence
  Synthetic DNA
tcaaacgactcaatattg

SEQ ID NO: 32008 - DNA, 18 bp, Artificial Sequence
  Synthetic DNA
tcaaacgtctcactattg

SEQ ID NO: 32009 - DNA, 18 bp, Artificial Sequence
  Synthetic DNA
tcaatcgacacactatag

SEQ ID NO: 32010 - DNA, 18 bp, Artificial Sequence
  Synthetic DNA
tcattcgacttacaatag

SEQ ID NO: 32011 - DNA, 18 bp, Artificial Sequence
  Synthetic DNA
tcattcgtatcactatag

SEQ ID NO: 32012 - DNA, 18 bp, Artificial Sequence
  Synthetic DNA
tgaatcgactcacaatag

SEQ ID NO: 32013 - DNA, 18 bp, Artificial Sequence
  Synthetic DNA
tgatacaactcactaatg

SEQ ID NO: 32014 - DNA, 18 bp, Artificial Sequence
  Synthetic DNA
tgatacaactcacttttg

SEQ ID NO: 32015 - DNA, 18 bp, Artificial Sequence
  Synthetic DNA
ttatatgactcactgttg

SEQ ID NO: 32016 - DNA, 18 bp, Artificial Sequence
  Synthetic DNA
ttatccgactcaatattg

SEQ ID NO: 32017 - DNA, 18 bp, Artificial Sequence
  Synthetic DNA
ttattatactcactatag

SEQ ID NO: 32018 - DNA, 18 bp, Artificial Sequence
  Synthetic DNA
ttattcgactctgtatag

SEQ ID NO: 32019 - DNA, 18 bp, Artificial Sequence
  Synthetic DNA
ttatttgtctcactatag

SEQ ID NO: 32020 - DNA, 18 bp, Artificial Sequence
  Synthetic DNA
ttttaccactcgctatag

SEQ ID NO: 32021 - DNA, 18 bp, Artificial Sequence
  Synthetic DNA
aaaaacgtctcactaaag

SEQ ID NO: 32022 - DNA, 18 bp, Artificial Sequence
  Synthetic DNA
aaacacgactctctgtag

SEQ ID NO: 32023 - DNA, 18 bp, Artificial Sequence
  Synthetic DNA
aaatacgaatctttatag

SEQ ID NO: 32024 - DNA, 18 bp, Artificial Sequence
  Synthetic DNA
aaatacgatacacaatag

SEQ ID NO: 32025 - DNA, 18 bp, Artificial Sequence
  Synthetic DNA
aaatacggctctctaaag

SEQ ID NO: 32026 - DNA, 18 bp, Artificial Sequence
  Synthetic DNA
aaatacgtctcacaatcg

SEQ ID NO: 32027 - DNA, 18 bp, Artificial Sequence
  Synthetic DNA
aaatacgtcttattatag

SEQ ID NO: 32028 - DNA, 18 bp, Artificial Sequence
  Synthetic DNA
aattacgactcaataaag

SEQ ID NO: 32029 - DNA, 18 bp, Artificial Sequence
  Synthetic DNA
aattatgactcacaatag

SEQ ID NO: 32030 - DNA, 18 bp, Artificial Sequence
  Synthetic DNA
agatacaactcacaatag

SEQ ID NO: 32031 - DNA, 18 bp, Artificial Sequence
  Synthetic DNA
agatacgactcattaaag

SEQ ID NO: 32032 - DNA, 18 bp, Artificial Sequence
  Synthetic DNA
atacacgactcacaatag

SEQ ID NO: 32033 - DNA, 18 bp, Artificial Sequence
  Synthetic DNA
atatacgacccacaatag

SEQ ID NO: 32034 - DNA, 18 bp, Artificial Sequence
  Synthetic DNA
atatacgacttattatag

SEQ ID NO: 32035 - DNA, 18 bp, Artificial Sequence
  Synthetic DNA
atatacgccttactatag

SEQ ID NO: 32036 - DNA, 18 bp, Artificial Sequence
  Synthetic DNA
atatacgtctcactctag

SEQ ID NO: 32037 - DNA, 18 bp, Artificial Sequence
  Synthetic DNA
atatacgtctcattatag

SEQ ID NO: 32038 - DNA, 18 bp, Artificial Sequence
  Synthetic DNA
atatactactcagtatag

SEQ ID NO: 32039 - DNA, 18 bp, Artificial Sequence
  Synthetic DNA
caaaacgactcattaaag

SEQ ID NO: 32040 - DNA, 18 bp, Artificial Sequence
  Synthetic DNA
caatactactctctttag

SEQ ID NO: 32041 - DNA, 18 bp, Artificial Sequence
  Synthetic DNA
ctatacgtctcacaatag

SEQ ID NO: 32042 - DNA, 18 bp, Artificial Sequence
  Synthetic DNA
ctatactacacactatag

SEQ ID NO: 32043 - DNA, 18 bp, Artificial Sequence
  Synthetic DNA
taaaacgaaactctatag

SEQ ID NO: 32044 - DNA, 18 bp, Artificial Sequence
  Synthetic DNA
taaaatgtctcactaaag

SEQ ID NO: 32045 - DNA, 18 bp, Artificial Sequence
  Synthetic DNA
taaagttactcactatag

SEQ ID NO: 32046 - DNA, 18 bp, Artificial Sequence
  Synthetic DNA
taataaaattctctatag

SEQ ID NO: 32047 - DNA, 18 bp, Artificial Sequence
  Synthetic DNA
taataacactctttatag

SEQ ID NO: 32048 - DNA, 18 bp, Artificial Sequence
  Synthetic DNA
taataagacccacttaag

SEQ ID NO: 32049 - DNA, 18 bp, Artificial Sequence
  Synthetic DNA
taataagattcaaaatag

SEQ ID NO: 32050 - DNA, 18 bp, Artificial Sequence
  Synthetic DNA
taataagtctaattatag

SEQ ID NO: 32051 - DNA, 18 bp, Artificial Sequence
  Synthetic DNA
taataatactctctttag

SEQ ID NO: 32052 - DNA, 18 bp, Artificial Sequence
  Synthetic DNA
taatacaactatctttag

SEQ ID NO: 32053 - DNA, 18 bp, Artificial Sequence
  Synthetic DNA
taatacaccgccctatag

SEQ ID NO: 32054 - DNA, 18 bp, Artificial Sequence
  Synthetic DNA
taatacatcgctctatag

SEQ ID NO: 32055 - DNA, 18 bp, Artificial Sequence
  Synthetic DNA
taatacatctcactctcg

SEQ ID NO: 32056 - DNA, 18 bp, Artificial Sequence
  Synthetic DNA
taatacatctcattgtag

SEQ ID NO: 32057 - DNA, 18 bp, Artificial Sequence
  Synthetic DNA
taatacgacacttcatag

SEQ ID NO: 32058 - DNA, 18 bp, Artificial Sequence
  Synthetic DNA
taatacgacatattaaag

SEQ ID NO: 32059 - DNA, 18 bp, Artificial Sequence
  Synthetic DNA
taatacgacattttatag

SEQ ID NO: 32060 - DNA, 18 bp, Artificial Sequence
  Synthetic DNA
taatacgactccaaaaag

SEQ ID NO: 32061 - DNA, 18 bp, Artificial Sequence
  Synthetic DNA
taatacgactcttttaag

SEQ ID NO: 32062 - DNA, 18 bp, Artificial Sequence
  Synthetic DNA
taatacgattctcaatcg

SEQ ID NO: 32063 - DNA, 18 bp, Artificial Sequence
  Synthetic DNA
taatacgattctgaatag

SEQ ID NO: 32064 - DNA, 18 bp, Artificial Sequence
  Synthetic DNA
taatacgattgacaaaag

SEQ ID NO: 32065 - DNA, 18 bp, Artificial Sequence
  Synthetic DNA
taatacgatttactttcg

SEQ ID NO: 32066 - DNA, 18 bp, Artificial Sequence
  Synthetic DNA
taatacggcttataatag

SEQ ID NO: 32067 - DNA, 18 bp, Artificial Sequence
  Synthetic DNA
taatacgtctaacattag

SEQ ID NO: 32068 - DNA, 18 bp, Artificial Sequence
  Synthetic DNA
taatacgtctcatgatcg

SEQ ID NO: 32069 - DNA, 18 bp, Artificial Sequence
  Synthetic DNA
taatacgtcttcctaaag

SEQ ID NO: 32070 - DNA, 18 bp, Artificial Sequence
  Synthetic DNA
taatacgtttcagtttag

SEQ ID NO: 32071 - DNA, 18 bp, Artificial Sequence
  Synthetic DNA
taatactacatactaaag

SEQ ID NO: 32072 - DNA, 18 bp, Artificial Sequence
  Synthetic DNA
taatactactcataaaag

SEQ ID NO: 32073 - DNA, 18 bp, Artificial Sequence
  Synthetic DNA
taataggattatctatag

SEQ ID NO: 32074 - DNA, 18 bp, Artificial Sequence
  Synthetic DNA
taatatgactcatcgtag

SEQ ID NO: 32075 - DNA, 18 bp, Artificial Sequence
  Synthetic DNA
taatatgactctttttag

SEQ ID NO: 32076 - DNA, 18 bp, Artificial Sequence
  Synthetic DNA
taatatgattcactaacg

SEQ ID NO: 32077 - DNA, 18 bp, Artificial Sequence
  Synthetic DNA
taatatgattttctatag

SEQ ID NO: 32078 - DNA, 18 bp, Artificial Sequence
  Synthetic DNA
taatatgtctcattaaag

SEQ ID NO: 32079 - DNA, 18 bp, Artificial Sequence
  Synthetic DNA
taatcctacacacaatag

SEQ ID NO: 32080 - DNA, 18 bp, Artificial Sequence
  Synthetic DNA
taatgcatctcattatag

SEQ ID NO: 32081 - DNA, 18 bp, Artificial Sequence
  Synthetic DNA
taatgccacttactttag

SEQ ID NO: 32082 - DNA, 18 bp, Artificial Sequence
  Synthetic DNA
tactaagattcacaatag

SEQ ID NO: 32083 - DNA, 18 bp, Artificial Sequence
  Synthetic DNA
tactaccactcatcatag

SEQ ID NO: 32084 - DNA, 18 bp, Artificial Sequence
  Synthetic DNA
tactacgacattctatag

SEQ ID NO: 32085 - DNA, 18 bp, Artificial Sequence
  Synthetic DNA
tactatgacacactaaag

SEQ ID NO: 32086 - DNA, 18 bp, Artificial Sequence
  Synthetic DNA
tagaacgaatctctatag

SEQ ID NO: 32087 - DNA, 18 bp, Artificial Sequence
  Synthetic DNA
tagtatcactctctatag

SEQ ID NO: 32088 - DNA, 18 bp, Artificial Sequence
  Synthetic DNA
tataacgaatcaatatag

SEQ ID NO: 32089 - DNA, 18 bp, Artificial Sequence
  Synthetic DNA
tataacgagttactatag

SEQ ID NO: 32090 - DNA, 18 bp, Artificial Sequence
  Synthetic DNA
tataacgtcccactatag

SEQ ID NO: 32091 - DNA, 18 bp, Artificial Sequence
  Synthetic DNA
tattacaactcattatgg

SEQ ID NO: 32092 - DNA, 18 bp, Artificial Sequence
  Synthetic DNA
tattacaactcattctag

SEQ ID NO: 32093 - DNA, 18 bp, Artificial Sequence
  Synthetic DNA
tattacaagttactatag

SEQ ID NO: 32094 - DNA, 18 bp, Artificial Sequence
  Synthetic DNA
tattacgaatcattttag

SEQ ID NO: 32095 - DNA, 18 bp, Artificial Sequence
  Synthetic DNA
tattacgactcacacaag

SEQ ID NO: 32096 - DNA, 18 bp, Artificial Sequence
  Synthetic DNA
tattacgactttttatag

SEQ ID NO: 32097 - DNA, 18 bp, Artificial Sequence
  Synthetic DNA
tattacgcctaacaatag

SEQ ID NO: 32098 - DNA, 18 bp, Artificial Sequence
  Synthetic DNA
tattacgtattactatag

SEQ ID NO: 32099 - DNA, 18 bp, Artificial Sequence
  Synthetic DNA
tattacttctctctatag

SEQ ID NO: 32100 - DNA, 18 bp, Artificial Sequence
  Synthetic DNA
tattaggactcaatatcg

SEQ ID NO: 32101 - DNA, 18 bp, Artificial Sequence
  Synthetic DNA
tattataactcactctag

SEQ ID NO: 32102 - DNA, 18 bp, Artificial Sequence
  Synthetic DNA
tattatgtctcaccatag

SEQ ID NO: 32103 - DNA, 18 bp, Artificial Sequence
  Synthetic DNA
tattattactcactttag

SEQ ID NO: 32104 - DNA, 18 bp, Artificial Sequence
  Synthetic DNA
tattccgactcacaatgg

SEQ ID NO: 32105 - DNA, 18 bp, Artificial Sequence
  Synthetic DNA
tcatacgacatacaatag

SEQ ID NO: 32106 - DNA, 18 bp, Artificial Sequence
  Synthetic DNA
tcttacgtgtcactatag

SEQ ID NO: 32107 - DNA, 18 bp, Artificial Sequence
  Synthetic DNA
tgatacgacacaatatcg

SEQ ID NO: 32108 - DNA, 18 bp, Artificial Sequence
  Synthetic DNA
tgttacgacaaactatag

SEQ ID NO: 32109 - DNA, 18 bp, Artificial Sequence
  Synthetic DNA
tgttacgactcagtaaag

SEQ ID NO: 32110 - DNA, 18 bp, Artificial Sequence
  Synthetic DNA
tgttacgacttactacag

SEQ ID NO: 32111 - DNA, 18 bp, Artificial Sequence
  Synthetic DNA
ttaaacgactccctttag

SEQ ID NO: 32112 - DNA, 18 bp, Artificial Sequence
  Synthetic DNA
ttataagaatcactatgg

SEQ ID NO: 32113 - DNA, 18 bp, Artificial Sequence
  Synthetic DNA
ttataatattcactatag

SEQ ID NO: 32114 - DNA, 18 bp, Artificial Sequence
  Synthetic DNA
ttatacaaatcactaaag

SEQ ID NO: 32115 - DNA, 18 bp, Artificial Sequence
  Synthetic DNA
ttatacgacacacaatcg

SEQ ID NO: 32116 - DNA, 18 bp, Artificial Sequence
  Synthetic DNA
ttatacgactcattctcg

SEQ ID NO: 32117 - DNA, 18 bp, Artificial Sequence
  Synthetic DNA
ttatacgcctcaatttag

SEQ ID NO: 32118 - DNA, 18 bp, Artificial Sequence
  Synthetic DNA
ttatacggttcacaatag

SEQ ID NO: 32119 - DNA, 18 bp, Artificial Sequence
  Synthetic DNA
ttatacgtcccactaaag

SEQ ID NO: 32120 - DNA, 18 bp, Artificial Sequence
  Synthetic DNA
ttatactccccactatag

SEQ ID NO: 32121 - DNA, 18 bp, Artificial Sequence
  Synthetic DNA
ttatacttctcactgtag

SEQ ID NO: 32122 - DNA, 18 bp, Artificial Sequence
  Synthetic DNA
ttataggtcacactatag

SEQ ID NO: 32123 - DNA, 18 bp, Artificial Sequence
  Synthetic DNA
ttatataactcactttag

SEQ ID NO: 32124 - DNA, 18 bp, Artificial Sequence
  Synthetic DNA
ttatatgtctcaatatag

SEQ ID NO: 32125 - DNA, 18 bp, Artificial Sequence
  Synthetic DNA
ttatattactcactatcg

SEQ ID NO: 32126 - DNA, 18 bp, Artificial Sequence
  Synthetic DNA
ttatccgagtcactaaag

SEQ ID NO: 32127 - DNA, 18 bp, Artificial Sequence
  Synthetic DNA
ttgtacgactctcaatag

SEQ ID NO: 32128 - DNA, 18 bp, Artificial Sequence
  Synthetic DNA
ttttacgactctcaatag

SEQ ID NO: 32129 - DNA, 18 bp, Artificial Sequence
  Synthetic DNA
ttttacgcctctctatag

SEQ ID NO: 32130 - DNA, 18 bp, Artificial Sequence
  Synthetic DNA
tattactactctctattg

SEQ ID NO: 32131 - DNA, 18 bp, Artificial Sequence
  Synthetic DNA
tataacgtcacactatag

SEQ ID NO: 32132 - DNA, 18 bp, Artificial Sequence
  Synthetic DNA
aaattcgactcacaattg

SEQ ID NO: 32133 - DNA, 18 bp, Artificial Sequence
  Synthetic DNA
taaatcgactcacaattg

SEQ ID NO: 32134 - DNA, 18 bp, Artificial Sequence
  Synthetic DNA
taatatgactctctaatg

SEQ ID NO: 32135 - DNA, 18 bp, Artificial Sequence
  Synthetic DNA
taattcaactcacttcag

SEQ ID NO: 32136 - DNA, 18 bp, Artificial Sequence
  Synthetic DNA
taattcatctcactttag

SEQ ID NO: 32137 - DNA, 18 bp, Artificial Sequence
  Synthetic DNA
tattactactcacaattg

SEQ ID NO: 32138 - DNA, 18 bp, Artificial Sequence
  Synthetic DNA
aaatacgtcacacaatag

SEQ ID NO: 32139 - DNA, 18 bp, Artificial Sequence
  Synthetic DNA
taaaacgactctttttag

SEQ ID NO: 32140 - DNA, 18 bp, Artificial Sequence
  Synthetic DNA
taataagactctcttaag

SEQ ID NO: 32141 - DNA, 18 bp, Artificial Sequence
  Synthetic DNA
taatatttctcactttag

SEQ ID NO: 32142 - DNA, 18 bp, Artificial Sequence
  Synthetic DNA
tataacgactttctatag

SEQ ID NO: 32143 - DNA, 18 bp, Artificial Sequence
  Synthetic DNA
tattaagtctctctatag

SEQ ID NO: 32144 - DNA, 18 bp, Artificial Sequence
  Synthetic DNA
tattacgacacactcaag

SEQ ID NO: 32145 - DNA, 18 bp, Artificial Sequence
  Synthetic DNA
tattacgacatactaaag

SEQ ID NO: 32146 - DNA, 18 bp, Artificial Sequence
  Synthetic DNA
tattacttcacactatag

SEQ ID NO: 32147 - DNA, 18 bp, Artificial Sequence
  Synthetic DNA
ttatatgacttactttag

SEQ ID NO: 32148 - DNA, 18 bp, Artificial Sequence
  Synthetic DNA
ttttacaactctctatag

SEQ ID NO: 32149 - DNA, 18 bp, Artificial Sequence
  Synthetic DNA
aatttcgactcactattg

SEQ ID NO: 32150 - DNA, 18 bp, Artificial Sequence
  Synthetic DNA
taaaacgacacattattg

SEQ ID NO: 32151 - DNA, 18 bp, Artificial Sequence
  Synthetic DNA
tattacgattctctattg

SEQ ID NO: 32152 - DNA, 18 bp, Artificial Sequence
  Synthetic DNA
ttatacaactcactaatg

SEQ ID NO: 32153 - DNA, 18 bp, Artificial Sequence
  Synthetic DNA
ttatacgtttcactattg

SEQ ID NO: 32154 - DNA, 18 bp, Artificial Sequence
  Synthetic DNA
ttatacttctcactaaag

SEQ ID NO: 32155 - DNA, 18 bp, Artificial Sequence
  Synthetic DNA
aatatcgactcactatag

SEQ ID NO: 32156 - DNA, 18 bp, Artificial Sequence
  Synthetic DNA
taatacgtcttgctattg

SEQ ID NO: 32157 - DNA, 18 bp, Artificial Sequence
  Synthetic DNA
taattcaactcactcttg

SEQ ID NO: 32158 - DNA, 18 bp, Artificial Sequence
  Synthetic DNA
taattccacacactattg

SEQ ID NO: 32159 - DNA, 18 bp, Artificial Sequence
  Synthetic DNA
aaatacaactcaatattg

SEQ ID NO: 32160 - DNA, 18 bp, Artificial Sequence
  Synthetic DNA
aaatacgactcacacttg

SEQ ID NO: 32161 - DNA, 18 bp, Artificial Sequence
  Synthetic DNA
aaatacgattcacaattg

SEQ ID NO: 32162 - DNA, 18 bp, Artificial Sequence
  Synthetic DNA
aaattagactcagtatag

SEQ ID NO: 32163 - DNA, 18 bp, Artificial Sequence
  Synthetic DNA
aaattctactcactaaag

SEQ ID NO: 32164 - DNA, 18 bp, Artificial Sequence
  Synthetic DNA
aatttcgacttactatag

SEQ ID NO: 32165 - DNA, 18 bp, Artificial Sequence
  Synthetic DNA
atatatgactcgctatag

SEQ ID NO: 32166 - DNA, 18 bp, Artificial Sequence
  Synthetic DNA
cattacgactcattattg

SEQ ID NO: 32167 - DNA, 18 bp, Artificial Sequence
  Synthetic DNA
ctattctactcactatag

SEQ ID NO: 32168 - DNA, 18 bp, Artificial Sequence
  Synthetic DNA
taaaaagacttactattg

SEQ ID NO: 32169 - DNA, 18 bp, Artificial Sequence
  Synthetic DNA
taaaacgactcaattttg

SEQ ID NO: 32170 - DNA, 18 bp, Artificial Sequence
  Synthetic DNA
taaatcgacttactaaag

SEQ ID NO: 32171 - DNA, 18 bp, Artificial Sequence
  Synthetic DNA
taaccagactcactattg

SEQ ID NO: 32172 - DNA, 18 bp, Artificial Sequence
  Synthetic DNA
taactcgaatctctatag

SEQ ID NO: 32173 - DNA, 18 bp, Artificial Sequence
  Synthetic DNA
taataagaccctctattg

SEQ ID NO: 32174 - DNA, 18 bp, Artificial Sequence
  Synthetic DNA
taataatactcaatattg

SEQ ID NO: 32175 - DNA, 18 bp, Artificial Sequence
  Synthetic DNA
taatacgacacaccaatg

SEQ ID NO: 32176 - DNA, 18 bp, Artificial Sequence
  Synthetic DNA
taatacgacgcaattttg

SEQ ID NO: 32177 - DNA, 18 bp, Artificial Sequence
  Synthetic DNA
taatacgactcaacaatg

SEQ ID NO: 32178 - DNA, 18 bp, Artificial Sequence
  Synthetic DNA
taatacgactttcttttg

SEQ ID NO: 32179 - DNA, 18 bp, Artificial Sequence
  Synthetic DNA
taatactacttacaattg

SEQ ID NO: 32180 - DNA, 18 bp, Artificial Sequence
  Synthetic DNA
taatactatacactattg

SEQ ID NO: 32181 - DNA, 18 bp, Artificial Sequence
  Synthetic DNA
taatatgaaacactattg

SEQ ID NO: 32182 - DNA, 18 bp, Artificial Sequence
  Synthetic DNA
taatatgacttcctattg

SEQ ID NO: 32183 - DNA, 18 bp, Artificial Sequence
  Synthetic DNA
taatatgtatcactattg

SEQ ID NO: 32184 - DNA, 18 bp, Artificial Sequence
  Synthetic DNA
taatgcgaatcacttttg

SEQ ID NO: 32185 - DNA, 18 bp, Artificial Sequence
  Synthetic DNA
taattagaatctctatag

SEQ ID NO: 32186 - DNA, 18 bp, Artificial Sequence
  Synthetic DNA
taattcaacactctatag

SEQ ID NO: 32187 - DNA, 18 bp, Artificial Sequence
  Synthetic DNA
taattcaactcaaaatag

SEQ ID NO: 32188 - DNA, 18 bp, Artificial Sequence
  Synthetic DNA
taattcgaatcacaacag

SEQ ID NO: 32189 - DNA, 18 bp, Artificial Sequence
  Synthetic DNA
taattcgaatctttatag

SEQ ID NO: 32190 - DNA, 18 bp, Artificial Sequence
  Synthetic DNA
taattcgactcaacaaag

SEQ ID NO: 32191 - DNA, 18 bp, Artificial Sequence
  Synthetic DNA
taattcgtctcataatag

SEQ ID NO: 32192 - DNA, 18 bp, Artificial Sequence
  Synthetic DNA
taatttgactcattttag

SEQ ID NO: 32193 - DNA, 18 bp, Artificial Sequence
  Synthetic DNA
taatttgactctctatgg

SEQ ID NO: 32194 - DNA, 18 bp, Artificial Sequence
  Synthetic DNA
tagaatgactcactattg

SEQ ID NO: 32195 - DNA, 18 bp, Artificial Sequence
  Synthetic DNA
tagtacgactcactcatg

SEQ ID NO: 32196 - DNA, 18 bp, Artificial Sequence
  Synthetic DNA
tattaagactcgctttag

SEQ ID NO: 32197 - DNA, 18 bp, Artificial Sequence
  Synthetic DNA
tattacggctcactaatg

SEQ ID NO: 32198 - DNA, 18 bp, Artificial Sequence
  Synthetic DNA
tatttccactcacaatag

SEQ ID NO: 32199 - DNA, 18 bp, Artificial Sequence
  Synthetic DNA
tatttcgaatcactctag

SEQ ID NO: 32200 - DNA, 18 bp, Artificial Sequence
  Synthetic DNA
tatttcgactcacaacag

SEQ ID NO: 32201 - DNA, 18 bp, Artificial Sequence
  Synthetic DNA
tatttcgattctctatag

SEQ ID NO: 32202 - DNA, 18 bp, Artificial Sequence
  Synthetic DNA
tcatacgaatcactaatg

SEQ ID NO: 32203 - DNA, 18 bp, Artificial Sequence
  Synthetic DNA
tcattcgattcattatag

SEQ ID NO: 32204 - DNA, 18 bp, Artificial Sequence
  Synthetic DNA
tcattctactcactaaag

SEQ ID NO: 32205 - DNA, 18 bp, Artificial Sequence
  Synthetic DNA
tgattcgactctcaatag

SEQ ID NO: 32206 - DNA, 18 bp, Artificial Sequence
  Synthetic DNA
ttatacacctcactattg

SEQ ID NO: 32207 - DNA, 18 bp, Artificial Sequence
  Synthetic DNA
ttatacgactcacctttg

SEQ ID NO: 32208 - DNA, 18 bp, Artificial Sequence
  Synthetic DNA
ttatacgattcgctttag

SEQ ID NO: 32209 - DNA, 18 bp, Artificial Sequence
  Synthetic DNA
ttattcgaaccactatag

SEQ ID NO: 32210 - DNA, 18 bp, Artificial Sequence
  Synthetic DNA
ttattcgactaaatatag

SEQ ID NO: 32211 - DNA, 18 bp, Artificial Sequence
  Synthetic DNA
ttattctactcaccatag

SEQ ID NO: 32212 - DNA, 18 bp, Artificial Sequence
  Synthetic DNA
ttcttcgattcactatag

SEQ ID NO: 32213 - DNA, 18 bp, Artificial Sequence
  Synthetic DNA
aaacacatctcactatag

SEQ ID NO: 32214 - DNA, 18 bp, Artificial Sequence
  Synthetic DNA
aaataagtcttactatag

SEQ ID NO: 32215 - DNA, 18 bp, Artificial Sequence
  Synthetic DNA
aaatacaactcataatag

SEQ ID NO: 32216 - DNA, 18 bp, Artificial Sequence
  Synthetic DNA
aaatacgactaattatcg

SEQ ID NO: 32217 - DNA, 18 bp, Artificial Sequence
  Synthetic DNA
aaatacgattaacaatag

SEQ ID NO: 32218 - DNA, 18 bp, Artificial Sequence
  Synthetic DNA
aaatacggcactctatag

SEQ ID NO: 32219 - DNA, 18 bp, Artificial Sequence
  Synthetic DNA
aaatatgaatcaatatag

SEQ ID NO: 32220 - DNA, 18 bp, Artificial Sequence
  Synthetic DNA
aaatatgactcacaaaag

SEQ ID NO: 32221 - DNA, 18 bp, Artificial Sequence
  Synthetic DNA
aataacgactcaatatag

SEQ ID NO: 32222 - DNA, 18 bp, Artificial Sequence
  Synthetic DNA
aattaaaactcactatag

SEQ ID NO: 32223 - DNA, 18 bp, Artificial Sequence
  Synthetic DNA
atatacaactcactttag

SEQ ID NO: 32224 - DNA, 18 bp, Artificial Sequence
  Synthetic DNA
atatacgactcatcatag

SEQ ID NO: 32225 - DNA, 18 bp, Artificial Sequence
  Synthetic DNA
atatacgactcattacag

SEQ ID NO: 32226 - DNA, 18 bp, Artificial Sequence
  Synthetic DNA
atataggtctcactatag

SEQ ID NO: 32227 - DNA, 18 bp, Artificial Sequence
  Synthetic DNA
atctacgactcaccatag

SEQ ID NO: 32228 - DNA, 18 bp, Artificial Sequence
  Synthetic DNA
caaaacgacttactaaag

SEQ ID NO: 32229 - DNA, 18 bp, Artificial Sequence
  Synthetic DNA
caaaatgattcactatag

SEQ ID NO: 32230 - DNA, 18 bp, Artificial Sequence
  Synthetic DNA
caatacgaaacaatatag

SEQ ID NO: 32231 - DNA, 18 bp, Artificial Sequence
  Synthetic DNA
caatacgtctccctttag

SEQ ID NO: 32232 - DNA, 18 bp, Artificial Sequence
  Synthetic DNA
ctatacgacacattatag

SEQ ID NO: 32233 - DNA, 18 bp, Artificial Sequence
  Synthetic DNA
taaaaagactcccaatag

SEQ ID NO: 32234 - DNA, 18 bp, Artificial Sequence
  Synthetic DNA
taaaacgacacccaatag

SEQ ID NO: 32235 - DNA, 18 bp, Artificial Sequence
  Synthetic DNA
taaaacgactctgaatag

SEQ ID NO: 32236 - DNA, 18 bp, Artificial Sequence
  Synthetic DNA
taaaacgattctcaatag

SEQ ID NO: 32237 - DNA, 18 bp, Artificial Sequence
  Synthetic DNA
taaaacgtctcacattag

SEQ ID NO: 32238 - DNA, 18 bp, Artificial Sequence
  Synthetic DNA
taaaactaatcactttag

SEQ ID NO: 32239 - DNA, 18 bp, Artificial Sequence
  Synthetic DNA
taaaactactcatcatag

SEQ ID NO: 32240 - DNA, 18 bp, Artificial Sequence
  Synthetic DNA
taaaactactttctatag

SEQ ID NO: 32241 - DNA, 18 bp, Artificial Sequence
  Synthetic DNA
taaaagtactctctatag

SEQ ID NO: 32242 - DNA, 18 bp, Artificial Sequence
  Synthetic DNA
taaaccaactctctatag

SEQ ID NO: 32243 - DNA, 18 bp, Artificial Sequence
  Synthetic DNA
taacacaactctctaaag

SEQ ID NO: 32244 - DNA, 18 bp, Artificial Sequence
  Synthetic DNA
taagatgactcacttaag

SEQ ID NO: 32245 - DNA, 18 bp, Artificial Sequence
  Synthetic DNA
taataaaacacacaatag

SEQ ID NO: 32246 - DNA, 18 bp, Artificial Sequence
  Synthetic DNA
taataaaattcactacag

SEQ ID NO: 32247 - DNA, 18 bp, Artificial Sequence
  Synthetic DNA
taataagacacacaatgg

SEQ ID NO: 32248 - DNA, 18 bp, Artificial Sequence
  Synthetic DNA
taataagattcacattag

SEQ ID NO: 32249 - DNA, 18 bp, Artificial Sequence
  Synthetic DNA
taataagtcacactttag

SEQ ID NO: 32250 - DNA, 18 bp, Artificial Sequence
  Synthetic DNA
taataagtttcaatatag

SEQ ID NO: 32251 - DNA, 18 bp, Artificial Sequence
  Synthetic DNA
taataatactctcaatag

SEQ ID NO: 32252 - DNA, 18 bp, Artificial Sequence
  Synthetic DNA
taatacaacactctttag

SEQ ID NO: 32253 - DNA, 18 bp, Artificial Sequence
  Synthetic DNA
taatacaactaccaatag

SEQ ID NO: 32254 - DNA, 18 bp, Artificial Sequence
  Synthetic DNA
taataccacatactttag

SEQ ID NO: 32255 - DNA, 18 bp, Artificial Sequence
  Synthetic DNA
taatacgaattacattag

SEQ ID NO: 32256 - DNA, 18 bp, Artificial Sequence
  Synthetic DNA
taatacgacactccttag

SEQ ID NO: 32257 - DNA, 18 bp, Artificial Sequence
  Synthetic DNA
taatacgacataataaag

SEQ ID NO: 32258 - DNA, 18 bp, Artificial Sequence
  Synthetic DNA
taatacgacattctacag

SEQ ID NO: 32259 - DNA, 18 bp, Artificial Sequence
  Synthetic DNA
taatacgacgcttaatag

SEQ ID NO: 32260 - DNA, 18 bp, Artificial Sequence
  Synthetic DNA
taatacgactcacctacg

SEQ ID NO: 32261 - DNA, 18 bp, Artificial Sequence
  Synthetic DNA
taatacgtatcactaacg

SEQ ID NO: 32262 - DNA, 18 bp, Artificial Sequence
  Synthetic DNA
taatacgtatcagaatag

SEQ ID NO: 32263 - DNA, 18 bp, Artificial Sequence
  Synthetic DNA
taatacgtatcattttag

SEQ ID NO: 32264 - DNA, 18 bp, Artificial Sequence
  Synthetic DNA
taatacgtctttctacag

SEQ ID NO: 32265 - DNA, 18 bp, Artificial Sequence
  Synthetic DNA
taatactaaatactatag

SEQ ID NO: 32266 - DNA, 18 bp, Artificial Sequence
  Synthetic DNA
taatactaattacaatag

SEQ ID NO: 32267 - DNA, 18 bp, Artificial Sequence
  Synthetic DNA
taatactacatactttag

SEQ ID NO: 32268 - DNA, 18 bp, Artificial Sequence
  Synthetic DNA
taatactatttactttag

SEQ ID NO: 32269 - DNA, 18 bp, Artificial Sequence
  Synthetic DNA
taatacttcccactttag

SEQ ID NO: 32270 - DNA, 18 bp, Artificial Sequence
  Synthetic DNA
taatacttctcaataaag

SEQ ID NO: 32271 - DNA, 18 bp, Artificial Sequence
  Synthetic DNA
taatatgactctctgtgg

SEQ ID NO: 32272 - DNA, 18 bp, Artificial Sequence
  Synthetic DNA
taatatgtctcataatag

SEQ ID NO: 32273 - DNA, 18 bp, Artificial Sequence
  Synthetic DNA
taatatgtctgacaatag

SEQ ID NO: 32274 - DNA, 18 bp, Artificial Sequence
  Synthetic DNA
taatattactcacaacag

SEQ ID NO: 32275 - DNA, 18 bp, Artificial Sequence
  Synthetic DNA
taatattactcattaaag

SEQ ID NO: 32276 - DNA, 18 bp, Artificial Sequence
  Synthetic DNA
taatccgactcttaatag

SEQ ID NO: 32277 - DNA, 18 bp, Artificial Sequence
  Synthetic DNA
taatgcaactcacaatgg

SEQ ID NO: 32278 - DNA, 18 bp, Artificial Sequence
  Synthetic DNA
taatgcaactctttatag

SEQ ID NO: 32279 - DNA, 18 bp, Artificial Sequence
  Synthetic DNA
taatgccactcattttag

SEQ ID NO: 32280 - DNA, 18 bp, Artificial Sequence
  Synthetic DNA
taatgcgactatctttag

SEQ ID NO: 32281 - DNA, 18 bp, Artificial Sequence
  Synthetic DNA
taatgcgattcacaacag

SEQ ID NO: 32282 - DNA, 18 bp, Artificial Sequence
  Synthetic DNA
tagaacgattctctatag

SEQ ID NO: 32283 - DNA, 18 bp, Artificial Sequence
  Synthetic DNA
tagcacgacatactatag

SEQ ID NO: 32284 - DNA, 18 bp, Artificial Sequence
  Synthetic DNA
tagtacgactaacattag

SEQ ID NO: 32285 - DNA, 18 bp, Artificial Sequence
  Synthetic DNA
tagtacgtctctctttag

SEQ ID NO: 32286 - DNA, 18 bp, Artificial Sequence
  Synthetic DNA
tataacctctcactatag

SEQ ID NO: 32287 - DNA, 18 bp, Artificial Sequence
  Synthetic DNA
tataacgaatcactctag

SEQ ID NO: 32288 - DNA, 18 bp, Artificial Sequence
  Synthetic DNA
tataacgactcaaaatag

SEQ ID NO: 32289 - DNA, 18 bp, Artificial Sequence
  Synthetic DNA
tattaaaaatcactatag

SEQ ID NO: 32290 - DNA, 18 bp, Artificial Sequence
  Synthetic DNA
tattaagaatcactaaag

SEQ ID NO: 32291 - DNA, 18 bp, Artificial Sequence
  Synthetic DNA
tattaagaatcactttag

SEQ ID NO: 32292 - DNA, 18 bp, Artificial Sequence
  Synthetic DNA
tattaccattcacaatag

SEQ ID NO: 32293 - DNA, 18 bp, Artificial Sequence
  Synthetic DNA
tattacgaaacactacag

SEQ ID NO: 32294 - DNA, 18 bp, Artificial Sequence
  Synthetic DNA
tattacgaaccactgtag

SEQ ID NO: 32295 - DNA, 18 bp, Artificial Sequence
  Synthetic DNA
tattacgaatatctatag

SEQ ID NO: 32296 - DNA, 18 bp, Artificial Sequence
  Synthetic DNA
tattacgaattactacag

SEQ ID NO: 32297 - DNA, 18 bp, Artificial Sequence
  Synthetic DNA
tattacttctcacaatag

SEQ ID NO: 32298 - DNA, 18 bp, Artificial Sequence
  Synthetic DNA
tcacaagactcactttag

SEQ ID NO: 32299 - DNA, 18 bp, Artificial Sequence
  Synthetic DNA
tcatacgacactttatag

SEQ ID NO: 32300 - DNA, 18 bp, Artificial Sequence
  Synthetic DNA
tcatacgacttactaacg

SEQ ID NO: 32301 - DNA, 18 bp, Artificial Sequence
  Synthetic DNA
tcataggactaattatag

SEQ ID NO: 32302 - DNA, 18 bp, Artificial Sequence
  Synthetic DNA
tcataggactctctttag

SEQ ID NO: 32303 - DNA, 18 bp, Artificial Sequence
  Synthetic DNA
tcttatgtctcactatag

SEQ ID NO: 32304 - DNA, 18 bp, Artificial Sequence
  Synthetic DNA
tgatacgacactcaatag

SEQ ID NO: 32305 - DNA, 18 bp, Artificial Sequence
  Synthetic DNA
tgatacgtctccatatag

SEQ ID NO: 32306 - DNA, 18 bp, Artificial Sequence
  Synthetic DNA
tgatactattcacaatag

SEQ ID NO: 32307 - DNA, 18 bp, Artificial Sequence
  Synthetic DNA
tgatattactcactttag

SEQ ID NO: 32308 - DNA, 18 bp, Artificial Sequence
  Synthetic DNA
ttaaacgaatcactttag

SEQ ID NO: 32309 - DNA, 18 bp, Artificial Sequence
  Synthetic DNA
ttaaacgactcacaatcg

SEQ ID NO: 32310 - DNA, 18 bp, Artificial Sequence
  Synthetic DNA
ttaaacgactcactttcg

SEQ ID NO: 32311 - DNA, 18 bp, Artificial Sequence
  Synthetic DNA
ttaaccgacttactatag

SEQ ID NO: 32312 - DNA, 18 bp, Artificial Sequence
  Synthetic DNA
ttatacaactcaccttag

SEQ ID NO: 32313 - DNA, 18 bp, Artificial Sequence
  Synthetic DNA
ttatacagctcattatag

SEQ ID NO: 32314 - DNA, 18 bp, Artificial Sequence
  Synthetic DNA
ttataccactctctctag

SEQ ID NO: 32315 - DNA, 18 bp, Artificial Sequence
  Synthetic DNA
ttatacgactcattgaag

SEQ ID NO: 32316 - DNA, 18 bp, Artificial Sequence
  Synthetic DNA
ttatacgatacactacag

SEQ ID NO: 32317 - DNA, 18 bp, Artificial Sequence
  Synthetic DNA
ttatacgtatcacaatag

SEQ ID NO: 32318 - DNA, 18 bp, Artificial Sequence
  Synthetic DNA
ttatacgtctaaatatag

SEQ ID NO: 32319 - DNA, 18 bp, Artificial Sequence
  Synthetic DNA
ttatacgtctcactgtgg

SEQ ID NO: 32320 - DNA, 18 bp, Artificial Sequence
  Synthetic DNA
ttatactactccttatag

SEQ ID NO: 32321 - DNA, 18 bp, Artificial Sequence
  Synthetic DNA
ttatactactgactaaag

SEQ ID NO: 32322 - DNA, 18 bp, Artificial Sequence
  Synthetic DNA
ttatattactgactatag

SEQ ID NO: 32323 - DNA, 18 bp, Artificial Sequence
  Synthetic DNA
ttatccgactcactttgg

SEQ ID NO: 32324 - DNA, 18 bp, Artificial Sequence
  Synthetic DNA
tttcacgaatcactatag

SEQ ID NO: 32325 - DNA, 18 bp, Artificial Sequence
  Synthetic DNA
ttttacgacacaccatag

SEQ ID NO: 32326 - DNA, 18 bp, Artificial Sequence
  Synthetic DNA
aaattcgactcacttttg

SEQ ID NO: 32327 - DNA, 18 bp, Artificial Sequence
  Synthetic DNA
taattcgactctcttcag

SEQ ID NO: 32328 - DNA, 18 bp, Artificial Sequence
  Synthetic DNA
tattaagactaactattg

SEQ ID NO: 32329 - DNA, 18 bp, Artificial Sequence
  Synthetic DNA
ttatatgactcacaattg

SEQ ID NO: 32330 - DNA, 18 bp, Artificial Sequence
  Synthetic DNA
aattacatctcactatag

SEQ ID NO: 32331 - DNA, 18 bp, Artificial Sequence
  Synthetic DNA
atatacgactcacattag

SEQ ID NO: 32332 - DNA, 18 bp, Artificial Sequence
  Synthetic DNA
atatacgattcactttag

SEQ ID NO: 32333 - DNA, 18 bp, Artificial Sequence
  Synthetic DNA
taatacgactctcaaacg

SEQ ID NO: 32334 - DNA, 18 bp, Artificial Sequence
  Synthetic DNA
taatatatcacactatag

SEQ ID NO: 32335 - DNA, 18 bp, Artificial Sequence
  Synthetic DNA
tatcacgtctcactttag

SEQ ID NO: 32336 - DNA, 18 bp, Artificial Sequence
  Synthetic DNA
tattactaccctctatag

SEQ ID NO: 32337 - DNA, 18 bp, Artificial Sequence
  Synthetic DNA
taatacgtcactctttag

SEQ ID NO: 32338 - DNA, 18 bp, Artificial Sequence
  Synthetic DNA
ttatacgacacaatttag

SEQ ID NO: 32339 - DNA, 18 bp, Artificial Sequence
  Synthetic DNA
taattcgacttactgttg

SEQ ID NO: 32340 - DNA, 18 bp, Artificial Sequence
  Synthetic DNA
taattctactcactcttg

SEQ ID NO: 32341 - DNA, 18 bp, Artificial Sequence
  Synthetic DNA
tcattcgattcactattg

SEQ ID NO: 32342 - DNA, 18 bp, Artificial Sequence
  Synthetic DNA
ttattcgactcactatta

SEQ ID NO: 32343 - DNA, 18 bp, Artificial Sequence
  Synthetic DNA
aaaatctactcactatag

SEQ ID NO: 32344 - DNA, 18 bp, Artificial Sequence
  Synthetic DNA
aaatacgacgctctattg

SEQ ID NO: 32345 - DNA, 18 bp, Artificial Sequence
  Synthetic DNA
aaatacgacttacaattg

SEQ ID NO: 32346 - DNA, 18 bp, Artificial Sequence
  Synthetic DNA
aaattcgattctctatag

SEQ ID NO: 32347 - DNA, 18 bp, Artificial Sequence
  Synthetic DNA
aagttcaactcactatag

SEQ ID NO: 32348 - DNA, 18 bp, Artificial Sequence
  Synthetic DNA
aattacgactcaatattg

SEQ ID NO: 32349 - DNA, 18 bp, Artificial Sequence
  Synthetic DNA
aattacgagtcactattg

SEQ ID NO: 32350 - DNA, 18 bp, Artificial Sequence
  Synthetic DNA
acatactactcactattg

SEQ ID NO: 32351 - DNA, 18 bp, Artificial Sequence
  Synthetic DNA
caatacgattcgctttag

SEQ ID NO: 32352 - DNA, 18 bp, Artificial Sequence
  Synthetic DNA
ctatacgactctctattg

SEQ ID NO: 32353 - DNA, 18 bp, Artificial Sequence
  Synthetic DNA
taaaaatactcgctatag

SEQ ID NO: 32354 - DNA, 18 bp, Artificial Sequence
  Synthetic DNA
taaaacgacacgcaatag

SEQ ID NO: 32355 - DNA, 18 bp, Artificial Sequence
  Synthetic DNA
taaaacgacttactcttg

SEQ ID NO: 32356 - DNA, 18 bp, Artificial Sequence
  Synthetic DNA
taaaacgattcaccattg

SEQ ID NO: 32357 - DNA, 18 bp, Artificial Sequence
  Synthetic DNA
taaaatgactctctattg

SEQ ID NO: 32358 - DNA, 18 bp, Artificial Sequence
  Synthetic DNA
taaaccgactcactaatg

SEQ ID NO: 32359 - DNA, 18 bp, Artificial Sequence
  Synthetic DNA
taaatcgactctctatgg

SEQ ID NO: 32360 - DNA, 18 bp, Artificial Sequence
  Synthetic DNA
taaatcgactgtctatag

SEQ ID NO: 32361 - DNA, 18 bp, Artificial Sequence
  Synthetic DNA
taataagagtcacaattg

SEQ ID NO: 32362 - DNA, 18 bp, Artificial Sequence
  Synthetic DNA
taatacaaatcacaattg

SEQ ID NO: 32363 - DNA, 18 bp, Artificial Sequence
  Synthetic DNA
taatacaactctatattg

SEQ ID NO: 32364 - DNA, 18 bp, Artificial Sequence
  Synthetic DNA
taataccactctccattg

SEQ ID NO: 32365 - DNA, 18 bp, Artificial Sequence
  Synthetic DNA
taatacgatacactaatg

SEQ ID NO: 32366 - DNA, 18 bp, Artificial Sequence
  Synthetic DNA
taatacgatttactaatg

SEQ ID NO: 32367 - DNA, 18 bp, Artificial Sequence
  Synthetic DNA
taatacgtttcaatattg

SEQ ID NO: 32368 - DNA, 18 bp, Artificial Sequence
  Synthetic DNA
taatactaattactattg

SEQ ID NO: 32369 - DNA, 18 bp, Artificial Sequence
  Synthetic DNA
taatagtactcattattg

SEQ ID NO: 32370 - DNA, 18 bp, Artificial Sequence
  Synthetic DNA
taatccgatacactattg

SEQ ID NO: 32371 - DNA, 18 bp, Artificial Sequence
  Synthetic DNA
taatcctactcactcttg

SEQ ID NO: 32372 - DNA, 18 bp, Artificial Sequence
  Synthetic DNA
taatgcgacacgttatag

SEQ ID NO: 32373 - DNA, 18 bp, Artificial Sequence
  Synthetic DNA
taattcaaatcactaaag

SEQ ID NO: 32374 - DNA, 18 bp, Artificial Sequence
  Synthetic DNA
taattcaactatctatag

SEQ ID NO: 32375 - DNA, 18 bp, Artificial Sequence
  Synthetic DNA
taattccacacacaatag

SEQ ID NO: 32376 - DNA, 18 bp, Artificial Sequence
  Synthetic DNA
taattcgaccctccatag

SEQ ID NO: 32377 - DNA, 18 bp, Artificial Sequence
  Synthetic DNA
taattcgattctatatag

SEQ ID NO: 32378 - DNA, 18 bp, Artificial Sequence
  Synthetic DNA
taattcgtctcattagag

SEQ ID NO: 32379 - DNA, 18 bp, Artificial Sequence
  Synthetic DNA
tactacaactctctattg

SEQ ID NO: 32380 - DNA, 18 bp, Artificial Sequence
  Synthetic DNA
tagtacgacttacttttg

SEQ ID NO: 32381 - DNA, 18 bp, Artificial Sequence
  Synthetic DNA
tatgtcaactcactatag

SEQ ID NO: 32382 - DNA, 18 bp, Artificial Sequence
  Synthetic DNA
tattacaactcattattg

SEQ ID NO: 32383 - DNA, 18 bp, Artificial Sequence
  Synthetic DNA
tattacaactcgcaatag

SEQ ID NO: 32384 - DNA, 18 bp, Artificial Sequence
  Synthetic DNA
tattacgactcacctttg

SEQ ID NO: 32385 - DNA, 18 bp, Artificial Sequence
  Synthetic DNA
tattacggctgactattg

SEQ ID NO: 32386 - DNA, 18 bp, Artificial Sequence
  Synthetic DNA
tatttcgactctctatcg

SEQ ID NO: 32387 - DNA, 18 bp, Artificial Sequence
  Synthetic DNA
tcataccactcaatattg

SEQ ID NO: 32388 - DNA, 18 bp, Artificial Sequence
  Synthetic DNA
tgatacatctcactattg

SEQ ID NO: 32389 - DNA, 18 bp, Artificial Sequence
  Synthetic DNA
tgattctactcactttag

SEQ ID NO: 32390 - DNA, 18 bp, Artificial Sequence
  Synthetic DNA
ttacaagactcactattg

SEQ ID NO: 32391 - DNA, 18 bp, Artificial Sequence
  Synthetic DNA
ttatacaactcgctttag

SEQ ID NO: 32392 - DNA, 18 bp, Artificial Sequence
  Synthetic DNA
ttatacgactgacaattg

SEQ ID NO: 32393 - DNA, 18 bp, Artificial Sequence
  Synthetic DNA
ttatgcgactctctattg

SEQ ID NO: 32394 - DNA, 18 bp, Artificial Sequence
  Synthetic DNA
ttctatgactcactattg

SEQ ID NO: 32395 - DNA, 18 bp, Artificial Sequence
  Synthetic DNA
ttttacgacccactattg

SEQ ID NO: 32396 - DNA, 18 bp, Artificial Sequence
  Synthetic DNA
aaaaacgtctcactacag

SEQ ID NO: 32397 - DNA, 18 bp, Artificial Sequence
  Synthetic DNA
aaaacctactcactatag

SEQ ID NO: 32398 - DNA, 18 bp, Artificial Sequence
  Synthetic DNA
aaagacaactcacaatag

SEQ ID NO: 32399 - DNA, 18 bp, Artificial Sequence
  Synthetic DNA
aaataccacacaccatag

SEQ ID NO: 32400 - DNA, 18 bp, Artificial Sequence
  Synthetic DNA
aaatacgacactctatcg

SEQ ID NO: 32401 - DNA, 18 bp, Artificial Sequence
  Synthetic DNA
aaataggtctcactttag

SEQ ID NO: 32402 - DNA, 18 bp, Artificial Sequence
  Synthetic DNA
aagtaccactcactaaag

SEQ ID NO: 32403 - DNA, 18 bp, Artificial Sequence
  Synthetic DNA
aattacgtctcactaaag

SEQ ID NO: 32404 - DNA, 18 bp, Artificial Sequence
  Synthetic DNA
acatacgactctccatag

SEQ ID NO: 32405 - DNA, 18 bp, Artificial Sequence
  Synthetic DNA
atatacgtcccactatag

SEQ ID NO: 32406 - DNA, 18 bp, Artificial Sequence
  Synthetic DNA
atatatgattcactatag

SEQ ID NO: 32407 - DNA, 18 bp, Artificial Sequence
  Synthetic DNA
caatatgtctcactacag

SEQ ID NO: 32408 - DNA, 18 bp, Artificial Sequence
  Synthetic DNA
cattacgtctcattatag

SEQ ID NO: 32409 - DNA, 18 bp, Artificial Sequence
  Synthetic DNA
ctatccgtctcactatag

SEQ ID NO: 32410 - DNA, 18 bp, Artificial Sequence
  Synthetic DNA
ctttactactcactatag

SEQ ID NO: 32411 - DNA, 18 bp, Artificial Sequence
  Synthetic DNA
taaaacaacttagtatag

SEQ ID NO: 32412 - DNA, 18 bp, Artificial Sequence
  Synthetic DNA
taaaacgagtcaataaag

SEQ ID NO: 32413 - DNA, 18 bp, Artificial Sequence
  Synthetic DNA
taaaacggcactctatag

SEQ ID NO: 32414 - DNA, 18 bp, Artificial Sequence
  Synthetic DNA
taaaacgtctcaatttag

SEQ ID NO: 32415 - DNA, 18 bp, Artificial Sequence
  Synthetic DNA
taaaatgattcactaaag

SEQ ID NO: 32416 - DNA, 18 bp, Artificial Sequence
  Synthetic DNA
taaaccgacacactaaag

SEQ ID NO: 32417 - DNA, 18 bp, Artificial Sequence
  Synthetic DNA
taaactaactcactatag

SEQ ID NO: 32418 - DNA, 18 bp, Artificial Sequence
  Synthetic DNA
taaactgactctctatag

SEQ ID NO: 32419 - DNA, 18 bp, Artificial Sequence
  Synthetic DNA
taacaagcctcattatag

SEQ ID NO: 32420 - DNA, 18 bp, Artificial Sequence
  Synthetic DNA
taacacgattctctttag

SEQ ID NO: 32421 - DNA, 18 bp, Artificial Sequence
  Synthetic DNA
taacatatctcactatag

SEQ ID NO: 32422 - DNA, 18 bp, Artificial Sequence
  Synthetic DNA
taataagacacactaacg

SEQ ID NO: 32423 - DNA, 18 bp, Artificial Sequence
  Synthetic DNA
taataagactcaattaag

SEQ ID NO: 32424 - DNA, 18 bp, Artificial Sequence
  Synthetic DNA
taataattcacactatag

SEQ ID NO: 32425 - DNA, 18 bp, Artificial Sequence
  Synthetic DNA
taatacatctatctatag

SEQ ID NO: 32426 - DNA, 18 bp, Artificial Sequence
  Synthetic DNA
taatacatctgactttag

SEQ ID NO: 32427 - DNA, 18 bp, Artificial Sequence
  Synthetic DNA
taatacgattcaatttcg

SEQ ID NO: 32428 - DNA, 18 bp, Artificial Sequence
  Synthetic DNA
taatacgtcccactttgg

SEQ ID NO: 32429 - DNA, 18 bp, Artificial Sequence
  Synthetic DNA
taatacgtctcaaaaaag

SEQ ID NO: 32430 - DNA, 18 bp, Artificial Sequence
  Synthetic DNA
taatacgtctcattttgg

SEQ ID NO: 32431 - DNA, 18 bp, Artificial Sequence
  Synthetic DNA
taatacgtctccatgtag

SEQ ID NO: 32432 - DNA, 18 bp, Artificial Sequence
  Synthetic DNA
taatacgtttcattaaag

SEQ ID NO: 32433 - DNA, 18 bp, Artificial Sequence
  Synthetic DNA
taatacgtttgtctatag

SEQ ID NO: 32434 - DNA, 18 bp, Artificial Sequence
  Synthetic DNA
taatactccacactaaag

SEQ ID NO: 32435 - DNA, 18 bp, Artificial Sequence
  Synthetic DNA
taataggtctatctatag

SEQ ID NO: 32436 - DNA, 18 bp, Artificial Sequence
  Synthetic DNA
taatataattcaccatag

SEQ ID NO: 32437 - DNA, 18 bp, Artificial Sequence
  Synthetic DNA
taatatcactctctatgg

SEQ ID NO: 32438 - DNA, 18 bp, Artificial Sequence
  Synthetic DNA
taatatgtcacactttag

SEQ ID NO: 32439 - DNA, 18 bp, Artificial Sequence
  Synthetic DNA
taatattactcccgatag

SEQ ID NO: 32440 - DNA, 18 bp, Artificial Sequence
  Synthetic DNA
taatccaacttactaaag

SEQ ID NO: 32441 - DNA, 18 bp, Artificial Sequence
  Synthetic DNA
taatgcaacacacaatag

SEQ ID NO: 32442 - DNA, 18 bp, Artificial Sequence
  Synthetic DNA
taatgcgtcccacaatag

SEQ ID NO: 32443 - DNA, 18 bp, Artificial Sequence
  Synthetic DNA
tactaccactcaccttag

SEQ ID NO: 32444 - DNA, 18 bp, Artificial Sequence
  Synthetic DNA
tactactactctctaaag

SEQ ID NO: 32445 - DNA, 18 bp, Artificial Sequence
  Synthetic DNA
tagaacgactctctctag

SEQ ID NO: 32446 - DNA, 18 bp, Artificial Sequence
  Synthetic DNA
tagcacgattcactaaag

SEQ ID NO: 32447 - DNA, 18 bp, Artificial Sequence
  Synthetic DNA
tataacgacacactttag

SEQ ID NO: 32448 - DNA, 18 bp, Artificial Sequence
  Synthetic DNA
tataacggctcactaaag

SEQ ID NO: 32449 - DNA, 18 bp, Artificial Sequence
  Synthetic DNA
tataacgtctcaccatag

SEQ ID NO: 32450 - DNA, 18 bp, Artificial Sequence
  Synthetic DNA
tatcacgactgactttag

SEQ ID NO: 32451 - DNA, 18 bp, Artificial Sequence
  Synthetic DNA
tattaagacacaatatag

SEQ ID NO: 32452 - DNA, 18 bp, Artificial Sequence
  Synthetic DNA
tattaatattcactatag

SEQ ID NO: 32453 - DNA, 18 bp, Artificial Sequence
  Synthetic DNA
tattacaaatctctatag

SEQ ID NO: 32454 - DNA, 18 bp, Artificial Sequence
  Synthetic DNA
tattacaacacaatatag

SEQ ID NO: 32455 - DNA, 18 bp, Artificial Sequence
  Synthetic DNA
tattacgaataactttag

SEQ ID NO: 32456 - DNA, 18 bp, Artificial Sequence
  Synthetic DNA
tattacgacataatatag

SEQ ID NO: 32457 - DNA, 18 bp, Artificial Sequence
  Synthetic DNA
tattacgactcaaaatcg

SEQ ID NO: 32458 - DNA, 18 bp, Artificial Sequence
  Synthetic DNA
tattacgactctctgaag

SEQ ID NO: 32459 - DNA, 18 bp, Artificial Sequence
  Synthetic DNA
tattacgattaactatcg

SEQ ID NO: 32460 - DNA, 18 bp, Artificial Sequence
  Synthetic DNA
tattacgattcacttcag

SEQ ID NO: 32461 - DNA, 18 bp, Artificial Sequence
  Synthetic DNA
tattacgattctctctag

SEQ ID NO: 32462 - DNA, 18 bp, Artificial Sequence
  Synthetic DNA
tattacgtctaactctag

SEQ ID NO: 32463 - DNA, 18 bp, Artificial Sequence
  Synthetic DNA
tattactacagactatag

SEQ ID NO: 32464 - DNA, 18 bp, Artificial Sequence
  Synthetic DNA
tattactactctctttag

SEQ ID NO: 32465 - DNA, 18 bp, Artificial Sequence
  Synthetic DNA
tattaggacttacaatag

SEQ ID NO: 32466 - DNA, 18 bp, Artificial Sequence
  Synthetic DNA
tattataactcacaatag

SEQ ID NO: 32467 - DNA, 18 bp, Artificial Sequence
  Synthetic DNA
tattatgactcaaaatag

SEQ ID NO: 32468 - DNA, 18 bp, Artificial Sequence
  Synthetic DNA
tcaaacgacactctatag

SEQ ID NO: 32469 - DNA, 18 bp, Artificial Sequence
  Synthetic DNA
tcatacgacttacattag

SEQ ID NO: 32470 - DNA, 18 bp, Artificial Sequence
  Synthetic DNA
tcatacgtcacaccatag

SEQ ID NO: 32471 - DNA, 18 bp, Artificial Sequence
  Synthetic DNA
tcatatgactaactaaag

SEQ ID NO: 32472 - DNA, 18 bp, Artificial Sequence
  Synthetic DNA
tctaactactcactatag

SEQ ID NO: 32473 - DNA, 18 bp, Artificial Sequence
  Synthetic DNA
tcttacgacacactttag

SEQ ID NO: 32474 - DNA, 18 bp, Artificial Sequence
  Synthetic DNA
tgttacgtcacactatag

SEQ ID NO: 32475 - DNA, 18 bp, Artificial Sequence
  Synthetic DNA
ttaaacgactctatatag

SEQ ID NO: 32476 - DNA, 18 bp, Artificial Sequence
  Synthetic DNA
ttaaacgtctcactctag

SEQ ID NO: 32477 - DNA, 18 bp, Artificial Sequence
  Synthetic DNA
ttatacaactccctttag

SEQ ID NO: 32478 - DNA, 18 bp, Artificial Sequence
  Synthetic DNA
ttatacaactctctaaag

SEQ ID NO: 32479 - DNA, 18 bp, Artificial Sequence
  Synthetic DNA
ttatacaacttagtatag

SEQ ID NO: 32480 - DNA, 18 bp, Artificial Sequence
  Synthetic DNA
ttatacacctcactttag

SEQ ID NO: 32481 - DNA, 18 bp, Artificial Sequence
  Synthetic DNA
ttatacgaatcacaaaag

SEQ ID NO: 32482 - DNA, 18 bp, Artificial Sequence
  Synthetic DNA
ttatacgacaatctatag

SEQ ID NO: 32483 - DNA, 18 bp, Artificial Sequence
  Synthetic DNA
ttatacgacacactctcg

SEQ ID NO: 32484 - DNA, 18 bp, Artificial Sequence
  Synthetic DNA
ttatacgactcaattaag

SEQ ID NO: 32485 - DNA, 18 bp, Artificial Sequence
  Synthetic DNA
ttatacgactcccaatgg

SEQ ID NO: 32486 - DNA, 18 bp, Artificial Sequence
  Synthetic DNA
ttatacgattcaatttag

SEQ ID NO: 32487 - DNA, 18 bp, Artificial Sequence
  Synthetic DNA
ttatacgtctccctacag

SEQ ID NO: 32488 - DNA, 18 bp, Artificial Sequence
  Synthetic DNA
ttatactacacactctag

SEQ ID NO: 32489 - DNA, 18 bp, Artificial Sequence
  Synthetic DNA
ttatactactcaatacag

SEQ ID NO: 32490 - DNA, 18 bp, Artificial Sequence
  Synthetic DNA
ttatactactctctatgg

SEQ ID NO: 32491 - DNA, 18 bp, Artificial Sequence
  Synthetic DNA
ttatatgactcacaatcg

SEQ ID NO: 32492 - DNA, 18 bp, Artificial Sequence
  Synthetic DNA
ttatatgactcacattag

SEQ ID NO: 32493 - DNA, 18 bp, Artificial Sequence
  Synthetic DNA
ttatatgactctatatag

SEQ ID NO: 32494 - DNA, 18 bp, Artificial Sequence
  Synthetic DNA
ttatccgatttactatag

SEQ ID NO: 32495 - DNA, 18 bp, Artificial Sequence
  Synthetic DNA
ttttacgactcaccaaag

SEQ ID NO: 32496 - DNA, 18 bp, Artificial Sequence
  Synthetic DNA
ttttacgactccctttag

SEQ ID NO: 32497 - DNA, 18 bp, Artificial Sequence
  Synthetic DNA
ttttacgtctcattatag

SEQ ID NO: 32498 - DNA, 18 bp, Artificial Sequence
  Synthetic DNA
aatttcgactctctatag

SEQ ID NO: 32499 - DNA, 18 bp, Artificial Sequence
  Synthetic DNA
ttatacgtctcaccattg

SEQ ID NO: 32500 - DNA, 18 bp, Artificial Sequence
  Synthetic DNA
aaatacgtcactctatag

SEQ ID NO: 32501 - DNA, 18 bp, Artificial Sequence
  Synthetic DNA
atatacgattaactatag

SEQ ID NO: 32502 - DNA, 18 bp, Artificial Sequence
  Synthetic DNA
atttacgattcactatag

SEQ ID NO: 32503 - DNA, 18 bp, Artificial Sequence
  Synthetic DNA
taatacaacttacttaag

SEQ ID NO: 32504 - DNA, 18 bp, Artificial Sequence
  Synthetic DNA
taatacatctcaataaag

SEQ ID NO: 32505 - DNA, 18 bp, Artificial Sequence
  Synthetic DNA
taatacgactttcattag

SEQ ID NO: 32506 - DNA, 18 bp, Artificial Sequence
  Synthetic DNA
tattacgactgacttaag

SEQ ID NO: 32507 - DNA, 18 bp, Artificial Sequence
  Synthetic DNA
ttataccactcacttaag

SEQ ID NO: 32508 - DNA, 18 bp, Artificial Sequence
  Synthetic DNA
ttatacaactctctattg

SEQ ID NO: 32509 - DNA, 18 bp, Artificial Sequence
  Synthetic DNA
taactcgtctcactattg

SEQ ID NO: 32510 - DNA, 18 bp, Artificial Sequence
  Synthetic DNA
taattcgcctcattattg

SEQ ID NO: 32511 - DNA, 18 bp, Artificial Sequence
  Synthetic DNA
taattggactaactattg

SEQ ID NO: 32512 - DNA, 18 bp, Artificial Sequence
  Synthetic DNA
taattggactcaatattg

SEQ ID NO: 32513 - DNA, 18 bp, Artificial Sequence
  Synthetic DNA
aattacgactgactattg

SEQ ID NO: 32514 - DNA, 18 bp, Artificial Sequence
  Synthetic DNA
atatacgtctcgctatag

SEQ ID NO: 32515 - DNA, 18 bp, Artificial Sequence
  Synthetic DNA
caaaacaactcactattg

SEQ ID NO: 32516 - DNA, 18 bp, Artificial Sequence
  Synthetic DNA
gaatacgactcgcaaaag

SEQ ID NO: 32517 - DNA, 18 bp, Artificial Sequence
  Synthetic DNA
taaaacgactcacttctg

SEQ ID NO: 32518 - DNA, 18 bp, Artificial Sequence
  Synthetic DNA
taaattgactctctatag

SEQ ID NO: 32519 - DNA, 18 bp, Artificial Sequence
  Synthetic DNA
taacacgacttaatattg

SEQ ID NO: 32520 - DNA, 18 bp, Artificial Sequence
  Synthetic DNA
taataagacacaatattg

SEQ ID NO: 32521 - DNA, 18 bp, Artificial Sequence
  Synthetic DNA
taataagcctcacttttg

SEQ ID NO: 32522 - DNA, 18 bp, Artificial Sequence
  Synthetic DNA
taatacgactcacagatg

SEQ ID NO: 32523 - DNA, 18 bp, Artificial Sequence
  Synthetic DNA
taatacgactctgttttg

SEQ ID NO: 32524 - DNA, 18 bp, Artificial Sequence
  Synthetic DNA
taatacgattctatattg

SEQ ID NO: 32525 - DNA, 18 bp, Artificial Sequence
  Synthetic DNA
taatacgtatcacttttg

SEQ ID NO: 32526 - DNA, 18 bp, Artificial Sequence
  Synthetic DNA
taatacgtcgctctattg

SEQ ID NO: 32527 - DNA, 18 bp, Artificial Sequence
  Synthetic DNA
taatacgtctcgttaaag

SEQ ID NO: 32528 - DNA, 18 bp, Artificial Sequence
  Synthetic DNA
taatacgtttaactattg

SEQ ID NO: 32529 - DNA, 18 bp, Artificial Sequence
  Synthetic DNA
taataggacctactattg

SEQ ID NO: 32530 - DNA, 18 bp, Artificial Sequence
  Synthetic DNA
taatatgacttgctttag

SEQ ID NO: 32531 - DNA, 18 bp, Artificial Sequence
  Synthetic DNA
taatattactcgctttag

SEQ ID NO: 32532 - DNA, 18 bp, Artificial Sequence
  Synthetic DNA
taattcgaaacattatag

SEQ ID NO: 32533 - DNA, 18 bp, Artificial Sequence
  Synthetic DNA
taattcgtctgtctatag

SEQ ID NO: 32534 - DNA, 18 bp, Artificial Sequence
  Synthetic DNA
taattcgtcttattatag

SEQ ID NO: 32535 - DNA, 18 bp, Artificial Sequence
  Synthetic DNA
taattgaacttactatag

SEQ ID NO: 32536 - DNA, 18 bp, Artificial Sequence
  Synthetic DNA
tactaagactcattattg

SEQ ID NO: 32537 - DNA, 18 bp, Artificial Sequence
  Synthetic DNA
tacttcgacttactttag

SEQ ID NO: 32538 - DNA, 18 bp, Artificial Sequence
  Synthetic DNA
tagttcgtcacactatag

SEQ ID NO: 32539 - DNA, 18 bp, Artificial Sequence
  Synthetic DNA
tatttcgactcaatacag

SEQ ID NO: 32540 - DNA, 18 bp, Artificial Sequence
  Synthetic DNA
tatttcgactcacagtag

SEQ ID NO: 32541 - DNA, 18 bp, Artificial Sequence
  Synthetic DNA
tatttcgagtcacaatag

SEQ ID NO: 32542 - DNA, 18 bp, Artificial Sequence
  Synthetic DNA
tcataagtctcactattg

SEQ ID NO: 32543 - DNA, 18 bp, Artificial Sequence
  Synthetic DNA
tcatacgacacattattg

SEQ ID NO: 32544 - DNA, 18 bp, Artificial Sequence
  Synthetic DNA
tcatacgtctcacttttg

SEQ ID NO: 32545 - DNA, 18 bp, Artificial Sequence
  Synthetic DNA
tcattccactctctatag

SEQ ID NO: 32546 - DNA, 18 bp, Artificial Sequence
  Synthetic DNA
tcattcgattcactaaag

SEQ ID NO: 32547 - DNA, 18 bp, Artificial Sequence
  Synthetic DNA
tgatacgacacacttttg

SEQ ID NO: 32548 - DNA, 18 bp, Artificial Sequence
  Synthetic DNA
ttactcgacttactatag

SEQ ID NO: 32549 - DNA, 18 bp, Artificial Sequence
  Synthetic DNA
ttatacgactccttattg

SEQ ID NO: 32550 - DNA, 18 bp, Artificial Sequence
  Synthetic DNA
ttattcgactcaatatcg

SEQ ID NO: 32551 - DNA, 18 bp, Artificial Sequence
  Synthetic DNA
ttattcgattcactaaag

SEQ ID NO: 32552 - DNA, 18 bp, Artificial Sequence
  Synthetic DNA
ttatttgactcaccatag

SEQ ID NO: 32553 - DNA, 18 bp, Artificial Sequence
  Synthetic DNA
ttgtactactcactattg

SEQ ID NO: 32554 - DNA, 18 bp, Artificial Sequence
  Synthetic DNA
aaatacaactcacaataa

SEQ ID NO: 32555 - DNA, 18 bp, Artificial Sequence
  Synthetic DNA
aaatacaacttacaatag

SEQ ID NO: 32556 - DNA, 18 bp, Artificial Sequence
  Synthetic DNA
aaatacatttcactatag

SEQ ID NO: 32557 - DNA, 18 bp, Artificial Sequence
  Synthetic DNA
aaatacgaccctctaaag

SEQ ID NO: 32558 - DNA, 18 bp, Artificial Sequence
  Synthetic DNA
aaatacgattcacttaag

SEQ ID NO: 32559 - DNA, 18 bp, Artificial Sequence
  Synthetic DNA
aaatacgtcacaccatag

SEQ ID NO: 32560 - DNA, 18 bp, Artificial Sequence
  Synthetic DNA
aaatacgtcccactttag

SEQ ID NO: 32561 - DNA, 18 bp, Artificial Sequence
  Synthetic DNA
aagtactactcactttag

SEQ ID NO: 32562 - DNA, 18 bp, Artificial Sequence
  Synthetic DNA
aatcaccactcactatag

SEQ ID NO: 32563 - DNA, 18 bp, Artificial Sequence
  Synthetic DNA
acatacaactcacaatag

SEQ ID NO: 32564 - DNA, 18 bp, Artificial Sequence
  Synthetic DNA
acatacgtctctctatag

SEQ ID NO: 32565 - DNA, 18 bp, Artificial Sequence
  Synthetic DNA
atatacgattcaccatag

SEQ ID NO: 32566 - DNA, 18 bp, Artificial Sequence
  Synthetic DNA
atctacgacacactatag

SEQ ID NO: 32567 - DNA, 18 bp, Artificial Sequence
  Synthetic DNA
atgtacgtctcactatag

SEQ ID NO: 32568 - DNA, 18 bp, Artificial Sequence
  Synthetic DNA
cattacgactcaccttag

SEQ ID NO: 32569 - DNA, 18 bp, Artificial Sequence
  Synthetic DNA
gaaaacgactctctgtag

SEQ ID NO: 32570 - DNA, 18 bp, Artificial Sequence
  Synthetic DNA
taaaacaacacactttag

SEQ ID NO: 32571 - DNA, 18 bp, Artificial Sequence
  Synthetic DNA
taaaacaattcattatag

SEQ ID NO: 32572 - DNA, 18 bp, Artificial Sequence
  Synthetic DNA
taaaaccactcacaaaag

SEQ ID NO: 32573 - DNA, 18 bp, Artificial Sequence
  Synthetic DNA
taaaacgacaccctttag

SEQ ID NO: 32574 - DNA, 18 bp, Artificial Sequence
  Synthetic DNA
taaaacgactaccaatag

SEQ ID NO: 32575 - DNA, 18 bp, Artificial Sequence
  Synthetic DNA
taaaacttcacactatag

SEQ ID NO: 32576 - DNA, 18 bp, Artificial Sequence
  Synthetic DNA
taaaataactctctatag

SEQ ID NO: 32577 - DNA, 18 bp, Artificial Sequence
  Synthetic DNA
taaaatgactcacattag

SEQ ID NO: 32578 - DNA, 18 bp, Artificial Sequence
  Synthetic DNA
taaaattactctctatag

SEQ ID NO: 32579 - DNA, 18 bp, Artificial Sequence
  Synthetic DNA
taaaccgactgactatcg

SEQ ID NO: 32580 - DNA, 18 bp, Artificial Sequence
  Synthetic DNA
taacactacacactctag

SEQ ID NO: 32581 - DNA, 18 bp, Artificial Sequence
  Synthetic DNA
taataacactaacaatag

SEQ ID NO: 32582 - DNA, 18 bp, Artificial Sequence
  Synthetic DNA
taataagactcacataag

SEQ ID NO: 32583 - DNA, 18 bp, Artificial Sequence
  Synthetic DNA
taataagattcacaacag

SEQ ID NO: 32584 - DNA, 18 bp, Artificial Sequence
  Synthetic DNA
taataagattcactgcag

SEQ ID NO: 32585 - DNA, 18 bp, Artificial Sequence
  Synthetic DNA
taatacgaatcaattaag

SEQ ID NO: 32586 - DNA, 18 bp, Artificial Sequence
  Synthetic DNA
taatacgaatcattcaag

SEQ ID NO: 32587 - DNA, 18 bp, Artificial Sequence
  Synthetic DNA
taatacgacactgaatag

SEQ ID NO: 32588 - DNA, 18 bp, Artificial Sequence
  Synthetic DNA
taatacgactatcagtag

SEQ ID NO: 32589 - DNA, 18 bp, Artificial Sequence
  Synthetic DNA
taatacgactctaaagag

SEQ ID NO: 32590 - DNA, 18 bp, Artificial Sequence
  Synthetic DNA
taatacgatcaactaaag

SEQ ID NO: 32591 - DNA, 18 bp, Artificial Sequence
  Synthetic DNA
taatacgatccataatag

SEQ ID NO: 32592 - DNA, 18 bp, Artificial Sequence
  Synthetic DNA
taatacggctctcaaaag

SEQ ID NO: 32593 - DNA, 18 bp, Artificial Sequence
  Synthetic DNA
taatacgtcacaacatag

SEQ ID NO: 32594 - DNA, 18 bp, Artificial Sequence
  Synthetic DNA
taatacgtcacactcaag

SEQ ID NO: 32595 - DNA, 18 bp, Artificial Sequence
  Synthetic DNA
taatacgtgacacaatag

SEQ ID NO: 32596 - DNA, 18 bp, Artificial Sequence
  Synthetic DNA
taatacgtttcattctag

SEQ ID NO: 32597 - DNA, 18 bp, Artificial Sequence
  Synthetic DNA
taatacgtttgactaaag

SEQ ID NO: 32598 - DNA, 18 bp, Artificial Sequence
  Synthetic DNA
taatactacacaccaaag

SEQ ID NO: 32599 - DNA, 18 bp, Artificial Sequence
  Synthetic DNA
taatactattcaaaatag

SEQ ID NO: 32600 - DNA, 18 bp, Artificial Sequence
  Synthetic DNA
taatatctctcactaaag

SEQ ID NO: 32601 - DNA, 18 bp, Artificial Sequence
  Synthetic DNA
taatatgacatactaaag

SEQ ID NO: 32602 - DNA, 18 bp, Artificial Sequence
  Synthetic DNA
taatatgactcacctaag

SEQ ID NO: 32603 - DNA, 18 bp, Artificial Sequence
  Synthetic DNA
taatatgactctctcaag

SEQ ID NO: 32604 - DNA, 18 bp, Artificial Sequence
  Synthetic DNA
taatatgactttcaatag

SEQ ID NO: 32605 - DNA, 18 bp, Artificial Sequence
  Synthetic DNA
taatccgactctttgtag

SEQ ID NO: 32606 - DNA, 18 bp, Artificial Sequence
  Synthetic DNA
taatccgactgtctttag

SEQ ID NO: 32607 - DNA, 18 bp, Artificial Sequence
  Synthetic DNA
taatccgtctctctttag

SEQ ID NO: 32608 - DNA, 18 bp, Artificial Sequence
  Synthetic DNA
taatcctactcaataaag

SEQ ID NO: 32609 - DNA, 18 bp, Artificial Sequence
  Synthetic DNA
taatgcgagtaactatgg

SEQ ID NO: 32610 - DNA, 18 bp, Artificial Sequence
  Synthetic DNA
tacaactactcactttag

SEQ ID NO: 32611 - DNA, 18 bp, Artificial Sequence
  Synthetic DNA
tacagcgactcaatatag

SEQ ID NO: 32612 - DNA, 18 bp, Artificial Sequence
  Synthetic DNA
tactacaactccctttag

SEQ ID NO: 32613 - DNA, 18 bp, Artificial Sequence
  Synthetic DNA
tactacgtatcactaaag

SEQ ID NO: 32614 - DNA, 18 bp, Artificial Sequence
  Synthetic DNA
tactacgtcacactatgg

SEQ ID NO: 32615 - DNA, 18 bp, Artificial Sequence
  Synthetic DNA
tactatgactccctttag

SEQ ID NO: 32616 - DNA, 18 bp, Artificial Sequence
  Synthetic DNA
tagaacgactcacattag

SEQ ID NO: 32617 - DNA, 18 bp, Artificial Sequence
  Synthetic DNA
tagtacgattcacaaaag

SEQ ID NO: 32618 - DNA, 18 bp, Artificial Sequence
  Synthetic DNA
tataaagactcaatatag

SEQ ID NO: 32619 - DNA, 18 bp, Artificial Sequence
  Synthetic DNA
tataacgaatcacaatag

SEQ ID NO: 32620 - DNA, 18 bp, Artificial Sequence
  Synthetic DNA
tataacgtctctctatag

SEQ ID NO: 32621 - DNA, 18 bp, Artificial Sequence
  Synthetic DNA
tatacagactcactatag

SEQ ID NO: 32622 - DNA, 18 bp, Artificial Sequence
  Synthetic DNA
tatcacaactcactctag

SEQ ID NO: 32623 - DNA, 18 bp, Artificial Sequence
  Synthetic DNA
tatcatgaatcactatag

SEQ ID NO: 32624 - DNA, 18 bp, Artificial Sequence
  Synthetic DNA
tattaaaactcaatatag

SEQ ID NO: 32625 - DNA, 18 bp, Artificial Sequence
  Synthetic DNA
tattaagtctcattatag

SEQ ID NO: 32626 - DNA, 18 bp, Artificial Sequence
  Synthetic DNA
tattacaaatcactaaag

SEQ ID NO: 32627 - DNA, 18 bp, Artificial Sequence
  Synthetic DNA
tattacatctcaatatag

SEQ ID NO: 32628 - DNA, 18 bp, Artificial Sequence
  Synthetic DNA
tattacctcttactatag

SEQ ID NO: 32629 - DNA, 18 bp, Artificial Sequence
  Synthetic DNA
tattacgaatcattctag

SEQ ID NO: 32630 - DNA, 18 bp, Artificial Sequence
  Synthetic DNA
tattacgaccccctttag

SEQ ID NO: 32631 - DNA, 18 bp, Artificial Sequence
  Synthetic DNA
tattacgagtctctttag

SEQ ID NO: 32632 - DNA, 18 bp, Artificial Sequence
  Synthetic DNA
tattcctaatcactatag

SEQ ID NO: 32633 - DNA, 18 bp, Artificial Sequence
  Synthetic DNA
tattgcaactctctatag

SEQ ID NO: 32634 - DNA, 18 bp, Artificial Sequence
  Synthetic DNA
tattgcgattcactttag

SEQ ID NO: 32635 - DNA, 18 bp, Artificial Sequence
  Synthetic DNA
tcatacaaattactatag

SEQ ID NO: 32636 - DNA, 18 bp, Artificial Sequence
  Synthetic DNA
tcatacgacacaacatag

SEQ ID NO: 32637 - DNA, 18 bp, Artificial Sequence
  Synthetic DNA
tcatacgtttcattatag

SEQ ID NO: 32638 - DNA, 18 bp, Artificial Sequence
  Synthetic DNA
tcatcccactcactaaag

SEQ ID NO: 32639 - DNA, 18 bp, Artificial Sequence
  Synthetic DNA
tgaaactactctctatag

SEQ ID NO: 32640 - DNA, 18 bp, Artificial Sequence
  Synthetic DNA
tgatacgtctcacttaag

SEQ ID NO: 32641 - DNA, 18 bp, Artificial Sequence
  Synthetic DNA
ttaaaccactcacaatag

SEQ ID NO: 32642 - DNA, 18 bp, Artificial Sequence
  Synthetic DNA
ttaaacgagtcactaaag

SEQ ID NO: 32643 - DNA, 18 bp, Artificial Sequence
  Synthetic DNA
ttacacgactctctaaag

SEQ ID NO: 32644 - DNA, 18 bp, Artificial Sequence
  Synthetic DNA
ttatacaactcattttag

SEQ ID NO: 32645 - DNA, 18 bp, Artificial Sequence
  Synthetic DNA
ttataccacaaactatag

SEQ ID NO: 32646 - DNA, 18 bp, Artificial Sequence
  Synthetic DNA
ttatacgacacacaatgg

SEQ ID NO: 32647 - DNA, 18 bp, Artificial Sequence
  Synthetic DNA
ttatacgactctcaacag

SEQ ID NO: 32648 - DNA, 18 bp, Artificial Sequence
  Synthetic DNA
ttatacgacttccaatag

SEQ ID NO: 32649 - DNA, 18 bp, Artificial Sequence
  Synthetic DNA
ttatacgattaactaaag

SEQ ID NO: 32650 - DNA, 18 bp, Artificial Sequence
  Synthetic DNA
ttatacgattcattacag

SEQ ID NO: 32651 - DNA, 18 bp, Artificial Sequence
  Synthetic DNA
ttatacgtcacactgtag

SEQ ID NO: 32652 - DNA, 18 bp, Artificial Sequence
  Synthetic DNA
ttatactcctcactaaag

SEQ ID NO: 32653 - DNA, 18 bp, Artificial Sequence
  Synthetic DNA
ttatatgtcacactatag

SEQ ID NO: 32654 - DNA, 18 bp, Artificial Sequence
  Synthetic DNA
ttttccgtctcactatag

SEQ ID NO: 32655 - DNA, 18 bp, Artificial Sequence
  Synthetic DNA
taattcgtctcacttaag

SEQ ID NO: 32656 - DNA, 18 bp, Artificial Sequence
  Synthetic DNA
taatactactctctaatg

SEQ ID NO: 32657 - DNA, 18 bp, Artificial Sequence
  Synthetic DNA
taatacatctctctaaag

SEQ ID NO: 32658 - DNA, 18 bp, Artificial Sequence
  Synthetic DNA
taaaacgactctctaatg

SEQ ID NO: 32659 - DNA, 18 bp, Artificial Sequence
  Synthetic DNA
taataagactctcaattg

SEQ ID NO: 32660 - DNA, 18 bp, Artificial Sequence
  Synthetic DNA
taattcgacattctatag

SEQ ID NO: 32661 - DNA, 18 bp, Artificial Sequence
  Synthetic DNA
taatttgactcacttaag

SEQ ID NO: 32662 - DNA, 18 bp, Artificial Sequence
  Synthetic DNA
ttatacgtctcacttttg

SEQ ID NO: 32663 - DNA, 18 bp, Artificial Sequence
  Synthetic DNA
ttattcgacacacaatag

SEQ ID NO: 32664 - DNA, 18 bp, Artificial Sequence
  Synthetic DNA
aaatactacacactaaag

SEQ ID NO: 32665 - DNA, 18 bp, Artificial Sequence
  Synthetic DNA
taatatgacaaactttag

SEQ ID NO: 32666 - DNA, 18 bp, Artificial Sequence
  Synthetic DNA
tagtacgtctctcaatag

SEQ ID NO: 32667 - DNA, 18 bp, Artificial Sequence
  Synthetic DNA
ttatacaacaaactatag

SEQ ID NO: 32668 - DNA, 18 bp, Artificial Sequence
  Synthetic DNA
ttatatgactctcaatag

SEQ ID NO: 32669 - DNA, 18 bp, Artificial Sequence
  Synthetic DNA
ttttacgacttactaaag

SEQ ID NO: 32670 - DNA, 18 bp, Artificial Sequence
  Synthetic DNA
ttatacaattcactattg

SEQ ID NO: 32671 - DNA, 18 bp, Artificial Sequence
  Synthetic DNA
taatacgtctctcaaaag

SEQ ID NO: 32672 - DNA, 18 bp, Artificial Sequence
  Synthetic DNA
taattcgactcgcaaaag

SEQ ID NO: 32673 - DNA, 18 bp, Artificial Sequence
  Synthetic DNA
taattcgactgacttttg

SEQ ID NO: 32674 - DNA, 18 bp, Artificial Sequence
  Synthetic DNA
aaaatcgactcactttag

SEQ ID NO: 32675 - DNA, 18 bp, Artificial Sequence
  Synthetic DNA
aaattggtctcactatag

SEQ ID NO: 32676 - DNA, 18 bp, Artificial Sequence
  Synthetic DNA
acattcgattcactatag

SEQ ID NO: 32677 - DNA, 18 bp, Artificial Sequence
  Synthetic DNA
agattcgactcacaatag

SEQ ID NO: 32678 - DNA, 18 bp, Artificial Sequence
  Synthetic DNA
atatacgactaactattg

SEQ ID NO: 32679 - DNA, 18 bp, Artificial Sequence
  Synthetic DNA
atatacgactcattattg

SEQ ID NO: 32680 - DNA, 18 bp, Artificial Sequence
  Synthetic DNA
atattcaactcactatag

SEQ ID NO: 32681 - DNA, 18 bp, Artificial Sequence
  Synthetic DNA
taaaacgacacactactg

SEQ ID NO: 32682 - DNA, 18 bp, Artificial Sequence
  Synthetic DNA
taaaacgacacactcttg

SEQ ID NO: 32683 - DNA, 18 bp, Artificial Sequence
  Synthetic DNA
taaaacgacccacttttg

SEQ ID NO: 32684 - DNA, 18 bp, Artificial Sequence
  Synthetic DNA
taaaacttctcactattg

SEQ ID NO: 32685 - DNA, 18 bp, Artificial Sequence
  Synthetic DNA
taacacgactcacatttg

SEQ ID NO: 32686 - DNA, 18 bp, Artificial Sequence
  Synthetic DNA
taacacgactcgcttaag

SEQ ID NO: 32687 - DNA, 18 bp, Artificial Sequence
  Synthetic DNA
taacactcctcactattg

SEQ ID NO: 32688 - DNA, 18 bp, Artificial Sequence
  Synthetic DNA
taatacatctctctattg

SEQ ID NO: 32689 - DNA, 18 bp, Artificial Sequence
  Synthetic DNA
taataccattctctattg

SEQ ID NO: 32690 - DNA, 18 bp, Artificial Sequence
  Synthetic DNA
taatacgactctaaattg

SEQ ID NO: 32691 - DNA, 18 bp, Artificial Sequence
  Synthetic DNA
taatacgcctctttattg

SEQ ID NO: 32692 - DNA, 18 bp, Artificial Sequence
  Synthetic DNA
taatatgactcagttttg

SEQ ID NO: 32693 - DNA, 18 bp, Artificial Sequence
  Synthetic DNA
taatatgtctcacaattg

SEQ ID NO: 32694 - DNA, 18 bp, Artificial Sequence
  Synthetic DNA
taatccgaatcacaattg

SEQ ID NO: 32695 - DNA, 18 bp, Artificial Sequence
  Synthetic DNA
taatgcgacatactattg

SEQ ID NO: 32696 - DNA, 18 bp, Artificial Sequence
  Synthetic DNA
taattagtatcactatag

SEQ ID NO: 32697 - DNA, 18 bp, Artificial Sequence
  Synthetic DNA
taattcatctcaatatag

SEQ ID NO: 32698 - DNA, 18 bp, Artificial Sequence
  Synthetic DNA
taattccacccactaaag

SEQ ID NO: 32699 - DNA, 18 bp, Artificial Sequence
  Synthetic DNA
taattcgacacactaacg

SEQ ID NO: 32700 - DNA, 18 bp, Artificial Sequence
  Synthetic DNA
taattcgactcaaattag

SEQ ID NO: 32701 - DNA, 18 bp, Artificial Sequence
  Synthetic DNA
taattcgactctctttcg

SEQ ID NO: 32702 - DNA, 18 bp, Artificial Sequence
  Synthetic DNA
tagtaatactcactattg

SEQ ID NO: 32703 - DNA, 18 bp, Artificial Sequence
  Synthetic DNA
tagttagactaactatag

SEQ ID NO: 32704 - DNA, 18 bp, Artificial Sequence
  Synthetic DNA
tattacaacttactattg

SEQ ID NO: 32705 - DNA, 18 bp, Artificial Sequence
  Synthetic DNA
tattacgactcacaaatg

SEQ ID NO: 32706 - DNA, 18 bp, Artificial Sequence
  Synthetic DNA
tattgcgactcactcttg

SEQ ID NO: 32707 - DNA, 18 bp, Artificial Sequence
  Synthetic DNA
tatttcctctcactatag

SEQ ID NO: 32708 - DNA, 18 bp, Artificial Sequence
  Synthetic DNA
tatttcgactcaccatgg

SEQ ID NO: 32709 - DNA, 18 bp, Artificial Sequence
  Synthetic DNA
tcattcgactctttatag

SEQ ID NO: 32710 - DNA, 18 bp, Artificial Sequence
  Synthetic DNA
tctttcaactcactatag

SEQ ID NO: 32711 - DNA, 18 bp, Artificial Sequence
  Synthetic DNA
tgaaacaactcactattg

SEQ ID NO: 32712 - DNA, 18 bp, Artificial Sequence
  Synthetic DNA
tggaacgactcactattg

SEQ ID NO: 32713 - DNA, 18 bp, Artificial Sequence
  Synthetic DNA
ttagacgattcactattg

SEQ ID NO: 32714 - DNA, 18 bp, Artificial Sequence
  Synthetic DNA
ttattcgactcaaaatag

SEQ ID NO: 32715 - DNA, 18 bp, Artificial Sequence
  Synthetic DNA
aaaaaagactcactaaag

SEQ ID NO: 32716 - DNA, 18 bp, Artificial Sequence
  Synthetic DNA
aaaaacgtctctctatag

SEQ ID NO: 32717 - DNA, 18 bp, Artificial Sequence
  Synthetic DNA
aaatacgacactatatag

SEQ ID NO: 32718 - DNA, 18 bp, Artificial Sequence
  Synthetic DNA
aaatacgattctttatag

SEQ ID NO: 32719 - DNA, 18 bp, Artificial Sequence
  Synthetic DNA
aaatatgactgactaaag

SEQ ID NO: 32720 - DNA, 18 bp, Artificial Sequence
  Synthetic DNA
aaatgcaactctctatag

SEQ ID NO: 32721 - DNA, 18 bp, Artificial Sequence
  Synthetic DNA
aattacgactcactttgg

SEQ ID NO: 32722 - DNA, 18 bp, Artificial Sequence
  Synthetic DNA
atatacgactcaatacag

SEQ ID NO: 32723 - DNA, 18 bp, Artificial Sequence
  Synthetic DNA
atatacgactgactttag

SEQ ID NO: 32724 - DNA, 18 bp, Artificial Sequence
  Synthetic DNA
atatacgattgactatag

SEQ ID NO: 32725 - DNA, 18 bp, Artificial Sequence
  Synthetic DNA
atatacgcctcactatgg

SEQ ID NO: 32726 - DNA, 18 bp, Artificial Sequence
  Synthetic DNA
atatactactcactttag

SEQ ID NO: 32727 - DNA, 18 bp, Artificial Sequence
  Synthetic DNA
atatactactctctatag

SEQ ID NO: 32728 - DNA, 18 bp, Artificial Sequence
  Synthetic DNA
atataggactctctatag

SEQ ID NO: 32729 - DNA, 18 bp, Artificial Sequence
  Synthetic DNA
caataaaacacactatag

SEQ ID NO: 32730 - DNA, 18 bp, Artificial Sequence
  Synthetic DNA
caataagactctttatag

SEQ ID NO: 32731 - DNA, 18 bp, Artificial Sequence
  Synthetic DNA
caataagtctcactttag

SEQ ID NO: 32732 - DNA, 18 bp, Artificial Sequence
  Synthetic DNA
cattacgacttactaaag

SEQ ID NO: 32733 - DNA, 18 bp, Artificial Sequence
  Synthetic DNA
gacaactactcactatag

SEQ ID NO: 32734 - DNA, 18 bp, Artificial Sequence
  Synthetic DNA
taaaaagagtcagtatag

SEQ ID NO: 32735 - DNA, 18 bp, Artificial Sequence
  Synthetic DNA
taaaaagattcactttag

SEQ ID NO: 32736 - DNA, 18 bp, Artificial Sequence
  Synthetic DNA
taaaacgagagactatag

SEQ ID NO: 32737 - DNA, 18 bp, Artificial Sequence
  Synthetic DNA
taaaacgtctaaccatag

SEQ ID NO: 32738 - DNA, 18 bp, Artificial Sequence
  Synthetic DNA
taaaacgtctcaataaag

SEQ ID NO: 32739 - DNA, 18 bp, Artificial Sequence
  Synthetic DNA
taaaactgcacactatag

SEQ ID NO: 32740 - DNA, 18 bp, Artificial Sequence
  Synthetic DNA
taaaccgaatcactatcg

SEQ ID NO: 32741 - DNA, 18 bp, Artificial Sequence
  Synthetic DNA
taaaccgtctcactttag

SEQ ID NO: 32742 - DNA, 18 bp, Artificial Sequence
  Synthetic DNA
taaagcgattctctatag

SEQ ID NO: 32743 - DNA, 18 bp, Artificial Sequence
  Synthetic DNA
taacatgacacactaaag

SEQ ID NO: 32744 - DNA, 18 bp, Artificial Sequence
  Synthetic DNA
taacatgtctcattatag

SEQ ID NO: 32745 - DNA, 18 bp, Artificial Sequence
  Synthetic DNA
taataacactcattttag

SEQ ID NO: 32746 - DNA, 18 bp, Artificial Sequence
  Synthetic DNA
taataagattcacaaaag

SEQ ID NO: 32747 - DNA, 18 bp, Artificial Sequence
  Synthetic DNA
taatacaactcatcaaag

SEQ ID NO: 32748 - DNA, 18 bp, Artificial Sequence
  Synthetic DNA
taatacaactctctcaag

SEQ ID NO: 32749 - DNA, 18 bp, Artificial Sequence
  Synthetic DNA
taatacaataaactatag

SEQ ID NO: 32750 - DNA, 18 bp, Artificial Sequence
  Synthetic DNA
taataccactcaaaaaag

SEQ ID NO: 32751 - DNA, 18 bp, Artificial Sequence
  Synthetic DNA
taatacctctgtctatag

SEQ ID NO: 32752 - DNA, 18 bp, Artificial Sequence
  Synthetic DNA
taatacgatacattttag

SEQ ID NO: 32753 - DNA, 18 bp, Artificial Sequence
  Synthetic DNA
taatacgattctcaaaag

SEQ ID NO: 32754 - DNA, 18 bp, Artificial Sequence
  Synthetic DNA
taatacgtccctctaaag

SEQ ID NO: 32755 - DNA, 18 bp, Artificial Sequence
  Synthetic DNA
taatacgtttcactaacg

SEQ ID NO: 32756 - DNA, 18 bp, Artificial Sequence
  Synthetic DNA
taatactacaaacaatag

SEQ ID NO: 32757 - DNA, 18 bp, Artificial Sequence
  Synthetic DNA
taatactacactctatgg

SEQ ID NO: 32758 - DNA, 18 bp, Artificial Sequence
  Synthetic DNA
taatactactctttatgg

SEQ ID NO: 32759 - DNA, 18 bp, Artificial Sequence
  Synthetic DNA
taatactattcacttaag

SEQ ID NO: 32760 - DNA, 18 bp, Artificial Sequence
  Synthetic DNA
taatatcacacacaatag

SEQ ID NO: 32761 - DNA, 18 bp, Artificial Sequence
  Synthetic DNA
taatatgcctctctatgg

SEQ ID NO: 32762 - DNA, 18 bp, Artificial Sequence
  Synthetic DNA
taatatgtctaacaatag

SEQ ID NO: 32763 - DNA, 18 bp, Artificial Sequence
  Synthetic DNA
taatatgtcttactaaag

SEQ ID NO: 32764 - DNA, 18 bp, Artificial Sequence
  Synthetic DNA
taatgcaactctctttag

SEQ ID NO: 32765 - DNA, 18 bp, Artificial Sequence
  Synthetic DNA
taatgcgacacacaaaag

SEQ ID NO: 32766 - DNA, 18 bp, Artificial Sequence
  Synthetic DNA
tagtaagaatcacaatag

SEQ ID NO: 32767 - DNA, 18 bp, Artificial Sequence
  Synthetic DNA
tagtacgatatactatag

SEQ ID NO: 32768 - DNA, 18 bp, Artificial Sequence
  Synthetic DNA
tagtacgtcccacaatag

SEQ ID NO: 32769 - DNA, 18 bp, Artificial Sequence
  Synthetic DNA
tagtacgtctcacattag

SEQ ID NO: 32770 - DNA, 18 bp, Artificial Sequence
  Synthetic DNA
tataacgactaactttag

SEQ ID NO: 32771 - DNA, 18 bp, Artificial Sequence
  Synthetic DNA
tattacaacttactgtag

SEQ ID NO: 32772 - DNA, 18 bp, Artificial Sequence
  Synthetic DNA
tattacaagtcacaatag

SEQ ID NO: 32773 - DNA, 18 bp, Artificial Sequence
  Synthetic DNA
tattaccaatctctatag

SEQ ID NO: 32774 - DNA, 18 bp, Artificial Sequence
  Synthetic DNA
tattacgacacactttcg

SEQ ID NO: 32775 - DNA, 18 bp, Artificial Sequence
  Synthetic DNA
tattacgactcataagag

SEQ ID NO: 32776 - DNA, 18 bp, Artificial Sequence
  Synthetic DNA
tattacgactcattttcg

SEQ ID NO: 32777 - DNA, 18 bp, Artificial Sequence
  Synthetic DNA
tattacgagtcacaaaag

SEQ ID NO: 32778 - DNA, 18 bp, Artificial Sequence
  Synthetic DNA
tattacgtctatctatag

SEQ ID NO: 32779 - DNA, 18 bp, Artificial Sequence
  Synthetic DNA
tattccgacacacaatag

SEQ ID NO: 32780 - DNA, 18 bp, Artificial Sequence
  Synthetic DNA
tattccgacacactttag

SEQ ID NO: 32781 - DNA, 18 bp, Artificial Sequence
  Synthetic DNA
tcataccactcaatctag

SEQ ID NO: 32782 - DNA, 18 bp, Artificial Sequence
  Synthetic DNA
tgatacgtatcacaatag

SEQ ID NO: 32783 - DNA, 18 bp, Artificial Sequence
  Synthetic DNA
ttaaacggctctctatag

SEQ ID NO: 32784 - DNA, 18 bp, Artificial Sequence
  Synthetic DNA
ttaaaggactcaatatag

SEQ ID NO: 32785 - DNA, 18 bp, Artificial Sequence
  Synthetic DNA
ttacacgcctcaatatag

SEQ ID NO: 32786 - DNA, 18 bp, Artificial Sequence
  Synthetic DNA
ttatacaacacaatatag

SEQ ID NO: 32787 - DNA, 18 bp, Artificial Sequence
  Synthetic DNA
ttatacctctctctatag

SEQ ID NO: 32788 - DNA, 18 bp, Artificial Sequence
  Synthetic DNA
ttatacttatcactatag

SEQ ID NO: 32789 - DNA, 18 bp, Artificial Sequence
  Synthetic DNA
ttatatgatacactatag

SEQ ID NO: 32790 - DNA, 18 bp, Artificial Sequence
  Synthetic DNA
ttatatgtctcactaaag

SEQ ID NO: 32791 - DNA, 18 bp, Artificial Sequence
  Synthetic DNA
ttatccgactcaatttag

SEQ ID NO: 32792 - DNA, 18 bp, Artificial Sequence
  Synthetic DNA
ttatcctactcattatag

SEQ ID NO: 32793 - DNA, 18 bp, Artificial Sequence
  Synthetic DNA
ttatgcgactcattttag

SEQ ID NO: 32794 - DNA, 18 bp, Artificial Sequence
  Synthetic DNA
ttctacaaatcactatag

SEQ ID NO: 32795 - DNA, 18 bp, Artificial Sequence
  Synthetic DNA
ttttacaactcacaatag

SEQ ID NO: 32796 - DNA, 18 bp, Artificial Sequence
  Synthetic DNA
ttttatgactcacaatag

SEQ ID NO: 32797 - DNA, 18 bp, Artificial Sequence
  Synthetic DNA
taatttgactcacaattg

SEQ ID NO: 32798 - DNA, 18 bp, Artificial Sequence
  Synthetic DNA
ttttacgactcacaattg

SEQ ID NO: 32799 - DNA, 18 bp, Artificial Sequence
  Synthetic DNA
aaactcaactcactatag

SEQ ID NO: 32800 - DNA, 18 bp, Artificial Sequence
  Synthetic DNA
taatttgaatcactaaag

SEQ ID NO: 32801 - DNA, 18 bp, Artificial Sequence
  Synthetic DNA
tataacgattcactttag

SEQ ID NO: 32802 - DNA, 18 bp, Artificial Sequence
  Synthetic DNA
tatcactactctctatag

SEQ ID NO: 32803 - DNA, 18 bp, Artificial Sequence
  Synthetic DNA
ttatacgtctctttatag

SEQ ID NO: 32804 - DNA, 18 bp, Artificial Sequence
  Synthetic DNA
ttatattactcactttag

SEQ ID NO: 32805 - DNA, 18 bp, Artificial Sequence
  Synthetic DNA
ttatacgactctctaatg

SEQ ID NO: 32806 - DNA, 18 bp, Artificial Sequence
  Synthetic DNA
ttattctactcactaaag

SEQ ID NO: 32807 - DNA, 18 bp, Artificial Sequence
  Synthetic DNA
ttatacgactttctaaag

SEQ ID NO: 32808 - DNA, 18 bp, Artificial Sequence
  Synthetic DNA
aaattcgactaactattg

SEQ ID NO: 32809 - DNA, 18 bp, Artificial Sequence
  Synthetic DNA
taattagactgactattg

SEQ ID NO: 32810 - DNA, 18 bp, Artificial Sequence
  Synthetic DNA
taattcaactcaatattg

SEQ ID NO: 32811 - DNA, 18 bp, Artificial Sequence
  Synthetic DNA
taattcaactcactgttg

SEQ ID NO: 32812 - DNA, 18 bp, Artificial Sequence
  Synthetic DNA
taattcgacgcattattg

SEQ ID NO: 32813 - DNA, 18 bp, Artificial Sequence
  Synthetic DNA
taatttggctcactattg

SEQ ID NO: 32814 - DNA, 18 bp, Artificial Sequence
  Synthetic DNA
tagttcgactcactagtg

SEQ ID NO: 32815 - DNA, 18 bp, Artificial Sequence
  Synthetic DNA
tatttcgagtcactattg

SEQ ID NO: 32816 - DNA, 18 bp, Artificial Sequence
  Synthetic DNA
aaatacaacacactattg

SEQ ID NO: 32817 - DNA, 18 bp, Artificial Sequence
  Synthetic DNA
aaataccactcacttttg

SEQ ID NO: 32818 - DNA, 18 bp, Artificial Sequence
  Synthetic DNA
aaattccactctctatag

SEQ ID NO: 32819 - DNA, 18 bp, Artificial Sequence
  Synthetic DNA
aaattcgactcattaaag

SEQ ID NO: 32820 - DNA, 18 bp, Artificial Sequence
  Synthetic DNA
acatacgactctctattg

SEQ ID NO: 32821 - DNA, 18 bp, Artificial Sequence
  Synthetic DNA
caattcgattcactaaag

SEQ ID NO: 32822 - DNA, 18 bp, Artificial Sequence
  Synthetic DNA
taaaacgactcagttttg

SEQ ID NO: 32823 - DNA, 18 bp, Artificial Sequence
  Synthetic DNA
taaaacgactctctcttg

SEQ ID NO: 32824 - DNA, 18 bp, Artificial Sequence
  Synthetic DNA
taaaacgactgactaatg

SEQ ID NO: 32825 - DNA, 18 bp, Artificial Sequence
  Synthetic DNA
taaaacgattcacaattg

SEQ ID NO: 32826 - DNA, 18 bp, Artificial Sequence
  Synthetic DNA
taaaacgattcacttttg

SEQ ID NO: 32827 - DNA, 18 bp, Artificial Sequence
  Synthetic DNA
taaaactactcgcaatag

SEQ ID NO: 32828 - DNA, 18 bp, Artificial Sequence
  Synthetic DNA
taaccccactcactattg

SEQ ID NO: 32829 - DNA, 18 bp, Artificial Sequence
  Synthetic DNA
taactcgtctcactaaag

SEQ ID NO: 32830 - DNA, 18 bp, Artificial Sequence
  Synthetic DNA
taatacgacactctaatg

SEQ ID NO: 32831 - DNA, 18 bp, Artificial Sequence
  Synthetic DNA
taatacgactcttaattg

SEQ ID NO: 32832 - DNA, 18 bp, Artificial Sequence
  Synthetic DNA
taatacgtcacactactg

SEQ ID NO: 32833 - DNA, 18 bp, Artificial Sequence
  Synthetic DNA
taatacgtgtctctattg

SEQ ID NO: 32834 - DNA, 18 bp, Artificial Sequence
  Synthetic DNA
taatactaatcactaatg

SEQ ID NO: 32835 - DNA, 18 bp, Artificial Sequence
  Synthetic DNA
taatactactcattaatg

SEQ ID NO: 32836 - DNA, 18 bp, Artificial Sequence
  Synthetic DNA
taatatcactcattattg

SEQ ID NO: 32837 - DNA, 18 bp, Artificial Sequence
  Synthetic DNA
taatattacacactattg

SEQ ID NO: 32838 - DNA, 18 bp, Artificial Sequence
  Synthetic DNA
taattcgacacacttaag

SEQ ID NO: 32839 - DNA, 18 bp, Artificial Sequence
  Synthetic DNA
taattcgatatactatag

SEQ ID NO: 32840 - DNA, 18 bp, Artificial Sequence
  Synthetic DNA
taattcgattcacactag

SEQ ID NO: 32841 - DNA, 18 bp, Artificial Sequence
  Synthetic DNA
taattcgtcccacaatag

SEQ ID NO: 32842 - DNA, 18 bp, Artificial Sequence
  Synthetic DNA
taattcttctctctatag

SEQ ID NO: 32843 - DNA, 18 bp, Artificial Sequence
  Synthetic DNA
taattcttctgactatag

SEQ ID NO: 32844 - DNA, 18 bp, Artificial Sequence
  Synthetic DNA
taattggtctcattatag

SEQ ID NO: 32845 - DNA, 18 bp, Artificial Sequence
  Synthetic DNA
tactacgactcacttatg

SEQ ID NO: 32846 - DNA, 18 bp, Artificial Sequence
  Synthetic DNA
tacttagactcactttag

SEQ ID NO: 32847 - DNA, 18 bp, Artificial Sequence
  Synthetic DNA
tataacgactcactgttg

SEQ ID NO: 32848 - DNA, 18 bp, Artificial Sequence
  Synthetic DNA
tatatagactcactatag

SEQ ID NO: 32849 - DNA, 18 bp, Artificial Sequence
  Synthetic DNA
tcaaacgactcacaattg

SEQ ID NO: 32850 - DNA, 18 bp, Artificial Sequence
  Synthetic DNA
tcattcgactcacattag

SEQ ID NO: 32851 - DNA, 18 bp, Artificial Sequence
  Synthetic DNA
tgatacgactctcttttg

SEQ ID NO: 32852 - DNA, 18 bp, Artificial Sequence
  Synthetic DNA
tgataggactcattattg

SEQ ID NO: 32853 - DNA, 18 bp, Artificial Sequence
  Synthetic DNA
ttacacaactcactattg

SEQ ID NO: 32854 - DNA, 18 bp, Artificial Sequence
  Synthetic DNA
ttattcgacttagtatag

SEQ ID NO: 32855 - DNA, 18 bp, Artificial Sequence
  Synthetic DNA
ttattcgattcactatgg

SEQ ID NO: 32856 - DNA, 18 bp, Artificial Sequence
  Synthetic DNA
ttcttcgacacactatag

SEQ ID NO: 32857 - DNA, 18 bp, Artificial Sequence
  Synthetic DNA
ttgtacgactcactaatg

SEQ ID NO: 32858 - DNA, 18 bp, Artificial Sequence
  Synthetic DNA
tttttcgattcactatag

SEQ ID NO: 32859 - DNA, 18 bp, Artificial Sequence
  Synthetic DNA
aaaaacgacacacaatag

SEQ ID NO: 32860 - DNA, 18 bp, Artificial Sequence
  Synthetic DNA
aaaaacgactcaacatag

SEQ ID NO: 32861 - DNA, 18 bp, Artificial Sequence
  Synthetic DNA
aaatacttctcactacag

SEQ ID NO: 32862 - DNA, 18 bp, Artificial Sequence
  Synthetic DNA
aagtacgactcaataaag

SEQ ID NO: 32863 - DNA, 18 bp, Artificial Sequence
  Synthetic DNA
aattacgattcacaatag

SEQ ID NO: 32864 - DNA, 18 bp, Artificial Sequence
  Synthetic DNA
acaaacgactcattatag

SEQ ID NO: 32865 - DNA, 18 bp, Artificial Sequence
  Synthetic DNA
acatacgacacactaaag

SEQ ID NO: 32866 - DNA, 18 bp, Artificial Sequence
  Synthetic DNA
atataagactctctatag

SEQ ID NO: 32867 - DNA, 18 bp, Artificial Sequence
  Synthetic DNA
caatactactcacaaaag

SEQ ID NO: 32868 - DNA, 18 bp, Artificial Sequence
  Synthetic DNA
caatatgtctcactatcg

SEQ ID NO: 32869 - DNA, 18 bp, Artificial Sequence
  Synthetic DNA
caatcagactcacaatag

SEQ ID NO: 32870 - DNA, 18 bp, Artificial Sequence
  Synthetic DNA
ctatacgtcacactatag

SEQ ID NO: 32871 - DNA, 18 bp, Artificial Sequence
  Synthetic DNA
gtatacgactaacaatag

SEQ ID NO: 32872 - DNA, 18 bp, Artificial Sequence
  Synthetic DNA
taaaacatttcactatag

SEQ ID NO: 32873 - DNA, 18 bp, Artificial Sequence
  Synthetic DNA
taaaacgactcccttaag

SEQ ID NO: 32874 - DNA, 18 bp, Artificial Sequence
  Synthetic DNA
taaaacgactgacttaag

SEQ ID NO: 32875 - DNA, 18 bp, Artificial Sequence
  Synthetic DNA
taaaacgattcataatag

SEQ ID NO: 32876 - DNA, 18 bp, Artificial Sequence
  Synthetic DNA
taaaacgtgtctctatag

SEQ ID NO: 32877 - DNA, 18 bp, Artificial Sequence
  Synthetic DNA
taaaaggactccccatag

SEQ ID NO: 32878 - DNA, 18 bp, Artificial Sequence
  Synthetic DNA
taaaccgtctcaccatag

SEQ ID NO: 32879 - DNA, 18 bp, Artificial Sequence
  Synthetic DNA
taacacttcacactatag

SEQ ID NO: 32880 - DNA, 18 bp, Artificial Sequence
  Synthetic DNA
taagacgacacaccaaag

SEQ ID NO: 32881 - DNA, 18 bp, Artificial Sequence
  Synthetic DNA
taagccgtctcagtatag

SEQ ID NO: 32882 - DNA, 18 bp, Artificial Sequence
  Synthetic DNA
taataagactctctcaag

SEQ ID NO: 32883 - DNA, 18 bp, Artificial Sequence
  Synthetic DNA
taatacaattaacaatag

SEQ ID NO: 32884 - DNA, 18 bp, Artificial Sequence
  Synthetic DNA
taataccacttacaaaag

SEQ ID NO: 32885 - DNA, 18 bp, Artificial Sequence
  Synthetic DNA
taatacgacaaaatttag

SEQ ID NO: 32886 - DNA, 18 bp, Artificial Sequence
  Synthetic DNA
taatacgacaaattttag

SEQ ID NO: 32887 - DNA, 18 bp, Artificial Sequence
  Synthetic DNA
taatacgacacacaaagg

SEQ ID NO: 32888 - DNA, 18 bp, Artificial Sequence
  Synthetic DNA
taatacgacacacattgg

SEQ ID NO: 32889 - DNA, 18 bp, Artificial Sequence
  Synthetic DNA
taatacgacatagtatgg

SEQ ID NO: 32890 - DNA, 18 bp, Artificial Sequence
  Synthetic DNA
taatacgaccctctgaag

SEQ ID NO: 32891 - DNA, 18 bp, Artificial Sequence
  Synthetic DNA
taatacgactaccaaaag

SEQ ID NO: 32892 - DNA, 18 bp, Artificial Sequence
  Synthetic DNA
taatacgagccattaaag

SEQ ID NO: 32893 - DNA, 18 bp, Artificial Sequence
  Synthetic DNA
taatacgataaactttag

SEQ ID NO: 32894 - DNA, 18 bp, Artificial Sequence
  Synthetic DNA
taatacgattatttatag

SEQ ID NO: 32895 - DNA, 18 bp, Artificial Sequence
  Synthetic DNA
taatacgattccttgtag

SEQ ID NO: 32896 - DNA, 18 bp, Artificial Sequence
  Synthetic DNA
taatacgcttctctacag

SEQ ID NO: 32897 - DNA, 18 bp, Artificial Sequence
  Synthetic DNA
taatacgtctgtctaaag

SEQ ID NO: 32898 - DNA, 18 bp, Artificial Sequence
  Synthetic DNA
taatactactcaaaatgg

SEQ ID NO: 32899 - DNA, 18 bp, Artificial Sequence
  Synthetic DNA
taatacttctttctatag

SEQ ID NO: 32900 - DNA, 18 bp, Artificial Sequence
  Synthetic DNA
taataggactcttaatag

SEQ ID NO: 32901 - DNA, 18 bp, Artificial Sequence
  Synthetic DNA
taatataactcacattag

SEQ ID NO: 32902 - DNA, 18 bp, Artificial Sequence
  Synthetic DNA
taatcccactctcaatag

SEQ ID NO: 32903 - DNA, 18 bp, Artificial Sequence
  Synthetic DNA
taatccgacaaacaatag

SEQ ID NO: 32904 - DNA, 18 bp, Artificial Sequence
  Synthetic DNA
taatcctattctctatag

SEQ ID NO: 32905 - DNA, 18 bp, Artificial Sequence
  Synthetic DNA
taatgatactcactacag

SEQ ID NO: 32906 - DNA, 18 bp, Artificial Sequence
  Synthetic DNA
taatgcgactcatattag

SEQ ID NO: 32907 - DNA, 18 bp, Artificial Sequence
  Synthetic DNA
tacaacgattcattatag

SEQ ID NO: 32908 - DNA, 18 bp, Artificial Sequence
  Synthetic DNA
tactacgacactctaaag

SEQ ID NO: 32909 - DNA, 18 bp, Artificial Sequence
  Synthetic DNA
tactacgatacattatag

SEQ ID NO: 32910 - DNA, 18 bp, Artificial Sequence
  Synthetic DNA
tactacgattaactatcg

SEQ ID NO: 32911 - DNA, 18 bp, Artificial Sequence
  Synthetic DNA
tagtaagacacacaatag

SEQ ID NO: 32912 - DNA, 18 bp, Artificial Sequence
  Synthetic DNA
tataacgactcagtttag

SEQ ID NO: 32913 - DNA, 18 bp, Artificial Sequence
  Synthetic DNA
tataatgactcactgtag

SEQ ID NO: 32914 - DNA, 18 bp, Artificial Sequence
  Synthetic DNA
tattaagtctcactatgg

SEQ ID NO: 32915 - DNA, 18 bp, Artificial Sequence
  Synthetic DNA
tattacaactcactttcg

SEQ ID NO: 32916 - DNA, 18 bp, Artificial Sequence
  Synthetic DNA
tattacgacacaataaag

SEQ ID NO: 32917 - DNA, 18 bp, Artificial Sequence
  Synthetic DNA
tattacgagtcacattag

SEQ ID NO: 32918 - DNA, 18 bp, Artificial Sequence
  Synthetic DNA
tattacgtcacactatcg

SEQ ID NO: 32919 - DNA, 18 bp, Artificial Sequence
  Synthetic DNA
tattaggattcacaatag

SEQ ID NO: 32920 - DNA, 18 bp, Artificial Sequence
  Synthetic DNA
tattatgacacactttag

SEQ ID NO: 32921 - DNA, 18 bp, Artificial Sequence
  Synthetic DNA
tattatgactcacaaaag

SEQ ID NO: 32922 - DNA, 18 bp, Artificial Sequence
  Synthetic DNA
tattccttctcactatag

SEQ ID NO: 32923 - DNA, 18 bp, Artificial Sequence
  Synthetic DNA
tcatacaactctcaatag

SEQ ID NO: 32924 - DNA, 18 bp, Artificial Sequence
  Synthetic DNA
tcatactactctcaatag

SEQ ID NO: 32925 - DNA, 18 bp, Artificial Sequence
  Synthetic DNA
tcataggtctcacaatag

SEQ ID NO: 32926 - DNA, 18 bp, Artificial Sequence
  Synthetic DNA
tgataccaatcacaatag

SEQ ID NO: 32927 - DNA, 18 bp, Artificial Sequence
  Synthetic DNA
tgatacgtattactatag

SEQ ID NO: 32928 - DNA, 18 bp, Artificial Sequence
  Synthetic DNA
ttaaacgacttaatatag

SEQ ID NO: 32929 - DNA, 18 bp, Artificial Sequence
  Synthetic DNA
ttacaggaatcactatag

SEQ ID NO: 32930 - DNA, 18 bp, Artificial Sequence
  Synthetic DNA
ttatacaattcactatgg

SEQ ID NO: 32931 - DNA, 18 bp, Artificial Sequence
  Synthetic DNA
ttatacgacacagaatag

SEQ ID NO: 32932 - DNA, 18 bp, Artificial Sequence
  Synthetic DNA
ttatacgactctttaaag

SEQ ID NO: 32933 - DNA, 18 bp, Artificial Sequence
  Synthetic DNA
ttatacgattcactgaag

SEQ ID NO: 32934 - DNA, 18 bp, Artificial Sequence
  Synthetic DNA
ttatacgtttctctatag

SEQ ID NO: 32935 - DNA, 18 bp, Artificial Sequence
  Synthetic DNA
ttatactactcaccaaag

SEQ ID NO: 32936 - DNA, 18 bp, Artificial Sequence
  Synthetic DNA
ttatactactcactttcg

SEQ ID NO: 32937 - DNA, 18 bp, Artificial Sequence
  Synthetic DNA
ttatacttcttactatag

SEQ ID NO: 32938 - DNA, 18 bp, Artificial Sequence
  Synthetic DNA
ttctacgaaacactatag

SEQ ID NO: 32939 - DNA, 18 bp, Artificial Sequence
  Synthetic DNA
tataacgtctcactattg

SEQ ID NO: 32940 - DNA, 18 bp, Artificial Sequence
  Synthetic DNA
taattcgtcacactattg

SEQ ID NO: 32941 - DNA, 18 bp, Artificial Sequence
  Synthetic DNA
aaaaacgtctcactattg

SEQ ID NO: 32942 - DNA, 18 bp, Artificial Sequence
  Synthetic DNA
taaatcttctcactatag

SEQ ID NO: 32943 - DNA, 18 bp, Artificial Sequence
  Synthetic DNA
tattacgtctcaataaag

SEQ ID NO: 32944 - DNA, 18 bp, Artificial Sequence
  Synthetic DNA
ttaaaagactcactaaag

SEQ ID NO: 32945 - DNA, 18 bp, Artificial Sequence
  Synthetic DNA
ttatacaactcaataaag

SEQ ID NO: 32946 - DNA, 18 bp, Artificial Sequence
  Synthetic DNA
tataacgactctctttag

SEQ ID NO: 32947 - DNA, 18 bp, Artificial Sequence
  Synthetic DNA
tatttcatctcactatag

SEQ ID NO: 32948 - DNA, 18 bp, Artificial Sequence
  Synthetic DNA
taactcgacttactattg

SEQ ID NO: 32949 - DNA, 18 bp, Artificial Sequence
  Synthetic DNA
taatacgtctcgccattg

SEQ ID NO: 32950 - DNA, 18 bp, Artificial Sequence
  Synthetic DNA
aaaatcgacccactatag

SEQ ID NO: 32951 - DNA, 18 bp, Artificial Sequence
  Synthetic DNA
aaatacgaatcacaattg

SEQ ID NO: 32952 - DNA, 18 bp, Artificial Sequence
  Synthetic DNA
aaatacgcctcacttttg

SEQ ID NO: 32953 - DNA, 18 bp, Artificial Sequence
  Synthetic DNA
aaatactcctcactattg

SEQ ID NO: 32954 - DNA, 18 bp, Artificial Sequence
  Synthetic DNA
aaattcgtttcactatag

SEQ ID NO: 32955 - DNA, 18 bp, Artificial Sequence
  Synthetic DNA
atatacgactctctattg

SEQ ID NO: 32956 - DNA, 18 bp, Artificial Sequence
  Synthetic DNA
atattcgaatcactatag

SEQ ID NO: 32957 - DNA, 18 bp, Artificial Sequence
  Synthetic DNA
caatacgacacaccattg

SEQ ID NO: 32958 - DNA, 18 bp, Artificial Sequence
  Synthetic DNA
caattcgacacactttag

SEQ ID NO: 32959 - DNA, 18 bp, Artificial Sequence
  Synthetic DNA
cattacgacttactattg

SEQ ID NO: 32960 - DNA, 18 bp, Artificial Sequence
  Synthetic DNA
taaaacgaatcattattg

SEQ ID NO: 32961 - DNA, 18 bp, Artificial Sequence
  Synthetic DNA
taaaacgattcactcttg

SEQ ID NO: 32962 - DNA, 18 bp, Artificial Sequence
  Synthetic DNA
taaaactacacactattg

SEQ ID NO: 32963 - DNA, 18 bp, Artificial Sequence
  Synthetic DNA
taaaactactcacttttg

SEQ ID NO: 32964 - DNA, 18 bp, Artificial Sequence
  Synthetic DNA
taaaccgactcacaattg

SEQ ID NO: 32965 - DNA, 18 bp, Artificial Sequence
  Synthetic DNA
taaatcgacacactttag

SEQ ID NO: 32966 - DNA, 18 bp, Artificial Sequence
  Synthetic DNA
taaatcgattcactaaag

SEQ ID NO: 32967 - DNA, 18 bp, Artificial Sequence
  Synthetic DNA
taagacgtttcactattg

SEQ ID NO: 32968 - DNA, 18 bp, Artificial Sequence
  Synthetic DNA
taataccactcaccaatg

SEQ ID NO: 32969 - DNA, 18 bp, Artificial Sequence
  Synthetic DNA
taatacgaccctttattg

SEQ ID NO: 32970 - DNA, 18 bp, Artificial Sequence
  Synthetic DNA
taattcaactctcaatag

SEQ ID NO: 32971 - DNA, 18 bp, Artificial Sequence
  Synthetic DNA
taattcgacttactcaag

SEQ ID NO: 32972 - DNA, 18 bp, Artificial Sequence
  Synthetic DNA
taattctgcacactatag

SEQ ID NO: 32973 - DNA, 18 bp, Artificial Sequence
  Synthetic DNA
taatttgtctcactgtag

SEQ ID NO: 32974 - DNA, 18 bp, Artificial Sequence
  Synthetic DNA
tactactactcacttttg

SEQ ID NO: 32975 - DNA, 18 bp, Artificial Sequence
  Synthetic DNA
tagtacgactcacatttg

SEQ ID NO: 32976 - DNA, 18 bp, Artificial Sequence
  Synthetic DNA
tataacgactcactagtg

SEQ ID NO: 32977 - DNA, 18 bp, Artificial Sequence
  Synthetic DNA
tattacgactcagcattg

SEQ ID NO: 32978 - DNA, 18 bp, Artificial Sequence
  Synthetic DNA
tatttagaatcactatag

SEQ ID NO: 32979 - DNA, 18 bp, Artificial Sequence
  Synthetic DNA
tcatacgactctcaattg

SEQ ID NO: 32980 - DNA, 18 bp, Artificial Sequence
  Synthetic DNA
tcatacgacttactaatg

SEQ ID NO: 32981 - DNA, 18 bp, Artificial Sequence
  Synthetic DNA
tgatacgattctctattg

SEQ ID NO: 32982 - DNA, 18 bp, Artificial Sequence
  Synthetic DNA
tgatttgactcactttag

SEQ ID NO: 32983 - DNA, 18 bp, Artificial Sequence
  Synthetic DNA
ttataccactcacttttg

SEQ ID NO: 32984 - DNA, 18 bp, Artificial Sequence
  Synthetic DNA
ttatacgtctgactattg

SEQ ID NO: 32985 - DNA, 18 bp, Artificial Sequence
  Synthetic DNA
ttatatgaatcactattg

SEQ ID NO: 32986 - DNA, 18 bp, Artificial Sequence
  Synthetic DNA
ttatccgactcacaattg

SEQ ID NO: 32987 - DNA, 18 bp, Artificial Sequence
  Synthetic DNA
ttattacactcactatag

SEQ ID NO: 32988 - DNA, 18 bp, Artificial Sequence
  Synthetic DNA
aaatacaacacagtatag

SEQ ID NO: 32989 - DNA, 18 bp, Artificial Sequence
  Synthetic DNA
aattaagactcaatatag

SEQ ID NO: 32990 - DNA, 18 bp, Artificial Sequence
  Synthetic DNA
ataaacgactcactaaag

SEQ ID NO: 32991 - DNA, 18 bp, Artificial Sequence
  Synthetic DNA
atatacgacttactaaag

SEQ ID NO: 32992 - DNA, 18 bp, Artificial Sequence
  Synthetic DNA
caatacgtctcataatag

SEQ ID NO: 32993 - DNA, 18 bp, Artificial Sequence
  Synthetic DNA
caatacttctccctatag

SEQ ID NO: 32994 - DNA, 18 bp, Artificial Sequence
  Synthetic DNA
taaaacaactcacttaag

SEQ ID NO: 32995 - DNA, 18 bp, Artificial Sequence
  Synthetic DNA
taaaacgacacattttag

SEQ ID NO: 32996 - DNA, 18 bp, Artificial Sequence
  Synthetic DNA
taaaacgattcaagatag

SEQ ID NO: 32997 - DNA, 18 bp, Artificial Sequence
  Synthetic DNA
taaaacgtctaattatag

SEQ ID NO: 32998 - DNA, 18 bp, Artificial Sequence
  Synthetic DNA
taaaactactcaccttag

SEQ ID NO: 32999 - DNA, 18 bp, Artificial Sequence
  Synthetic DNA
taaaaggactctctaaag

SEQ ID NO: 33000 - DNA, 18 bp, Artificial Sequence
  Synthetic DNA
taacaccaatcactaaag

SEQ ID NO: 33001 - DNA, 18 bp, Artificial Sequence
  Synthetic DNA
taataagtcaccctatag

SEQ ID NO: 33002 - DNA, 18 bp, Artificial Sequence
  Synthetic DNA
taataagtctctctatgg

SEQ ID NO: 33003 - DNA, 18 bp, Artificial Sequence
  Synthetic DNA
taatacaaatcacaaaag

SEQ ID NO: 33004 - DNA, 18 bp, Artificial Sequence
  Synthetic DNA
taatacaactaacttcag

SEQ ID NO: 33005 - DNA, 18 bp, Artificial Sequence
  Synthetic DNA
taatacaccacaatatag

SEQ ID NO: 33006 - DNA, 18 bp, Artificial Sequence
  Synthetic DNA
taatacatctcacaaaag

SEQ ID NO: 33007 - DNA, 18 bp, Artificial Sequence
  Synthetic DNA
taatacgattcagaaaag

SEQ ID NO: 33008 - DNA, 18 bp, Artificial Sequence
  Synthetic DNA
taatactattcactcaag

SEQ ID NO: 33009 - DNA, 18 bp, Artificial Sequence
  Synthetic DNA
taatactattttctatag

SEQ ID NO: 33010 - DNA, 18 bp, Artificial Sequence
  Synthetic DNA
taatacttcccattatag

SEQ ID NO: 33011 - DNA, 18 bp, Artificial Sequence
  Synthetic DNA
taatacttccctctatag

SEQ ID NO: 33012 - DNA, 18 bp, Artificial Sequence
  Synthetic DNA
taatattactcattttag

SEQ ID NO: 33013 - DNA, 18 bp, Artificial Sequence
  Synthetic DNA
taatcctacactctatag

SEQ ID NO: 33014 - DNA, 18 bp, Artificial Sequence
  Synthetic DNA
taatcctatacactatag

SEQ ID NO: 33015 - DNA, 18 bp, Artificial Sequence
  Synthetic DNA
taatgcttctaactatag

SEQ ID NO: 33016 - DNA, 18 bp, Artificial Sequence
  Synthetic DNA
tactatgactcattttag

SEQ ID NO: 33017 - DNA, 18 bp, Artificial Sequence
  Synthetic DNA
tagtaagagacactatag

SEQ ID NO: 33018 - DNA, 18 bp, Artificial Sequence
  Synthetic DNA
tatcacgacttactttag

SEQ ID NO: 33019 - DNA, 18 bp, Artificial Sequence
  Synthetic DNA
tattacaattcagtatag

SEQ ID NO: 33020 - DNA, 18 bp, Artificial Sequence
  Synthetic DNA
tattacaattcattatag

SEQ ID NO: 33021 - DNA, 18 bp, Artificial Sequence
  Synthetic DNA
tattacatcacactatag

SEQ ID NO: 33022 - DNA, 18 bp, Artificial Sequence
  Synthetic DNA
tattacgaccttctatag

SEQ ID NO: 33023 - DNA, 18 bp, Artificial Sequence
  Synthetic DNA
tattacgacttataatag

SEQ ID NO: 33024 - DNA, 18 bp, Artificial Sequence
  Synthetic DNA
tattactattcactatcg

SEQ ID NO: 33025 - DNA, 18 bp, Artificial Sequence
  Synthetic DNA
tattgcgtcttactatag

SEQ ID NO: 33026 - DNA, 18 bp, Artificial Sequence
  Synthetic DNA
tcatacgtatcattatag

SEQ ID NO: 33027 - DNA, 18 bp, Artificial Sequence
  Synthetic DNA
tcttacgacactctatag

SEQ ID NO: 33028 - DNA, 18 bp, Artificial Sequence
  Synthetic DNA
tcttacgcctcacaatag

SEQ ID NO: 33029 - DNA, 18 bp, Artificial Sequence
  Synthetic DNA
ttaaacgactcagtttag

SEQ ID NO: 33030 - DNA, 18 bp, Artificial Sequence
  Synthetic DNA
ttaaccgtctcactatag

SEQ ID NO: 33031 - DNA, 18 bp, Artificial Sequence
  Synthetic DNA
ttataagaatcactaaag

SEQ ID NO: 33032 - DNA, 18 bp, Artificial Sequence
  Synthetic DNA
ttatacaactaactttag

SEQ ID NO: 33033 - DNA, 18 bp, Artificial Sequence
  Synthetic DNA
ttatacagcttactatag

SEQ ID NO: 33034 - DNA, 18 bp, Artificial Sequence
  Synthetic DNA
ttatacgacacacagtag

SEQ ID NO: 33035 - DNA, 18 bp, Artificial Sequence
  Synthetic DNA
ttatacgtctcacgaaag

SEQ ID NO: 33036 - DNA, 18 bp, Artificial Sequence
  Synthetic DNA
ttatactacacactaaag

SEQ ID NO: 33037 - DNA, 18 bp, Artificial Sequence
  Synthetic DNA
ttatatgacttagtatag

SEQ ID NO: 33038 - DNA, 18 bp, Artificial Sequence
  Synthetic DNA
ttatcagactcactaaag

SEQ ID NO: 33039 - DNA, 18 bp, Artificial Sequence
  Synthetic DNA
ttatccgactctctaaag

SEQ ID NO: 33040 - DNA, 18 bp, Artificial Sequence
  Synthetic DNA
ttatgcgtcacactatag

SEQ ID NO: 33041 - DNA, 18 bp, Artificial Sequence
  Synthetic DNA
tttagcgactcactatag

SEQ ID NO: 33042 - DNA, 18 bp, Artificial Sequence
  Synthetic DNA
ttttatgactcattatag

SEQ ID NO: 33043 - DNA, 18 bp, Artificial Sequence
  Synthetic DNA
tatttcgactcacaattg

SEQ ID NO: 33044 - DNA, 18 bp, Artificial Sequence
  Synthetic DNA
taattcgtttcacaatag

SEQ ID NO: 33045 - DNA, 18 bp, Artificial Sequence
  Synthetic DNA
taatttgtctcactaaag

SEQ ID NO: 33046 - DNA, 18 bp, Artificial Sequence
  Synthetic DNA
ttatacgacatactattg

SEQ ID NO: 33047 - DNA, 18 bp, Artificial Sequence
  Synthetic DNA
aattacgtctcactttag

SEQ ID NO: 33048 - DNA, 18 bp, Artificial Sequence
  Synthetic DNA
taaaacgactctcaaaag

SEQ ID NO: 33049 - DNA, 18 bp, Artificial Sequence
  Synthetic DNA
taaaacgtcacacaatag

SEQ ID NO: 33050 - DNA, 18 bp, Artificial Sequence
  Synthetic DNA
tattacgtcactctatag

SEQ ID NO: 33051 - DNA, 18 bp, Artificial Sequence
  Synthetic DNA
tcatacgtcactctatag

SEQ ID NO: 33052 - DNA, 18 bp, Artificial Sequence
  Synthetic DNA
ttatacgtctcattttag

SEQ ID NO: 33053 - DNA, 18 bp, Artificial Sequence
  Synthetic DNA
tatatcgactcactattg

SEQ ID NO: 33054 - DNA, 18 bp, Artificial Sequence
  Synthetic DNA
tatttctactcactttag

SEQ ID NO: 33055 - DNA, 18 bp, Artificial Sequence
  Synthetic DNA
taaatcgactcattattg

SEQ ID NO: 33056 - DNA, 18 bp, Artificial Sequence
  Synthetic DNA
taataccacacgctattg

SEQ ID NO: 33057 - DNA, 18 bp, Artificial Sequence
  Synthetic DNA
taattcaattcactattg

SEQ ID NO: 33058 - DNA, 18 bp, Artificial Sequence
  Synthetic DNA
taatttgacacactattg

SEQ ID NO: 33059 - DNA, 18 bp, Artificial Sequence
  Synthetic DNA
aaaaacgacacgctatag

SEQ ID NO: 33060 - DNA, 18 bp, Artificial Sequence
  Synthetic DNA
aaatacaactcattattg

SEQ ID NO: 33061 - DNA, 18 bp, Artificial Sequence
  Synthetic DNA
aaatactacacactattg

SEQ ID NO: 33062 - DNA, 18 bp, Artificial Sequence
  Synthetic DNA
aaattcgacacacaatag

SEQ ID NO: 33063 - DNA, 18 bp, Artificial Sequence
  Synthetic DNA
atatacgactcactcttg

SEQ ID NO: 33064 - DNA, 18 bp, Artificial Sequence
  Synthetic DNA
atatacgactcagtattg

SEQ ID NO: 33065 - DNA, 18 bp, Artificial Sequence
  Synthetic DNA
catttcgtctcactatag

SEQ ID NO: 33066 - DNA, 18 bp, Artificial Sequence
  Synthetic DNA
taaaatcactcactattg

SEQ ID NO: 33067 - DNA, 18 bp, Artificial Sequence
  Synthetic DNA
taaaccgactcaatattg

SEQ ID NO: 33068 - DNA, 18 bp, Artificial Sequence
  Synthetic DNA
taacacgactcgatgtag

SEQ ID NO: 33069 - DNA, 18 bp, Artificial Sequence
  Synthetic DNA
taacatgactcacttttg

SEQ ID NO: 33070 - DNA, 18 bp, Artificial Sequence
  Synthetic DNA
taactcgactaacaatag

SEQ ID NO: 33071 - DNA, 18 bp, Artificial Sequence
  Synthetic DNA
taatacgactctcagttg

SEQ ID NO: 33072 - DNA, 18 bp, Artificial Sequence
  Synthetic DNA
taatacgatttacaattg

SEQ ID NO: 33073 - DNA, 18 bp, Artificial Sequence
  Synthetic DNA
taatacgtctcacttctg

SEQ ID NO: 33074 - DNA, 18 bp, Artificial Sequence
  Synthetic DNA
taataggactcaattttg

SEQ ID NO: 33075 - DNA, 18 bp, Artificial Sequence
  Synthetic DNA
taatccgtctcactaatg

SEQ ID NO: 33076 - DNA, 18 bp, Artificial Sequence
  Synthetic DNA
taattacactcactaaag

SEQ ID NO: 33077 - DNA, 18 bp, Artificial Sequence
  Synthetic DNA
taattagactcattttag

SEQ ID NO: 33078 - DNA, 18 bp, Artificial Sequence
  Synthetic DNA
taattcgacacacaacag

SEQ ID NO: 33079 - DNA, 18 bp, Artificial Sequence
  Synthetic DNA
taattcgagtctctaaag

SEQ ID NO: 33080 - DNA, 18 bp, Artificial Sequence
  Synthetic DNA
taattctatacactatag

SEQ ID NO: 33081 - DNA, 18 bp, Artificial Sequence
  Synthetic DNA
taattcttctcattatag

SEQ ID NO: 33082 - DNA, 18 bp, Artificial Sequence
  Synthetic DNA
taatttgattcactaaag

SEQ ID NO: 33083 - DNA, 18 bp, Artificial Sequence
  Synthetic DNA
tacctcgtctcactatag

SEQ ID NO: 33084 - DNA, 18 bp, Artificial Sequence
  Synthetic DNA
tatttcaattcactatag

SEQ ID NO: 33085 - DNA, 18 bp, Artificial Sequence
  Synthetic DNA
tatttcgactctctagag

SEQ ID NO: 33086 - DNA, 18 bp, Artificial Sequence
  Synthetic DNA
tcatacgaatcgctaaag

SEQ ID NO: 33087 - DNA, 18 bp, Artificial Sequence
  Synthetic DNA
tctttcgactcactaaag

SEQ ID NO: 33088 - DNA, 18 bp, Artificial Sequence
  Synthetic DNA
ttatacgcttcactattg

SEQ ID NO: 33089 - DNA, 18 bp, Artificial Sequence
  Synthetic DNA
ttatccaactcactattg

SEQ ID NO: 33090 - DNA, 18 bp, Artificial Sequence
  Synthetic DNA
ttattcgactcacttaag

SEQ ID NO: 33091 - DNA, 18 bp, Artificial Sequence
  Synthetic DNA
ttattcgtcttactatag

SEQ ID NO: 33092 - DNA, 18 bp, Artificial Sequence
  Synthetic DNA
tttttcgactcaatatag

SEQ ID NO: 33093 - DNA, 18 bp, Artificial Sequence
  Synthetic DNA
aaaaaagactcaatatag

SEQ ID NO: 33094 - DNA, 18 bp, Artificial Sequence
  Synthetic DNA
aaaaacgacttactaaag

SEQ ID NO: 33095 - DNA, 18 bp, Artificial Sequence
  Synthetic DNA
aaaaatgactcacaatag

SEQ ID NO: 33096 - DNA, 18 bp, Artificial Sequence
  Synthetic DNA
aaatacgtatcactaaag

SEQ ID NO: 33097 - DNA, 18 bp, Artificial Sequence
  Synthetic DNA
aaatacgtctctctaaag

SEQ ID NO: 33098 - DNA, 18 bp, Artificial Sequence
  Synthetic DNA
aaatactactcacaaaag

SEQ ID NO: 33099 - DNA, 18 bp, Artificial Sequence
  Synthetic DNA
aaatacttctcactatcg

SEQ ID NO: 33100 - DNA, 18 bp, Artificial Sequence
  Synthetic DNA
aattactactcactaaag

SEQ ID NO: 33101 - DNA, 18 bp, Artificial Sequence
  Synthetic DNA
acatacgagtctctatag

SEQ ID NO: 33102 - DNA, 18 bp, Artificial Sequence
  Synthetic DNA
ataaacgactcattatag

SEQ ID NO: 33103 - DNA, 18 bp, Artificial Sequence
  Synthetic DNA
atatacgaatcacaatag

SEQ ID NO: 33104 - DNA, 18 bp, Artificial Sequence
  Synthetic DNA
atatgcgattcactatag

SEQ ID NO: 33105 - DNA, 18 bp, Artificial Sequence
  Synthetic DNA
caaaactactcactagag

SEQ ID NO: 33106 - DNA, 18 bp, Artificial Sequence
  Synthetic DNA
ctatactactctctatag

SEQ ID NO: 33107 - DNA, 18 bp, Artificial Sequence
  Synthetic DNA
taaaacctctcactttag

SEQ ID NO: 33108 - DNA, 18 bp, Artificial Sequence
  Synthetic DNA
taaaacgacacaatttag

SEQ ID NO: 33109 - DNA, 18 bp, Artificial Sequence
  Synthetic DNA
taaaacgacacaccctag

SEQ ID NO: 33110 - DNA, 18 bp, Artificial Sequence
  Synthetic DNA
taaaacgactaaccttag

SEQ ID NO: 33111 - DNA, 18 bp, Artificial Sequence
  Synthetic DNA
taaaacgtctcacactag

SEQ ID NO: 33112 - DNA, 18 bp, Artificial Sequence
  Synthetic DNA
taaaacgtctctccatag

SEQ ID NO: 33113 - DNA, 18 bp, Artificial Sequence
  Synthetic DNA
taaaactactgactaaag

SEQ ID NO: 33114 - DNA, 18 bp, Artificial Sequence
  Synthetic DNA
taacacgactctcttaag

SEQ ID NO: 33115 - DNA, 18 bp, Artificial Sequence
  Synthetic DNA
taacacgactgtcaatag

SEQ ID NO: 33116 - DNA, 18 bp, Artificial Sequence
  Synthetic DNA
taacactactcacattag

SEQ ID NO: 33117 - DNA, 18 bp, Artificial Sequence
  Synthetic DNA
taataaagctcacaatag

SEQ ID NO: 33118 - DNA, 18 bp, Artificial Sequence
  Synthetic DNA
taataagacactctttag

SEQ ID NO: 33119 - DNA, 18 bp, Artificial Sequence
  Synthetic DNA
taatacgaatgaccaaag

SEQ ID NO: 33120 - DNA, 18 bp, Artificial Sequence
  Synthetic DNA
taatacgacacccattag

SEQ ID NO: 33121 - DNA, 18 bp, Artificial Sequence
  Synthetic DNA
taatacgactcttaaaag

SEQ ID NO: 33122 - DNA, 18 bp, Artificial Sequence
  Synthetic DNA
taatacgacttacctaag

SEQ ID NO: 33123 - DNA, 18 bp, Artificial Sequence
  Synthetic DNA
taatacgattctatgtag

SEQ ID NO: 33124 - DNA, 18 bp, Artificial Sequence
  Synthetic DNA
taatacgtatctttatag

SEQ ID NO: 33125 - DNA, 18 bp, Artificial Sequence
  Synthetic DNA
taataggattctcaatag

SEQ ID NO: 33126 - DNA, 18 bp, Artificial Sequence
  Synthetic DNA
taatagggctcacttaag

SEQ ID NO: 33127 - DNA, 18 bp, Artificial Sequence
  Synthetic DNA
taatatcactctctttag

SEQ ID NO: 33128 - DNA, 18 bp, Artificial Sequence
  Synthetic DNA
taatatgattctcaatag

SEQ ID NO: 33129 - DNA, 18 bp, Artificial Sequence
  Synthetic DNA
taatattacaaactatag

SEQ ID NO: 33130 - DNA, 18 bp, Artificial Sequence
  Synthetic DNA
taatattactcaatacag

SEQ ID NO: 33131 - DNA, 18 bp, Artificial Sequence
  Synthetic DNA
taatcattctcactatag

SEQ ID NO: 33132 - DNA, 18 bp, Artificial Sequence
  Synthetic DNA
tacaacgaattactatag

SEQ ID NO: 33133 - DNA, 18 bp, Artificial Sequence
  Synthetic DNA
tactaaatctcactatag

SEQ ID NO: 33134 - DNA, 18 bp, Artificial Sequence
  Synthetic DNA
tactacgaatcacttaag

SEQ ID NO: 33135 - DNA, 18 bp, Artificial Sequence
  Synthetic DNA
tagtaagactctctaaag

SEQ ID NO: 33136 - DNA, 18 bp, Artificial Sequence
  Synthetic DNA
tataacgactaacaatag

SEQ ID NO: 33137 - DNA, 18 bp, Artificial Sequence
  Synthetic DNA
tataatgaatcactatag

SEQ ID NO: 33138 - DNA, 18 bp, Artificial Sequence
  Synthetic DNA
tataattactcactatag

SEQ ID NO: 33139 - DNA, 18 bp, Artificial Sequence
  Synthetic DNA
tatcacgactctccatag

SEQ ID NO: 33140 - DNA, 18 bp, Artificial Sequence
  Synthetic DNA
tatcacgtctcactctag

SEQ ID NO: 33141 - DNA, 18 bp, Artificial Sequence
  Synthetic DNA
tattacaaaccactatag

SEQ ID NO: 33142 - DNA, 18 bp, Artificial Sequence
  Synthetic DNA
tattacaactcacattag

SEQ ID NO: 33143 - DNA, 18 bp, Artificial Sequence
  Synthetic DNA
tattacaactctttatag

SEQ ID NO: 33144 - DNA, 18 bp, Artificial Sequence
  Synthetic DNA
tattacgattcacactag

SEQ ID NO: 33145 - DNA, 18 bp, Artificial Sequence
  Synthetic DNA
tattacgattccctaaag

SEQ ID NO: 33146 - DNA, 18 bp, Artificial Sequence
  Synthetic DNA
tattacgccacactttag

SEQ ID NO: 33147 - DNA, 18 bp, Artificial Sequence
  Synthetic DNA
tattacgtcacattatag

SEQ ID NO: 33148 - DNA, 18 bp, Artificial Sequence
  Synthetic DNA
tattacgtctttctatag

SEQ ID NO: 33149 - DNA, 18 bp, Artificial Sequence
  Synthetic DNA
tattactactctatatag

SEQ ID NO: 33150 - DNA, 18 bp, Artificial Sequence
  Synthetic DNA
tcaaacgattctctatag

SEQ ID NO: 33151 - DNA, 18 bp, Artificial Sequence
  Synthetic DNA
tcatatgacttcctatag

SEQ ID NO: 33152 - DNA, 18 bp, Artificial Sequence
  Synthetic DNA
tgatatgattcacaatag

SEQ ID NO: 33153 - DNA, 18 bp, Artificial Sequence
  Synthetic DNA
tgatatgtatcactatag

SEQ ID NO: 33154 - DNA, 18 bp, Artificial Sequence
  Synthetic DNA
ttaaacgactcacagtag

SEQ ID NO: 33155 - DNA, 18 bp, Artificial Sequence
  Synthetic DNA
ttaaacgactcattaaag

SEQ ID NO: 33156 - DNA, 18 bp, Artificial Sequence
  Synthetic DNA
ttataaggctcactttag

SEQ ID NO: 33157 - DNA, 18 bp, Artificial Sequence
  Synthetic DNA
ttatactacacactttag

SEQ ID NO: 33158 - DNA, 18 bp, Artificial Sequence
  Synthetic DNA
ttatactacttaatatag

SEQ ID NO: 33159 - DNA, 18 bp, Artificial Sequence
  Synthetic DNA
ttatatgattcactctag

SEQ ID NO: 33160 - DNA, 18 bp, Artificial Sequence
  Synthetic DNA
ttatgcgacacactaaag

SEQ ID NO: 33161 - DNA, 18 bp, Artificial Sequence
  Synthetic DNA
tttaacgactcactatcg

SEQ ID NO: 33162 - DNA, 18 bp, Artificial Sequence
  Synthetic DNA
ttttacgattcactttag

SEQ ID NO: 33163 - DNA, 18 bp, Artificial Sequence
  Synthetic DNA
ttttactacacactatag

SEQ ID NO: 33164 - DNA, 18 bp, Artificial Sequence
  Synthetic DNA
taattcgtctcacttttg

SEQ ID NO: 33165 - DNA, 18 bp, Artificial Sequence
  Synthetic DNA
tatatcgattcactatag

SEQ ID NO: 33166 - DNA, 18 bp, Artificial Sequence
  Synthetic DNA
ttataagactcactaatg

SEQ ID NO: 33167 - DNA, 18 bp, Artificial Sequence
  Synthetic DNA
ttttacgacacactattg

SEQ ID NO: 33168 - DNA, 18 bp, Artificial Sequence
  Synthetic DNA
taatacgacacatttaag

SEQ ID NO: 33169 - DNA, 18 bp, Artificial Sequence
  Synthetic DNA
taatactacacacttaag

SEQ ID NO: 33170 - DNA, 18 bp, Artificial Sequence
  Synthetic DNA
taatattattcactttag

SEQ ID NO: 33171 - DNA, 18 bp, Artificial Sequence
  Synthetic DNA
tataacgtctcactaaag

SEQ ID NO: 33172 - DNA, 18 bp, Artificial Sequence
  Synthetic DNA
ttaaactactcactaaag

SEQ ID NO: 33173 - DNA, 18 bp, Artificial Sequence
  Synthetic DNA
aaattcgactcactaatg

SEQ ID NO: 33174 - DNA, 18 bp, Artificial Sequence
  Synthetic DNA
taattcgactctctcttg

SEQ ID NO: 33175 - DNA, 18 bp, Artificial Sequence
  Synthetic DNA
taattcgactctcttttg

SEQ ID NO: 33176 - DNA, 18 bp, Artificial Sequence
  Synthetic DNA
tatatcgactcgctatag

SEQ ID NO: 33177 - DNA, 18 bp, Artificial Sequence
  Synthetic DNA
aaaaacgactcactaatg

SEQ ID NO: 33178 - DNA, 18 bp, Artificial Sequence
  Synthetic DNA
aaatacgactcatttttg

SEQ ID NO: 33179 - DNA, 18 bp, Artificial Sequence
  Synthetic DNA
aaatacgcctcattattg

SEQ ID NO: 33180 - DNA, 18 bp, Artificial Sequence
  Synthetic DNA
acatacgactcacttttg

SEQ ID NO: 33181 - DNA, 18 bp, Artificial Sequence
  Synthetic DNA
atattcgactaactatag

SEQ ID NO: 33182 - DNA, 18 bp, Artificial Sequence
  Synthetic DNA
taaaacgactcgcattag

SEQ ID NO: 33183 - DNA, 18 bp, Artificial Sequence
  Synthetic DNA
taactcgactcactgaag

SEQ ID NO: 33184 - DNA, 18 bp, Artificial Sequence
  Synthetic DNA
taataagattcattattg

SEQ ID NO: 33185 - DNA, 18 bp, Artificial Sequence
  Synthetic DNA
taatacgacacacaactg

SEQ ID NO: 33186 - DNA, 18 bp, Artificial Sequence
  Synthetic DNA
taatacgactcaatcatg

SEQ ID NO: 33187 - DNA, 18 bp, Artificial Sequence
  Synthetic DNA
taatacgactgtcttttg

SEQ ID NO: 33188 - DNA, 18 bp, Artificial Sequence
  Synthetic DNA
taatacgactttccattg

SEQ ID NO: 33189 - DNA, 18 bp, Artificial Sequence
  Synthetic DNA
taatacgtctttctattg

SEQ ID NO: 33190 - DNA, 18 bp, Artificial Sequence
  Synthetic DNA
taatacgtttcgcaatag

SEQ ID NO: 33191 - DNA, 18 bp, Artificial Sequence
  Synthetic DNA
taatacttctcactcttg

SEQ ID NO: 33192 - DNA, 18 bp, Artificial Sequence
  Synthetic DNA
taattcaaataactatag

SEQ ID NO: 33193 - DNA, 18 bp, Artificial Sequence
  Synthetic DNA
taattcaactaactatcg

SEQ ID NO: 33194 - DNA, 18 bp, Artificial Sequence
  Synthetic DNA
tacttcttctcactatag

SEQ ID NO: 33195 - DNA, 18 bp, Artificial Sequence
  Synthetic DNA
tataacgactcaatattg

SEQ ID NO: 33196 - DNA, 18 bp, Artificial Sequence
  Synthetic DNA
tattaagactctctattg

SEQ ID NO: 33197 - DNA, 18 bp, Artificial Sequence
  Synthetic DNA
tattacgacttagtattg

SEQ ID NO: 33198 - DNA, 18 bp, Artificial Sequence
  Synthetic DNA
tattacgcctcaatattg

SEQ ID NO: 33199 - DNA, 18 bp, Artificial Sequence
  Synthetic DNA
tatttcgactcaccaaag

SEQ ID NO: 33200 - DNA, 18 bp, Artificial Sequence
  Synthetic DNA
tatttcgactgactaaag

SEQ ID NO: 33201 - DNA, 18 bp, Artificial Sequence
  Synthetic DNA
tatttctacacactatag

SEQ ID NO: 33202 - DNA, 18 bp, Artificial Sequence
  Synthetic DNA
tcatacgactcacatttg

SEQ ID NO: 33203 - DNA, 18 bp, Artificial Sequence
  Synthetic DNA
tcattcgtctcactaaag

SEQ ID NO: 33204 - DNA, 18 bp, Artificial Sequence
  Synthetic DNA
tctttcgactcactttag

SEQ ID NO: 33205 - DNA, 18 bp, Artificial Sequence
  Synthetic DNA
ttatacgactcgctaacg

SEQ ID NO: 33206 - DNA, 18 bp, Artificial Sequence
  Synthetic DNA
ttattcaactctctatag

SEQ ID NO: 33207 - DNA, 18 bp, Artificial Sequence
  Synthetic DNA
ttattcgacttactttag

SEQ ID NO: 33208 - DNA, 18 bp, Artificial Sequence
  Synthetic DNA
ttattcgattaactatag

SEQ ID NO: 33209 - DNA, 18 bp, Artificial Sequence
  Synthetic DNA
aaatacaactcattgtag

SEQ ID NO: 33210 - DNA, 18 bp, Artificial Sequence
  Synthetic DNA
aaatacgaatctctttag

SEQ ID NO: 33211 - DNA, 18 bp, Artificial Sequence
  Synthetic DNA
aaatacgacactttatag

SEQ ID NO: 33212 - DNA, 18 bp, Artificial Sequence
  Synthetic DNA
aaatacgactgtctttag

SEQ ID NO: 33213 - DNA, 18 bp, Artificial Sequence
  Synthetic DNA
aaatacgtattactatag

SEQ ID NO: 33214 - DNA, 18 bp, Artificial Sequence
  Synthetic DNA
ataaacgactcacaatag

SEQ ID NO: 33215 - DNA, 18 bp, Artificial Sequence
  Synthetic DNA
atacacgacacactatag

SEQ ID NO: 33216 - DNA, 18 bp, Artificial Sequence
  Synthetic DNA
atataagactcacaatag

SEQ ID NO: 33217 - DNA, 18 bp, Artificial Sequence
  Synthetic DNA
atatacatctcactatag

SEQ ID NO: 33218 - DNA, 18 bp, Artificial Sequence
  Synthetic DNA
attaacgactcactatag

SEQ ID NO: 33219 - DNA, 18 bp, Artificial Sequence
  Synthetic DNA
caatatgtttcactatag

SEQ ID NO: 33220 - DNA, 18 bp, Artificial Sequence
  Synthetic DNA
ctaaacgactcacaatag

SEQ ID NO: 33221 - DNA, 18 bp, Artificial Sequence
  Synthetic DNA
ctatacgactccctaaag

SEQ ID NO: 33222 - DNA, 18 bp, Artificial Sequence
  Synthetic DNA
ctatatgactctctatag

SEQ ID NO: 33223 - DNA, 18 bp, Artificial Sequence
  Synthetic DNA
taaaacgacactctacag

SEQ ID NO: 33224 - DNA, 18 bp, Artificial Sequence
  Synthetic DNA
taaaacgatcctctatag

SEQ ID NO: 33225 - DNA, 18 bp, Artificial Sequence
  Synthetic DNA
taaaactacccactaaag

SEQ ID NO: 33226 - DNA, 18 bp, Artificial Sequence
  Synthetic DNA
taaaactactcacttaag

SEQ ID NO: 33227 - DNA, 18 bp, Artificial Sequence
  Synthetic DNA
taaaactatacactatag

SEQ ID NO: 33228 - DNA, 18 bp, Artificial Sequence
  Synthetic DNA
taaacctacacactatag

SEQ ID NO: 33229 - DNA, 18 bp, Artificial Sequence
  Synthetic DNA
taacacgacacaccatcg

SEQ ID NO: 33230 - DNA, 18 bp, Artificial Sequence
  Synthetic DNA
taacacgtaacactatag

SEQ ID NO: 33231 - DNA, 18 bp, Artificial Sequence
  Synthetic DNA
taataagactctttttag

SEQ ID NO: 33232 - DNA, 18 bp, Artificial Sequence
  Synthetic DNA
taataatactcacattag

SEQ ID NO: 33233 - DNA, 18 bp, Artificial Sequence
  Synthetic DNA
taataattatcactatag

SEQ ID NO: 33234 - DNA, 18 bp, Artificial Sequence
  Synthetic DNA
taataattctcacaatag

SEQ ID NO: 33235 - DNA, 18 bp, Artificial Sequence
  Synthetic DNA
taatacaacacaataaag

SEQ ID NO: 33236 - DNA, 18 bp, Artificial Sequence
  Synthetic DNA
taatacgacacattaacg

SEQ ID NO: 33237 - DNA, 18 bp, Artificial Sequence
  Synthetic DNA
taatacgtcacacaatcg

SEQ ID NO: 33238 - DNA, 18 bp, Artificial Sequence
  Synthetic DNA
taatacgtcaccctttag

SEQ ID NO: 33239 - DNA, 18 bp, Artificial Sequence
  Synthetic DNA
taatacgtctctatttag

SEQ ID NO: 33240 - DNA, 18 bp, Artificial Sequence
  Synthetic DNA
taatactcttcactaaag

SEQ ID NO: 33241 - DNA, 18 bp, Artificial Sequence
  Synthetic DNA
taataggacactcaatag

SEQ ID NO: 33242 - DNA, 18 bp, Artificial Sequence
  Synthetic DNA
taatatgacttaatttag

SEQ ID NO: 33243 - DNA, 18 bp, Artificial Sequence
  Synthetic DNA
taatatgacttacttaag

SEQ ID NO: 33244 - DNA, 18 bp, Artificial Sequence
  Synthetic DNA
taatatgtctcaatagag

SEQ ID NO: 33245 - DNA, 18 bp, Artificial Sequence
  Synthetic DNA
taatatgtctctatatag

SEQ ID NO: 33246 - DNA, 18 bp, Artificial Sequence
  Synthetic DNA
taatattacatactatag

SEQ ID NO: 33247 - DNA, 18 bp, Artificial Sequence
  Synthetic DNA
taatattactttctatag

SEQ ID NO: 33248 - DNA, 18 bp, Artificial Sequence
  Synthetic DNA
taatgtgtctccctatag

SEQ ID NO: 33249 - DNA, 18 bp, Artificial Sequence
  Synthetic DNA
tacaccgacacactatag

SEQ ID NO: 33250 - DNA, 18 bp, Artificial Sequence
  Synthetic DNA
tagaacgattcactttag

SEQ ID NO: 33251 - DNA, 18 bp, Artificial Sequence
  Synthetic DNA
tataacaacttactatag

SEQ ID NO: 33252 - DNA, 18 bp, Artificial Sequence
  Synthetic DNA
tataaccattcactatag

SEQ ID NO: 33253 - DNA, 18 bp, Artificial Sequence
  Synthetic DNA
tataacgaatcaccatag

SEQ ID NO: 33254 - DNA, 18 bp, Artificial Sequence
  Synthetic DNA
tattacaactcacaatcg

SEQ ID NO: 33255 - DNA, 18 bp, Artificial Sequence
  Synthetic DNA
tattacgacttacttcag

SEQ ID NO: 33256 - DNA, 18 bp, Artificial Sequence
  Synthetic DNA
tattacgatcctctatag

SEQ ID NO: 33257 - DNA, 18 bp, Artificial Sequence
  Synthetic DNA
tcatacatctcacaatag

SEQ ID NO: 33258 - DNA, 18 bp, Artificial Sequence
  Synthetic DNA
tgaaatgacttactatag

SEQ ID NO: 33259 - DNA, 18 bp, Artificial Sequence
  Synthetic DNA
tgatacgactcacacaag

SEQ ID NO: 33260 - DNA, 18 bp, Artificial Sequence
  Synthetic DNA
tgatacgactcatttaag

SEQ ID NO: 33261 - DNA, 18 bp, Artificial Sequence
  Synthetic DNA
tgatacgtctctctttag

SEQ ID NO: 33262 - DNA, 18 bp, Artificial Sequence
  Synthetic DNA
ttaaacgactcaatttag

SEQ ID NO: 33263 - DNA, 18 bp, Artificial Sequence
  Synthetic DNA
ttaaacgattcactacag

SEQ ID NO: 33264 - DNA, 18 bp, Artificial Sequence
  Synthetic DNA
ttaaacgattcactttag

SEQ ID NO: 33265 - DNA, 18 bp, Artificial Sequence
  Synthetic DNA
ttacacaacacactatag

SEQ ID NO: 33266 - DNA, 18 bp, Artificial Sequence
  Synthetic DNA
ttataagactcacattag

SEQ ID NO: 33267 - DNA, 18 bp, Artificial Sequence
  Synthetic DNA
ttataagtctcattatag

SEQ ID NO: 33268 - DNA, 18 bp, Artificial Sequence
  Synthetic DNA
ttatacaactcaaaatag

SEQ ID NO: 33269 - DNA, 18 bp, Artificial Sequence
  Synthetic DNA
ttatacgagtccctaaag

SEQ ID NO: 33270 - DNA, 18 bp, Artificial Sequence
  Synthetic DNA
ttatacgatacattatag

SEQ ID NO: 33271 - DNA, 18 bp, Artificial Sequence
  Synthetic DNA
ttatacgtctcacttgag

SEQ ID NO: 33272 - DNA, 18 bp, Artificial Sequence
  Synthetic DNA
ttatactacttattatag

SEQ ID NO: 33273 - DNA, 18 bp, Artificial Sequence
  Synthetic DNA
ttataggtctcactacag

SEQ ID NO: 33274 - DNA, 18 bp, Artificial Sequence
  Synthetic DNA
ttgtacaactcactaaag

SEQ ID NO: 33275 - DNA, 18 bp, Artificial Sequence
  Synthetic DNA
taatacgattcacttatg

SEQ ID NO: 33276 - DNA, 18 bp, Artificial Sequence
  Synthetic DNA
ttattccaatcactatag

SEQ ID NO: 33277 - DNA, 18 bp, Artificial Sequence
  Synthetic DNA
taaatcgactctctaaag

SEQ ID NO: 33278 - DNA, 18 bp, Artificial Sequence
  Synthetic DNA
tatttcgactcgctttag

SEQ ID NO: 33279 - DNA, 18 bp, Artificial Sequence
  Synthetic DNA
tcattcgactctctattg

SEQ ID NO: 33280 - DNA, 18 bp, Artificial Sequence
  Synthetic DNA
aaaaacgaatcactattg

SEQ ID NO: 33281 - DNA, 18 bp, Artificial Sequence
  Synthetic DNA
aaatacgacaaactattg

SEQ ID NO: 33282 - DNA, 18 bp, Artificial Sequence
  Synthetic DNA
aaatacgacttactcttg

SEQ ID NO: 33283 - DNA, 18 bp, Artificial Sequence
  Synthetic DNA
aaatgcgtctcactattg

SEQ ID NO: 33284 - DNA, 18 bp, Artificial Sequence
  Synthetic DNA
aaattcgactcacattag

SEQ ID NO: 33285 - DNA, 18 bp, Artificial Sequence
  Synthetic DNA
aaattcgattcactttag

SEQ ID NO: 33286 - DNA, 18 bp, Artificial Sequence
  Synthetic DNA
aaattctactcaatatag

SEQ ID NO: 33287 - DNA, 18 bp, Artificial Sequence
  Synthetic DNA
taaaacatctcactattg

SEQ ID NO: 33288 - DNA, 18 bp, Artificial Sequence
  Synthetic DNA
taaaacgagacactattg

SEQ ID NO: 33289 - DNA, 18 bp, Artificial Sequence
  Synthetic DNA
taaaacgtctcactcttg

SEQ ID NO: 33290 - DNA, 18 bp, Artificial Sequence
  Synthetic DNA
taaaactactaactattg

SEQ ID NO: 33291 - DNA, 18 bp, Artificial Sequence
  Synthetic DNA
taaattgactcactctag

SEQ ID NO: 33292 - DNA, 18 bp, Artificial Sequence
  Synthetic DNA
taatacaagtcacttttg

SEQ ID NO: 33293 - DNA, 18 bp, Artificial Sequence
  Synthetic DNA
taatacgacctacaattg

SEQ ID NO: 33294 - DNA, 18 bp, Artificial Sequence
  Synthetic DNA
taatacgactcatatttg

SEQ ID NO: 33295 - DNA, 18 bp, Artificial Sequence
  Synthetic DNA
taatacgatacattattg

SEQ ID NO: 33296 - DNA, 18 bp, Artificial Sequence
  Synthetic DNA
taatacggctcattaatg

SEQ ID NO: 33297 - DNA, 18 bp, Artificial Sequence
  Synthetic DNA
taatactgatcactattg

SEQ ID NO: 33298 - DNA, 18 bp, Artificial Sequence
  Synthetic DNA
taattagtctaactatag

SEQ ID NO: 33299 - DNA, 18 bp, Artificial Sequence
  Synthetic DNA
taattcgaataactttag

SEQ ID NO: 33300 - DNA, 18 bp, Artificial Sequence
  Synthetic DNA
taattcgactatctaaag

SEQ ID NO: 33301 - DNA, 18 bp, Artificial Sequence
  Synthetic DNA
taattcgactctataaag

SEQ ID NO: 33302 - DNA, 18 bp, Artificial Sequence
  Synthetic DNA
taattcgtctcattttag

SEQ ID NO: 33303 - DNA, 18 bp, Artificial Sequence
  Synthetic DNA
taattcttctaactatag

SEQ ID NO: 33304 - DNA, 18 bp, Artificial Sequence
  Synthetic DNA
taatttgactttctatag

SEQ ID NO: 33305 - DNA, 18 bp, Artificial Sequence
  Synthetic DNA
taattttactcactaaag

SEQ ID NO: 33306 - DNA, 18 bp, Artificial Sequence
  Synthetic DNA
tactactactcattattg

SEQ ID NO: 33307 - DNA, 18 bp, Artificial Sequence
  Synthetic DNA
tattacgaatcacaattg

SEQ ID NO: 33308 - DNA, 18 bp, Artificial Sequence
  Synthetic DNA
tattacgagtcactaatg

SEQ ID NO: 33309 - DNA, 18 bp, Artificial Sequence
  Synthetic DNA
tattacgagtctctattg

SEQ ID NO: 33310 - DNA, 18 bp, Artificial Sequence
  Synthetic DNA
tatttcgactaactttag

SEQ ID NO: 33311 - DNA, 18 bp, Artificial Sequence
  Synthetic DNA
tatttcgcctcacaatag

SEQ ID NO: 33312 - DNA, 18 bp, Artificial Sequence
  Synthetic DNA
tcatactacacactattg

SEQ ID NO: 33313 - DNA, 18 bp, Artificial Sequence
  Synthetic DNA
tgattctactcactaaag

SEQ ID NO: 33314 - DNA, 18 bp, Artificial Sequence
  Synthetic DNA
ttaaacgagtcactattg

SEQ ID NO: 33315 - DNA, 18 bp, Artificial Sequence
  Synthetic DNA
ttatacgacttaccattg

SEQ ID NO: 33316 - DNA, 18 bp, Artificial Sequence
  Synthetic DNA
ttatacgagtcactaatg

SEQ ID NO: 33317 - DNA, 18 bp, Artificial Sequence
  Synthetic DNA
ttatacgtctcacaattg

SEQ ID NO: 33318 - DNA, 18 bp, Artificial Sequence
  Synthetic DNA
ttattcgactctttatag

SEQ ID NO: 33319 - DNA, 18 bp, Artificial Sequence
  Synthetic DNA
aaaaacgattcattatag

SEQ ID NO: 33320 - DNA, 18 bp, Artificial Sequence
  Synthetic DNA
aaatacctctcactttag

SEQ ID NO: 33321 - DNA, 18 bp, Artificial Sequence
  Synthetic DNA
aaatacgacctacaatag

SEQ ID NO: 33322 - DNA, 18 bp, Artificial Sequence
  Synthetic DNA
aaatccgactctctaaag

SEQ ID NO: 33323 - DNA, 18 bp, Artificial Sequence
  Synthetic DNA
aattgctactcactatag

SEQ ID NO: 33324 - DNA, 18 bp, Artificial Sequence
  Synthetic DNA
caatacgactttctttag

SEQ ID NO: 33325 - DNA, 18 bp, Artificial Sequence
  Synthetic DNA
caatacgtctctttatag

SEQ ID NO: 33326 - DNA, 18 bp, Artificial Sequence
  Synthetic DNA
caatactactctctaaag

SEQ ID NO: 33327 - DNA, 18 bp, Artificial Sequence
  Synthetic DNA
cataacgactcactaaag

SEQ ID NO: 33328 - DNA, 18 bp, Artificial Sequence
  Synthetic DNA
cattacgactcattttag

SEQ ID NO: 33329 - DNA, 18 bp, Artificial Sequence
  Synthetic DNA
taaaacgtctaacaatag

SEQ ID NO: 33330 - DNA, 18 bp, Artificial Sequence
  Synthetic DNA
taacaagtctcacaatag

SEQ ID NO: 33331 - DNA, 18 bp, Artificial Sequence
  Synthetic DNA
taacacgaaacactagag

SEQ ID NO: 33332 - DNA, 18 bp, Artificial Sequence
  Synthetic DNA
taacacgacacacaaaag

SEQ ID NO: 33333 - DNA, 18 bp, Artificial Sequence
  Synthetic DNA
taataaatctctctatag

SEQ ID NO: 33334 - DNA, 18 bp, Artificial Sequence
  Synthetic DNA
taataagacttacattag

SEQ ID NO: 33335 - DNA, 18 bp, Artificial Sequence
  Synthetic DNA
taatacaactcacagcag

SEQ ID NO: 33336 - DNA, 18 bp, Artificial Sequence
  Synthetic DNA
taatacatctcacttaag

SEQ ID NO: 33337 - DNA, 18 bp, Artificial Sequence
  Synthetic DNA
taatacgactttcaatgg

SEQ ID NO: 33338 - DNA, 18 bp, Artificial Sequence
  Synthetic DNA
taatacgataatctatag

SEQ ID NO: 33339 - DNA, 18 bp, Artificial Sequence
  Synthetic DNA
taatacgatcaactttag

SEQ ID NO: 33340 - DNA, 18 bp, Artificial Sequence
  Synthetic DNA
taatacgattaacagtag

SEQ ID NO: 33341 - DNA, 18 bp, Artificial Sequence
  Synthetic DNA
taatacgattctcaacag

SEQ ID NO: 33342 - DNA, 18 bp, Artificial Sequence
  Synthetic DNA
taatacgatttacaatgg

SEQ ID NO: 33343 - DNA, 18 bp, Artificial Sequence
  Synthetic DNA
taatacggttctctttag

SEQ ID NO: 33344 - DNA, 18 bp, Artificial Sequence
  Synthetic DNA
taatacgtatatctatag

SEQ ID NO: 33345 - DNA, 18 bp, Artificial Sequence
  Synthetic DNA
taatacgtattactttag

SEQ ID NO: 33346 - DNA, 18 bp, Artificial Sequence
  Synthetic DNA
taatacgtcactccatag

SEQ ID NO: 33347 - DNA, 18 bp, Artificial Sequence
  Synthetic DNA
taatacgtcactctatgg

SEQ ID NO: 33348 - DNA, 18 bp, Artificial Sequence
  Synthetic DNA
taatacgtcactgtatag

SEQ ID NO: 33349 - DNA, 18 bp, Artificial Sequence
  Synthetic DNA
taatactacacattttag

SEQ ID NO: 33350 - DNA, 18 bp, Artificial Sequence
  Synthetic DNA
taatactacccactttgg

SEQ ID NO: 33351 - DNA, 18 bp, Artificial Sequence
  Synthetic DNA
taatactacttacattag

SEQ ID NO: 33352 - DNA, 18 bp, Artificial Sequence
  Synthetic DNA
taatatgaatctctctag

SEQ ID NO: 33353 - DNA, 18 bp, Artificial Sequence
  Synthetic DNA
taatgctactcacaaaag

SEQ ID NO: 33354 - DNA, 18 bp, Artificial Sequence
  Synthetic DNA
tagtacaactctctctag

SEQ ID NO: 33355 - DNA, 18 bp, Artificial Sequence
  Synthetic DNA
tataaatactcactatag

SEQ ID NO: 33356 - DNA, 18 bp, Artificial Sequence
  Synthetic DNA
tataacgcctcactaaag

SEQ ID NO: 33357 - DNA, 18 bp, Artificial Sequence
  Synthetic DNA
tataatgactcacaatag

SEQ ID NO: 33358 - DNA, 18 bp, Artificial Sequence
  Synthetic DNA
tatagccactcactatag

SEQ ID NO: 33359 - DNA, 18 bp, Artificial Sequence
  Synthetic DNA
tatcacgactcacttaag

SEQ ID NO: 33360 - DNA, 18 bp, Artificial Sequence
  Synthetic DNA
tatcacgattcaatatag

SEQ ID NO: 33361 - DNA, 18 bp, Artificial Sequence
  Synthetic DNA
tattacgagtcaatttag

SEQ ID NO: 33362 - DNA, 18 bp, Artificial Sequence
  Synthetic DNA
tattacgcctcacattag

SEQ ID NO: 33363 - DNA, 18 bp, Artificial Sequence
  Synthetic DNA
tattactattctctatag

SEQ ID NO: 33364 - DNA, 18 bp, Artificial Sequence
  Synthetic DNA
tattataactcactaaag

SEQ ID NO: 33365 - DNA, 18 bp, Artificial Sequence
  Synthetic DNA
tcatacgaaactctatag

SEQ ID NO: 33366 - DNA, 18 bp, Artificial Sequence
  Synthetic DNA
tcatacgactacctatcg

SEQ ID NO: 33367 - DNA, 18 bp, Artificial Sequence
  Synthetic DNA
tgatacgtctcattaaag

SEQ ID NO: 33368 - DNA, 18 bp, Artificial Sequence
  Synthetic DNA
ttatactacatactatag

SEQ ID NO: 33369 - DNA, 18 bp, Artificial Sequence
  Synthetic DNA
ttatactactctccatag

SEQ ID NO: 33370 - DNA, 18 bp, Artificial Sequence
  Synthetic DNA
ttatactacttactaaag

SEQ ID NO: 33371 - DNA, 18 bp, Artificial Sequence
  Synthetic DNA
ttatatgaaacactatag

(The sequence listing continues in the following parts.)

What is claimed is:

1. A method of identifying functional promoter sequences, comprising:
   a) providing a population of plasmids comprising operably linked polynucleotides encoding:
      (i) a mini-monomer cassette, comprising a first ribozyme cleavage site and a second ribozyme cleavage site, and comprising between the first ribozyme cleavage site and the second ribozyme cleavage site:
         (1) a ribozyme catalytic core;
         (2) a reverse primer annealing polynucleotide;
         (3) a forward primer annealing polynucleotide; and
         (4) an inserted polynucleotide suspected of comprising a promoter; and
      (ii) a plasmid backbone, comprising an origin of replication;
   b) transcribing the population of plasmids into RNA; wherein the second ribozyme cleavage site is transcribed by an RNA polymerase when the inserted polynucleotide comprises a functional promoter; wherein RNA transcripts comprising the mini-monomer cassette self-cleave from the transcript, thereby forming a population of circularized RNA transcripts of self-cleaved mini-monomer cassettes;
   c) reverse transcribing into cDNA the population of circularized RNA transcripts of self-cleaved mini-monomer cassettes, thereby forming a population of cDNA reverse-transcripts of self-cleaved mini-monomer cassettes; and
   d) sequencing the inserted polynucleotides comprising a functional promoter in the population of cDNA reverse-transcripts of self-cleaved mini-monomer cassettes, whereby functional promoter sequences are identified.

2. The method of claim 1, further comprising after step b), the step of purifying or isolating the population of circularized RNA transcripts of self-cleaved mini-monomer cassettes.

3. The method of claim 1, wherein the reverse transcribing step comprises amplifying from the forward and reverse primer annealing polynucleotides.

4. The method of claim 1, wherein the step of transcribing the population of plasmids into RNA is performed in the presence and absence of an adjusted external factor, selected from the group consisting of temperature, pH, ion concentrations, ionic strength, salt concentration, calcium concentration, endoplasmic reticulum stress, hormones and ligands, heavy metals, toxins, glucose, the presence of virus, fungi, bacteria or other pathogens.

5. A method of identifying RNA stability modifying and/or transcription modifying sequences, comprising:
   a) providing a population of plasmids comprising operably linked polynucleotides encoding:
      i) a test promoter, wherein the test promoter is functional in a eukaryotic cell or in a prokaryotic cell;
      ii) a first mini-monomer cassette, comprising:
         (1) a first ribozyme cleavage site;
         (2) a first ribozyme catalytic core;
         (3) a first reverse primer annealing polynucleotide;
         (4) a first forward primer annealing polynucleotide;
         (5) a barcode polynucleotide
         (6) a second ribozyme cleavage site;
      iii) a second mini-monomer cassette, comprising:
         (1) the second ribozyme cleavage site;
         (2) a second ribozyme catalytic core;
         (3) a second reverse primer annealing polynucleotide;
         (4) a second forward primer annealing polynucleotide;
         (5) an inserted polynucleotide suspected of comprising an RNA stability modifier or a transcription modifier;
         (6) a third ribozyme cleavage site; and
      iv) a plasmid backbone, comprising an origin of replication;
   b) sequencing the first and second mini-monomer cassettes; thereby linking the barcode polynucleotide to a unique inserted polynucleotide suspected of comprising a RNA stability modifier;
   c) transcribing in vitro the population of plasmids into RNA from a control promoter functional in a prokaryotic cell, wherein RNA transcripts comprising the first and second mini-monomer cassettes self-cleave from the transcript;
   d) sequencing the self-cleaved first and second mini-monomer cassettes transcribed in vitro in step c); thereby controlling for cleavage and circularization efficiency;
   e) transcribing either in vitro or in a population of host cells the population of plasmids into RNA from a test promoter, wherein the test promoter functional in a eukaryotic cell or in a prokaryotic cell, wherein RNA transcripts comprising the first and second mini-monomer cassettes self-cleave from the transcript;
   f) sequencing the self-cleaved first and second mini-monomer cassettes transcribed in step e);
   g) comparing the relative abundance or frequency of the self-cleaved second mini-monomer cassettes transcribed in vitro in step c) with the self-cleaved second mini-monomer cassettes transcribed in step e), wherein a higher or increased relative abundance or frequency of the self-cleaved second mini-monomer cassettes transcribed in step e) identifies RNA stabilizing sequences or transcription enhancer sequences in the second mini-monomer cassette, and wherein a lower or decreased relative abundance or frequency of the self-cleaved second mini-monomer cassettes transcribed in step e) identifies RNA destabilizing sequences or transcription reduction sequences in the second mini-monomer cassette; and
   h) comparing the ratios of the relative abundance or frequency of the self-cleaved first mini-monomers to their linked self-cleaved second mini-monomers produced in vitro in step c) with those produced in step e),
   wherein a substantially unchanged and/or a substantially 1:1 ratio, and an increased relative abundance or frequency of the self-cleaved second mini-monomer cassettes transcribed in step e) identifies a transcriptional enhancer;
   wherein a ratio showing a higher relative abundance of the self-cleaved second mini-monomer, and an increased relative abundance or frequency of the self-cleaved second mini-monomer cassettes transcribed in step e) identifies a RNA stabilizing sequence;
   wherein a substantially unchanged and/or a substantially 1:1 ratio, and a decreased relative abundance or frequency of the self-cleaved second mini-monomer cassettes transcribed in step e) identifies a transcriptional reducing sequence; and
   wherein a ratio showing a lower relative abundance of the self-cleaved second mini-monomer, and a decreased relative abundance or frequency of the self-cleaved second mini-monomer cassettes transcribed in a host cell in step g) identifies a RNA destabilizing sequence.

6. A method of identifying a polynucleotide sequence bound by a transcription factor, comprising:
   a) providing a population of plasmids comprising operably linked polynucleotides encoding:
      i) a test promoter, wherein the test promoter is functional in a eukaryotic cell or in a prokaryotic cell;
      ii) a first mini-monomer cassette, comprising:
         (1) a first ribozyme cleavage site;
         (2) a first ribozyme catalytic core;
         (3) a first reverse primer annealing polynucleotide;
         (4) a first forward primer annealing polynucleotide;
         (5) a barcode polynucleotide
         (6) a second ribozyme cleavage site;
      iii) a second mini-monomer cassette, comprising:
         (1) the second ribozyme cleavage site;
         (2) a second ribozyme catalytic core;
         (3) a second reverse primer annealing polynucleotide;
         (4) a second forward primer annealing polynucleotide;
         (5) an inserted polynucleotide suspected of comprising an RNA stability modifier or a transcription modifier;
         (6) a third ribozyme cleavage site; and
      iv) a plasmid backbone, comprising an origin of replication;
   b) sequencing the first and second mini-monomer cassettes; thereby linking the barcode polynucleotide to a unique inserted polynucleotide suspected of comprising a RNA stability modifier;
   c) transcribing in vitro the population of plasmids into RNA from the promoter functional in a prokaryotic cell, wherein RNA transcripts comprising the first and second mini-monomer cassettes self-cleave from the transcript;
   d) sequencing the self-cleaved first and second mini-monomer cassettes transcribed in vitro; thereby controlling for cleavage and circularization efficiency;
   e) transcribing the population of plasmids into RNA from the promoter functional in a eukaryotic cell, wherein the transcribing is performed in a population of host cells and in the presence and absence of an inhibitory nucleic acid that inhibits or reduces the expression of the transcription factor, wherein RNA transcripts comprising the first and second mini-monomer cassettes self-cleave from the transcript;

f) sequencing the self-cleaved first and second mini-monomer cassettes transcribed in a host cell; and g) comparing the relative abundance or frequency of the self-cleaved second mini-monomer cassettes transcribed in the host cell in the presence of the inhibitory nucleic acid with the self-cleaved second mini-monomer cassettes transcribed in a host cell in the absence of the inhibitory nucleic acid, wherein a higher or increased relative abundance or frequency of the self-cleaved second mini-monomer cassettes transcribed in a host cell in the absence of the inhibitory nucleic acid identifies the polynucleotide sequence bound by the transcription factor.

7. The method of claim 6, wherein the inhibitory nucleic acid is an interfering RNA polynucleotide (RNAi).

8. The method of claim 5, wherein the step of transcribing the population of plasm ids into RNA is performed in the presence and absence of an adjusted external factor selected from the group consisting of temperature, pH, ion concentrations, ionic strength, salt concentration, calcium concentration, endoplasmic reticulum stress, hormones and ligands, heavy metals, toxins, glucose, the presence of virus, fungi, bacteria or other pathogens.

9. The method of claim 5, further comprising after step c), the step of purifying or isolating RNA from non-RNA.

10. The method of claim 5, wherein statistical analyses of a population of RT-PCR products are performed and the identified RNA stability modifying and/or transcription modifying sequences are ordered by strength.

11. The method of claim 5, wherein said polynucleotide comprises one or more promoters selected from the group consisting of SEQ ID NOs: 10-73473.

* * * * *